United States Patent 6,812,339 (POLYMORPHISMS IN KNOWN GENES ASSOCIATED WITH HUMAN DISEASE, METHODS OF DETECTION AND USES THEREOF) - sequence listing, part 87

SEQ ID NO: 38908 - DNA, 601 bp, Human
tgagatatgaaataaaaaccaggagcaactttcaccagtagacatttttttcttcattcattaaaaaaaattatagcattgatgagggcagaaagatggagaagagtttgggaaaaattaagaatattgatcattttaagatactttaaattgtttcaagatttccattatagggaaatagaaatatttccattataagggaaaagacaattaaatatagttatcttacctttaacatcctatttgctctaaacattggattaaacccaaagaagaggtagcaaatatcaaatggtattaytgatgcgacatccaactgttgaaagaacacattcacaaatatgttgtgtttacatgcctttctgggaatggatggatttacgctgatgtctgtaaaagttgaccaatcacaatatattatttgttgtttaatccaaaactgctttcaattaactatgcatggggctttttaaggcgtattagcaccatgaaaactattttgtagccttcttccaacatatttcatttccacctccatgcatctgatctctccttaggcgttgcatttactgggatttttattgagctgtcacatatacaa

SEQ ID NO: 38909 - DNA, 601 bp, Human
aattatataaatatattttggtatatttaactaattccctcttgagaaacatttgagttatattcaagtatgtaagtaaatgtgatgtgaaagtatgtgctcacatacttgtgaaagcatgtctgtgatgtaaaagtatgtttacatttttttttagaattacaaaatttaagatgagtaagataatttagggtaatctaacctaaccccttaattttacatcccatacaccatgcattcagcaactgaaaaaggacaaatagaaaaaaacaaaaagtataaaatactcatttgtaattayagctaaatttagaaatacaaagcatccctattttagattataaaaacatctgttatgagatatgaaataaaaaccaggagcaactttcaccagtagacatttttttcttcattcattaaaaaaaattatagcattgatgagggcagaaagatggagaagagtttgggaaaaattaagaatattgatcattttaagatactttaaattgtttcaagatttccattatagggaaatagaaatatttccattataagggaaaagacaattaaatatagttatcttacctttaacatcctattt

SEQ ID NO: 38910 - DNA, 601 bp, Human
gagactgaaaatttgataagggatggcctgaccactagattgcttggaacattattgtgttccacctccatttattctcacattccatggtcaaaccagaagtctctagagttgtctcagatgtttggaaatatgggataaagaacctctgaagtttaaatatcagagcagagaaaaaaaaaccctttcagcctgaggcctacccagtcaatctgattataataaagaatttggagttagataaatgtgatagagttcagacactgcccctcatatgcagtgtgtctggacagatttttcygccatgctaattctcattttcttcgtctctaaaatgaagttgttgggaggaatcagtgagataatgaatataaagttttagcaaagtgtgtagcctcaagtgtgtattcaacagacagctgcaactattattgtcgttgttgttgtcaggatctgctggtgttaccaggttatgttatcttgtcttcccaagatgcaaaatagataattacctacaatttataaagtcttttgtgatccctttaagaaggttgtttttggaaatatattgttgctattgttaaagatttacatgaaattt

SEQ ID NO: 38911 - DNA, 601 bp, Human
ggggaatgaagagttggcattttataagcttttatcataatgccagataaactcctaaatctatagaaacctgagaatttctgaaaattgtttatgtccaagcaggtaccttctgaaatttccatgtgagactgaaaatttgataagggatggcctgaccactagattgcttggaacattattgtgttccacctccatttattctcacattccatggtcaaaccagaagtctctagagttgtctcagatgtttggaaatatgggataaagaacctctgaagtttaaatatcagagcagagaaaaaaaaaccctttcagcctgaggcctacccagtcaatctgattataataaagaatttggagttagataaatgtgatagagttcagacactgcccctcatatgcagtgtgtctggacagatttttccgccatgctaattctcattttcttcgtctctaaaatgaagttgttgggaggaatcagtgagataatgaatataaagttttagcaaagtgtgtagcctcaagtgtgtattcaacagacagctgcaactattattgtcgttgttgttgtcaggatctgctggtgttaccaggttat

SEQ ID NO: 38912 - DNA, 601 bp, Human
tattgctcaacactagcattatttttcagtaaattgcattaaatgtgtatttgtttaaacaaaatttaaagttcagtaagtattagcattggccgttcttgacattattcaaagatacaaagagtttatgtgcatctgatacaagcagagttactatttccctcaaggttttttcttgcttgcttctacttttatctcaaccttttctgcctgcatgcactcctacttcctacttcctacttcctacttcctcttttgtttctataggcagtaaagtatggaatccagagcaaaatgccarttctatctctaccacttactactgtgtaactgtggaaaagtctcttgctatttccgtgtcttggtttcctcatctgtaaaatgagatcaataagaaaagatgccccccaaaagggttgtgtgcatacatgagttaatatatttaatgtgcttcaaatcatagactcttacagatagaagggactgcagagattacttagttcaaaattttgcccaacgtagatatgactgcaatagaacgtttagaattaaaaatagtatatgtaatagtaatgactatttaactagaaatatacacaaa

SEQ ID NO: 38913 - DNA, 601 bp, Human
gataatgatattttatacttaacaatttttagctcttagtgttcatcttcctaaacctaaatattttctacatagagtttactttactacccctctctgtatttcattaacatgttaaggctggaactgccatatccccgtgtatctgtattaacctgttttattttctatgttttgatatgttaatatcagggactttgctgactgaggccttgcttgtttctcccacggttagagatggtggccaaatctcctgagagtgtgtcttccatgcgtaaactaactaatctggaacccatakcccaactgccttctgtatcaggttcttacatgggctcctacattcaggccactatccacctgtcctacaaaaaaaattagcttggtgtggtggggtgcaactgtagttgcagctacttggggggctggggtgggtagatcccttgagcccaggaggctgaggctgcagtgagccatgtttgtgccactgctccccagcttgggtgacagagcaagaccctgtctcaaaaaaaaaaaaaaaaaaaaagggctctatcctttgtaagtgccaactatcttcaatataataatttatgtattt

SEQ ID NO: 38914 - DNA, 601 bp, Human
atgaagaaaagaattagccaggcatgatggcacgcacctgtagtcccagctacctgggaagctgaggtgagaggattgcttgaacccaggagtttgaggctacagtgagctatgattaagccactacaccctagcctgggcacagagccagaccctgtctcttaataaaaaaagagtgatgattagttccatcgtatagtctctatgtgggaattttgagtgagtggagggtttttttctgtcccaggcttttaaacttttatttctatctgttcccctgctcagcatcttttattcactrtgagagtttgaggcacatatctgtatctctagcctcaatctttctcttgtggtctactaccacattttcagtgacttgatattccttcttgttcctattggaacctcaaatccaatttaaaagcagatgtggtgtggtgtataaaacagcacttttcaaacattcgtgtgtgtatgaatcacttgacgattttgttaaaatacaagttctgattcactagtctgaggtggggcttgaactctgaatttctcaagtgctgctgctgctgcttgtccaaagattacactatgagtaacaaga

SEQ ID NO: 38915 - DNA, 601 bp, Human
tgttctgggtaagagagtgatattgaagtaagagcaagagtttggaagagaagagatgcgggtctgagttctatttagactgtgtgctggctctgtgtcttcgcccaaatttctcagttaggagcctccattttctacccttcaaagggatagacaatgcctaattttcccacttccttttttgtatgtgtgactatatgagacaatgtgtgtaataccgagcatccagaagatgctgattaaaatttagccttttctcttccaaggttttcaaaaccagtaagatatttatatttcaggaaaaaaaaaaaacctgtagcattaaacgaatgctttaaggatcatttagttgtttttcaaccttttgttcaaatccaactagtctctgctaccttacagaattttcatcatatgacaaggtttacaggaatttaatcggtaatctgccatgcttacctagcattctttgagagtcccatgtatattcataccaagtccgaactcgcttttgcacaagtttaggaatggagtaattgttcatgtaggcaatggtgtcatccatgcaggcgcggaagtagttctgattggctgtagctgctcc

SEQ ID NO: 38916 - DNA, 601 bp, Human
attgtgtgccctgaggcaggatgggagtggcctgaaaggttgctgctttctattagtacagttgacccttgaacaacacgtgtttgaactacacaggtccacttatacaagaattttcttccgcctctgctacacctgagagcaaaaccaactcctttttctccttctcctcagcctactcgacagtgaagatgaggaggatgaagacctttatgatgatctagtctcacttaattactagtaagtatagttcttttccttataattttcttaataacattttcttttctctagtttattktaagaatatggtatataatacagataacatacaaaatttgtgttaatagtaaggcttccagtcaacagtagcctattagtagttcagttctgggggagtcaaaagttatatgtggatttctttctgttattttgagacagaatctggctctgttgcctaggctggagtgtagtggtgcatcaccacattctgctaatttttgtatttctagtagagatggagttttgccatgttggccaggctggtcttgaactcctgacctcaagtgatctgcctgcctcagcctcccaaaatgctgag

SEQ ID NO: 38917 - DNA, 601 bp, Human
ctggatgacatactgaataattccagaacattatgcttgctgaaactttagctatgaaacgtaatgatcatagcacaaaggctagtgaacaagctagcatggctgaaggatctagttcttattttctgattctattgattccagccttagcattcaagggatggcaaataataatgagcaccatgtggcactggagagcttacagagctctgtcacacccattatcttatttgacccttgtgacaaccccaagggtaaatgttctcattcctactttgcagaaagaagaaaaacaaaaagractgaagccctgagaagctgtaagtgacttgctccattgtgcataattagtaggtggctcagctgggatggaatctaaagaaaaaatgtgctaagagagtaaattcaaattattgttatttacttgcttattaactcgatgaagaatgtgaatacattacagatttttctacatgtgaattaaatgatgggcttcaggctgataaaatgttccgtaaacaaaattgcctattcttttttttttctttttttaaaaccttgtattttaagttctggggtacatgtgcaagtttgttatacg

SEQ ID NO: 38918 - DNA, 601 bp, Human
agagcttagattccatagagaaatagatacagagtctattaattgtaaaagcacttgccttgaacaagtcgactttgctgatgatgctgaagttcacatcaatggcgagggctaactggaccgtagttggtagggtcttaagcaaatcagactcatctttataaagataaacacatcaaaccccgatgcagaataattaatgaaataagtcaccaaggtacaagtagaaaaatttttaaaataaaggaaacaaaatgcaaacactttttatacataattagatgcatcagattctatattktcattacttctattggacctccatacctattacaataacactattatgcttatgcaataaaagaagtatttttaaccctggatgacatactgaataattccagaacattatgcttgctgaaactttagctatgaaacgtaatgatcatagcacaaaggctagtgaacaagctagcatggctgaaggatctagttcttattttctgattctattgattccagccttagcattcaagggatggcaaataataatgagcaccatgtggcactggagagcttacagagctctgtcacacccatt

SEQ ID NO: 38919 - DNA, 601 bp, Human
atatatgaagagtggttattattggatggtggtatttatgtccttatgtttttatgtgttttctattttaaaataatgaacatgcattattttgtaatcataaaaagcacagtacagttttttaaaatgtggcattgattattcactacttgggagagcaaaatgaaggtaactgatattttgccgaagacataaaaaaggctgaaccacctatcgcttctgtaactttttcctccactttaaatatttgaaattaataagctgtgacgattgataattaacatttaaacagagcagtttytcagactacccacacttctatcctataatataagtaatgaaatccatattgtcttgttcctttgtgaactctgagagcacgttattgctgtacagagctatatatcataattatttctatactatggaattcaccctgaacaaattttgtttaaacaatgttcttgacttatgtccgaaatcctcaaatgcatttattagttgtgcatttgaaaaatagcatgcactcacctttttgcagacaaagtcaccaggcaaatagagaacggatttcaatcttagcaacatgtcataaatcatc

SEQ ID NO: 38920 - DNA, 601 bp, Human
taattctcaaggaactggaatgatttttcaaaggcagttattacaactgactggaggtagaagtacatagtgggtacttaaatacagttcagctcttttaattattttttaatgatcatttcaataattttccaaggagatctggcataatcaacgaaccaaaacttccactatttcttgcatatttctaggctaatttaagccttttctgcaagtttaattagcattcaaattaagtagacattcctcagagaataagggctgacagcatgtgcaaaataagattgaaccaagctctggytgttagcgtgtggactaatttggagaaagtatgaaaaaacaagagcttcatgtagagtgaggtaacccctggagatagcgcccttcaaaatttcagggtttctgtgtaggaagctatttctaaggctcatgagggctttatgacactcaagggcaccccaacagaaaagagcagtgctactcaaagtgtggttcctgggtcagcagcatcagcatcactaggagcttgtttagaggtgcaaattctcagtttactgagagttcttactgcagaaatatgaatcagaatttttgggaatga

SEQ ID NO: 38921 - DNA, 601 bp, Human
aattggggcataggagatctttgagttattattagtattccatactgagataaagtattaatgcagcaggttgttttactcagttcttgcctatctttggggactcttgggaccagggcaatgatctttgttcaagccctaagaattaaactcctggaatgttcacatagccactggttaatggtgttattctatattcctgagccagtatagcaggatgtatcaggctgtcaacactatttaatataatcacaaagatttatgatgtgtaccttgtacatagtttgaaagtctgaatcaygtctggtcatgcagctatatgcgccatttaagaacattggacccaagactaatatgagcttccaccggtggagatattttgctcatgtttctgtggtccactggagagaaaaatgcatccatgtgaccctcatagaaataggacctagtaagcctgtgtctgatttctctcgtgtttgcccatgtatatctttttcttgctattcttgcattttatcctttgctataataaatcttaagccataaatataactttatgttgaattatatgagttcttacaagtaaatcaccaaactagtg

SEQ ID NO: 38922 - DNA, 601 bp, Human
aaatataaatgaaggaagcaaagaacattagtgtaaaattaattatcttaagacctaaagtatttacagacatgggttgaacatatcatgtgaaagaaaatgattaggaagatgatacttctcaacacgtgagtactgtttgcctcccttggatacatgaagatatttcagttagcacattgctttaggaaggaccctgggtagaggaagtaattgattttaagcatggtcgaacctggctttgatgaccaccactatgcttggaagaagttgcttggtctagccaaagagcatagactgyagcctttcaaaggtcaattctattcatctacccatggcattgaggtctgatttggggaattggggcataggagatctttgagttattattagtattccatactgagataaagtattaatgcagcaggttgttttactcagttcttgcctatctttggggactcttgggaccagggcaatgatctttgttcaagccctaagaattaaactcctggaatgttcacatagccactggttaatggtgttattctatattcctgagccagtatagcaggatgtatcaggctgtcaacactattta

SEQ ID NO: 38923 - DNA, 601 bp, Human
tcaccacagtgttgtatgtgtggaaaaggaaaatgcaagttttcatcttttgtatgtgactgactttataatatgtgctttacttattttctgaaaggtccacagctacccatttctacagttttagagataacataatgactaggttcagaaaacctgaatccctgctctgtctgtttctcaatatctgccctcataggctaattatgagaatcaaagaaatatgaaaccaaaaaaaaagagagagagagagagaaacaataacatttgagtttctttacatttttaggaattgaaaggmagcttagtgtaggcctgtaagtctgaacacctgagtaatagctttctgctctgtaactaattatgatcttatccaaatcccttgatctggttttcagtttcttcatctataacatgaaaagcttggatgaaatttacaaagttattttgggctttaaacatttgtgatctatagtaattgaatatttgtgaaaatgttgataaaatgggttatttatttatatatccatatgtatgtctgtatatatacagttgatttttattcatgtagttttgttctataaattttccacaaacagca

SEQ ID NO: 38924 - DNA, 601 bp, Human
attattatttctatgctgatgcaaatgaagcatttggtttatactggatccctaactttcaccacagtgttgtatgtgtggaaaaggaaaatgcaagttttcatcttttgtatgtgactgactttataatatgtgctttacttattttctgaaaggtccacagctacccatttctacagttttagagataacataatgactaggttcagaaaacctgaatccctgctctgtctgtttctcaatatctgccctcataggctaattatgagaatcaaagaaatatgaaaccaaaaaaaaagagagagagagagagaaacaataacatttgagtttctttacatttttaggaattgaaaggcagcttagtgtaggcctgtaagtctgaacacctgagtaatagctttctgctctgtaactaattatgatcttatccaaatcccttgatctggttttcagtttcttcatctataacatgaaaagcttggatgaaatttacaaagttattttgggctttaaacatttgtgatctatagtaattgaatatttgtgaaaatgttgataaaatgggttatttatttatatatccatatgtatgtctgta

SEQ ID NO: 38925 - DNA, 601 bp, Human
aaattattatttctatgctgatgcaaatgaagcatttggtttatactggatccctaactttcaccacagtgttgtatgtgtggaaaaggaaaatgcaagttttcatcttttgtatgtgactgactttataatatgtgctttacttattttctgaaaggtccacagctacccatttctacagttttagagataacataatgactaggttcagaaaacctgaatccctgctctgtctgtttctcaatatctgccctcataggctaattatgagaatcaaagaaatatgaaaccaaaaaaaaagagagagagagagagaaacaataacatttgagtttctttacatttttaggaattgaaaggcagcttagtgtaggcctgtaagtctgaacacctgagtaatagctttctgctctgtaactaattatgatcttatccaaatcccttgatctggttttcagtttcttcatctataacatgaaaagcttggatgaaatttacaaagttattttgggctttaaacatttgtgatctatagtaattgaatatttgtgaaaatgttgataaaatgggttatttatttatatatccatatgtatgtctg

SEQ ID NO: 38926 - DNA, 601 bp, Human
actcccatacattttttatgcaaattattatttctatgctgatgcaaatgaagcatttggtttatactggatccctaactttcaccacagtgttgtatgtgtggaaaaggaaaatgcaagttttcatcttttgtatgtgactgactttataatatgtgctttacttattttctgaaaggtccacagctacccatttctacagttttagagataacataatgactaggttcagaaaacctgaatccctgctctgtctgtttctcaatatctgccctcataggctaattatgagaatcaaagaaatatgaaaccaaaaaaaaagagagagagagagagaaacaataacatttgagtttctttacatttttaggaattgaaaggcagcttagtgtaggcctgtaagtctgaacacctgagtaatagctttctgctctgtaactaattatgatcttatccaaatcccttgatctggttttcagtttcttcatctataacatgaaaagcttggatgaaatttacaaagttattttgggctttaaacatttgtgatctatagtaattgaatatttgtgaaaatgttgataaaatgggttatttattt

SEQ ID NO: 38927 - DNA, 601 bp, Human
tcttaacacatttacttatatatttctttactcccatacattttttatgcaaattattatttctatgctgatgcaaatgaagcatttggtttatactggatccctaactttcaccacagtgttgtatgtgtggaaaaggaaaatgcaagttttcatcttttgtatgtgactgactttataatatgtgctttacttattttctgaaaggtccacagctacccatttctacagttttagagataacataatgactaggttcagaaaacctgaatccctgctctgtctgtttctcaatatctgccctcataggctaattatgagaatcaaagaaatatgaaaccaaaaaaaaagagagagagagagagaaacaataacatttgagtttctttacatttttaggaattgaaaggcagcttagtgtaggcctgtaagtctgaacacctgagtaatagctttctgctctgtaactaattatgatcttatccaaatcccttgatctggttttcagtttcttcatctataacatgaaaagcttggatgaaatttacaaagttattttgggctttaaacatttgtgatctatagtaattgaatatttgtg

SEQ ID NO: 38928 - DNA, 601 bp, Human
aattttaaatatttatttttaataaaaacatattaaccaatactatataaaaatactgtaaaaagtagggttttcctcttgcctaagcttgtgggagaacctcagggagaaacttatccctttcctagtatgatcttttccatttgtcccacaggtgcttgacctgtcatgtttgtacctatcgtgtttagcactagctatagaaatttcatagcaaaaggtacactatgctctttactggtaatgcttgggatcaatttgagaaaggcttgcctgacatatgaatgtgcacagataaagytgagattcttaacacatttacttatatatttctttactcccatacattttttatgcaaattattatttctatgctgatgcaaatgaagcatttggtttatactggatccctaactttcaccacagtgttgtatgtgtggaaaaggaaaatgcaagttttcatcttttgtatgtgactgactttataatatgtgctttacttattttctgaaaggtccacagctacccatttctacagttttagagataacataatgactaggttcagaaaacctgaatccctgctctgtctgtttctcaa

SEQ ID NO: 38929 - DNA, 601 bp, Human
tcttctggctctcttcctttatctttatcttcattttcttttcctttatcttcattttctttttgtttatcttcattttctttttgtttatcttcattttcttttccttcttcctctcctccttcagaattttctttcttctggaaggagcaattacaaagaactggtgttgaaatcgtaattaaaaacattggattagattttgattagcatgcaatggctaagatcaccaccaagacagactgtctgaattaagtgaatccaggaatcatgtctgctttgcttctgactatcatttgaygaagtttctggtgtgctagagaatggacttgttgcctttgactcatgatgttagtctgaattgcatttttttgtctctgccaaggaattctcttcctattggtccttatactctctgaattattagactcagtgctcaggactctgtttttgctttttaaatatttacttattctgtagagataaaattttaaatatttatttttaataaaaacatattaaccaatactatataaaaatactgtaaaaagtagggttttcctcttgcctaagcttgtgggagaacctcagggagaaactt

SEQ ID NO: 38930 - DNA, 601 bp, Human
gtttcccctcgttaatttaagttacaatcctaggtacaatcactttgggaactagctatatcacatctaaagataatcaaacatttattgcttagccttttctttgacttcaatagtaagaacctcttctccgccctcagcagaaggagccatgctgataatgagtgattgacgagaagtccctctgggtaaaactgtccttctaactgagtggggttcttcctccactgcaataggacttgctgtacattcaggtctgtccagtggcttctcttctggctctcttcctttatctttatcytcattttcttttcctttatcttcattttctttttgtttatcttcattttctttttgtttatcttcattttcttttccttcttcctctcctccttcagaattttctttcttctggaaggagcaattacaaagaactggtgttgaaatcgtaattaaaaacattggattagattttgattagcatgcaatggctaagatcaccaccaagacagactgtctgaattaagtgaatccaggaatcatgtctgctttgcttctgactatcatttgacgaagtttctggtgtgctagagaatggact

SEQ ID NO: 38931 - DNA, 601 bp, Human
gaaactaagctagggatttgcctttcgtttctcaagggtcccagcatgtcgtttcccctcgttaatttaagttacaatcctaggtacaatcactttgggaactagctatatcacatctaaagataatcaaacatttattgcttagccttttctttgacttcaatagtaagaacctcttctccgccctcagcagaaggagccatgctgataatgagtgattgacgagaagtccctctgggtaaaactgtccttctaactgagtggggttcttcctccactgcaataggacttgctgtacatycaggtctgtccagtggcttctcttctggctctcttcctttatctttatcttcattttcttttcctttatcttcattttctttttgtttatcttcattttctttttgtttatcttcattttcttttccttcttcctctcctccttcagaattttctttcttctggaaggagcaattacaaagaactggtgttgaaatcgtaattaaaaacattggattagattttgattagcatgcaatggctaagatcaccaccaagacagactgtctgaattaagtgaatccaggaatcatgtctgctt

SEQ ID NO: 38932 - DNA, 601 bp, Human
agcgcccaagaagaaaatggccataagtggagtccctgtgctaggatttttcatcatagctgtgctgatgagcgctcaggaatcatgggctatcaaaggtaggtgctgagggaatgaaatctgggacgatagactacgaagcattggagaaaagacctatggacatttggaagataatgtgtggagtgaaagaatagtgtgacaggtattatgtggtctcgacagaaagtataacaaattgtggtttggtggagttcttccctcaccacaaactgaagtaagtcaaatttggtttagaggrtcaaaactgagttgtgtattgatgaatagcaaggtcctgctacaagccaaactgggggtgggggtgggggtgggggaggaagaatattttctggcaagcattaacaagttatatttctgggctttaattattctttctggaaaattagtaaaattaaaaactaaaaaccacacatagttttgctagaattaaatgaaaaaaaaagttattagccctgttcttatctgaatacatgatacagtagttattttttggagtgtaaatcctgtcggtatatattgagcacatatattgtgttga

SEQ ID NO: 38933 - DNA, 601 bp, Human
tccctgtgctaggatttttcatcatagctgtgctgatgagcgctcaggaatcatgggctatcaaaggtaggtgctgagggaatgaaatctgggacgatagactacgaagcattggagaaaagacctatggacatttggaagataatgtgtggagtgaaagaatagtgtgacaggtattatgtggtctcgacagaaagtataacaaattgtggtttggtggagttcttccctcaccacaaactgaagtaagtcaaatttggtttagaggatcaaaactgagttgtgtattgatgaatagcamggtcctgctacaagccaaactgggggtgggggtgggggtgggggaggaagaatattttctggcaagcattaacaagttatatttctgggctttaattattctttctggaaaattagtaaaattaaaaactaaaaaccacacatagttttgctagaattaaatgaaaaaaaaagttattagccctgttcttatctgaatacatgatacagtagttattttttggagtgtaaatcctgtcggtatatattgagcacatatattgtgttgaagattactagaaggaaaagtcatcaaaaagca

SEQ ID NO: 38934 - DNA, 601 bp, Human
ccctgttcttatctgaatacatgatacagtagttattttttggagtgtaaatcctgtcggtatatattgagcacatatattgtgttgaagattactagaaggaaaagtcatcaaaaagcaacaatttaccccaggaaaaggggagggaaggcatgctgatatgagttgcctcatgggacagtgatagccattccctgccttcccatctccatggtacagcagatcttatatcatgttaacttagtaatatttccaagagagtagaaaaataagtaaggaaatggggaatctgatattattstctctcatctccagagcaacattggtgctgttgtaaagatgtactgtagaaaagtattcttcacccagcatgacccccacagaaggtgtcaggtagacttgaaataagcaaagtaataacccagctcccatacccatagtggcaattgtagatttctattgccccaaaagagccatacatagggatacttacctagaaagacagaggctcttcccttggtttgtgaagaggcagctagtatatttgtgtgtgtttgcatagatgcaaacggtaaataaattcctaggtttatcaatacac

SEQ ID NO: 38935 - DNA, 601 bp, Human
gcacatatattgtgttgaagattactagaaggaaaagtcatcaaaaagcaacaatttaccccaggaaaaggggagggaaggcatgctgatatgagttgcctcatgggacagtgatagccattccctgccttcccatctccatggtacagcagatcttatatcatgttaacttagtaatatttccaagagagtagaaaaataagtaaggaaatggggaatctgatattattctctctcatctccagagcaacattggtgctgttgtaaagatgtactgtagaaaagtattcttcacccagcrtgacccccacagaaggtgtcaggtagacttgaaataagcaaagtaataacccagctcccatacccatagtggcaattgtagatttctattgccccaaaagagccatacatagggatacttacctagaaagacagaggctcttcccttggtttgtgaagaggcagctagtatatttgtgtgtgtttgcatagatgcaaacggtaaataaattcctaggtttatcaatacacagtcaaacattaaaatctctcatcttggctgggcacggtggctcacgcctgtaatcccagcactttggga

SEQ ID NO: 38936 - DNA, 601 bp, Human
cagaaggtgtcaggtagacttgaaataagcaaagtaataacccagctcccatacccatagtggcaattgtagatttctattgccccaaaagagccatacatagggatacttacctagaaagacagaggctcttcccttggtttgtgaagaggcagctagtatatttgtgtgtgtttgcatagatgcaaacggtaaataaattcctaggtttatcaatacacagtcaaacattaaaatctctcatcttggctgggcacggtggctcacgcctgtaatcccagcactttgggaggccgaggcrggcggatcacgaggtcaagagatcgagaccgtcctgggcaacatggtgaaaccccgtctctactaaaaatacaaaaaattagctgggtatggtggcacacgcctgtagtcccagctactcgggaggctgaggcaggaggattgcttgagcccgggaggcggaggttgcagtgagctgagatggtgccactgcactccagcctggcgatagagcaagactccgtctcaaacaaccaaaccaaaacaaaacaaaatatctcaccttatctttgaagactaaggaaaaaaaaatctcccactc

SEQ ID NO: 38937 - DNA, 601 bp, Human
agctagtatatttgtgtgtgtttgcatagatgcaaacggtaaataaattcctaggtttatcaatacacagtcaaacattaaaatctctcatcttggctgggcacggtggctcacgcctgtaatcccagcactttgggaggccgaggcaggcggatcacgaggtcaagagatcgagaccgtcctgggcaacatggtgaaaccccgtctctactaaaaatacaaaaaattagctgggtatggtggcacacgcctgtagtcccagctactcgggaggctgaggcaggaggattgcttgagcccrggaggcggaggttgcagtgagctgagatggtgccactgcactccagcctggcgatagagcaagactccgtctcaaacaaccaaaccaaaacaaaacaaaatatctcaccttatctttgaagactaaggaaaaaaaaatctcccactcatcgatacactccacagaggcagcatactctccaagtgtagctttctcttttcatgttcattattcccttggtgttggttattctcaatgtcaatcataacagaacatcttccataataacagtcccaatttaaggagcattaagataaaagg

SEQ ID NO: 38938 - DNA, 601 bp, Human
actttgggaggccgaggcaggcggatcacgaggtcaagagatcgagaccgtcctgggcaacatggtgaaaccccgtctctactaaaaatacaaaaaattagctgggtatggtggcacacgcctgtagtcccagctactcgggaggctgaggcaggaggattgcttgagcccgggaggcggaggttgcagtgagctgagatggtgccactgcactccagcctggcgatagagcaagactccgtctcaaacaaccaaaccaaaacaaaacaaaatatctcaccttatctttgaagactaaggaaaaaaaaatctcccactcatcgatacactccacagaggcagcatactctccaagtgtagctttctcttttcatgttcattattcccttggtgttggttattctcaatgtcaatcataacagaacatcttccataataacagtcccaatttaaggagcattaagataaaaggtggaattgccaaggtcaatccagacgagaaccttctcatagaggtaaccaccgtgtgggtttggatgctgggaagcagggggactatgacgctacaaggtctcagtcttaatttttggagtacttcagt

SEQ ID NO: 38939 - DNA, 601 bp, Human
ctgggcaacatggtgaaaccccgtctctactaaaaatacaaaaaattagctgggtatggtggcacacgcctgtagtcccagctactcgggaggctgaggcaggaggattgcttgagcccgggaggcggaggttgcagtgagctgagatggtgccactgcactccagcctggcgatagagcaagactccgtctcaaacaaccaaaccaaaacaaaacaaaatatctcaccttatctttgaagactaaggaaaaaaaaatctcccactcatcgatacactccacagaggcagcatactctccmagtgtagctttctcttttcatgttcattattcccttggtgttggttattctcaatgtcaatcataacagaacatcttccataataacagtcccaatttaaggagcattaagataaaaggtggaattgccaaggtcaatccagacgagaaccttctcatagaggtaaccaccgtgtgggtttggatgctgggaagcagggggactatgacgctacaaggtctcagtcttaatttttggagtacttcagtccccaggtatattttccatagatttggcccttaaataaaaagaagcttctga

SEQ ID NO: 38940 - DNA, 601 bp, Human
ctaaggaaaaaaaaatctcccactcatcgatacactccacagaggcagcatactctccaagtgtagctttctcttttcatgttcattattcccttggtgttggttattctcaatgtcaatcataacagaacatcttccataataacagtcccaatttaaggagcattaagataaaaggtggaattgccaaggtcaatccagacgagaaccttctcatagaggtaaccaccgtgtgggtttggatgctgggaagcagggggactatgacgctacaaggtctcagtcttaatttttggagtayttcagtccccaggtatattttccatagatttggcccttaaataaaaagaagcttctgactctaaaatgtaaacagtgcttgttacagtcttgttgatatattaagaaattactcaccttatctcatttaatcttaaaaacaaacccctgacaggatcaaaaccacagcagggctacataataggaaaactatacataaataggtagaataatctgctcaggatcactaggtaagttgctgaataagaattcaagatgtttttgatcccagagtttaaaacccaacctttcaaacagtgtt

SEQ ID NO: 38941 - DNA, 601 bp, Human
agcatactctccaagtgtagctttctcttttcatgttcattattcccttggtgttggttattctcaatgtcaatcataacagaacatcttccataataacagtcccaatttaaggagcattaagataaaaggtggaattgccaaggtcaatccagacgagaaccttctcatagaggtaaccaccgtgtgggtttggatgctgggaagcagggggactatgacgctacaaggtctcagtcttaatttttggagtacttcagtccccaggtatattttccatagatttggcccttaaataaaragaagcttctgactctaaaatgtaaacagtgcttgttacagtcttgttgatatattaagaaattactcaccttatctcatttaatcttaaaaacaaacccctgacaggatcaaaaccacagcagggctacataataggaaaactatacataaataggtagaataatctgctcaggatcactaggtaagttgctgaataagaattcaagatgtttttgatcccagagtttaaaacccaacctttcaaacagtgtttccttcttcttagagtacaatgttctgagaaagagatcctctggaa

SEQ ID NO: 38942 - DNA, 601 bp, Human
aaaaggtggaattgccaaggtcaatccagacgagaaccttctcatagaggtaaccaccgtgtgggtttggatgctgggaagcagggggactatgacgctacaaggtctcagtcttaatttttggagtacttcagtccccaggtatattttccatagatttggcccttaaataaaaagaagcttctgactctaaaatgtaaacagtgcttgttacagtcttgttgatatattaagaaattactcaccttatctcatttaatcttaaaaacaaacccctgacaggatcaaaaccacagcaggrctacataataggaaaactatacataaataggtagaataatctgctcaggatcactaggtaagttgctgaataagaattcaagatgtttttgatcccagagtttaaaacccaacctttcaaacagtgtttccttcttcttagagtacaatgttctgagaaagagatcctctggaattctggcctaagtgtatttaatgcccgggtaaagaaagtgagagaacatttctctttaggggctgctgctggatttctaaaaagaaaataatttctcagctagtaacatggagccaaacaacagct

SEQ ID NO: 38943 - DNA, 601 bp, Human
gtacttcagtccccaggtatattttccatagatttggcccttaaataaaaagaagcttctgactctaaaatgtaaacagtgcttgttacagtcttgttgatatattaagaaattactcaccttatctcatttaatcttaaaaacaaacccctgacaggatcaaaaccacagcagggctacataataggaaaactatacataaataggtagaataatctgctcaggatcactaggtaagttgctgaataagaattcaagatgtttttgatcccagagtttaaaacccaacctttcaaacagygtttccttcttcttagagtacaatgttctgagaaagagatcctctggaattctggcctaagtgtatttaatgcccgggtaaagaaagtgagagaacatttctctttaggggctgctgctggatttctaaaaagaaaataatttctcagctagtaacatggagccaaacaacagcttcacaagactctgggttctttagccctcatctccttcaatccaccctctttataaccagtccttcttgtttttcccctcccagctttgttcagcagcatgcccttcacccagaccttgtcttgtc

SEQ ID NO: 38944 - DNA, 601 bp, Human
cagtccccaggtatattttccatagatttggcccttaaataaaaagaagcttctgactctaaaatgtaaacagtgcttgttacagtcttgttgatatattaagaaattactcaccttatctcatttaatcttaaaaacaaacccctgacaggatcaaaaccacagcagggctacataataggaaaactatacataaataggtagaataatctgctcaggatcactaggtaagttgctgaataagaattcaagatgtttttgatcccagagtttaaaacccaacctttcaaacagtgtttcyttcttcttagagtacaatgttctgagaaagagatcctctggaattctggcctaagtgtatttaatgcccgggtaaagaaagtgagagaacatttctctttaggggctgctgctggatttctaaaaagaaaataatttctcagctagtaacatggagccaaacaacagcttcacaagactctgggttctttagccctcatctccttcaatccaccctctttataaccagtccttcttgtttttcccctcccagctttgttcagcagcatgcccttcacccagaccttgtcttgtcactcat

SEQ ID NO: 38945 - DNA, 601 bp, Human
aaaataatttctcagctagtaacatggagccaaacaacagcttcacaagactctgggttctttagccctcatctccttcaatccaccctctttataaccagtccttcttgtttttcccctcccagctttgttcagcagcatgcccttcacccagaccttgtcttgtcactcatccctactcgccatcattctttcattcctcttggcccaatctctctccaccacttcctgcctacatgtatgtaggttattcatttccctctcttgattccccccacccaactctctttctccatttctygcctttcagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatggtacctccctctctgctgcactcctggacatgggaatccatagtt

SEQ ID NO: 38946 - DNA, 601 bp, Human
tgcattggccaacatagctgtggacaaagccaacctggaaatcatgacaaagcgctccaactatactccgatcaccaatggtacctccctctctgctgcactcctggacatgggaatccatagtttgaaagtagttgcttcagctctttgtgttagattattgtaactgattttccctccaagggcctaaccttgccattaacaagccccaaattctcatgccagaggtctgagaactttatgggtttgatcctatcttgttgtgctcaagtcttgtctctgtcatccatggtctcctacraagtcattgccctaagttcatgctgggggagccagaagggaagtccttggatatcttatacctcaatattggctcaatttcttggggagggggtgctgtcagagattgttatctgaggatgtgacatagatttctcagggcacaatttcaactactttttcagctttagggtttttagatacgtttgtaccacaattgagcatgggagggagaggggtgagcctaagcagtgatggctgatttctgtcacgtctgtcatgtgtcccccagtacctccagaggtaactgtgctcacgaaca

SEQ ID NO: 38947 - DNA, 601 bp, Human
tcctatcttgttgtgctcaagtcttgtctctgtcatccatggtctcctacgaagtcattgccctaagttcatgctgggggagccagaagggaagtccttggatatcttatacctcaatattggctcaatttcttggggagggggtgctgtcagagattgttatctgaggatgtgacatagatttctcagggcacaatttcaactactttttcagctttagggtttttagatacgtttgtaccacaattgagcatgggagggagaggggtgagcctaagcagtgatggctgatttctgtcaygtctgtcatgtgtcccccagtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactg

SEQ ID NO: 38948 - DNA, 601 bp, Human
ctacgaagtcattgccctaagttcatgctgggggagccagaagggaagtccttggatatcttatacctcaatattggctcaatttcttggggagggggtgctgtcagagattgttatctgaggatgtgacatagatttctcagggcacaatttcaactactttttcagctttagggtttttagatacgtttgtaccacaattgagcatgggagggagaggggtgagcctaagcagtgatggctgatttctgtcacgtctgtcatgtgtcccccagtacctccagaggtaactgtgctcacraacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactggggtatggaccaacactcaatctcctttatttcaaggtttcctcct

SEQ ID NO: 38949 - DNA, 601 bp, Human
tccttggatatcttatacctcaatattggctcaatttcttggggagggggtgctgtcagagattgttatctgaggatgtgacatagatttctcagggcacaatttcaactactttttcagctttagggtttttagatacgtttgtaccacaattgagcatgggagggagaggggtgagcctaagcagtgatggctgatttctgtcacgtctgtcatgtgtcccccagtacctccagaggtaactgtgctcacgaacagccctgtggaactgagagagcccaacgtcctcatctgtttcatmgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactggggtatggaccaacactcaatctcctttatttcaaggtttcctcctatgatgcttgtgtgaaactcggtgttctaactgtttcataatatctgc

SEQ ID NO: 38950 - DNA, 601 bp, Human
agcctcttctcaagcactggggtatggaccaacactcaatctcctttatttcaaggtttcctcctatgatgcttgtgtgaaactcggtgttctaactgtttcataatatctgctacaattaatataactgtcttctcctcctatccagcttcctcctttttttaatctgtaattctctcaatacatcattctgtcttcctcttctttaatctatgaataacttttctctttattaagaaccctacatttgattctgagtgttacttcttcccacactcattaccatgtactctgccttatytccccccagagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgagttaggtgtggtcagaggaagacatatatggagatatctgagggaggaaaacagggtggggaaaggaaatgtaatgcatttaagagacaaggtaggaacagatgtggctcttgatttctct

SEQ ID NO: 38951 - DNA, 601 bp, Human
aggtcatcagttcagaagcatttccagatcctggctcctttcaggttagggtcaattcattgcatgaaatgggaatctcttagaggccaatgcctgcttttgcttctttagtctcaaatgtagtatgagaaactctaaaaaaaggtaaagcatggttgcttattatgttcagttggagagtaggaactaactgtatacagttagttcatgttggaaaggttagatgaacattgaaagaattttgcaaagtcaaaggattaagagagaagaggaaggaatctgaagcaaggagctcaaaacrgatcttaaattccttggtaactatgtgtgtcttgctataggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctct

SEQ ID NO: 38952 - DNA, 601 bp, Human
agggtcaattcattgcatgaaatgggaatctcttagaggccaatgcctgcttttgcttctttagtctcaaatgtagtatgagaaactctaaaaaaaggtaaagcatggttgcttattatgttcagttggagagtaggaactaactgtatacagttagttcatgttggaaaggttagatgaacattgaaagaattttgcaaagtcaaaggattaagagagaagaggaaggaatctgaagcaaggagctcaaaacggatcttaaattccttggtaactatgtgtgtcttgctataggtgatgrtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatgg

SEQ ID NO: 38953 - DNA, 601 bp, Human
ctggtctctgcggtgatgctgcttgtccgtctgggcccccagacagagtgtgtctgacccagtgaggaagactcgtctgtgagatctccaatgagtccctttgcctctcagagcctcagtttccctatttgtaaagtgggggctatgatagtatggtctgcctgggaactggccagagcgctggacccctagtgagtgttcaaaatcattgtcccccttgtggtctttctccccaggaatccctggggttggcactgggccaagcccaggagcccttgcacagcttgttggaggccgctgrggacctggcccaggaggtacgaggccccactcatcctcaacccccatggaggcaacgttggcaggcagcctgcgccgggagggtctggggcagcccgggcacttcccttgggtgggttttcaggaggattagacagcgagagggagaggctgcccctggcccagtgccctgccctggttagggcttggaggtgggatcattgccagctccgtctggtaacctctctctagctcctggcgctgcgcagcctggtggagcttcgggcactgctgcagagaccccgagggaccagcggccccc

SEQ ID NO: 38954 - DNA, 601 bp, Human
gcctgctcggagctgattggagccctggacagccacccgctgtcccgcctgctctggagacgcctgaagcctctgatcctcgggaagctactctttgcaccagatacaccttttacccggaagctcatggcccaggtgggggcagcctggatgctggggtgggagggtggtggccagagcccatccagtaccctcagtccaggtgggccagggccaggccggagggtcacggaaactatttgaagaagtaggagttagccgatggagggggatcagcttgtgcggaggatcagaggcacaygcaggagcaaggcagagggggcagggggtgggcaggggtcctcagaggaggagagggtcatcagtggagggggtgctgtccacaggtgaaccggaccttcgaggagctcaccctgctgagggatgtccgggaggtgtgggagatgctgggaccccggatcttcaccttcatgaacgacagttccaatgtggccatgctgcaggtgtgcgggggtgctggggaggtgggatgtggctccccggtgaggagggtagacaggcccggtggatgggaaggtgggctccgtgcagacccccactt

SEQ ID NO: 38955 - DNA, 601 bp, Human
tcacggaaactatttgaagaagtaggagttagccgatggagggggatcagcttgtgcggaggatcagaggcacacgcaggagcaaggcagagggggcagggggtgggcaggggtcctcagaggaggagagggtcatcagtggagggggtgctgtccacaggtgaaccggaccttcgaggagctcaccctgctgagggatgtccgggaggtgtgggagatgctgggaccccggatcttcaccttcatgaacgacagttccaatgtggccatgctgcaggtgtgcgggggtgctggggaggtsggatgtggctccccggtgaggagggtagacaggcccggtggatgggaaggtgggctccgtgcagacccccacttttttttttttttttttgagatggagtctcgctctgtcgcccaagctggaatgcagtggcgtgatctcgactcactgcaacctccacctcccgggttcaagcgattctcctgtctcaccctctgagtagctgggactacaggcgcccaccaccacgcccggatgattttttttttttatttttagtagagacggggtttaaccatgttagccaggatggtctcgatc

SEQ ID NO: 38956 - DNA, 601 bp, Human
gccaggctggtctcgaactcctgacctcaggtgatccacccgcctcgcctcccaaagtgctgggattacaggcatgagccactgtgcccgacccagactctcactttcacctgcgccccccagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggaggtgagggccygtccacctgcggggtctgtttcagtggggagggcaggtcccatcctagtgttcccaccctggtgttcccagggggaggcgggcccggccctagtaagagcctgggatttgtagagatctcaggagggagccggccgtgggcctacgaggggaaaacatggcccagccccgaggtccagggggaggagcggagtggtctaggaggcaggcggaccccagcgcctaggactcacccccgcatcccacagtgcctgtccttggacaagctggaggcggcaccctcagaggcagccctggtgtc

SEQ ID NO: 38957 - DNA, 601 bp, Human
aaagctggctgggtgcggtggctcacgcctgtaatcccagcactttgggaggccgaggcgggcgggtcatctgaggtcgggatttcgagaccagcctgaccaacatggagaaaccccgtctctactaaaaatacaaaattagctgggtgtggtggcgggtgcctgtttcctagctacttggaaggcagaggcaggagaaatgcttgaatcccggaggcggaggttgcggtgagtcgagatcgcgccactgcactccagcctgggcaacaagagtgaaactcagtctcaaaaaaaaaaaaacaaaaaaaaaaaaaacaaggccgggcacggtggctcacgcctgctttcccagcactttgggaggccgaggtgggcagatcacgaggtcaggagatggagaccatcctggctaacacggtgaaaccccgtctctcccaaaaatacaaaaaattagccaggcatggtggcgggcgcctgtagtcccagctactcaggaggctgaggcaggagaatgacgtgaactggggaggcggagcttgcagcgagtcaaaatcgtgccactgcactccagcctgggcaacagagcaagactccgtctcaa

SEQ ID NO: 38958 - DNA, 601 bp, Human
ggcgggtgcctgtttcctagctacttggaaggcagaggcaggagaaatgcttgaatcccggaggcggaggttgcggtgagtcgagatcgcgccactgcactccagcctgggcaacaagagtgaaactcagtctcaaaaaaaaaaaaacaaaaaaaaaaaaaacaaggccgggcacggtggctcacgcctgctttcccagcactttgggaggccgaggtgggcagatcacgaggtcaggagatggagaccatcctggctaacacggtgaaaccccgtctctcccaaaaatacaaaaaattakccaggcatggtggcgggcgcctgtagtcccagctactcaggaggctgaggcaggagaatgacgtgaactggggaggcggagcttgcagcgagtcaaaatcgtgccactgcactccagcctgggcaacagagcaagactccgtctcaaaaaaaaaaaaaaacaaaaccccaaaaaaagcctggtacactcctggggggtgggctaagcaataacccgcgcccctccccgcaggccagtacgggatccctgaaccatggaattttccttttcggaggagctactggtgcggacctcggcccc

SEQ ID NO: 38959 - DNA, 601 bp, Human
ggcgtgaacccgggaggtggagcttgcagtgagccgagatcgtgccgctgcactccagcctgggcaacagagtgaaactccgtctcaaaaataataataataataataataataataataataaataattaaaaattttttaaaaacagaaattaaaaatagaagctctgtaactgccagtgcactctgtgaagggggctactctgagacccctctatccacaggtccatcttgagtggcctcttcccacccagtggtggctctgccttcatcctgggccacgacgtccgctccagcatgrccgccatccggccccacctgggcgtctgtcctcagtacaacgtgctgtttgacatgtgcgtctcggcaggcccagagtgcagcggtgggaagggactggacgccctctgggactctgcctgccatgtgggtcactctgctctgtgcactggccgcaggctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtg

SEQ ID NO: 38960 - DNA, 601 bp, Human
ccacaggtccatcttgagtggcctcttcccacccagtggtggctctgccttcatcctgggccacgacgtccgctccagcatggccgccatccggccccacctgggcgtctgtcctcagtacaacgtgctgtttgacatgtgcgtctcggcaggcccagagtgcagcggtgggaagggactggacgccctctgggactctgcctgccatgtgggtcactctgctctgtgcactggccgcaggctgaccgtggacgagcacgtctggttctatgggcggctgaagggtctgagtgccgctgtrgtgggccccgagcaggaccgtctgctgcaggatgtggggctggtctccaagcagagtgtgcagactcgccacctctctggtgagcccatccccaagggaggtcacctcacagggaggggcctggggattcatcctgaaggcagggggaagccgggtactgaggtccacgtgggtaggcaaccttgcccaaggctgggtgtgacacactgaggtcccttccccatctctaccaggtgggatgcaacggaagctgtccgtggccattgcctttgtgggcggctcccaagttgttatcctgga

SEQ ID NO: 38961 - DNA, 601 bp, Human
gcatttaggggctactgctcaaataccgagacagtaagagttggggatagacagaggttcccctggattctgcctgaagggccagaaaaggtttccaacaaggaggttctggggatgaggttttgagggatgaataggagtttgcttcatggggcagacaactcctggcagaggccccagctcgggcaaagacgcggcggcctgatggtagttgtgggttggtcccccgtgcctaggtcgcacgctgatcctctccacccaccacctggatgaggcagagctgctgggagaccgtgtggcygtggtggcaggtggccgcttgtgctgctgtggctccccactcttcctgcgccgtcacctgggctccggctactacctgacgctggtgaaggcccgcctgcccctgaccaccaatgagaaggtggggaccggccttctcctgacccctgacccccgggactctgttcagccctgaaggccaagccacttggtgcctctctgcccgcaggctgacactgacatggagggcagtgtggacaccaggcaggaaaagaagaatggcagccagggcagcagagtcggtgagggccggggtgggaga

SEQ ID NO: 38962 - DNA, 601 bp, Human
aagtaggagggagaggagggggaggagaagggggaggagtaggagggagaggaggaggagggagaggagggggaggagaaggagaggaggaggagagcacttgagaacctgagatgatgcccccatccctgggctgagccggaaccatgagactaacttgaacactgaccccacctttaacccaaccagggctgagcccagagacaaacctacccctgacctccaacactaggtccagcactgccctcaagatctctttttgtttgtttctgagtcttgctctgtcgcccaggctgtagtrcagtggtgtgatctcagctcactgcaacctctgcctcctgggttcaagcatttctcctccctcagcctctcgagtaactgggattacaggtgggttccaccatgcctggctaatttttgcatttttggtagaaatggggtttcaccatgttggtcaggctggtctcaaactcctgacctcaggtgatctgcctgcttcaaccctcaaagtgctgggattacaggcgtgagccactgcgcccggccgcacctggcctacgttcttaaccctgatctctgtctgccgggacagtcccctcac

SEQ ID NO: 38963 - DNA, 601 bp, Human
tctcctccctcagcctctcgagtaactgggattacaggtgggttccaccatgcctggctaatttttgcatttttggtagaaatggggtttcaccatgttggtcaggctggtctcaaactcctgacctcaggtgatctgcctgcttcaaccctcaaagtgctgggattacaggcgtgagccactgcgcccggccgcacctggcctacgttcttaaccctgatctctgtctgccgggacagtcccctcacaggtcaccaatgcctcttccccagggagactggggtggggcgtgagccggggytccctgaagcacccctttgtccacacaggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggaggtgtgaggcctgggtggtggtgaggtggggccaggaggagggcttcctggaggaggtggtgttttgaag

SEQ ID NO: 38964 - DNA, 601 bp, Human
tctctgagcccctgcttgtctccccagatcttcctgaaggtggtggaggagtgtgctgcggacacagatatggagggtgcggccacagctccctgacccctgaccccagtccagagtgggaccagaggccaggtccccatccctggcttagtgtggcccaaggcatagcctttaccctatacctgattcctgatcccccaatccgtgaccctcaactttgaccctgacccctgatggccctgcagatggcagctgcgggcagcacctatgcacaggcattgctggcctagacgtaaccctrcggctcaagatgccgccacaggagacagcgctggagaacggggaaccaggtaagtccttcccagtggccctggggtcctcccagccacccccccacagcagcgtgagcactgaccctctcatccctcacagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccaggtgaggagggctagcaccag

SEQ ID NO: 38965 - DNA, 601 bp, Human
ttggcctggacctttcccctctctggcctcagttttcccatctggtccctggccagggagcctcagggggcacctggagcatcccctgtgcccacctgggagctgggagcctctgtggctccaggaacccccagaagctgggtgcccacagaccttcaccttgaccctgcagcgcccttgagtgtgcacagcccattgtctgcaggttctcggcaccagaagttcctgctgaagtggccaaggtcttggccagtggcaactggaccccagagtctccatccccagcctgccagtgtagccrgcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccaggggtgagccatgccctgggactcagtttccctggctatagcatgggtccttgggttgctggggctggtgtggtcctggaggaggaagtggaggggttggatgcccagcttggggctacgggctgggagtctcgcgtaccttcc

SEQ ID NO: 38966 - DNA, 601 bp, Human
ctgtctgacttcctggtcaagacctacccgcgcctggtgcgccaggggtgagccatgccctgggactcagtttccctggctatagcatgggtccttgggttgctggggctggtgtggtcctggaggaggaagtggaggggttggatgcccagcttggggctacgggctgggagtctcgcgtaccttcctttcctctttttttttttttttttttttgagatggagtctccctctgttgcccaggctggagtgcagaggtgtgatctcagctcattgcaacctccacctcccagtttcaagygattctcctccctcagcctcccgagtagctgggattacaggcacgcaccaccactcccgactaatttttgtatttttagtagagatggggtttcaccgtgttgccaggctggtctcgaactcctgacctcaggtgatccacccgccttggcctcccaaagtgttgggattacaggcaggagccaccgcgcccggctttctttcctgtttttgtccacccttgactctgtgctcccctctcaccatctctctctctgtcccacatccctgtctgcctgtgtctctgtccatctctcccaca

SEQ ID NO: 38967 - DNA, 601 bp, Human
accttgggctgactgtgcacctagcctaagtacacacagtgtgccaggaaacatatggagagctcatgccctgatatttgttgagcactgctgcacacgacctttatagggtacccactgtgtgccaaaagccattccctgctaagtgacagctttatgcctcgctacataccccaatatctgcctagctcccccggggccccacccacggccttccatgtggacactcagaaatcagaggtgctgaggccaggcgtggtggctcacagctgtaaccccagcactttgggaggccaaggcrggaggatcacttgaggtcaggagttcgagaccagcctggccaacatgccaaaaccccgtctctactaaaaatacaaaaattagccgggcttggtggcacacgcctgtagtcccagctactccggagcctgagacaggagaattgcttgaacccaggaggtggaggttgcagtgggccaagatcgtgccattgcgccggggtgacacagcaaggctccgtctcaaaaaaaaaaaaaaaaaaaaaagaggctgggtgccgtggctcacgcctgtaatcccagcactttaggagttcaaggca

SEQ ID NO: 38968 - DNA, 601 bp, Human
ttccatgtggacactcagaaatcagaggtgctgaggccaggcgtggtggctcacagctgtaaccccagcactttgggaggccaaggcaggaggatcacttgaggtcaggagttcgagaccagcctggccaacatgccaaaaccccgtctctactaaaaatacaaaaattagccgggcttggtggcacacgcctgtagtcccagctactccggagcctgagacaggagaattgcttgaacccaggaggtggaggttgcagtgggccaagatcgtgccattgcgccggggtgacacagcaagsctccgtctcaaaaaaaaaaaaaaaaaaaaaagaggctgggtgccgtggctcacgcctgtaatcccagcactttaggagttcaaggcaggcggatcacaaggtcaagagatcgagaccatcctggccaacacggtgaaaccccatctctactaaaaaaaaatacaaaaattagctgggcatggtggcaggcgtctgtagccccagctacttgggaggctaaggcaggagaattgcttgaacccgggaggcagaggttgcagtgagccaagatcgcaccactgcagtccagcctgggaaaca

SEQ ID NO: 38969 - DNA, 601 bp, Human
gcccaggttgcccaggtgagcccactttgtccccaccgctctcacctcccagggcccacccgacccaggccgtgcctctaaagcctggcccaatcccgcactctctcgccttggctccatccctgtccctgcccccagaccgtgcttccttcccctatacctctgtcccccatcctggtccaatagggatgtggctagcccgcctctttgccccgcaacaccaagttccaccattctcattggtccacccacccttccttccgctgcacgttgcccctctctccttgactctgccttctgyggccctgcccacttgctcctcttctgcctaccccctagggcttcgcgcctttctcgctggggtcacggtcacattctcactctggccgttcccagtttgcagccgtttcactgcctcttccatctgcttgggggtcttgtctttgccctggcccgccccaccctcacactgtcccaccccatgccctttctggccctgcctcatacccatgttggctccacccacaccatggccctgctccatacccatcccagctccacccataccaaggccccaccccatactcatgctggctccacc

SEQ ID NO: 38970 - DNA, 601 bp, Human
ctctccctgctccgggagaactcaccaagaacacacaggagcaaaaagatgctgagccccatggtgggtcacttccaaagtctgggggaaaaggggaatctcagaggtcaccctttccctgtgccccccacctctgccctctctgcttctctttgaaggtcaccaaggggatgacctgcttgtcctctctctacctgctcccctgtgtgtcactccctcattggcagtcgcctacctccttctcaccttgtctctttgtctgccagatcctctacgtggctgtcactgtttggcctgtcckcgtcgctgctatctctccgtccacctacctgcctgtcttctcatgtgctggccactccgccagccaactctaccactctgcacctggctcctcagccacctgtcatgttgctcaaccggtccctttccttccatctgtcgctccagacagaccactgacaaagctcttaactctctttgtcctggcccatccagtttccgggttaagggaaggggaccacgaagacaggggtggggcgtgctctaattctgcagaaactcttctcagctaatcacacttaattgagctttacagctaaac

SEQ ID NO: 38971 - DNA, 601 bp, Human
aatggagagacagagattcagagagggacagaagggaagagggatcaaaaaataggggagaccgaggtgagcagtaccctgagagctgcaggtaaatggaggcacagagaaagcccctctcctcctcaccaccaggctgggggccagagctgagatggggagggtggtggggcctcctcatgggggtgaagggatccagtcgcagtcctgccctctccctgctccgggagaactcaccaagaacacacaggagcaaaaagatgctgagccccatggtgggtcacttccaaagtctgggggaaaaggggaatctcagaggtcaccctttccctgtgccccccacctctgccctctctgcttctctttgaaggtcaccaaggggatgacctgcttgtcctctctctacctgctcccctgtgtgtcactccctcattggcagtcgcctacctccttctcaccttgtctctttgtctgccagatcctctacgtggctgtcactgtttggcctgtcctcgtcgctgctatctctccgtccacctacctgcctgtcttctcatgtgctggccactccgccagccaactctaccactctgcacctggc

SEQ ID NO: 38972 - DNA, 601 bp, Human
tgcctggctgagccctggagacagacaggggcatgggtcagagagaggaagaaaagatacagagatggagagacacacagagtgagagagagaaacaggcaggagagagagaggagaaagagagacgagaaagagagagaaagagagagagacccagtgatagaaaaagaccatgaaacatcaaagacacccagggagaaagatgcttacacataggagggaaatggagagacagagattcagagagggacagaagggaagagggatcaaaaaataggggagaccgaggtgagcagtaccmtgagagctgcaggtaaatggaggcacagagaaagcccctctcctcctcaccaccaggctgggggccagagctgagatggggagggtggtggggcctcctcatgggggtgaagggatccagtcgcagtcctgccctctccctgctccgggagaactcaccaagaacacacaggagcaaaaagatgctgagccccatggtgggtcacttccaaagtctgggggaaaaggggaatctcagaggtcaccctttccctgtgccccccacctctgccctctctgcttctctttgaaggtcaccaag

SEQ ID NO: 38973 - DNA, 601 bp, Human
caggcctgtagtcttagctccttgggaggctgaggtgtgaggatcacttgagcccaggtggttgaggctgtagtgagccaagatagcatcactgcactccagcttggatgacagaaagagcaagactctgtctccaaaaaaaaaaaaaaagaaagaaaaagaaaaaaattccagaacatcagtctactgaggcccagagaggtgccaggcatagattctgaagttgcacaaagagtttgggtcatgttggccgggtgcagtggctcacacctgtaatcccagcactttgggaggccaagaygggcaggtcatttgaggccaggagttcgagaccagcctggccaacatggcaaaaccctgtctctacaaaaaatacaaaaattagctgggcatggtggcgggtgcctgtaatcccagctactcaggaggctggggcaggagaatcacttgaacctgggaggcagagacagcagtgagctgtgatcacgccattgcacagcagcctgggcgacagagcgagaccctgtctcaaaaaaataaaaaaaagaaaaagaaaaagagcttgggtgagacctgggccccgggcccagactgggtcaag

SEQ ID NO: 38974 - DNA, 601 bp, Human
aaaaagttccaggccaggcacagtggctcatgcctgtaatcccagcactttgggaggtcaaggcaggaagattgcttgagctgaggagtttgagaccagcctgggtaacatagcaaaaccctgtctctacaaaaaaaatttaaaaattagccaggtgtggtggcgcaggcctgtagtcttagctccttgggaggctgaggtgtgaggatcacttgagcccaggtggttgaggctgtagtgagccaagatagcatcactgcactccagcttggatgacagaaagagcaagactctgtctccaaaaaaaaaaaaaaagaaagaaaaagaaaaaaattccagaacatcagtctactgaggcccagagaggtgccaggcatagattctgaagttgcacaaagagtttgggtcatgttggccgggtgcagtggctcacacctgtaatcccagcactttgggaggccaagacgggcaggtcatttgaggccaggagttcgagaccagcctggccaacatggcaaaaccctgtctctacaaaaaatacaaaaattagctgggcatggtggcgggtgcctgtaatcccagctactcaggaggctggggc

SEQ ID NO: 38975 - DNA, 601 bp, Human
aatgcccatatcctatacatacatatatatatatatatgccttttgctccagtgtgatgacctctgacacactctgacctctgacctctgatccctgacttcatacccagtcctttaacccctttggctcccaagaccccaatccaccataatctctgaccccaaaccatgatcctgatgtcccatcccacaccctgaccctttacccatccttcctctgaggtgtcatgattcgacctctcgccctgcatcccagacttgtacccatcctgacccctgacccctggccctgggccccttrctccgtgggtggttggtgatgccccagcctgagacgtggcactcggtgccagcggttgcacagtcattgggcaggggcaggggttgaacgctgctggttacgcggacgggcaggcgcagccgcagcagccggaggtcgtgctcgtggctcgtcgaggctcccaggtagccgggatgggtcacagagaagccgctgtgccggatctgctcggtccagtcgagctggctgaggctgtgttcccccaggcgcacccagtacctgctgccggtggcgacggctgagcgggtggcaggcacgcag

SEQ ID NO: 38976 - DNA, 601 bp, Human
aatcccaggggaggagggtgggactccataaaggatagaggttctctcaaggacaatgcctggggttctgaccaatgaggggagagagtgccatcaaaaatgaccaatcccagggaaggtgggcaggactccatcaaaagcacagagttctctcaaggacaatggctggggccctgaccaatgaggggagagaccgccatcctcaaatctctctcagtctgggacagcaccaactggaggatggtatgggaaagacttagagccccagaaacagctggttccctgtctgggctcccagtcstctccgtctgttttgctgtctctctctgtaacccctgccccatctttccttctctgttcccttcctccctctctctccctgcccctccccctcctccattccccggtcctcccttttactccctgtctctctccctcccttatcctgggcctctcctccattattattattattattattattattattattaattattttgttttgagacagagtctggctctgtcgcccaggctggagtgcagtggcgtgatctcagctcactgcaacctccgcctcccgggatcaagcgattctcct

SEQ ID NO: 38977 - DNA, 601 bp, Human
ttatttttcaaggtgcaacattttgacgtcaaaattcagctagtgagatttccaaagtccctttcttctaatttcttatttccaagtattttttttaattgcagcttaatttatgataagaagcagctgcatttcttgaccccaaagtactagagtgaattaataatttaacgtggtgcaaccactgattcaagtgcttttaatgtctcatttaatcctaaagcctgtgctggcctctgagatgtagttactgctgttattctcattaaaaagatgaaagaactaaggtatgaggtgctcwagtaactttccaaaggtgactcagctaggagtggaggagctcctgggagtggaggagctcctcaaaagtgaggagttcctttttggatacaggtggcttggccccagacttacactcttagatgttgttctcgacctttggacccagactagctcactgggacattagactatacagtaaagggagaagggaatcctacctgactgcttcattgtcagcaggatgaataggaaggaggcgactgcaccagacagattgtagcctggaaaatccaccatcctccctggaacaaagacaagg

SEQ ID NO: 38978 - DNA, 601 bp, Human
ctgcttgtattcttcattgatgaagtctaaatatgaagctagaactgaagacattccatcagattgactgttacagggtagggagctgcagcacaagcacagagaagccagcagcttcatcacatcacaccagctctgcagcgccaaggcagacacaccagctctgcggcaccgaggcagacacaccagctctgcggtgccgaggcagagcctgcgccctctgatgctctgtgtcgtgttttttcccacttcgccatgctgcattttccttagggctctgacatctccttctgacactgattttttttttttgacactgaatttttaaataattatttttcaaggtgcaacattttgacgtcaaaattcagctagtgagatttccaaagtccctttcttctaatttcttatttccaagtattttttttaattgcagcttaatttatgataagaagcagctgcatttcttgaccccaaagtactagagtgaattaataatttaacgtggtgcaaccactgattcaagtgcttttaatgtctcatttaatcctaaagcctgtgctggcctctgagatgtagttactgctgttattctcattaa

SEQ ID NO: 38979 - DNA, 601 bp, Human
catgtatgatatgttctttctcattctaaatgctccggggccatttgctctttctctgtgcagatccaatcctgctaggaagaacctcaccctacttagctgctgctgggtatcaaatagatgctgctcaaaaggtggctaaagagcctaagtggagatctgcttgtattcttcattgatgaagtctaaatatgaagctagaactgaagacattccatcagattgactgttacagggtagggagctgcagcacaagcacagagaagccagcagcttcatcacatcacaccagctctgcagsgccaaggcagacacaccagctctgcggcaccgaggcagacacaccagctctgcggtgccgaggcagagcctgcgccctctgatgctctgtgtcgtgttttttcccacttcgccatgctgcattttccttagggctctgacatctccttctgacactgattttttttttttgacactgaatttttaaataattatttttcaaggtgcaacattttgacgtcaaaattcagctagtgagatttccaaagtccctttcttctaatttcttatttccaagtattttttttaattgcagcttaat

SEQ ID NO: 38980 - DNA, 601 bp, Human
attttcctgaagtttagataataaatccatttattagctttttttagcctttcaggattcctcttctcttagatataaaaactgttttttttttgttttttttttgtttgtttttttcccgtctggagttggcaggaggccaattactgggactatgtacaatgcagttttcacaaggacattttgtgctggattaaggacactggtttgtctagagatttttgggtcttccaaacaaattctaagacatgtctgatctcttccttgttatctgcaaattgaagagatgtttaacagttakgtatgttattatgtttgatcattttatgtcatgtatgatatgttctttctcattctaaatgctccggggccatttgctctttctctgtgcagatccaatcctgctaggaagaacctcaccctacttagctgctgctgggtatcaaatagatgctgctcaaaaggtggctaaagagcctaagtggagatctgcttgtattcttcattgatgaagtctaaatatgaagctagaactgaagacattccatcagattgactgttacagggtagggagctgcagcacaagcacagagaagccagc

SEQ ID NO: 38981 - DNA, 601 bp, Human
taccagctatgtgattcggtggcaaatctattactcttggtaagattttgagatttgaagtcctaatttcttcatcttcaagatattaataccagcatacctgggttgtttttattctcaagtaaattatttattccttgagtcatttattctcatgtaaattgactttttaaattggaaaccttattcttgttattaacattttattttcctgaagtttagataataaatccatttattagctttttttagcctttcaggattcctcttctcttagatataaaaactgttttttttttgttttttttttgtttgtttttttcccgtctggagttggcaggaggccaattactgggactatgtacaatgcagttttcacaaggacattttgtgctggattaaggacactggtttgtctagagatttttgggtcttccaaacaaattctaagacatgtctgatctcttccttgttatctgcaaattgaagagatgtttaacagttatgtatgttattatgtttgatcattttatgtcatgtatgatatgttctttctcattctaaatgctccggggccatttgctctttctctgtgcagatc

SEQ ID NO: 38982 - DNA, 601 bp, Human
ctaccagctatgtgattcggtggcaaatctattactcttggtaagattttgagatttgaagtcctaatttcttcatcttcaagatattaataccagcatacctgggttgtttttattctcaagtaaattatttattccttgagtcatttattctcatgtaaattgactttttaaattggaaaccttattcttgttattaacattttattttcctgaagtttagataataaatccatttattagctttttttagcctttcaggattcctcttctcttagatataaaaactgttttttttttkttttttttttgtttgtttttttcccgtctggagttggcaggaggccaattactgggactatgtacaatgcagttttcacaaggacattttgtgctggattaaggacactggtttgtctagagatttttgggtcttccaaacaaattctaagacatgtctgatctcttccttgttatctgcaaattgaagagatgtttaacagttatgtatgttattatgtttgatcattttatgtcatgtatgatatgttctttctcattctaaatgctccggggccatttgctctttctctgtgcagat

SEQ ID NO: 38983 - DNA, 601 bp, Human
tgtctgtcacctaccagctatgtgattcggtggcaaatctattactcttggtaagattttgagatttgaagtcctaatttcttcatcttcaagatattaataccagcatacctgggttgtttttattctcaagtaaattatttattccttgagtcatttattctcatgtaaattgactttttaaattggaaaccttattcttgttattaacattttattttcctgaagtttagataataaatccatttattagctttttttagcctttcaggattcctcttctcttagatataaaaactgttttttttttgttttttttttgtttgtttttttcccgtctggagttggcaggaggccaattactgggactatgtacaatgcagttttcacaaggacattttgtgctggattaaggacactggtttgtctagagatttttgggtcttccaaacaaattctaagacatgtctgatctcttccttgttatctgcaaattgaagagatgtttaacagttatgtatgttattatgtttgatcattttatgtcatgtatgatatgttctttctcattctaaatgctccggggccatttgctctttct

SEQ ID NO: 38984 - DNA, 601 bp, Human
ttgtgtactgaaaacaaatgcagttcaaaaatgtgggtgaggttgctgtctgtcacctaccagctatgtgattcggtggcaaatctattactcttggtaagattttgagatttgaagtcctaatttcttcatcttcaagatattaataccagcatacctgggttgtttttattctcaagtaaattatttattccttgagtcatttattctcatgtaaattgactttttaaattggaaaccttattcttgttattaacattttattttcctgaagtttagataataaatccatttattagctttttttagcctttcaggattcctcttctcttagatataaaaactgttttttttttgttttttttttgtttgtttttttcccgtctggagttggcaggaggccaattactgggactatgtacaatgcagttttcacaaggacattttgtgctggattaaggacactggtttgtctagagatttttgggtcttccaaacaaattctaagacatgtctgatctcttccttgttatctgcaaattgaagagatgtttaacagttatgtatgttattatgtttgatcattttatgtcatgtatga

SEQ ID NO: 38985 - DNA, 601 bp, Human
agctattcaagtaaaatgtagtgcgtatatttccagtcataaatgttttatggctttcaatacatattgctatatgatagataatgtctcttgataaaaatacgaggtgctatggtgcagtccctgggacctctcctgctgatctgagcatgtgggtcctagaggcagagcactgacctgggaggctgatgaccgaccccttctcctcagtgaggacggggttgtggaccaagcaggacacagactctgcagaggcgttcctgaccaccagggtggcttccgcatagaacaggccatcttyatcttggatgcgatgctcagacacggccagcagcttctctccccggatgtcttcccaatacacctggggctctgggaaccagccccttgcagtgcacacaagctggactccactctccccaggtccctccatgtggatgctaggggcagaccccagacctgcagagggaagccacagctctgacacccagagcccacagaggcagaaatcacagaggctgagatcccagtgacgttgctcacagggaggtggccggagttcaggagtctgaggagcagaaagtcgacctcagtctcccca

SEQ ID NO: 38986 - DNA, 601 bp, Human
agaagtaatcagcacaagacagcataggaaaacatttcagttgaagaaatatagctttattttctttacaatgcaatgaatacttgtgagtaaaaacaatcaatgcagaagaaggaaaggtagaactcaaaaataacgcaggcgccataacagctattcaagtaaaatgtagtgcgtatatttccagtcataaatgttttatggctttcaatacatattgctatatgatagataatgtctcttgataaaaatacgaggtgctatggtgcagtccctgggacctctcctgctgatctgagcrtgtgggtcctagaggcagagcactgacctgggaggctgatgaccgaccccttctcctcagtgaggacggggttgtggaccaagcaggacacagactctgcagaggcgttcctgaccaccagggtggcttccgcatagaacaggccatctttatcttggatgcgatgctcagacacggccagcagcttctctccccggatgtcttcccaatacacctggggctctgggaaccagccccttgcagtgcacacaagctggactccactctccccaggtccctccatgtggatgctaggggcag

SEQ ID NO: 38987 - DNA, 601 bp, Human
ccataattaatattctattatgcaaatagttgtctacatctctgattatcttcatatgatagatttctagaagtaatcagcacaagacagcataggaaaacatttcagttgaagaaatatagctttattttctttacaatgcaatgaatacttgtgagtaaaaacaatcaatgcagaagaaggaaaggtagaactcaaaaataacgcaggcgccataacagctattcaagtaaaatgtagtgcgtatatttccagtcataaatgttttatggctttcaatacatattgctatatgatagayaatgtctcttgataaaaatacgaggtgctatggtgcagtccctgggacctctcctgctgatctgagcatgtgggtcctagaggcagagcactgacctgggaggctgatgaccgaccccttctcctcagtgaggacggggttgtggaccaagcaggacacagactctgcagaggcgttcctgaccaccagggtggcttccgcatagaacaggccatctttatcttggatgcgatgctcagacacggccagcagcttctctccccggatgtcttcccaatacacctggggctctgggaacca

SEQ ID NO: 38988 - DNA, 601 bp, Human
ctgttgtattggggggttggttgtttttgctgctatttataaataaggccataattaatattctattatgcaaatagttgtctacatctctgattatcttcatatgatagatttctagaagtaatcagcacaagacagcataggaaaacatttcagttgaagaaatatagctttattttctttacaatgcaatgaatacttgtgagtaaaaacaatcaatgcagaagaaggaaaggtagaactcaaaaataacgcaggcgccataacagctattcaagtaaaatgtagtgcgtatatttcyagtcataaatgttttatggctttcaatacatattgctatatgatagataatgtctcttgataaaaatacgaggtgctatggtgcagtccctgggacctctcctgctgatctgagcatgtgggtcctagaggcagagcactgacctgggaggctgatgaccgaccccttctcctcagtgaggacggggttgtggaccaagcaggacacagactctgcagaggcgttcctgaccaccagggtggcttccgcatagaacaggccatctttatcttggatgcgatgctcagacacggccagcag

SEQ ID NO: 38989 - DNA, 601 bp, Human
tacttatatccaaatgtggagggtatcctgaaagttttagtgcagttataagttatttaaggccagtaacttttatgtgattggaaatgtcaatttataggtagatgtcatgtttatcattgaatagtgcatcatgaggatttttttcaaccattaaaattatttaaaaatatctttttattaatgctataatgtatagtaagacaagattccacactgtactgttgtattggggggttggttgtttttgctgctatttataaataaggccataattaatattctattatgcaaatagttktctacatctctgattatcttcatatgatagatttctagaagtaatcagcacaagacagcataggaaaacatttcagttgaagaaatatagctttattttctttacaatgcaatgaatacttgtgagtaaaaacaatcaatgcagaagaaggaaaggtagaactcaaaaataacgcaggcgccataacagctattcaagtaaaatgtagtgcgtatatttccagtcataaatgttttatggctttcaatacatattgctatatgatagataatgtctcttgataaaaatacgaggtgctat

SEQ ID NO: 38990 - DNA, 601 bp, Human
tacacagaaagtacaaaattatatggacataaacagtatcacctaaattacaaagtagagagacgaattatatgtaatatacaatcagcttcatttaaaattaaaatgtaacattaactttaaagtttttttaatctatccatttatatgaataactgtatacttatatccaaatgtggagggtatcctgaaagttttagtgcagttataagttatttaaggccagtaacttttatgtgattggaaatgtcaatttataggtagatgtcatgtttatcattgaatagtgcatcatgaggatttttttcaaccattaaaattatttaaaaatatctttttattaatgctataatgtatagtaagacaagattccacactgtactgttgtattggggggttggttgtttttgctgctatttataaataaggccataattaatattctattatgcaaatagttgtctacatctctgattatcttcatatgatagatttctagaagtaatcagcacaagacagcataggaaaacatttcagttgaagaaatatagctttattttctttacaatgcaatgaatacttgtgagtaaaaacaatcaat

SEQ ID NO: 38991 - DNA, 601 bp, Human
gaaagtaacagctccctcccaatagtgattagcttaggggtgtactggggtgaggagcaggtgcaggaccccatagcagagttgagcagggaggtgctgggtgcaacccaggttgtcataatgatgctgcccttgttcacacttgaaatgttttcaaagggcctccaggccccggccagctgtctgctgtcatcccccacacattctgaggcagctccctttcccctcaacacatagaacagagatgatgccatgcttcctataggtgtccatctgatgctcactggaatctccatgagcycccaaagtgtcaggtaacacagctgcaacctccttgaatgaggccattactttgctggtctcctctggtatttaatgaacataggacctggtaaaatcgtgcctcagtttttcctctgggtcacatggtctcgtggtagctcccctccctctgctggggagggcagaggctccctccacaggtgtgtgccagcacctcgtacttacccagctcagtctggagtttctctggaaaaagaacaagaataacatattaaggaatttggtgtaagggaaaggagagaaactattttttaaaaaa

SEQ ID NO: 38992 - DNA, 601 bp, Human
ttgaaggtgccatagtagactctggtagagattgggttgtgtttgttaccctgattttcctcaaaaactcttttgtgggctgaaaggtgtgcttaagctcacctaaagcacacacatggatacacattcctggagcaggtgacttgatggagagcaaggaattgatggaaagagcacataagggatccacgttctatgcacctaggcagggaggcaggctggttgccttgggctgggagaagaggccataaaaaggagggagctagtaaggaggtaaaggggaaactcaaaggggctcagmcatcggctggttatgttttaaaccacttatctcaggtgcagcaaaataataccctcagtccaactccgagatttaaaaaacaaaaattaggctgggtgcagtggctcatgcctgtaatcccagcacctttgggaggccaaggccggcggatcatgaggtcaggagatcgagaccatcctggccaacatggtgaaaccccgtctctactaaaaaaaaaaaaaaaaaattagctgggtgtggtggcgcatgcctgtagtcccagttactcaggaggctgaggcaggagaatagcttgaatcc

SEQ ID NO: 38993 - DNA, 601 bp, Human
gtcgtattgtgtgtgctgggtctccagtgggtctcagagaactcagaggagtgactcttctcctaaaaccttcttgagagacagacttgtgtcaacctgccccaaacactggctttacttcctgatctcagaagggtaagatacacaggtgtgtgtctctcctcagattgtggagttactttgcgccttccagggacccttccctttatgtttatggcctaatggggttgaaggtgccatagtagactctggtagagattgggttgtgtttgttaccctgattttcctcaaaaactctttygtgggctgaaaggtgtgcttaagctcacctaaagcacacacatggatacacattcctggagcaggtgacttgatggagagcaaggaattgatggaaagagcacataagggatccacgttctatgcacctaggcagggaggcaggctggttgccttgggctgggagaagaggccataaaaaggagggagctagtaaggaggtaaaggggaaactcaaaggggctcagccatcggctggttatgttttaaaccacttatctcaggtgcagcaaaataataccctcagtccaactccgagatt

SEQ ID NO: 38994 - DNA, 601 bp, Human
tagagagctgggtgtcccatcattagagctcacctgcaaagcttccgtgcccagagccctcctctcccacctgacaggaagcaaagggaagctccatctttccgtgttggttaattgtggccccggaggttaccatgacttaggaacaacaggacatggggtcgtattgtgtgtgctgggtctccagtgggtctcagagaactcagaggagtgactcttctcctaaaaccttcttgagagacagacttgtgtcaacctgccccaaacactggctttacttcctgatctcagaagggtaagrtacacaggtgtgtgtctctcctcagattgtggagttactttgcgccttccagggacccttccctttatgtttatggcctaatggggttgaaggtgccatagtagactctggtagagattgggttgtgtttgttaccctgattttcctcaaaaactcttttgtgggctgaaaggtgtgcttaagctcacctaaagcacacacatggatacacattcctggagcaggtgacttgatggagagcaaggaattgatggaaagagcacataagggatccacgttctatgcacctaggcagggagg

SEQ ID NO: 38995 - DNA, 601 bp, Human
tttttaaaaactattatttttataaatgaaaaacattatttgtaagactacaagcagtgatttcagtcttaggacttccatagagagctgggtgtcccatcattagagctcacctgcaaagcttccgtgcccagagccctcctctcccacctgacaggaagcaaagggaagctccatctttccgtgttggttaattgtggccccggaggttaccatgacttaggaacaacaggacatggggtcgtattgtgtgtgctgggtctccagtgggtctcagagaactcagaggagtgactcttcycctaaaaccttcttgagagacagacttgtgtcaacctgccccaaacactggctttacttcctgatctcagaagggtaagatacacaggtgtgtgtctctcctcagattgtggagttactttgcgccttccagggacccttccctttatgtttatggcctaatggggttgaaggtgccatagtagactctggtagagattgggttgtgtttgttaccctgattttcctcaaaaactcttttgtgggctgaaaggtgtgcttaagctcacctaaagcacacacatggatacacattcctgga

SEQ ID NO: 38996 - DNA, 601 bp, Human
atgaaataattcccataacatattcagcatcgtgcctggcatacaattaatatttttaaaaactattatttttataaatgaaaaacattatttgtaagactacaagcagtgatttcagtcttaggacttccatagagagctgggtgtcccatcattagagctcacctgcaaagcttccgtgcccagagccctcctctcccacctgacaggaagcaaagggaagctccatctttccgtgttggttaattgtggccccggaggttaccatgacttaggaacaacaggacatggggtcgtattktgtgtgctgggtctccagtgggtctcagagaactcagaggagtgactcttctcctaaaaccttcttgagagacagacttgtgtcaacctgccccaaacactggctttacttcctgatctcagaagggtaagatacacaggtgtgtgtctctcctcagattgtggagttactttgcgccttccagggacccttccctttatgtttatggcctaatggggttgaaggtgccatagtagactctggtagagattgggttgtgtttgttaccctgattttcctcaaaaactcttttgtgggctg

SEQ ID NO: 38997 - DNA, 601 bp, Human
taattattgtaagaaaaaatgaaataattcccataacatattcagcatcgtgcctggcatacaattaatatttttaaaaactattatttttataaatgaaaaacattatttgtaagactacaagcagtgatttcagtcttaggacttccatagagagctgggtgtcccatcattagagctcacctgcaaagcttccgtgcccagagccctcctctcccacctgacaggaagcaaagggaagctccatctttccgtgttggttaattgtggccccggaggttaccatgacttaggaacaacwggacatggggtcgtattgtgtgtgctgggtctccagtgggtctcagagaactcagaggagtgactcttctcctaaaaccttcttgagagacagacttgtgtcaacctgccccaaacactggctttacttcctgatctcagaagggtaagatacacaggtgtgtgtctctcctcagattgtggagttactttgcgccttccagggacccttccctttatgtttatggcctaatggggttgaaggtgccatagtagactctggtagagattgggttgtgtttgttaccctgattttcctcaa

SEQ ID NO: 38998 - DNA, 601 bp, Human
atgtctctaagattgtttcttagctgtaatatgaggataaagcaattaaactttataattattgtaagaaaaaatgaaataattcccataacatattcagcatcgtgcctggcatacaattaatatttttaaaaactattatttttataaatgaaaaacattatttgtaagactacaagcagtgatttcagtcttaggacttccatagagagctgggtgtcccatcattagagctcacctgcaaagcttccgtgcccagagccctcctctcccacctgacaggaagcaaagggaagctccrtctttccgtgttggttaattgtggccccggaggttaccatgacttaggaacaacaggacatggggtcgtattgtgtgtgctgggtctccagtgggtctcagagaactcagaggagtgactcttctcctaaaaccttcttgagagacagacttgtgtcaacctgccccaaacactggctttacttcctgatctcagaagggtaagatacacaggtgtgtgtctctcctcagattgtggagttactttgcgccttccagggacccttccctttatgtttatggcctaatggggttgaaggtg

SEQ ID NO: 38999 - DNA, 601 bp, Human
taagttccggggtacatgtgcaggatgtgcaggtttgttacataggtaaacatgtgccatggtggcttactgcacaggtcatcccatcacccaggtgttaagcccagcatccattagctgttcttcctgatgctctccctcccccatcccccaacaggtgtccagtgtgtgttgttccctgccatgcatccatgtgttctcaccaatcagctcccccttataagtgtgaacatgcagtagttaacctcctttttctatacggttttgtacacagccttccagacaattttgtgctgaaatrtattgctttgttttgttttggttattgtttgtatgttctgaatgccttctgaatatccactgaaaaattaattcccttctggagcgtgaagtacactgaattatacactgattccttgaaacctgataatctcatcatcataccacataatcctctttcaatcagcatattcaattaatgcactatctcatttctcaaatatgctaagttatatctaatctcttagaactggacactacattagagattaaattcaacctgttcactttaaagatgagaaaaatagagatgaatgagctg

SEQ ID NO: 39000 - DNA, 601 bp, Human
gaggattttattccctgtccgtgtgtgacctgtgcacatattagatcttaaactggcttgccctgcctgacataggtaattaagagctaaaattgacttcaatggagactgaaggaagcaaaatgtaagtatggagattcaattaatttgatgcattacagatacagacaaaactccttttgtccagaatccaagtaaaactaaagtttaaagtgctaaaaaaatcatgcagccctgtttgttaataattgatgttctactagaatacaagctccttgggagccactatgcctaacccactttttttttctttcaattttaagttccggggtacatgtgcaggatgtgcaggtttgttacataggtaaacatgtgccatggtggcttactgcacaggtcatcccatcacccaggtgttaagcccagcatccattagctgttcttcctgatgctctccctcccccatcccccaacaggtgtccagtgtgtgttgttccctgccatgcatccatgtgttctcaccaatcagctcccccttataagtgtgaacatgcagtagttaacctcctttttctatacggttttgtacacagccttccag

SEQ ID NO: 39001 - DNA, 601 bp, Human
tgtgtcagtctgagtaaaacagtaattgaatccctacctgcttctacctgtatttttttcagtttacagaccaataataaaataattttgcaattaaaactcccagataggctgggtgtggtggctcaagtctataatcccagcactttgggaggccgaagcgggtggatcaccagaggtcaggagttcaagaccagcctggccaacatggtgaaaccccgtctctacagaaatacaaaaattagtcgggcatgatggtgggtgcctgtaatcccagctactcaggaggctgaggtggaaraattgctcgaacccgggaggcagaggttgcagtgagctgagatcatgccactgcactccaggctgggtgacaaagcgagactttaaaaacaaacaaacaaaaaacacccagaataaagtgaacagtttataaatttggccccagatgcctctgtacctgactccttatgtaacaaactgcaatttaacttagtacgtcaactactgaaagcctaacttaggttgcagtttgttacataagcactcaggtacagaggcatcctggggccaaatttataaattgctcattttattctgagag

SEQ ID NO: 39002 - DNA, 601 bp, Human
cctccatgctctgtgcattcgccttgggggacaggtaacaggttagctgtatatcttctcccactctgacgaggatgggctgggaaggtccattcacttttaaagaagctgttaaatagagtggacaaaacacaatgaaagaatcaaaatggaaccaataatgtcatctctaagaacagctccattggagtttagaaaccatgagcatcccagggttgctgtgaggctcagggtcatccttaggtgaggtgggggtttcatggactcagaatagaggttgctcttctttaaggaggaatcrttccatgatgtgtgtcagtctgagtaaaacagtaattgaatccctacctgcttctacctgtatttttttcagtttacagaccaataataaaataattttgcaattaaaactcccagataggctgggtgtggtggctcaagtctataatcccagcactttgggaggccgaagcgggtggatcaccagaggtcaggagttcaagaccagcctggccaacatggtgaaaccccgtctctacagaaatacaaaaattagtcgggcatgatggtgggtgcctgtaatcccagctactcaggaggc

SEQ ID NO: 39003 - DNA, 601 bp, Human
taagtaactatgacagtttcacacactggaggatttgatataaatttgatgatgaataagcattaagaaaatttcaaatgtcagagaaattgtccaggaactagcatattaaagtggcaggagcaggtattgaatacaaaatatctatctagaattcttacctaccaccttcagatccaaactggcctcctggtagacatcatctttttcaaaaaggcagcggtactgcccgtcgtccgaaggtctggcactgagtatctgcagggtcagtctgccctcgtcaatggcgtcactcaccagyacagtcctccctctgtactctgccatctgctctccagccacatggtccccatccatatacacatgcacagcagggtaacggtgggatcggtcccacctcacctccatgctctgtgcattcgccttgggggacaggtaacaggttagctgtatatcttctcccactctgacgaggatgggctgggaaggtccattcacttttaaagaagctgttaaatagagtggacaaaacacaatgaaagaatcaaaatggaaccaataatgtcatctctaagaacagctccattggagtttagaaacc

SEQ ID NO: 39004 - DNA, 601 bp, Human
agtaagatactcagatttccttaaagatatggtcaatttttgaagatactggaaaagatacaagttatatgcccaaataattaaatttcatccatttgagtttgtggattttaagtaactatgacagtttcacacactggaggatttgatataaatttgatgatgaataagcattaagaaaatttcaaatgtcagagaaattgtccaggaactagcatattaaagtggcaggagcaggtattgaatacaaaatatctatctagaattcttacctaccaccttcagatccaaactggcctcytggtagacatcatctttttcaaaaaggcagcggtactgcccgtcgtccgaaggtctggcactgagtatctgcagggtcagtctgccctcgtcaatggcgtcactcaccagtacagtcctccctctgtactctgccatctgctctccagccacatggtccccatccatatacacatgcacagcagggtaacggtgggatcggtcccacctcacctccatgctctgtgcattcgccttgggggacaggtaacaggttagctgtatatcttctcccactctgacgaggatgggctgggaaggt

SEQ ID NO: 39005 - DNA, 601 bp, Human
gaaacaatgagccttttgtaaaatatgtagtaagatactcagatttccttaaagatatggtcaatttttgaagatactggaaaagatacaagttatatgcccaaataattaaatttcatccatttgagtttgtggattttaagtaactatgacagtttcacacactggaggatttgatataaatttgatgatgaataagcattaagaaaatttcaaatgtcagagaaattgtccaggaactagcatattaaagtggcaggagcaggtattgaatacaaaatatctatctagaattcttacytaccaccttcagatccaaactggcctcctggtagacatcatctttttcaaaaaggcagcggtactgcccgtcgtccgaaggtctggcactgagtatctgcagggtcagtctgccctcgtcaatggcgtcactcaccagtacagtcctccctctgtactctgccatctgctctccagccacatggtccccatccatatacacatgcacagcagggtaacggtgggatcggtcccacctcacctccatgctctgtgcattcgccttgggggacaggtaacaggttagctgtatatcttctcc

SEQ ID NO: 39006 - DNA, 601 bp, Human
acgtgtttattaatttagaatcaaaatccgtgggagaaacacgtagcatatccaagacttgggcctatatgtactcaatggcatctgctaaccttggacgtttcaattctcacacacacggacagtgggaaatgatgctgcagggagtgatttcatcttttctcccctgtccctgccaaaactgtcaatatttataattttggtttacacagtggatccagtttagtcttcagatgattacagtttctagaattttattgcatttctcagaattctaataacacactgtgaaacaatgagycttttgtaaaatatgtagtaagatactcagatttccttaaagatatggtcaatttttgaagatactggaaaagatacaagttatatgcccaaataattaaatttcatccatttgagtttgtggattttaagtaactatgacagtttcacacactggaggatttgatataaatttgatgatgaataagcattaagaaaatttcaaatgtcagagaaattgtccaggaactagcatattaaagtggcaggagcaggtattgaatacaaaatatctatctagaattcttacctaccaccttca

SEQ ID NO: 39007 - DNA, 601 bp, Human
gaacagcccgtggctgccttgagtcagggcctgggaagatgatggtatcgtctttccttccatgtccctccatggcacgtggggctgtgggaaccacccatctgaagagcacatcggctgcatttctccatcttcttgcccctccacagtgatcagtggggaagaacccagacctggggcagagaaagcaaccaaagcctggggtcctttcaagtggatgagtgggcagcaatttcactgggaggaaagaaggggatgtggagggcttggggaagggagaaaagcttaagggggattgcaytccacttagggatgaggctggctggagcattttcttattttgtttgtttgcttatttttattctttgtattcctaaatcattctgggatgattaagaggtaaggtaaatgttcaaatccaacatttattctgtccctgagaacaaaataacttcggccagggcatgggtcacatggacaggattaacatacggagtaggaggatattctcaaaaatcgaaaccttataaatatctacgtccaatggcagaaaatacgaggctcatgaaacttctcaacatgcgctcccatggctaaacgt

SEQ ID NO: 39008 - DNA, 601 bp, Human
tgcatttcagtttctgtcacccctccagcagaatttgtttaaattttgtctgtcccttcgttcttactcagctacaatccaagccttccagcaggtgggtccagtgctcttaaagaacagcattttagagtgtatatcatgatgaatggatggaccccagttgtcctggaattgaattacagagctattatcacttttttgcctgaaattttctaggatttatgatttttaaaaaaaataataagcaaaattgatgttaagtcttcaacccacagatttaaaaaaataagaaaaagaataaatagaaaagagacagcaatattttatttatgcattgcagcctgggagatgtaatcttgttaaaccagtgagccagcatctaattacagcctgtagttctaaaagcagttcacaggaaatacaggaggcaagaaatgtttagcatcaccacagggatgcagtcaggaaaatctagaattcaggaatcgttgtagtaaagtaatctagtttcttcagtacataaattatggaaatttctattgtaattgaaaagaaaaagagggacagaggaacctcaagttaagagagacttaagaagaga

SEQ ID NO: 39009 - DNA, 601 bp, Human
atagaaaagagacagcaatattttatttatgcattgcagcctgggagatgtaatcttgttaaaccagtgagccagcatctaattacagcctgtagttctaaaagcagttcacaggaaatacaggaggcaagaaatgtttagcatcaccacagggatgcagtcaggaaaatctagaattcaggaatcgttgtagtaaagtaatctagtttcttcagtacataaattatggaaatttctattgtaattgaaaagaaaaagagggacagaggaacctcaagttaagagagacttaagaagagacaaagatgtcttcaccaacttgatatttgatataaaagcaatgctaattttaaaattattttttattataaaataaaacatggaaaaactcctcacaaaaaaatatagtaatggactattataatgtgaacatccttgtaattttcacccaagtcaagaagcaggacttagtctggcaccatggaaagccctccatgtactgtgtcctgattgtggccacctttcacccctgaaaccaaccaccctgttaatttctgttggaatcacttgcttgttactgtattgtattgcccaaaggtac

SEQ ID NO: 39010 - DNA, 601 bp, Human
attttttgtatttttagtagagagggggtttcaccatgttggccaggctggtctcaaattcctgacctcaggtgatctgaccgcctcagcctcccaaagtgctgggattacaggcgtgagtcactgtgcctggccataaaattttaaatgaaaatttgtacaagcagaaagttttattgaagtccagtttttgattctccctctgcccccttcattgctgttaggatggatgttaatgtctgaagggccatcttcagtcaggatgctggtgagcctgtgacatctggtcactccaagctcygctcgaaggcatttaaatttaataaaaagcatactcccatgggcctcaaaaaacacctctgggactgagacctcaccagctttcaaccctgctttgtaggttctggaacttctttttctctttctccatttcttatggttgggaccatagcactttcagctgtccattcatctggttttgcttctaccttggaattccattcccacagttgtggcagcctacaacatgtaaaggagcctaggattttataaggagagaatatagactctgaattgatttttaaaacatataatcaatatt

SEQ ID NO: 39011 - DNA, 601 bp, Human
ggatgatactcaggtgaaaggtgaatttgtaaaaatgggaccagtgtgctttcttcaaatatgagttaaaggggagtttgtttccatatgaaaaataatagatttaggtgtatgctgaacctgtgtttgcatcctggttctgttacacctgagtgggtgacccttaagcagattctctagatcccagttttctcttgtgtaaagtacaggtaatgatacatgtctcttccagtattggggaggaataaataagatgtgtaaggaaagaattttttcatgtactaaaaaaaaaaaaaaaaaacaaaaaccctcaaaaaaagaacctggcacagtggtttgcccaaaaacgttcagcaagtagtagctattgttgttgatgttataggggatttacaaatagccatttatttgtgactccaacgtgaaatcttaaagtatcctatatttaacaaacaattttatgttgtttattatttctgtacatggaacagtttactgtggatactttctgttgtaatactctagggttttgaatttattattttacctacaagttttaaatgatattttttcatttcttttatgcttattttaaagataa

SEQ ID NO: 39012 - DNA, 601 bp, Human
aaagaattttttcatgtactaaaaaaaaaaaaaaaaaacaaaaaccctcaaaaaaagaacctggcacagtggtttgcccaaaaacgttcagcaagtagtagctattgttgttgatgttataggggatttacaaatagccatttatttgtgactccaacgtgaaatcttaaagtatcctatatttaacaaacaattttatgttgtttattatttctgtacatggaacagtttactgtggatactttctgttgtaatactctagggttttgaatttattattttacctacaagttttaaatgmtattttttcatttcttttatgcttattttaaagataaaaaatcaatttgagtagtaaagcagatggaaaataaactactacctcattctattttcttcaataattgtattaggattaagttgactaattataaattcttcagaattttaatattgaaaaattctttgttcatagtgtttgactattaatttcataattgtccataatgtttaaatgtattaattttgaagtttttagcatgtaaaattttcaaagtttaaggaaaaatgcattctttatccaggaacacaggagatatta

SEQ ID NO: 39013 - DNA, 601 bp, Human
taatactctagggttttgaatttattattttacctacaagttttaaatgatattttttcatttcttttatgcttattttaaagataaaaaatcaatttgagtagtaaagcagatggaaaataaactactacctcattctattttcttcaataattgtattaggattaagttgactaattataaattcttcagaattttaatattgaaaaattctttgttcatagtgtttgactattaatttcataattgtccataatgtttaaatgtattaattttgaagtttttagcatgtaaaattttcaaagtttaaggaaaaatgcattctttatccaggaacacaggagatattaaaatgcatttatcctgtttgtttaaagaaccattgccaaagggtaattgtgatagtcagcattttaaatggtataatttcaggggtttctgatttttttcacattattcaattttatgaagtttatgagactagtaacgtttttgtttcaaatctgagcaattattaataatatgtattttctattctttcataggaactgaggtaaacaccacagtgattggtgaaaatgatcctattgatgaggttcag

SEQ ID NO: 39014 - DNA, 601 bp, Human
agcctttgtatgagatctcttaaggatcttttctttgactctagttatctgaaatttcataattatatgtgtttttaaaaaaatctctgtactgttaggtggttcgtgggcccttaaaatcttgaaaatcatttcctttagctttgggaaattttcttaaattctttgtttgtgtttcttctctctggtttctctttcctcttttcctagaaatatgtatttatttattttttaaatgttgcacctctgactagtttggccttttaaaagtctcttctttcctattcttttctctttttcaaaaaaaaaaacactttctggtaagagtttttaacctgtgtgtatctttcttcctttagttgtcaaatatttaattttcaggggttttttttgttctttttatggtgttcccgtgtatctctgaagataatggtgcttgtgttttctgtctgcaaagtctgtttcctcttaagctgcgtttttgggttttggtcttttcagtggtggaggccttccttaggtgtctggtgatcacactcagagtgaggcactaaggacctggttggaagtcctaatgatgtggctttgtgactgtaaggtg

SEQ ID NO: 39015 - DNA, 601 bp, Human
tacctgccaccacgcccagctaattttttgtaattttagtagagatggggtttcaccatgttggtcaggctggtctcaaactcctgacctcaggtaatccacccgcctcggcctctcaaagtgctgggattacaggcatgagccactgtgccctgcccaaaatgtatatatgaaacacaaagagggaagcacacaaattctcagtcattcgtttgatgaactttcccaaaatgaacccatctatattaccagtgtccagacctagaaatagatctgctattcaccagctcagggtcagtcttttttttttttttttttttgagacagtcttgctctgtcgttcaagctggagtgcagtggtgctatctcggctcactgcatgcagcctctacctcctgggttcgagcggttcttgtgcctcagcctcccaggcagctgggactataggagtacaccaccatagctggttaatttttgtatttttaatagagacggggttttgccacgttgtccaggctggtctccaactcctggcctcaagtgatccacctgccttggcctccccaagtgctgagattacaggtgtgagcctctgtgcctg

SEQ ID NO: 39016 - DNA, 601 bp, Human
cacagccttttgtagatgcaaacagtaacagttacttcacttgtgttgccaaacctgcctacagggtactgagtggctggatttccactgtctttttaagaacagttttttttattttttaaaggttttacatataaatgctaagatattttcacctacattctaaataattctggtaattttacatgttggtgaaattttaattcttagaaaatgtgaaaataaagaagaaaataactctttattcaataaatattactgtgtgttccatgattactactgggctaaatgctgtaaacaygtatgccttattctaccttcttggaaaagatcctctgtatactttcaaaccctttagggagatatatgatcaactgctaggttatgtcctactggttagttataagtgcgttaggatttcagggaaacaaaaaaaatcattgagatatttgggaagccaaaggtttttggagaagttggatttcaaataggctttgaggaaaacagagggttctgatagttggaaatgcagagattttgagtttcatgacatttttcatataaagcatgaatacatctggttagatggaagaacctatta

SEQ ID NO: 39017 - DNA, 601 bp, Human
cacagccttgccagcatttggttttaccagtatttaggattttggtcattctgataggtgtgtggtggtatgtcattgttgtttaatttgccgttccctaatgacatatgatgttcaggatctacttatatttatcacctatctgtatatcttgtttggtgaagtgtctgttcagattttttgtccttttcttttttcttctttttttccccctgcccttttgtctccatttttaaaactttggttgttttcttattgttgagttttaagagttctttgtaagccaggtgcaatggctcaygcctataatcccaggactttgggaggccaaggtgggaggatcgcttgaggccaggatttgagatcaccatgggcaacatgagaagacctccatctctacagagaactaaaaaagagtagccaggcgtggtggcacacacctgtagtcccagctacttgggaggctgaagtggaggattgtttgagcccagaggtttgaggctgcaatgagctgattgtgccactgcactctggcctcggcaacagagcaaggccctgttgaaaaacaaacaagaagagttgcatattttgtttacctgtc

SEQ ID NO: 39018 - DNA, 601 bp, Human
gattgttcgcttctctagtcataaagcagttctctttcttcatcctcattctagagtcagtcagccataatgtcaacaaatatctcagtgaattttactctgagaacttaggaaggcctttagcagcttcatcaagatatgatgtatatgccataaaactcaaccttttaaagtatacaattcaatggtttttttaatgaaaaaaaccccacaaagtttgtgcagtcatcaccactgtctaatgatacatcattatcatcaccccccaaaaattccccagaattccatgtacctattagtrgtcactctctgttcctcccttcccctatcctctggcaacaactaatctactttctgtgtctatggatttgcctattctagacatttcatataattggaagccttttgtgcctggcttgtttaatttagcatattgttaaggcttatgcatgttgttgtgtatgtcagcatttcattcctttttatagtccactttatggatagtccacatatatctgttcctcagttggtggacagttggcagttttctgctagaataccttataagagccaaatatgttaagcccaggtgcaatttgtt

SEQ ID NO: 39019 - DNA, 601 bp, Human
tttgttttaggtagaggaaaaatacatgtatatatacacacacacacacacacacacactcctatacataagcacacacacactgaggaaaaagtgtaaatataggcttatatttgagaaagaaactacccagaaagtgagctttttcttcacagccgggttttcctttcttccctgaagtttcagtagagcaaggtgagcgtgttgtggctcttcatcctaagtgtttattgttttcatcatttttatttaaatttgaagggttgtctctggaatacacatgaataaggaacataatagyggttttgtttttgaatttccttttccattgagtgttgcagcaatgagctatgaaacagtgctagtccacagtggcaaagtgccacctgtcagctgaacatagtgcagacatcaattaggaggctctggcatcctcttgacctggtggtggtggcattgtcactcaggtttctttggctttggctgtcctggaacctttttagtaggatactaatttttaccagcatggtaaaatttttaattttatactaatttttatcggcatggtgtgctctcccttcccccacgtgatatcatggac

SEQ ID NO: 39020 - DNA, 601 bp, Human
aaaaataaaaatcagttttcttacgtattttctcttttacccctgcttcctctgtaggaacaggaagagcttactccactggttggactagggaagggagaaatgagttaaggggatctctttgagattgtcctccagttgacaagtgacaggaatgggaataggatgaattcagccattaaactgacacatacttatatgatagctgtgtgagatatgtatgtttccatcaaccttgtgtctttgatgtgtgacttcagtagggataggggccatgttgtgaagttgttcagtaaacatrgaacttaatatacttcactcacgcatttctataaatcttatattatgatcaagtcaggttatcagttgaatattaagaatagattgaactggaactaatatatacgtatttcattttttctcccagataacttctttgtggatgattatgctagatttactatcttggattcccaaggcaagactgctgctgtagccaatagtatgaactatctgacaaagaaaggtaatccatttgaggcttattatcttgcattcaacatttttttgaaagtatttgcatattcatcttaatgtgcaa

SEQ ID NO: 39021 - DNA, 601 bp, Human
gtgatgtaaaaatgggttaatgaattaaaaatgactgtacagggttaatattattttggggtttataagataaagttggttttagaaagccttgtataatctttgaagctgattttatgcagaggtatttatttaggctaagattgtgtaaaatgacgccctgtagtggcggacagattctgtcgccctcgggtcagtgcttcagaaaagcactggctgttattttaagtcagctatttttaccgcctttttaaatccccgctgtggtctctccccaagagaagttctggtttctcagctrtatgtaaagtacaagcaattactccatttggttctttaaagaaactgtttcttagggtactgggacagcgccatgacaccgacaggactaagcagcaggaagaaccatagaccgtgttagccattgtttagactttcaatttttacagtaggcattcattccagaaatgatactttttttctactcttttctctttacctttgttcaggaatgtcctccaaggaaatctatggtaacttaaaacttcagaatgttctatttcttaattttcttctttggtttcagtgaccattgtaattt

SEQ ID NO: 39022 - DNA, 601 bp, Human
aatgtgggaaggctgtatgaatgaagaagggtttgaggagagcactgaaaacacttctaaaacaagtgcgttagaagaatacaaaatgtgtggcataagaatataaactgtgttgggtaaagataggactctgagggtctgtaatttatgctatatttaccgggaaggtaagaaatgaagttggaaaggtgggctgggggccacttcatgtagggttttgaatgcttgatgatggcatttttaattttattttgaatgaggaggagaactatctgagactttttttttttttttttttttaatgagacggagtcttactctgtcatccaggctggagtgcagtggtgtgatcttggctcagtgcaacctccacctcccgagttcaagcgattctcctgccacagccttgcgagtagctggaattacaggcgcccaccaccatgcctggctaatcttttgtatttttagtagagacagagtttcactctgttggccaggctggtctcgaactcctgatctcgtggtccgcccgctttggctttccaaagtgctgggattacaggcatgagccactgcgcccggcctgagacttttaagagag

SEQ ID NO: 39023 - DNA, 601 bp, Human
atacaaaatgtgtggcataagaatataaactgtgttgggtaaagataggactctgagggtctgtaatttatgctatatttaccgggaaggtaagaaatgaagttggaaaggtgggctgggggccacttcatgtagggttttgaatgcttgatgatggcatttttaattttattttgaatgaggaggagaactatctgagactttttttttttttttttttttaatgagacggagtcttactctgtcatccaggctggagtgcagtggtgtgatcttggctcagtgcaacctccacctcccragttcaagcgattctcctgccacagccttgcgagtagctggaattacaggcgcccaccaccatgcctggctaatcttttgtatttttagtagagacagagtttcactctgttggccaggctggtctcgaactcctgatctcgtggtccgcccgctttggctttccaaagtgctgggattacaggcatgagccactgcgcccggcctgagacttttaagagagatattatttgctacttattgaacatgactgatgttaatgctgctttttaagttcaaaaatatctacaatatgactccc

SEQ ID NO: 39024 - DNA, 601 bp, Human
taaactcttcagacagagccactcttttttcaaaggtgattggggcttatgaagtgccattgatgtttctgcctcctatttccaaggagctgtgctttttgacatagacaaatatccccatatggagccttcctgctgtcggtgagagtgtggtggctctcagaaagtcagtcagtatggactttgacacataaagtagcctttgttgtttttattcaggtagaattaatgaaaactactttacgattttattttactttgtccttgaggaattgataagtaaataactacaagtatttgytttgggcttcactttgtattatttcactgattttatctaaacatgtacctgtctcaggtctttaagatgttctggcgtatgaggtagcctgaggacgccagagggttccttaccagcttgctgagtgcaggcagccttccagagctaagcgcctgctcttctctccttcacagatcattgggccactggaggatagtgagctctttaatcaagacgatttccacctcctcgaaaatatcatcttaaaaacctcaggacagaaaataaaatctcatattcaacagcttcgggtagaagaag

SEQ ID NO: 39025 - DNA, 601 bp, Human
tcagttagaaatcaattttaggctgggcgtggtggctcacacctgtaatcccagcacttgggaaggccgaggcgggcggatcatgaggtcaggagatcgagaccatcttggctaacacggtgaaaccccgtctctactaaaaatacaaaaaattagccgggcatggtggcgggcgcctgtgatcccagctactcaggaggctgaggcaggagaatggcgtgaacccgggaggcagagcttgcagtgagcgagatcgcgccactgcactccagcctgggcgatagagtgagactccgtctcaaaaaaaaaaaaattaattttagaagaggcagggacaataaaattctttttaaagtggtttacttcagtgttaattgtaatagtgaaattagaaacaacacagatgttcagtagttggcttaatatttagattattttgtatccataaatgtaacattatgcagtcataaatatattgaaataggctgggcacggtggctcacacctgtaatcccagcactttgggaggttgagatgggcagattgtgtgagcccaggagttcaagaccagcctggcctgtactaaaaccctgtctgtact

SEQ ID NO: 39026 - DNA, 601 bp, Human
attacagagttgtgtctctttggtctcctttaatctggaagagttctttgccattttttttcctagtcttttgtcttttatgatgacattttttaagagtccaggacagttgtcttatggaatgtctcacagtctgagttgcttcctcatgattagatttaattgtttctaggaaagagccctgcgcagtaatgtatatagcctttgctgtagctggcaagtatatacatatacactgattgtgcctcggaatccccagggaggctttaaatatagatgcctgtgtcctattcctctgtgwttctgagctgatcagtctggcatggattggactttggtttagtgggcctgtgttttttatgacccatccttgtggggatcaggtgtgcgtggtgagatcatttgatgattgtaggctggaatggaggccctctctgtttgcactggttgtgtgtcctaattttttatgtcagcagtgggtgaagattcttatggctcctggataatccttgttgaatttggccattagcacccagattgcacccattttctcaacattttgtgaactttcaggaagtaactcattagtcaccagcgggag

SEQ ID NO: 39027 - DNA, 601 bp, Human
taaaagaagaatattcatttcaagttggaatatacatgttagaggaagcttgcttagctatatattgtcatgagctttggaatggtcatttatgaaaaaagtgatacagaaagcagttagcgttgtggctatgggaaatttctaacttgccagtgtgctgtgttttataggttagcttctaagtggattgaaacagcatttgaaagtaaccaaagggttcccagcttccaccattattctcgtataggggaaatgtttacattattagtgttttcaggactagcctgagagcccaatcagyatttaggaattggttttaaagagaaaaatgagtcctccttgaagggaggaaaatgcccaggacctaactgtgaccctgacagccatccatgtgaacgagtggcctccgttcaagtgattggattttggcttgcaggtggacagtatagtggctgctgagtatgagctagagtacctgttactagaaggtcattgctacgacatcaccacaggccaccactgagcactcctcctcagtgctgtccttgtttgccttttcttgcatctgcagcaaccacaaggaggcatcataaggtcaaag

SEQ ID NO: 39028 - DNA, 601 bp, Human
ttatggccaatctggtaaataatctgttcatcagatagtgatattgtagttacgttaatttgggcactataatttatgatggagcaattagcattcttaaccatagagtgagattaaaattcattatgggctgaatttggtcaatatagaaatcattagttcagctaaatttgtaggttagaattacatgtcaaaagaaaaaacatgctggaatactcagctataactgaattggccccctgaaaatagattgctcatgagctgacagcctttttcttttctttggaagtgcaacacttaytcatgcatcacacgttgattcttccctgaagcacagctaaagagcagatgatttattggtgtgactggcctttattgtactagtttttttttttttttttttgagactcctgcccaggctggagtgcagtggtgtgatctcagctcactgcaacctccgcctcccaggttcaagcaattctcctgccccagcctcctgagtagctgggattacgggcacccaccaccatgcccggctaatttttgtccttttttagtagagatggggtttcaccatgttagccaggctggtctcgaactc

SEQ ID NO: 39029 - DNA, 601 bp, Human
atcattagttcagctaaatttgtaggttagaattacatgtcaaaagaaaaaacatgctggaatactcagctataactgaattggccccctgaaaatagattgctcatgagctgacagcctttttcttttctttggaagtgcaacacttattcatgcatcacacgttgattcttccctgaagcacagctaaagagcagatgatttattggtgtgactggcctttattgtactagtttttttttttttttttttgagactcctgcccaggctggagtgcagtggtgtgatctcagctcactgyaacctccgcctcccaggttcaagcaattctcctgccccagcctcctgagtagctgggattacgggcacccaccaccatgcccggctaatttttgtccttttttagtagagatggggtttcaccatgttagccaggctggtctcgaactcctcacctcagttgatccacctgccgtggtctcccgaagtgctgggattacaggcgtgagccaccgcacctggtctgtgctagagtttttaatgtgtagttttggttttttaagagttgcattgatttgtttactgtgttattcacattata

SEQ ID NO: 39030 - DNA, 601 bp, Human
tttaccttaaggtttactgcacatatttattagtttaaaaataattatgttgcctttaaaaaagtttgatataaattctgcttaacacaatttaaattagttttaaactgtgtgaagaggcttcccgtcaggttgtgtaggggatgatttccattagggcacatttgaagcactctgtagtatgtccttgccttaattagctccgtagcgacacacatgaaacagtggattagtgcctggttcttacccaggaaatagaagaattctgtattataataacaccattgtaaacagtagaagstttttttccacataacattttcctcagataaggttttacaaaatttgggatgcacttccgaactccttcccttttggatgccctggcccttgccagccctccccttcccaggagcatggtgccccctcttcctagctgttcagggccccacccccattagaatcttcctttgcctgagaaccctactctctgctagatgacagcaaatgcagtgaattcatgttgtaattatgactttctgcaccttgaaatttggtgactggaaattttaggcattgctgttgattagtagggaaacat

SEQ ID NO: 39031 - DNA, 601 bp, Human
taaggtttactgcacatatttattagtttaaaaataattatgttgcctttaaaaaagtttgatataaattctgcttaacacaatttaaattagttttaaactgtgtgaagaggcttcccgtcaggttgtgtaggggatgatttccattagggcacatttgaagcactctgtagtatgtccttgccttaattagctccgtagcgacacacatgaaacagtggattagtgcctggttcttacccaggaaatagaagaattctgtattataataacaccattgtaaacagtagaagcttttttyccacataacattttcctcagataaggttttacaaaatttgggatgcacttccgaactccttcccttttggatgccctggcccttgccagccctccccttcccaggagcatggtgccccctcttcctagctgttcagggccccacccccattagaatcttcctttgcctgagaaccctactctctgctagatgacagcaaatgcagtgaattcatgttgtaattatgactttctgcaccttgaaatttggtgactggaaattttaggcattgctgttgattagtagggaaacatacattta

SEQ ID NO: 39032 - DNA, 601 bp, Human
acaggcggttgtttagtactcaccatgtggttaccacacatgggtgcctctcactacgtgatgggtaatttgcaagaggactcacaaaggaggtttgggcatgcaccttatataaagagaggtttcaacacgtgcttctgtgcagctcgaaggagcttaaggagcaagaagatagctggatctggaaaactcctttatgagaaggatgatggactcagatgctctgagagcatttgctgccttttgagaattgtgccttgtaatattgatctttcttttctcgcaaagccacgatggcacygattctccccctgatgctgatgaggtggttatcgtcctcaacaacttcaaaagcaaaattattaaagtgaaggtgagtttggtaaaagtagtggcattctgttattggacagctgtcatttaaaaatatgtatcttggaaccagcccaagagtctctttggaatttgctatggcaattatagggatactgctttaaggcaaaatgtctttgtaactgtgagtttgtggcttccctcaactgaaagattgtaccttttgggtaatctcggtgtgcagaacatgtcccatcttatataaaat

SEQ ID NO: 39033 - DNA, 601 bp, Human
gaacgagtgagaatgaatctggattttgggattccttcaaatggtaagttgacattgtaagagttatgtttttaaggaaaaactgagatataagcaccatccatccctcctttttgcatcttgtgattctgtctgggcctttcacattctactttgtgcagctacatctcacacttatatttggcatagatgagtattttccactcgattgatccaaaagaggttcatgtctcctagtggggaagttacttctgctccatactttgtgactctcattgcctgtacctgctctttggaaatwtgactgctccctgctcagtttacttcccgttgtgtaagttgcattctggtgcagcctgtgttcagtctcttcctaaaacaacactgtcggagagtgaacattctttttgtaggttggttttgtcagtcttgtggtctctccagggtgtgagggaagcttcataaccactcctgctgcagctcacccgctagggaaggatgggaagcgcagtctctttcctcttactttcaaaggccgtgtgtctgtatgagtgtttcaagtggtcttttttttacccttattgttataggggctttacag

SEQ ID NO: 39034 - DNA, 601 bp, Human
cttctgctccatactttgtgactctcattgcctgtacctgctctttggaaatttgactgctccctgctcagtttacttcccgttgtgtaagttgcattctggtgcagcctgtgttcagtctcttcctaaaacaacactgtcggagagtgaacattctttttgtaggttggttttgtcagtcttgtggtctctccagggtgtgagggaagcttcataaccactcctgctgcagctcacccgctagggaaggatgggaagcgcagtctctttcctcttactttcaaaggccgtgtgtctgtaygagtgtttcaagtggtcttttttttacccttattgttataggggctttacaggacagaagactgaggaagtgaagcaagataaagatgacataattaatattttctccgttgcatctggtcatctctacgaaagatttcttcggtcagtcttgttgattatttcattatatatgatgaatgaattggtcagtgttcttatttagagaggaaaggttttgtgggattctgctcattatactcctgtgtctttgaagcactctgagcattgtgactggcttgccatttatcattggatttgt

SEQ ID NO: 39035 - DNA, 601 bp, Human
tagccacatttaatccttgttgagtacttacgatgggcaaggcattattctacatctgtccatccatatgttaacttacataatcctcccagcaaccctgtgagataggtactgtcattatcattatctccattttacagatgaagaaactgaggcacagaaaggctaagcagttgaaatttgttttattcctactcccacacaccttgctaagaagtgtcttacatgttagtgagtcaaccaggtaataagtggagcaatcaaagtgcatctgcccctagtgcctgtgccactaaccacrgagcagccttccatgctgccttaagcgagccactctgtatctgaaggaaaccgcattagagctgtctgcatggttgcttaacaaatgactttttatattctccagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcaggtactgaaaagaagcactcctaacactgttacgg

SEQ ID NO: 39036 - DNA, 601 bp, Human
catggtggtgggcgcctgtaatcccagctactcgggaggctaaggcaggagaattgcttgaacccaggaggcggaggttgcagtgagctgagatcacgccgctgcactccagcctggatgacagagtgagattccatctcaaaaaaaaaaaaaaaatacagtgtaaaaaaaacttcctaatcctgtctctctctttcctactcagttcctgttctcacagcagataacctcccaacttattgactgtctatccttccagattttcttaattcttacagaaacagctgtgaatgtgtattctttttttttttacacaaaatatgctacctatttatacattttgtaacttggcttttttttttttttttttacttaatgtcatatacatcttctcagtgaatagagagagacctgattccttttcatagctgcatattattccagtgtgtgagtgttatttatagttttccctgtgacctacaatgttgcaatgaataatctactaaataatttttcatatctcatatatttgtgagataaattcctagacgtagaccttttaggtcgaacagtgtgtgtgttgttacatttctaatgagca

SEQ ID NO: 39037 - DNA, 601 bp, Human
attgcttgaacccaggaggcggaggttgcagtgagctgagatcacgccgctgcactccagcctggatgacagagtgagattccatctcaaaaaaaaaaaaaaaatacagtgtaaaaaaaacttcctaatcctgtctctctctttcctactcagttcctgttctcacagcagataacctcccaacttattgactgtctatccttccagattttcttaattcttacagaaacagctgtgaatgtgtattctttttttttttacacaaaatatgctacctatttatacattttgtaacttggcttttttttttttttttttacttaatgtcatatacatcttctcagtgaatagagagagacctgattccttttcatagctgcatattattccagtgtgtgagtgttatttatagttttccctgtgacctacaatgttgcaatgaataatctactaaataatttttcatatctcatatatttgtgagataaattcctagacgtagaccttttaggtcgaacagtgtgtgtgttgttacatttctaatgagcaccccattctcttctctgcgagaagtgtgatttgaagatgtgcagggaagagg

SEQ ID NO: 39038 - DNA, 601 bp, Human
cattgggtttagttttcctgtcgtaatccatggttggttgtaacaagcgggtcttctttattcagtgcactatatgttgtggatctgaagaagtttaggaaaatagctgctggtgacagactcaggggacagtaccaaggtctgagtcaggaccctaacagcctttcaaatcttgatcaagtaagtgtccattttttatggttaactgtgagtgacgggtatacagtgttgcatcagaaaatgaagtattacttgtgtcttcagtcctctcctcacaggatggcgtcttgttttttcatgttgtgtgtgtgtgtgtgtgtgtgtgtgtgagagagagagagagagagagagatttttatctgccctcaagacatatcagcgtgaaaaatgtcatagatttgatgctggctggggagagagatggaaggagaatgctgcctctctgaaccattagcatatctttgtattttgtactcaaactaatctcataggtttgtttctctacctactagggtcagtttgtttttctgctgtaggaactaaatagctcaggattcgtagtatagaatcacagtatagtatcacagcttcccctttttct

SEQ ID NO: 39039 - DNA, 601 bp, Human
ccatggttggttgtaacaagcgggtcttctttattcagtgcactatatgttgtggatctgaagaagtttaggaaaatagctgctggtgacagactcaggggacagtaccaaggtctgagtcaggaccctaacagcctttcaaatcttgatcaagtaagtgtccattttttatggttaactgtgagtgacgggtatacagtgttgcatcagaaaatgaagtattacttgtgtcttcagtcctctcctcacaggatggcgtcttgttttttcatggtgtgtgtgtgtgtgtgtgtgtgtgtgwgagagagagagagagagagagagatttttatctgccctcaagacatatcagcgtgaaaaatgtcatagatttgatgctggctggggagagagatggaaggagaatgctgcctctctgaaccattagcatatctttgtattttgtactcaaactaatctcataggtttgtttctctacctactagggtcagtttgtttttctgctgtaggaactaaatagctcaggattcgtagtatagaatcacagtatagtatcacagcttcccctttttctatgtcagaaaccatgatgtgtttcaag

SEQ ID NO: 39040 - DNA, 601 bp, Human
catggttggttgtaacaagcgggtcttctttattcagtgcactatatgttgtggatctgaagaagtttaggaaaatagctgctggtgacagactcaggggacagtaccaaggtctgagtcaggaccctaacagcctttcaaatcttgatcaagtaagtgtccattttttatggttaactgtgagtgacgggtatacagtgttgcatcagaaaatgaagtattacttgtgtcttcagtcctctcctcacaggatggcgtcttgttttttcatggtgtgtgtgtgtgtgtgtgtgtgtgtgtgagagagagagagagagagagagatttttatctgccctcaagacatatcagcgtgaaaaatgtcatagatttgatgctggctggggagagagatggaaggagaatgctgcctctctgaaccattagcatatctttgtattttgtactcaaactaatctcataggtttgtttctctacctactagggtcagtttgtttttctgctgtaggaactaaatagctcaggattcgtagtatagaatcacagtatagtatcacagcttcccctttttctatgtcagaaaccatgatgtgtttcaagg

SEQ ID NO: 39041 - DNA, 601 bp, Human
atcccagaagccatccttcctccctaacaaaagtgtctagcatcacgacttttatggtaatcatttttgtttctttatagatttactgtttaagcatgtatccataaacactagtttaatttgctcattttcttctcctctatctcaatggaataataaaaggtaaacttttttgtttgtttgtttgttttgagacagaatctcactctgtttcccaggctggagtgcagtggcatgctctgggttgcactcactgcaacctccacctcccgggttcaagtgatcctcctgcctcagcctsctgagtaactaggattacaggcacgcaccaccactcctggctaatttttgtattttcagtagagacagggtttcaccatgttggccaggctggtctcaaactcctgacctcaagtgatccacccgctttggcctcccaaagtgccgggattacaatcacgagccacagtgcccggctctacttactttaaaatttgtgtgatacctggtatcttctaatttatggagctactatggatctgattctgttgtattatttctgttattcttttgttcatactgtctatcacatatttgttta

SEQ ID NO: 39042 - DNA, 601 bp, Human
taatccttccattctaacatcaaccagtatatatttttcattttccttttatgttggtcttctaaacagtatttattagtgcaattgctatgtttttttttttttctcgtttttctggtgagggggagaaagggtattttaattgtgattatagttatttaggttcatgagttttgtgatacataaaccaaaccttttgcagagttcttcttagattccttgttttttttttcattaaatctgtcagtgtactagtgaatgaaaaaatttagatcaacacaaatatgtagttgaagaaactttttttttttttttttgagacagagtctcactctgttgcccaggctggagtgcagtggcatgatcttggctcactgcagcctccacctcccaggttcatgtgtttctcatgcctcagcctcccaagtagctggaattacaggcatgcaccaccacacccagctatttttaaattttatttattttttattttttgtagttttagtagagacagggtttcaccatgttgcccaggctggtctcaaactcctgacccaagtgatccgcccgcctcagcctcccaaagtgctaggattacaga

SEQ ID NO: 39043 - DNA, 601 bp, Human
aacagtaatcaaattaaagcagtctatcactagtatctgctacatggaagaaaacagacatagtgataatgccatttgtttgggaggcggtgatgaaaccgttgtggatgtagcttgatgaagctttgtgtattggaatagcccttgttacaaagcagtacatctgccattagaagcccgtaaggcgtttatataccctcaagaattactctcttgagaatatatctgaaagaaataattcaacagaaaaaacaaagttgtatacatgaaaaaatttattttactattacttataagccaraagcatcaaaaacagtttaaacatccaagaatgagctacactgatacatagaaaatgtttagatgctattaaatgataaaagaaaaatcccgactaaaaaaatgcatgcaacgtttactgaaagtaaatattgtatttgtgaaaacaattcagttggagtggggtttacagatagtttccatttttaaaaaatctttaatttagtttttgctttcaaaatacagtacaaaagcacaaatcccaaagatttagtaagtgagataagatgaaggtggaggtacaaagaataggttccagtga

SEQ ID NO: 39044 - DNA, 601 bp, Human
gttccagtgatgaaaaatgcccactcagtggtgtttgtaatttgaagatcatctgttttcttttctgtggttctccttttccttaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctrttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaac

SEQ ID NO: 39045 - DNA, 601 bp, Human
tctaggtaaaaagaaaactatcttaatttttttggggggggacaggggagacaaggcctctctctgtcgctcaggctggagtgcagtggtacaaacacagctcaaactcctgggttcaagtgatcctccacctcagtctcacaaagtgctgggattacaggtgtgaaacaccacacctggccaatttattttatttttttatttttcttttttagaaacagggtcttgctatactgcccaggctagtctctgactcctgggctcaagcagtcaatcctctggccttgggccttccaagtarctgctactacagatgcacaccaccatgcccaggtaacaattttgatttcttcttgatgagaatgcaatatccaaacatgactaattatatgaggtatcttataataaagtattaaaaccttgtatttttggaaacagatgcttagaatggtttctattaaaacatattttcaaatttaatgttcggatttactaacccagtgaagcattcacacttaaccattaccattaaaaaataataaacattacaatgtgtgtacataaatacaaatcttacaagttaaaatttacatatcaccta

SEQ ID NO: 39046 - DNA, 601 bp, Human
gattgaaccctaatgtaaactatggaccttgcgtattaaggatctgtcaaggaaggttcatcaacagatatatatgtaccacactagtgagggatgttgataacaggggaggctatttatgtgtaggggaagggggaatatgggaaatctctgtactttctgtccaattttgctatgaacttagaactactctaaaaaaattaagtctacttttaaaaaagaaaaaaatgtactattactagatgcaaaattattacttcaaagaaatctaggtaaaaagaaaactatcttaatttttttkgggggggacaggggagacaaggcctctctctgtcgctcaggctggagtgcagtggtacaaacacagctcaaactcctgggttcaagtgatcctccacctcagtctcacaaagtgctgggattacaggtgtgaaacaccacacctggccaatttattttatttttttatttttcttttttagaaacagggtcttgctatactgcccaggctagtctctgactcctgggctcaagcagtcaatcctctggccttgggccttccaagtagctgctactacagatgcacaccaccatgcccagg

SEQ ID NO: 39047 - DNA, 601 bp, Human
cattccattccggtctcttctactcatttgtgttccctactccctggctaaatctcatcattcaaactcagctccagcattcagcactgaaaatcctgtcttgctctctctggaacactgactaggtgcctcttttatgtgttttcatgttatgcatgacccaattaaagctcttatcgcctaatagtgtacatcactgttttgctgtctccttcattgtttcacaaagtcctgtggatgtagatcccatttattcatctttgtattcccatcatctaaagtacctccagcatttcttatractaaaaagctttttcaggaaaaaattttgaaaggaaaaattatttgcttttggaaatatttcagtttaaaatgttattaaaagcatgtctgatctctttatttttaaaatctactttgtgaaatcacaaaatcactgaacttcaaggctacctgagccaaacaggcttcagtaaatgagcatttaaaacatctgaaacttagtttatcttacatttacactcaggaacaaaataataaactattttaatcaccaatagtaagaagatgtctctatatctaaatggctgaagattttact

SEQ ID NO: 39048 - DNA, 601 bp, Human
tttggtgttaggtttttttaaactatcttggatacttgacattaaccatgaaaaccttacatattaatctagcctacttttacctcaatcaccaaaactattaataaaattactaggacaaatatgaggacaacagacagtaatttcctaatgatttgaaagtaaacattactaagtgatcgaggttcctccacacattccattccggtctcttctactcatttgtgttccctactccctggctaaatctcatcattcaaactcagctccagcattcagcactgaaaatcctgtcttgctstctctggaacactgactaggtgcctcttttatgtgttttcatgttatgcatgacccaattaaagctcttatcgcctaatagtgtacatcactgttttgctgtctccttcattgtttcacaaagtcctgtggatgtagatcccatttattcatctttgtattcccatcatctaaagtacctccagcatttcttatgactaaaaagctttttcaggaaaaaattttgaaaggaaaaattatttgcttttggaaatatttcagtttaaaatgttattaaaagcatgtctgatctctttatttt

SEQ ID NO: 39049 - DNA, 601 bp, Human
tatgctgatatatttaagtaacttaaaatgaatttgaaatttacaggagtaatttttaagattgcgtctccaataaaaaatagcactgaataaggccaaaaagcatgtactgagaacaacatatatgggacagatatattgaggattttaggtgagagacacgaaatttggtgttaggtttttttaaactatcttggatacttgacattaaccatgaaaaccttacatattaatctagcctacttttacctcaatcaccaaaactattaataaaattactaggacaaatatgaggacaacmgacagtaatttcctaatgatttgaaagtaaacattactaagtgatcgaggttcctccacacattccattccggtctcttctactcatttgtgttccctactccctggctaaatctcatcattcaaactcagctccagcattcagcactgaaaatcctgtcttgctctctctggaacactgactaggtgcctcttttatgtgttttcatgttatgcatgacccaattaaagctcttatcgcctaatagtgtacatcactgttttgctgtctccttcattgtttcacaaagtcctgtggatg

SEQ ID NO: 39050 - DNA, 601 bp, Human
aaaaattagccgggcgtggtggtgggcacctgtagccccagctacttcagaggcttaggtgggagaatggtgtgaacccaggaggcggagctggcagttagccgagatcatgccactgaactccagcctgggcgacacagtgagacaccgtctcaaaaaaaaatctctgctcattatttctcatttgtaccattcttttccacatttaacaaggtcagcaataatatcaccacatgcattagactctgccattataaataaagccaatagaattatattttaagtgttatttatttatttwtttttttgagtcagagtctcactctgttgcccagactgcagtccagtggtgtgatctcggctcactgcagcctatgcctccagtgttcaagtgagtcttgtgcctcagcctcccgagtagctggattacaggcccgcaccaccacgcccagctaatttgtgtattttcagtagagacggggtctcacaatgttggccaggctggtctcgaactcctggcctcaagtgatctgcccacctcagcctcccaaagtgctgggattacaggcatgagccactgtgctgtgctagtaattcctac

SEQ ID NO: 39051 - DNA, 601 bp, Human
tagatgtaactagcaagatcatctctattatgaaatggatgcattgggctattttggctgatttgttaaataactaaatccatgctcaccaaccacctgctaaaaatgccccttcaatattttctgcctttatcttcaacctcagcttttactcaatttttgactactggcacctaatattcaaaaatcactcttattaaaaaaaataagtggcagcctccacagacagctactgactcatcttattcccttcatagtcaaaggtcttaaaagacttaacgacacgtagctctactggaargggacattttgggggtggttggagactgggttatttgctgattgtgacaatttgacaagaaactcagaaattagataaccaaataacagagatatgaaaagctttactcacatcttaacttactaaagtcttgattactataccagtgaaatggttctcaccaaaggcactaataatttctctgtttttaaaagtagtaggtgcataatattcatattacttgatctgtctacagtatttgataacagcaatcacttacaacttaatattctcctggctttcatgatctaatacttttac

SEQ ID NO: 39052 - DNA, 601 bp, Human
ttagccaggatggtctcgatctcctgacctcatgatccacctgcctcggcctcccaaagtgctgggattacaggcgtgagccaccgcgcccagcccactcttaattctttaacaaactatagatgatttctcagaacttgggagatatggtgagttttcctccaagaatcaaaaaataatgcaaataagattcgtgttcaacagtaaaagcaaaatagaaaataaatgttattttaaataatattcttaaaatacttatagttacaaggtcagcaagaaaataataaaaattaatgtaatracatctaaaatatgactacatcagtcaaaggactggtcacccagggaagcagagaaaagtcaaaagaaatgtgagtagtgcctgacaacagataccaaatttcatcaaggtcaccatcaaggttgtcccttatgtagtaatgaatgtaggattcaggagtttatagaaagtaaacttttataatttagatgtaactagcaagatcatctctattatgaaatggatgcattgggctattttggctgatttgttaaataactaaatccatgctcaccaaccacctgctaaaaatgccccttc

SEQ ID NO: 39053 - DNA, 601 bp, Human
tttttttttttttttttttttgagacggagtctcgctctgtcgcccaggtcggactgcggactgcagtggcgcaatctcggctcactgcaagctccgcttcccaggttcacgccattctcctgcctcagcctcccgagtagctgggactacaggcgccctccaccgcgcccggctaattttttgtatttttagtagagacggggtttcaccttgttagccaggatggtctcgatctcctgacctcatgatccacctgcctcggcctcccaaagtgctgggattacaggcgtgagccaccgygcccagcccactcttaattctttaacaaactatagatgatttctcagaacttgggagatatggtgagttttcctccaagaatcaaaaaataatgcaaataagattcgtgttcaacagtaaaagcaaaatagaaaataaatgttattttaaataatattcttaaaatacttatagttacaaggtcagcaagaaaataataaaaattaatgtaataacatctaaaatatgactacatcagtcaaaggactggtcacccagggaagcagagaaaagtcaaaagaaatgtgagtagtgcctgac

SEQ ID NO: 39054 - DNA, 601 bp, Human
gaagtaatagtggatattctgacaaaactgtacagtcaatcaggcaatgagtcatcttaattttgctgcctattaatgaagagaagaagaaaaggttataggccaagggaaataagttcaaaaatatctcccaaacaatgtcttagtggcaccttatgactaaattcctcctacagtccaacttgccaatattagatcctttcaaagatgacaataaaaagtctcagagtttagttcaataggtcctggctgatataaagaagctatgaatcactcaggagatttcctctagtcagttatraagtctttcagctctgatccaagagtcttatgttgtccatctgattcctgaaactgtggcaagctaagtttttagcttgcaagcagggtaaaaattccagccccttcacagctcttgacaaaaagctcagaaatgagatgaccaaaaaaagagggagatatgagaagtttcctgaaagaatacaaataagaactagaaagaaaataatactagaaaatacagattaaattagaaggagcacaagagtaaagagacactgtggaaaacagtaggagaaacagaatatgcagaggaaaagtg

SEQ ID NO: 39055 - DNA, 601 bp, Human
aacttgaacaaactaacctgagctgcgagttgcctactataaaccctattcaaagaactcaaagacataaaggagaaggagggatcctagaatttaattaaaaattctccaacacccctggggagacagagatcacttgaatgggagaaggcagaaaagtgcagcctagagctgaagaagacctggtggcactaacggggataagcaggggtgggcagaactttctgtctgtgcccttttcctttctctactcttccctgggtgtaaccattgactgcattgtgtcagaaaactgtaatgycattccagggccagccagagatggtaaggtaataacagggcagctctggagtccatttggtataggcatccatagaggctggcctctagacattctctggtaatttattctcctctacatcttggcactgggttatcaagtgatggaaatttctcatacaaaagaacagagttgaggtagatgaagagcagttccctgtggatatctgatgtgaaagggataacaagaagaatgtggttacaccagactgcaacaccagatactctctttctgagaggaggaaaaggatgttctgactgg

SEQ ID NO: 39056 - DNA, 601 bp, Human
agtatgcccttatagagaaagcaaactttaaaaggttgatgtgtaaattgtctagaaactgtccagctttcttcaggattaagttgtaataagaataatctgattctataaaaagaagtcaaaagaaaataaatgttagcattttatacactgcacattggcacatcttccactgtaaggctaacttaatgtcatataatcatatctgaagtttggttatggataatgctagagaaaaatggaaaaatcaagatctcagttctataatcaacttcattttggatcttccagtaatgtccamgtaatcaacatgagaccaggtgaaaataatcttgccattaaaatctatttggaaacaccaacatttcagaccaacttactccaaagttgtggggttatattacaaggataagatataagtcctacctacaaggtagaaattaagaacagcagaaaagttaaataatatgattgttaatgaattttaaagtacctgtatgaataaattctactgagatttagtgccaatagccaagtataattagtgtatccagaatacttttaggagacaaaatttgaaccaggtcttcaaaactaaatg

SEQ ID NO: 39057 - DNA, 601 bp, Human
ctctatgtacattgctagcgtgcctctttgtcaaatacagattgggtatttttacgcacctgctgaaacatctgaatagctggggagtatgcccttatagagaaagcaaactttaaaaggttgatgtgtaaattgtctagaaactgtccagctttcttcaggattaagttgtaataagaataatctgattctataaaaagaagtcaaaagaaaataaatgttagcattttatacactgcacattggcacatcttccactgtaaggctaacttaatgtcatataatcatatctgaagtttgrttatggataatgctagagaaaaatggaaaaatcaagatctcagttctataatcaacttcattttggatcttccagtaatgtccaagtaatcaacatgagaccaggtgaaaataatcttgccattaaaatctatttggaaacaccaacatttcagaccaacttactccaaagttgtggggttatattacaaggataagatataagtcctacctacaaggtagaaattaagaacagcagaaaagttaaataatatgattgttaatgaattttaaagtacctgtatgaataaattctactgag

SEQ ID NO: 39058 - DNA, 601 bp, Human
gatagattaaaagtttaatgtaaaataaaaggaaaaacttttagaaagctacagaaagaattagtaaaatctcccaatcaggttcgggaaaaactgttagtataaaaacaatataaaagtcacatacacaggaaaatttggctacataaaaataaaagtcttttgtatatgaaattcaatacaagtataagaaaatgttagaaatggtttgttaacaagtgagttaagtattaatatgcataaatatatattactgtttaatagagctctttcaaaattaaaaaaactactttattatttyttaaagtataaataatcaggcaaaaaaaatatactggtagtattactctaaaaaatcactaataaattaataatttacttctgatttgccattttttaaattaaatacttgcaaaaaagcaaaaaaatagttttgaatataggaagcaacctcatctattgttttgattactttgttattccccaggtatatattcagtttatatttaaagagctataggccaaataaactcagttttgcatgtttatttcaaaaaacaagttatgcttatatgaaacatttcatacattttatgttatt

SEQ ID NO: 39059 - DNA, 601 bp, Human
gagaaaaaccttgtatccatcccaatagttgaaaaaataattgataaaataaagcaattatttctgcctttaagttttaaaagcaggtgtgaacagagaaacatgccatgttatttgataagagattcaatacaacacagatgtaaatttttcctaaattaaccaatacttttaacataattctaattaaaccctaacaaggcttttggggaaggggagcttggggaggaaaaggattccaatgttgacttaaaagcatcaacaaatacaaggagctaaggcattctggaggaaaaaagarccacaatgaagaagaaatcctcctgtcagaaactggataataaagcaataaatattaaaacagtatggcactactataagaaatagataatggagcagaacaaagagctatgaaatagaccataatataaatataatgaatacaattgactaggtacctgaggaaaaaaatctggttggattcttaccttttgatgaaaataaattacagatagattaaaagtttaatgtaaaataaaaggaaaaacttttagaaagctacagaaagaattagtaaaatctcccaatcaggttcgggaaa

SEQ ID NO: 39060 - DNA, 601 bp, Human
tttgtctctattcacacttatcagggaatgggtctataatatgtacatctaaaggagtaaaccagactgtcagatgggcaagtgcaaattactttcacagtgtgcaagccccaaggagtggtatttttaagctgcccatctgtagtcttccaagtggcagaccagacaggtaggccattggcaacagcacaagagtcagtatgaatgtattatatttaaccaaggggtcagattttgttcagggagaggatgacggccttgagttctgcccactgagtagagtgaccacttcagcttttgsttttacaaggcttatgcctggtgaaatggtagcagaggcagcccgaagagcccaccagctgttaacttagctaaacgtcccagcagcctggcccaggcatttagggaaaccactgtgaactgagggcccttttgagccagtgaccttacttcaggtagtgaaatgggttatttagttcactcccaaaagagtagctgccactttttcacatatacctgataccatgctagggcccagaagctgggcttttgaatatataatttccatttgagcagggaggcttattgggtcccttttacc

SEQ ID NO: 39061 - DNA, 601 bp, Human
accacagacagaagaaaatacataaatgcaaaacctattagaataaaaaagcagaaaaaatttatcagtcatttctttaaaaaaagataaaaacctaatctggaaaaactgaaagaaaatgaaaactaaagaaaatctaggaaggagaaacatatctacagagaggaaaaaattaaaatatttatattactatacataacctatgtaaaaacataaattatatgcttaaataagaaaaaaaaaccattgaccaatattgataagatatcacaaacccaagagtatatgcctgaagttcacraaaggaaaaaaaaaattattaactttgccctacatagcggggggggggggggggaatgtttctgtcaggctgtagaattgttttaccctacttacaagctaataagttagcttttcattgtttcatggattctggcaaaagacagagatttctgagtcaaagagcttgattacttgtggcacagcaagcaacatgaacattagtatgtttacatgggttccccatgggcccacattccatagggagaagtatgatggacccacaagaattctacacaggcagtgggtatggatcacatct

SEQ ID NO: 39062 - DNA, 601 bp, Human
tgggaagcagaagttgcagtaagccaagactgcaccactgcactctagcctgggcactagagtgagaccttgtctcaaaaaaataaataaataaaacaaaataaaatatgagttatatatctgggggaaagtgacagcaatcattaccatcctaaatgagtataactttctcccagtggtcactctactttccaacatgtaaataaaactactgttaagaagaattttacgaaattgggacaatgagaatatcacatagtaaagaaaggcaacattgatgacctaaatatgttataattgaaaaaaaaaacaaaaaaaacacaaaaaaccaagtgtttagctcaaccacagacagaagaaaatacataaatgcaaaacctattagaataaaaaagcagaaaaaatttatcagtcatttctttaaaaaaagataaaaacctaatctggaaaaactgaaagaaaatgaaaactaaagaaaatctaggaaggagaaacatatctacagagaggaaaaaattaaaatatttatattactatacataacctatgtaaaaacataaattatatgcttaaataagaaaaaaaaaccattgaccaatat

SEQ ID NO: 39063 - DNA, 601 bp, Human
ttcgccttctgtcatggctgtaaggttcctgaggctctcaccagaagccaagcagatgttaatgccatgtttgtacagactgcagaaccataaaccaactaaacctcttttacttataaattacccagcctcaggtatttctttatagtaacacaaaaacagcctaacacataaaatcggtacataccagtaattttatttatttacatgtaagaacacaataactttgtgggagaaggatctaagataccctttatagtacaataaatgtttttttaagtatgtctgtatatgcatatakgcattaaaaaagaacatatactaaactgttagcagaattataggccattttccctttctactttgcatttttctaaagtatttgaattcttttataatgaccatatgggatttttttaactttaaacatacagctttccatttgggacaaaagtttaaagccacaaaaaagatggtcatattgatttgaagtggcatttggagagcagtccctgacactaaattttacagtatctccaaaaatatttacaaagactcagatacaaaaattcttaatgaagttgcaaactaaaaataactt

SEQ ID NO: 39064 - DNA, 601 bp, Human
cgctggagctgcccaaggcctagggagcccaccaggatgtacatcacgatgtgggacatggagtcaaggattacatgacagctttaagatttagtgcctgcctactgtgtttcagacttgcatggggcctgttactcttttcttttggccgatttctccctttggtaacgggaatgtttacccaatgcctgcaccatctctgtaccttggaagtaaataacttgttttgattttacaggctcataagtggaagcagatgagtctcagatggcacttaggacattggacttgatgttggaaygagttaagacatggggaagaaatgactgtaatttgcaatgtgagaaggacatgagattttgggggctaggaaaagaatgacatagtttgggtatttgtcccctccaaatcgcatgttgaaatgcaattcccaggggccccccttactctcttgctcatgctctcactatgtgacgtgcctgttccagcttcgccttctgtcatggctgtaaggttcctgaggctctcaccagaagccaagcagatgttaatgccatgtttgtacagactgcagaaccataaaccaactaaacctctttta

SEQ ID NO: 39065 - DNA, 601 bp, Human
gctgagtctgtaatcgacagtaccttccttcctgtacctatagacacataactttcaaaatttgcttttatgattatttcaggaactgcttggatatatcataggtagaaaaattatacctatagaggatggctggataagaggaaaatgatctttgaaaattaaataattatatttaaaagtagcaatttactgaattgactaaggtgttaaagagaattaatacaaattagcattggtaaaaattttagaagtagagtataaaacttcagctttctgaagacaattttgtagtatacaytttaatatacatgtacttacctagagattttagttctagaaatttaagaaaataaccaaggtaactatgcaaagatatatgtacaaggaagttcaattagatattgtttactgtaaactacctatatatacaccgcaaggagtggaataatgaaacttatttattcatttcattacggtatcactcactcaatatttttcagcatctactacatggtaggtgaactttttgggaactggagtaaaggtcacccttgttatgccttagcaaataacttggctgcattgtgcttatgcccta

SEQ ID NO: 39066 - DNA, 601 bp, Human
tgttgaaaactagaaaggcggccaggcgcggtggctcaggcctgaaatcccagcactttgggaggccgaggtgggcggatcatgaggtcaggatatcgagaccatcctggctaacatggtgaaaccctgtctgtaccaaaaatacaaaaaattagccgggcgtggtggcagacgcctgtagtcccagctactcgggaggctgaggcaggagaatggcatgaatccaggaggtggagcttgcagtgagccgagatcgcatcactgcactccagtctgggcaacagagcaagactccgtctcaaaaaaaaaaaaaaagaaagaaaactagaaaggctgccaataaaactatgctaggagataaatattgaggttgaatataaaaggaaaaattagaggaaatggaatagactttacacacaaaggtaagggctctctaccatttgctgagtctgtaatcgacagtaccttccttcctgtacctatagacacataactttcaaaatttgcttttatgattatttcaggaactgcttggatatatcataggtagaaaaattatacctatagaggatggctggataagaggaaaatgatctttgaa

SEQ ID NO: 39067 - DNA, 601 bp, Human
ggaggcagaggttgcagtgagctgagatcacaccactgcactccagcctgggtgacagagcaatgattccatctcaggaaaaaaaagaaaaagatgtgaagtctttagaagaaatgaaagaagtgaagacagcggtaggcaaaaggaacagcatatgctaagggatgaatgtaggagaggtcataaagacttcccatggagcccatgcataaaagcatccagggaacagaaaattattctaaatagtaagtagtttagtgtttcaggcaagaggacacaaattagagagggctgaaggacmgtaaaaaggcagtaagaaatcagattgtgaaaagctttgtttgctatgttctgaatttttgagagaggttatagggagccactaaaggatttaaccagtggaatcacaaagtcagattttcaacatcagaagttcatttggaaagtactgtggagattagattgattaatctgttttgaggggtggtgagattaagggcactgaagacctaagatcagagagatggctagttaaaggtctgatacatgtatacagagaaaaaaagaactgcactaaggagtggcaactagaattgacagg

SEQ ID NO: 39068 - DNA, 601 bp, Human
aaaccaaaaaacaacaaaaatattttcagactgggaaaagaacatgtaatcaaaaattagaagaacttggccaggtgcggcagctcatgcctgtaatcccagcactttgggaggccgaggtgggtaaatcacttgagctcacgagttcaagaccagcctgaccaacacagtgaaaccttgtctctactaaaaatacaaaaattagccaggtgtggtggtgtgcgcctgcagtcccagctacttgggaggcaggagagtggcttgagcctgggaggtggaggttgcagtggactgagatcgygccactgcactccagcctgggtgacagagtaagactgtgtctaaaaaaaaaaaaaaaaattagaactcacaatgaaatgaaattccattcgttttaccttgtttttccttcatggaccagattaatacatatatatgcatgtgtacaggctaacattcctaagtgtgagctatcttttttaacatgcttgattaaatacttagcaactataataaagtgctttatagattagttaatagtcaagttctatttcataatcagaaataagccaaaaggcctgtaacaaatgctgggtttagc

SEQ ID NO: 39069 - DNA, 601 bp, Human
gattttaaaaatagtatgagtggttattaattaaagttctgggaaatgaacacatttcacattctggggtgagtgtccatgttagtacaattttatgagggtagtttacaagtatgaatcaaaaatttcaagaagcacatatactttatcaactattttcctgaaatttgtgctaaggaaaatctgcaatacacacaaactggtacacaaaaaaaaaattaaatgaaaaagtagggaaagaatttaaagtcctgttctatgggactgtttcaataaatgatggactatccacaagatgtgraaaaaacagctacacactatggttctactgtgcaaaacaatatgttgtgtatgcatttatttgatgctataaaaatattcacagaaagactggaaaaacatactgtacaccaaaacattatgagttatctctttaattgtgaaattagtgattatttttaaatgtgcttttctgctttctgtagctttttgacattagccatgtgttacttctgtaataaataaaaacaatcgtatgtgtgtgtgtttgtactttctacataaaagaaaggtgaagcatatggcaaaacagtatatcaaa

SEQ ID NO: 39070 - DNA, 601 bp, Human
attctataaatgaactttatttatgggacaaataatttattctgggtaaaaggagaaaaacatgcatatttaacagttaccaaccataggtatcgaaagtcttaaatttcaaattttctagttatcccagggataccaccagagtttcagaaataaaatcccactctcaatgtaaacataacagttgtatctaatgaaaaaaacttccatctttaagattaatatgaaaataaacttcgacagtaagtaattcaatatgtggcaaaggtttcagaattttttataaagagctgttataatyagtaaaaaaagataaacacagcaagaacaaatgagcacaagttaggaataagcaatttactcaagaagaaattccaaggccaataaacatgaaaaaaagttaatccttgcaataatagactgccaatagttgactttcttggagacaaattataaaattggttcaatccagtgaattaaatacacttttttaaaaaaagaaacaacatttcatttattaaactgaaaaagattttaaaaatagtatgagtggttattaattaaagttctgggaaatgaacacatttcacattctggggtg

SEQ ID NO: 39071 - DNA, 601 bp, Human
gtttccagcttcatccatgtccctgcaaaggacatgaacttatccttttttatggatgcagagtattctatggtgtatatgtgccacattttctttatccagtctatcattgatggacatttgggttggttcgaagtctttgctattgtgaatagtgctacaatcaacatacgtgtgcatgtgtctttatagtagaatgatttataatcctttgggtatacacccagtaatgggcattgctgggtcaaatggtatttctggttctagatccttgaggaattgccacactgtcttccacaayggttgaactcatctacacacacaccaacagtgtaaaagccttcctatttctccacatcccctccagcatctgtcgtttcctttttaatgattgtcattctaactggtgtgagatggtgtctcattgaaaacacgtattttcaatagtcaatagacaagcctttgaaaagtgaaataaaaaatacagaatatacataaatatggtaatcttatagttacgaataaatatatatagtacagtgtcaatatcttacaggtttactacaatgtgggatcatgttttgaaaacaaatcaaaattg

SEQ ID NO: 39072 - DNA, 601 bp, Human
attttttagttaacctgggaacctaccagagtagaaatgttctaaaaaactgaaatcatggctttacatcactcactctttcaattttttcaatttgtttattaaaaacatttttttagagacagagtctcactcttctacccagcaggactgcagtggcatgatcacaactcactgtagtctcgggttcctgggctcaagtgattctcctgcctcagcctctcaattagataggactacaggtacacaccaccacatccagctaatttttcaattttcttctagagatggagtcttcctrtgttgcccgggttggtctaaaactcctggcctcaagtgaccctcctactgccacctcccaaagtgctgaaattataggtgcgagccattgcacccagcctattcactcttgaagagtttataattcacttataatttaaagacagcagaagtgttcaaaatacagttcctatggactgtattcaacttgataattcctaaacatgactagcttttacaaattttataaatagaattaaaaaattaaaagattgttaatgcaaagttctgctttaaggaaaactcaagtagaaaggtgtac

SEQ ID NO: 39073 - DNA, 601 bp, Human
atgtcagaaaagattggctgattaaatgctcatatagtccacagtataaaaatagaagaacccagactgttttaataatcaaaaaagcacaaattactatttccttttttgtatgaatattgaagatccaaagtcagaaacagtgatattagttgggtaaatgttttaaaaaaggaattcaaacaaaccttttgattttcctttatttcttctctcatatgttgatttacagcaattctggttagagatctggaaaaatgaatactaatataattgatccttccttaaatgtttagaactsatctatataacccaatgtaatctaatactttggataagaagctaaaaactccaaatcctttgtgactgaaaagtatacatttccatatggcctaatttagctttcatttgacaaaagtatttggttcaagtggaatggaggttctcaaaatttcatgtgtactagctgtatgcagtatggattgtcatcatttactatgacttattttttgaaaacacttcattgaaaaagctgttttgcgttattttgcccaatagagaaattttgtatgaaattaccaatgtataagtacatgaatat

SEQ ID NO: 39074 - DNA, 601 bp, Human
tccaatatattttccaacgtatttccaaactggtaagaatttaaataaacaattcaaataatttcacttcaacaaaagtatattcaattgaattaaaactgaacatctgaattaaagtatcatgtatcctaagttcatctaatgtttcaaatattaattttaatgtagttttatgtttctctataaaagtaactcttctgtttggcccacaactgtaattttgggtgagtgaccattgataaagcaaggacttcctaattctgtcctgttcaaaattctgagcaaaaaaattttgaagaattttttttttttttttgacaagaaaccagatagcatccagcattcaaatacaagcattttaaattcctcttgtcaatttctgtcttctggggaaataccccatgttgacttcagtccttatctggtatctggttgttcagtccagttccaaataacttctctgcaaatcatcaatctactcttcaataaaagacagtttagaataacaaagtaattataggtctaaccctcatccaaacaaatatcttgactgtttctcccagttctgatattctaagacactttgggcttgcccattttg

SEQ ID NO: 39075 - DNA, 601 bp, Human
gaagaatgtcgaatatctaatacataagtatattcccaaatgtgtgaatttaattttaaaaatttgctcatatcttccccattgatcccaagattgcgaaggccattcatcatttttccttctaatttcagcatatccaaaatactatatattcaaagaaaaaacagttttattttgattttccaaattaaaaacaaatgttttaaagtttgatagtcttaaagcattagaaatgagattttttggtatcttcattaatagcaggaaaaatatattaaactcattaagaaataaggcaaayagttctaattagttatccagagtaaacttacataattttagtggtagtaaaaacttattattatataaaagataaaacaacaaagactattgtattctttatcaaagtagtgaggatatgatcagccctgagaaagccaaaaatgagaaaaaaaatattaggtcactcttttgacaaacctactacaaaaataatgtaagatcgaacaagacataaagtataaaattctaatacagaggaagctccattaaatcatgaagttcacgtgtgtttgaatacaaatttaaattttttattaca

SEQ ID NO: 39076 - DNA, 601 bp, Human
aagatgaacaaggactgttataattacctcttgaatcacaataaaccattatttagaaacgttattagactacaatatctagatggagagaatgtattaatagacagagaaaaggagaattttatcacttcaaaagtttgaatgtaatgcctattcaccaaaatccacatagctactggattcctataaaatatcactctctctccctctagtgctaacattatcaaatggccatgttcttttgtacaaaaagggtaaatatactctttttatttttttttttttttgagacaagagtctygctctgtcacccaggctggagtgcagtggcacaatccaggctcactgaaacctccgcctcccaggttcaagtgattctcctgcctcagcctccaggtagctgggactataggtgcgcaccaccacgccttgctaatttttgaatttttagtagagacggggtttcatcatattggccaggctggtcttgaacccctgacctcgtgatctgcctgattcggcctcccaaacccaaagtgctgggattacaagcatatgaagctggacctttctataagtttccagagtgatcagattattc

SEQ ID NO: 39077 - DNA, 601 bp, Human
ggaaaaagaagatgaacaaggactgttataattacctcttgaatcacaataaaccattatttagaaacgttattagactacaatatctagatggagagaatgtattaatagacagagaaaaggagaattttatcacttcaaaagtttgaatgtaatgcctattcaccaaaatccacatagctactggattcctataaaatatcactctctctccctctagtgctaacattatcaaatggccatgttcttttgtacaaaaagggtaaatatactctttttatttttttttttttttgagacaagagtctcgctctgtcacccaggctggagtgcagtggcacaatccaggctcactgaaacctccgcctcccaggttcaagtgattctcctgcctcagcctccaggtagctgggactataggtgcgcaccaccacgccttgctaatttttgaatttttagtagagacggggtttcatcatattggccaggctggtcttgaacccctgacctcgtgatctgcctgattcggcctcccaaacccaaagtgctgggattacaagcatatgaagctggacctttctataagtttccagagtgatca

SEQ ID NO: 39078 - DNA, 601 bp, Human
aaatcacatttagtgcataaactcacgtgtactatagaaataaatgcttctgatatatcaaattcttctgcaatatagttgaaagctcgccagagagcaactccagcatcatttgctccatcaacttcatcatctgtattaagaatgaacacaaaaccaattctggaaaaagaagatgaacaaggactgttataattacctcttgaatcacaataaaccattatttagaaacgttattagactacaatatctagatggagagaatgtattaatagacagagaaaaggagaattttatcacytcaaaagtttgaatgtaatgcctattcaccaaaatccacatagctactggattcctataaaatatcactctctctccctctagtgctaacattatcaaatggccatgttcttttgtacaaaaagggtaaatatactctttttatttttttttttttttgagacaagagtctcgctctgtcacccaggctggagtgcagtggcacaatccaggctcactgaaacctccgcctcccaggttcaagtgattctcctgcctcagcctccaggtagctgggactataggtgcgcaccaccacgcc

SEQ ID NO: 39079 - DNA, 601 bp, Human
catctgtattaatctccatgacagtttataaactttgaaatgttacaataaatgtaatgcaaaaattatacattctaaagaaatcataatatagtaatgcaagaattttaccttctaaacaaatcacatttagtgcataaactcacgtgtactatagaaataaatgcttctgatatatcaaattcttctgcaatatagttgaaagctcgccagagagcaactccagcatcatttgctccatcaacttcatcatctgtattaagaatgaacacaaaaccaattctggaaaaagaagatgaayaaggactgttataattacctcttgaatcacaataaaccattatttagaaacgttattagactacaatatctagatggagagaatgtattaatagacagagaaaaggagaattttatcacttcaaaagtttgaatgtaatgcctattcaccaaaatccacatagctactggattcctataaaatatcactctctctccctctagtgctaacattatcaaatggccatgttcttttgtacaaaaagggtaaatatactctttttatttttttttttttttgagacaagagtctcgctctgtc

SEQ ID NO: 39080 - DNA, 601 bp, Human
aaacaaattcatcatctgtattaatctccatgacagtttataaactttgaaatgttacaataaatgtaatgcaaaaattatacattctaaagaaatcataatatagtaatgcaagaattttaccttctaaacaaatcacatttagtgcataaactcacgtgtactatagaaataaatgcttctgatatatcaaattcttctgcaatatagttgaaagctcgccagagagcaactccagcatcatttgctccatcaacttcatcatctgtattaagaatgaacacaaaaccaattctggaamaagaagatgaacaaggactgttataattacctcttgaatcacaataaaccattatttagaaacgttattagactacaatatctagatggagagaatgtattaatagacagagaaaaggagaattttatcacttcaaaagtttgaatgtaatgcctattcaccaaaatccacatagctactggattcctataaaatatcactctctctccctctagtgctaacattatcaaatggccatgttcttttgtacaaaaagggtaaatatactctttttatttttttttttttttgagacaagag

SEQ ID NO: 39081 - DNA, 601 bp, Human
aataatcattttctattaatatgttttcctctaaagttacatataaaatttaaattactttattggctgagtaaaccttagtaaattcaaatatcttggtagaacctcagttgcctaatttataatgtgaggataatatgtacttcagaagggagttacagaaaacaaattcatcatctgtattaatctccatgacagtttataaactttgaaatgttacaataaatgtaatgcaaaaattatacattctaaagaaatcataatatagtaatgcaagaattttaccttctaaacaaatcayatttagtgcataaactcacgtgtactatagaaataaatgcttctgatatatcaaattcttctgcaatatagttgaaagctcgccagagagcaactccagcatcatttgctccatcaacttcatcatctgtattaagaatgaacacaaaaccaattctggaaaaagaagatgaacaaggactgttataattacctcttgaatcacaataaaccattatttagaaacgttattagactacaatatctagatggagagaatgtattaatagacagagaaaaggagaattttatcacttcaaaa

SEQ ID NO: 39082 - DNA, 601 bp, Human
tgtggtttcaagtataatttgtttttccaggagattatatattaacagtattgtgctgaacactgtagattaatgccatcacatgtaaattaatgtctgataaaaaacacttacaaaacagagattcaatattgataattaagataacttaggtaaagataatttctgaatatcttcaggtttctaagttttgaatatcataatgatcctttacaataaaatggctgaatcttgaatcttaataaaagatgtaactcaaattgactatgtcccttataaactcttacaccagtaagttagtaaaacaaataagctgagacataatattgatgcatattccatggcactattttatagagcaaactgtacccctgccaaatcactgaagtgtagtttctatactctagctcagtgaattaataaggtatttaatgattttcctgggagttacagaagtagggtaggaaatttgcactactttggaaattcctttctcagttggaagaagagtcattccttgatataatattgattgacaagctaaagcccaatgaatataaaaatgaaaaaaaacttctattttataagctatgacttattt

SEQ ID NO: 39083 - DNA, 601 bp, Human
gagcttttcattcatttaggtaaactttcatggctataattccaaattttctccacaaaactgaccttccccccagcccccaggtttcctaagtatcttttatttgcttgctcttgtcattgtaaatgtaggagtcattacagaaagtactctcatgaggataaggattgttggctatatatgttattaatttatccaagcacctaaaacagggtgtggtatgtagtaggcatttaataaaactgatgaaaataattaataaatatttgttgttagaagagagaaaagcaactgatattartatactgatctcatatccagttactttactaacctcctgtgtcaaatctcacaatcaatggattcttttgagtctcctctgtaggcaagtctggaattttaaataaaaatttgtttcttttaaatattttaaatgagtatttcctttacttatcttattgcattgactggaacttgaggattatacttgaagtgttgacagtgggtaccttatctttttccatttttaaaaacaatgctttctatcattttactgctaagatgtgctgtcatcaattaacaaaattcccttacataatag

SEQ ID NO: 39084 - DNA, 601 bp, Human
cccaaaattccactttggtcggaaatgcaatgaatttagaaatcacttgcagaaaacaatataattatgaagtgaaatatttctattgataaacatggtagagcttttcattcatttaggtaaactttcatggctataattccaaattttctccacaaaactgaccttccccccagcccccaggtttcctaagtatcttttatttgcttgctcttgtcattgtaaatgtaggagtcattacagaaagtactctcatgaggataaggattgttggctatatatgttattaatttatccaagyacctaaaacagggtgtggtatgtagtaggcatttaataaaactgatgaaaataattaataaatatttgttgttagaagagagaaaagcaactgatattagtatactgatctcatatccagttactttactaacctcctgtgtcaaatctcacaatcaatggattcttttgagtctcctctgtaggcaagtctggaattttaaataaaaatttgtttcttttaaatattttaaatgagtatttcctttacttatcttattgcattgactggaacttgaggattatacttgaagtgttgaca

SEQ ID NO: 39085 - DNA, 601 bp, Human
ctttttgaattctagagttttatgcgaatacgtattcccatacttagttttgtttgcttctgagctttaagaagtatatggtatggtgttagtcttctatgacttcattatgtttctaatacatctatgctcttgcatatgatatttcattctaatatgccaaattctacttatctattttgctactgatatgtatatatgtgtatatttatcatagtttgttgctattctgaatgattctgctaacaatagcctcctaaggtgcaggtacaagagcttctcttagggtgagggggtgtgtgtgtgtgtgtgtgtgtgtgtgtgtgtgtgtgtgtgtgtgttgtctgtaggaaatgtggaaatttaacttcaaatagtgaattattatcagattgtttttcagtgtggctctgccagtttagattcctacaggcagggtagcaatgtaaatgtaaaggcattccattgctctacattctcattaacaaatgataccttcagctttcttaattcctgccaaattacagggtataaaataatcttgtggtcgtagtctttatttgcatttttcaaatttgtaagataattatcttgtttagtt

SEQ ID NO: 39086 - DNA, 601 bp, Human
tcctttttgaattctagagttttatgcgaatacgtattcccatacttagttttgtttgcttctgagctttaagaagtatatggtatggtgttagtcttctatgacttcattatgtttctaatacatctatgctcttgcatatgatatttcattctaatatgccaaattctacttatctattttgctactgatatgtatatatgtgtatatttatcatagtttgttgctattctgaatgattctgctaacaatagcctcctaaggtgcaggtacaagagcttctcttagggtgagggggtgtgtgtgtgtgtgtgtgtgtgtgtgtgtgtgtgtgtgtgtgtgttgtctgtaggaaatgtggaaatttaacttcaaatagtgaattattatcagattgtttttcagtgtggctctgccagtttagattcctacaggcagggtagcaatgtaaatgtaaaggcattccattgctctacattctcattaacaaatgataccttcagctttcttaattcctgccaaattacagggtataaaataatcttgtggtcgtagtctttatttgcatttttcaaatttgtaagataattatcttgtttag

SEQ ID NO: 39087 - DNA, 601 bp, Human
aatgccatgaagtacaacttctctcccaatcccatttccttgtgcttcaggagatgcaagcattgttttgaatttgcatttatcattccctttcctttttgaattctagagttttatgcgaatacgtattcccatacttagttttgtttgcttctgagctttaagaagtatatggtatggtgttagtcttctatgacttcattatgtttctaatacatctatgctcttgcatatgatatttcattctaatatgccaaattctacttatctattttgctactgatatgtatatatgtgtatwtttatcatagtttgttgctattctgaatgattctgctaacaatagcctcctaaggtgcaggtacaagagcttctcttagggtgagggggtgtgtgtgtgtgtgtgtgtgtgtgtgtgtgtgtgtgtgtgtgtgttgtctgtaggaaatgtggaaatttaacttcaaatagtgaattattatcagattgtttttcagtgtggctctgccagtttagattcctacaggcagggtagcaatgtaaatgtaaaggcattccattgctctacattctcattaacaaatgataccttcagctttct

SEQ ID NO: 39088 - DNA, 601 bp, Human
ccaatgccatgaagtacaacttctctcccaatcccatttccttgtgcttcaggagatgcaagcattgttttgaatttgcatttatcattccctttcctttttgaattctagagttttatgcgaatacgtattcccatacttagttttgtttgcttctgagctttaagaagtatatggtatggtgttagtcttctatgacttcattatgtttctaatacatctatgctcttgcatatgatatttcattctaatatgccaaattctacttatctattttgctactgatatgtatatatgtgtctatttatcatagtttgttgctattctgaatgattctgctaacaatagcctcctaaggtgcaggtacaagagcttctcttagggtgagggggtgtgtgtgtgtgtgtgtgtgtgtgtgtgtgtgtgtgtgtgtgtgttgtctgtaggaaatgtggaaatttaacttcaaatagtgaattattatcagattgtttttcagtgtggctctgccagtttagattcctacaggcagggtagcaatgtaaatgtaaaggcattccattgctctacattctcattaacaaatgataccttcagcttt

SEQ ID NO: 39089 - DNA, 601 bp, Human
acatcaccaatgccatgaagtacaacttctctcccaatcccatttccttgtgcttcaggagatgcaagcattgttttgaatttgcatttatcattccctttcctttttgaattctagagttttatgcgaatacgtattcccatacttagttttgtttgcttctgagctttaagaagtatatggtatggtgttagtcttctatgacttcattatgtttctaatacatctatgctcttgcatatgatatttcattctaatatgccaaattctacttatctattttgctactgatatgtatatwtgtgtatatttatcatagtttgttgctattctgaatgattctgctaacaatagcctcctaaggtgcaggtacaagagcttctcttagggtgagggggtgtgtgtgtgtgtgtgtgtgtgtgtgtgtgtgtgtgtgtgtgtgttgtctgtaggaaatgtggaaatttaacttcaaatagtgaattattatcagattgtttttcagtgtggctctgccagtttagattcctacaggcagggtagcaatgtaaatgtaaaggcattccattgctctacattctcattaacaaatgataccttc

SEQ ID NO: 39090 - DNA, 601 bp, Human
cataagttactcagacatatcaactcaatcctcttacacatttttaaattttaaaaattattttgtaacttggtaagcaaagaggaatacacataacatacacattatgaggcataaataacaaaataaacaattcttatgaataaaccacgtaacataagaaatggaacatcaccaatgccatgaagtacaacttctctcccaatcccatttccttgtgcttcaggagatgcaagcattgttttgaatttgcatttatcattccctttcctttttgaattctagagttttatgcgaatamgtattcccatacttagttttgtttgcttctgagctttaagaagtatatggtatggtgttagtcttctatgacttcattatgtttctaatacatctatgctcttgcatatgatatttcattctaatatgccaaattctacttatctattttgctactgatatgtatatatgtgtatatttatcatagtttgttgctattctgaatgattctgctaacaatagcctcctaaggtgcaggtacaagagcttctcttagggtgagggggtgtgtgtgtgtgtgtgtgtgtgtgtgtgtgtgtgt

SEQ ID NO: 39091 - DNA, 601 bp, Human
ctgggtagctgggactacaggaacttgccaccacacctggctagattttttggtattttttgtaaagatggggtcttgccatgttgcttaggctggtatcgaattcctgggctcaagcaatccacctcctgcggcctcccgaagggcttggcttacaggaacttgccaccacatctggataaatttttttgtattttttgtaaagacagggtcttgccatgttgctcaggctggtctcaaacacctgggctcaagcaatctacctgcctcggcctcccaaatagttgagactacaggcatragccaccatgccaggccttactagtaagtattttgactaaactttctctgcacctctactcttccccagtctcaaatattctaaacacacttgtagaatgtaagctgttattctttttatcttttctcatttctttctttaataagtacttagagatcctctatgacccaggtgctgttttaggttttgcaccaagagagatggcatctcttgagtagacgactaagctgagacataagtatgaacactcagctagcattaagacattctggggaaagaaacttataagcagaaggaaca

SEQ ID NO: 39092 - DNA, 601 bp, Human
ttaccttttttaatgtatgtataatatattctaatatgacatttcagaaatgctttcattttttattgcttttctgtaatttttttctttttcttttttttttttttttttgagacagggtcttaccattgactaggctggaatgcagtggtgtgatcatggctcactgcagcttcaacctcccagctcaagcaatcctcccacctagccccctgggtagctgggactacaggaacttgccaccacacctggctagattttttggtattttttgtaaagatggggtcttgccatgttgctyaggctggtatcgaattcctgggctcaagcaatccacctcctgcggcctcccgaagggcttggcttacaggaacttgccaccacatctggataaatttttttgtattttttgtaaagacagggtcttgccatgttgctcaggctggtctcaaacacctgggctcaagcaatctacctgcctcggcctcccaaatagttgagactacaggcatgagccaccatgccaggccttactagtaagtattttgactaaactttctctgcacctctactcttccccagtctcaaatattctaaacac

SEQ ID NO: 39093 - DNA, 601 bp, Human
cttacctttctttcttcatcatatttagaatgaattcccaaaatatcccaaatattagcatgaggaaatgtattttggagaacactcttcacattgtccacagtgagtatattttgatccttcttcactttttggtacatctgtgaaaatttagatattataattaattttcttcttatagcaattagttttcttttttttccttagcatgcagatagatttttattttgtaagttcaaaatatactaactacacatacacacataccacataaaaataattttaaccatatatcatcttytaataaagatggttttaaaatattctatagttttcaaaaatatcataacaaatttatgttttactctattttgatgaaaccagacaccattattcttaataaaataatgattaccttttttaatgtatgtataatatattctaatatgacatttcagaaatgctttcattttttattgcttttctgtaatttttttctttttcttttttttttttttttttgagacagggtcttaccattgactaggctggaatgcagtggtgtgatcatggctcactgcagcttcaacctcccagctca

SEQ ID NO: 39094 - DNA, 601 bp, Human
gcaacatcagcttctctcaattcctttacatctcagaacacaatatttttctgactggaatgttaatctcttacaacccccttgttttcttttgtctaacttttcctcctgcttcaggattctgcttaaatatcacttcttcagaaaagtattccttatccccataccccagagcattcctctttcattcaatgtgttgcgtatttggtgagtcccttctaatgaaggctcctatacattaatttttggaatttctttgtactatttctctttctctgaaaatttctttgagttgttgcctttttttttttttttttggctctttccgaatcttctgggttgagtctctaattgttcaccttttaaaaaatgacaagtaaaaaatatatatgtttatgatatatgacattttgatattaatatacattgtggaatagctaataaagctaattatcatatgcattacctcatatacttctcatattttgtggtgagaatccttaaaatgtacttagtaatttcaagtataaaatatgtcattaactacagtcaccaccatgtacaatagatctcttgaacttatttctctagtctaactgaa

SEQ ID NO: 39095 - DNA, 601 bp, Human
aaattttagctcccacatttcccacatgttgtggggggacccagtgggaggtaatgaaatcatgagggcagatctttcccatgctattctcgtgacagtgaatatgtctcatgagatctgctggttttataagggggaatttccctgcacaagttctcttctcttgtctgccatcatgtgagacatgcctttcaccttctgccatgattgtgaggtttccccagccacgtggaactgtaagtccattaaaccactttcttttctaaattgcccagtctcaggtatgtctttatcagcagcrtgaaaatggactaatacagcagtgtttacagggtgtgaaatatgggggacagctgtcagatacggagttagagaggggtgtaggcagaggccagatcatgaaggtcctcaacatttgaattttagcttatgagttaaaaagtgactaaataactcatttgctatccaatactaagtattatcattattatagccaacattctcacaaatactctaggaagccaagtactactattacatcaattttacagatgataaaacagatacagagagattaaatcacttcttatgttacacagct

SEQ ID NO: 39096 - DNA, 601 bp, Human
ctgtatttatatgttcaataaacacttattcaatcctgccacctgcattaggctagatactgtgattatagagctgaaagtcttttctcaaggggttcacatacagacagacaaaacacaggcatgtagaagactctatggggcccaggagaagcacctaatcaagctggagtatggagaggaagggatcatacaggtcttcttttagggagtcatactaaaaatcttaaaggcttaataaaaatttgccagagagataaaatagagaaagacagtccaagtgaggagaatatagcaaggraagtaagagtgtggtatacttatgcaatggtaaattcacagttgatatggtttggctgtgtccccacccaattcttatcttaaattttagctcccacatttcccacatgttgtggggggacccagtgggaggtaatgaaatcatgagggcagatctttcccatgctattctcgtgacagtgaatatgtctcatgagatctgctggttttataagggggaatttccctgcacaagttctcttctcttgtctgccatcatgtgagacatgcctttcaccttctgccatgattgtgaggtttc

SEQ ID NO: 39097 - DNA, 601 bp, Human
ataggaaaaaacatccattttgctaactttatctgtcctttccaaacattgcctaaaggaaagtaatttacctacaaggagtcaaaaaactttttatgtaaagggccagagagtaaatattttaggctttgtgagccactcagtttctgacatagtgactccactctcgttacagcacaaaagcagtcatagacgacatatgaataaacaagtatggctgtgtccccaaaatatttacaaaaacaagcagtgggtggacttgctgattcttggtatagagtatgacattaacttaataaamatccaaacatttatcggcatcagagacttatttatccctgtatttatatgttcaataaacacttattcaatcctgccacctgcattaggctagatactgtgattatagagctgaaagtcttttctcaaggggttcacatacagacagacaaaacacaggcatgtagaagactctatggggcccaggagaagcacctaatcaagctggagtatggagaggaagggatcatacaggtcttcttttagggagtcatactaaaaatcttaaaggcttaataaaaatttgccagagagataaaat

SEQ ID NO: 39098 - DNA, 601 bp, Human
ttgaaatctaggcctctactcaaaaatagcaacatattaaaatttattatacaactgccttatgaacattacaagtttctatcactttaagaattcaggtaaataaaatatgcttattaccgtcttgggttaaataatacatgttctttgcaattacagcactcttatcttgtgaatccaagaaaaagaaagtagagaaatcttcaacatcagcagttactgaaaaatttcaaattaaacgttaaatataaataaagaattcacaactcaataaacatttgtagaacagtataggattatyttacctgatgtagatattaaattgaggtactgctggttagtacgcaaaatcaaagtatttatacggggtacaacattattcctatccattagaaaatcaattgcattcgtgcgatcatttaatgtgccctaaaaaaacaaaaatgttatttagataatacaggcaatttatatccatgtttcaaaaagtatgcagataacacaaagattacttaatcaaaaataaataagcaatttagaattattacaatacattttctttcttttttttttttttttttattcttcagtttggtaaaca

SEQ ID NO: 39099 - DNA, 601 bp, Human
tcactgttagaaaattaccacttccctactgagaccaaaatcagccttctttaatcttttactcattggctcttgtttttatttctagagcaaagcaggccaaacaaaacaaagcaaagcaaaacaaaaaccaccaaattcgaattatattcatctatctgaatagttaattgtaccctaacaaatctacggtcccactgcagacttctcagtttggctaaatcctttttcccaagtgtgttactatcttggtctcctctcttctggttgtaacccctaccttaagcaaaatatctgcatrttatttaatcagaatgcagaagaattattatcttctctgatctggtaattgtacttttctgtatacattataagatagtttacatagtactgaaaagattttattcttttcttaaaaaggtgaaaatagtttgtttaaaaaaggcaaaaataagataaacaaagttagaatagaaggcattgttttctcagcacacgttaaatactaaaaaatttacaaactctaaaattgaaatctaggcctctactcaaaaatagcaacatattaaaatttattatacaactgccttatgaacattac

SEQ ID NO: 39100 - DNA, 601 bp, Human
taagtacatatcctaactagaatgccatcaactttaagaatcatgaagtagttaatgaaacatatgaaatctgatttattaaatgcctctgtgcagagtcatatcatttaatgtttatcttttcccatttgaaaaggaatgtttattatcttcatttgtttaaatctaccattgtttttcagtaacaatatctccaaatacactcacacttttaaaatatgcaatacatacatatttaatatttcaaatagctactgacctcaataaggaatgttttaattttatctccagagtaaatagytgtagcaatttcttcctttgccagttgcccaagaaagcttctcaaaaacatgttcttctgtgtaagaaaagctgccaaaattcctctagaaatagctgtgttctcttcatttatttttgatgtaggattataaataatccccaaccgactatgaacacttgttttctgcaaacatatttatagattaaaaagaccagtatcatacatatcattttacaggtgaatatattttctttcccatccagtttgttcactgtatcatgcaccatctttcactatcaaagccctcccatgtttact

SEQ ID NO: 39101 - DNA, 601 bp, Human
tcaggtattttgttacagcagcacaaaacagattaagacaaaacgtgtccctcaaaacccatgtgttgaaacttagtggccagtgcgatagcactgagaggtgtggcctttgggagatgattaagccacgagggctctgccctcatgaatggaatttgtatccttataataaaagagttcaagactgaagggagcactctgttgcccttctactttccaccatgtaaaaacagagcaacaaggagccatcctggaagcagagagcagccctcaccagacatccatggcagcacgtcagccytacatttccaagcatccagaagtataagaaataaatttatgttctttataaattagccagtctgtggcatatttttatagcagcataaacatacttaagatagatgccttatcagtaagggtgctgtttgttgtctctctctatccatcaaaatattagccccatgaaaacgtagttgtttactgctgtgccttcagaatctagaagaatgtttggttcacagtaggtgtaagattaatatcttaatatttttatcaattttaaggaaagtcaggacaaaacatagttttatgtttatga

SEQ ID NO: 39102 - DNA, 601 bp, Human
agtctcaggtattttgttacagcagcacaaaacagattaagacaaaacgtgtccctcaaaacccatgtgttgaaacttagtggccagtgcgatagcactgagaggtgtggcctttgggagatgattaagccacgagggctctgccctcatgaatggaatttgtatccttataataaaagagttcaagactgaagggagcactctgttgcccttctactttccaccatgtaaaaacagagcaacaaggagccatcctggaagcagagagcagccctcaccagacatccatggcagcacgtcrgccttacatttccaagcatccagaagtataagaaataaatttatgttctttataaattagccagtctgtggcatatttttatagcagcataaacatacttaagatagatgccttatcagtaagggtgctgtttgttgtctctctctatccatcaaaatattagccccatgaaaacgtagttgtttactgctgtgccttcagaatctagaagaatgtttggttcacagtaggtgtaagattaatatcttaatatttttatcaattttaaggaaagtcaggacaaaacatagttttatgttt

SEQ ID NO: 39103 - DNA, 601 bp, Human
aaacagttgaatcttatctatactacctctagcgacaggggcagttttgttagtaacattagaataaggaaataaaatcttaaaagtattgtcttaaggggttaactacattggctatctttactgattaaatttaccagaaaactggctgtattttgcttacattaagcacagcatcaaacaggagaaacctaatgtttctgtgtcttggttctatttaaagctgaaaatttgtggaataaagtaacttaaatagcataaaatcacataatgtccaagttgggtaaaagaacaataaacytgaaaattatgttgcttaaatcttcttcataacatttgagaaatgtgatttttcagttacatagaataattgctgtaacagaaatgcattacttcatttgacaggtcatgaaaattgcagaaaactctgtcagattttcatccacatactgagctaaaaatgtctctctactcacagaagtttgatcaactagttttgattttatgctaacttttagctagtgtaacacaaattaagtctacaaatgcccattatttttcatgatgcccttcaaatattgagagaaaatagcagttaata

SEQ ID NO: 39104 - DNA, 601 bp, Human
gtaatactgataattcataaattcaaatgtaaagtgacctgaagtatttgcccatcactgtggcatactgtattatcctaattatcaatttccaaaggttcactgacattttctaaaattcaataacagagtgtgactttaatgtagaaatttacatataaatttaaccgtatttatattattatctcccttgataggaaagaatgctctttgacagacaaaaaatggtatttctagagaaaattactaaaggtgataactgtaagacacttgagtgagctcagggaatcttcagtagtatttttttaaaaagcagtttagctacttttacaattaacgaggcactctcatagagaatatgggcatagaaatcacatatgatagtgattaaacagccttttatttccatcctaccacaggagcctgacagagtaaatccttggacccttggtccacgcagcagctttataatgtgtcaacttgaccaggctaaatcatattttccagaatgtttcttgcttgggcgggcaacaacagagattctcaggagatctagagaacagagaggcagcagcagcaattttgcagctcacacacttgc

SEQ ID NO: 39105 - DNA, 601 bp, Human
gtaggatgaattaattatacattttacatattacaaaggaaaaaggttaccaaatcaagaggtacatgtgtagttacaggaatattagtttctttggtaggaaaaggcttctgcagtgaggggattaattgctcagcaatttttaaaaagctaatataaacacttacttcaaatatgggtcatctaaatagaaaactgcaagacattttattttctaggcagttgacgatttaattatcttaaaataagaggggcatagtcagacaacagaccttaatggataattattgctagacctaaragccacaaatcagacgttctgctattaaagtgactcttgacaattgttgcttcctgtagttaccttggtgaacactttacaaattactaccctactttgtaacaccactcaaaactggtcattttatgtatgctgtatgagatgtaattatggtttcagcatgcacctgtttactgctgcttttttctcccagactgctaattctatgaagttgtatgaagcagaattccatagtccccaccatctgattatacatgtacaagacagttctgagtagaatcctgagcccactagtagata

SEQ ID NO: 39106 - DNA, 601 bp, Human
tgaataaatataaatccatgtaaattctgtaattaggtcagatcactttgctgagttaggttattttaattttgacatcaattttaagtcagttaaggttagtaaatagtctgactttctgacttatttctttgaagcatcttgtgaagaaaagaaaaaaccaggtccagtaacaatgattgtttttttcttctcagcatttacaaatttttcaaaatgaaattttgttcactcagactcacctttctaaaggggcttctgaaagcctgcccctacagttcatgaacaactttatcttcakgttgataatcttgccaagtacctattggaaagaaattcccatgtttgatattaaataatattaatagctaatatttattatgtatttactatgtaccaggtactatattaaaactttatgttcattatctcacttgatccttacaacgccctgctgaaatagtacttttgcagtttaggtacagagagattaaggtcacacagaaactcacagcacaggcaagattttaatccaaacagttgatttcaatgtcccagggttatgctgcttgccctttgcctaaagtgactttttttcata

SEQ ID NO: 39107 - DNA, 601 bp, Human
cctataatcccagcactttgagagagcaaggcaggtgtatctcttgaggccaggagttcaaaaccagcctggagaacatggcaagaccccgtctctacaaaaatacaaaacaaaacaaaacaaaaaaactgtgcgtggtggcacgtacctgtagtcccagttactcaggaggctgaggtgggaaaatcacctgagcctgagaagtcgaggctacagtgaactgtgatggtgccccagcctggacaatgggagtgagaacctgtctccaaaaaaaataaaaataaaaataaaaaaaagttcygctcaaggcaacatctatagtatgtcagttgtaacaaatacaatttgaaaagtaaacaaggaatgaacagaatgctacctgtcttgtgtgtgtatgcatacattttttgtttagaattacatcattaaataatacagagatgagcacattaaaaagtcttaaaaagctatactagtgcaatggtacataccctgttttctgcccaatgacacatgaaggagaactgaatattcccatcaataagaatggctcataatgaatgacagtgattctgatccacaaagaagagaaagggtatat

SEQ ID NO: 39108 - DNA, 601 bp, Human
aggtacagtgaatgagatatgaagacagagtctgaccattctttgaagaaatttagttaagaaggaatgaagaagagggaaaaaaaagactctagaggagagaaagttaagggagcaacttttaaaaaaattgaataactttaaggactgaatgaaaaaagctagtatagagattaaagatccacaagagagaatatgtgatatagcaaggatccagaacaaacaggaaagcatgagatcaaaacagagtgggaatgtttaactaaaaaagaagaaagatgcctcattccttccctacaayacaggaaggctgaggaagtatagcagttaagagtaagaagctgaggggattcctgcccttaacctgtctcatctctgagaagaataaatttactaaaaggaaagggctgggaataaatgtgtatgctaggttgcttgatatatgctactgagttaataagattctgttgaactactagttaaaaaaataactgtatactctagtacattatttcatttagaaaagtcaattctttccctcccagtagattatgcttgcttatatgttcagtaatcctattctttattacataatgtgatg

SEQ ID NO: 39109 - DNA, 601 bp, Human
tgagatttttcttttaaaatattttcaaaattgaaaattgcttaatgatctgaccagaagtctacaatcaaaaagactaagatgcattatactgcagaaaagttaatgcttatgagaaatagacaatcattatttgttgacactactatctaagtctatgtatattatctaccattgttaactattccttaatgaacatgattagaatccctttaagatatacctgacttatgcaggttctaggagtttatgatctgttattgtattatgatttgtatgcatcctccttcaaatctgaccrtggtctatttttcagctattttattaacttttaccaccactaataatatgaagagaaatggtaggaaacaaatgaaattcaagctgaaattctagtaccacttttaaaagctcaactaaaaacaaataggattaagttgaaagcaactgcttaatagcacttttagacttaacttcagttttgctgtattttaacctcatccttcaatattgtgcacagaattattatgttatgctatcaaggctagtggcttttactattttgagactgcagtcaaggtgtcagctgtgctgtagttct

SEQ ID NO: 39110 - DNA, 601 bp, Human
aggcggccgagcatggtggctcatgcctgtaatcccagcactctgcgaggccaaggcgggtggatcacttgaggtcaagaatttaagaccagcctgaccaacacagtgaaaccccacctctactaaaaatacaaaaaatacacacaaacataaaaattagccaggcatggtagcacatgcctgtggtcccagttactcagggggctgaggcagagagatcacttgaccttaggagacggaggctgcagtgagccaagatcgggccactgaactccagagtgagcaacagagcgagactacrtctcaaaacaaaaacaaaaacaaactactgaaatacctagggtatgggtaggctgtagaatatttctaattggtttctttcataattcataaaaattcttagccattattgcttcaaatgttacttgtaccccattctttaattatctttgaaattccatttagtttacttttatttatccaacaaatactcataaagtgctttatcttatcttcataacagtcctgtaaggtatattctattgttaaccccattttacagatgaggaaatgagacagaaagagattaagtaatccgtcc

SEQ ID NO: 39111 - DNA, 601 bp, Human
gagtctgaggctacagtaagctatgactgtgccactgcactccagcctggatgacagagtgagaccctgtctcttaaaagaaattgaaatatactttttgttccacataaattctaacttatccatttaatttatattttcatttacatattacttttttcttagaaattctgtgtattttcaatttttttttcccactaatgatgcaaaagcaatgcaaggagggaaaaaggaaaagtcataatttttggacatataaattttgaaagcagagggccttgggtgttttttttttttttttggccaaatttatttgcttttatttttagagatagggtctcactctttcactcaggctggagtgcagtggcatgattatatctcactgtgacttctaactcctgggctcaaactttcctccccacctcagcctccaaaagtgctgagactacaggcataagctggccaaatttaaaatgctcttttccttaagagatagagtgatgagaatttggttattggttgaatgcgaaagaatgctgttgaaggtggaagaatgagagttgtatgtaactgctagcttttctagcaagaagaaatt

SEQ ID NO: 39112 - DNA, 601 bp, Human
ttatattcctagtctttaagacagtggtcttactcaccaacaagaatattttgttatgtcatttataaacaagtcattttacgaatcagacatttggggaaggggttaaatattacgtaagtgcagagctcttagtttctcaatgtatgaataacaaaatcattccatgccaaatctccattattgtatattggcaaatgttaagtttgaatcataaagaaaaatctcccaattattctaaatagcttgaataaaataatataaatgttattttttaatatgctcaagccttctagaaaartattagtgcacccattgaaagaaaggtaggagaaagaatcatattagatattatgtgtggggctcagatgggaggattgcttgaggccagaagtttgagaccagcctgggcaacacagtgagaccctgtctgtaaaaaaaaaaaaaaaaaaaaaaaaaaaaaaattagccaggcgtggtggtgtgcacctggagttccagctcctaggatgctgaggtgggaggatggctcgaatgcaggagtctgaggctacagtaagctatgactgtgccactgcactccagcctggatgacagagtg

SEQ ID NO: 39113 - DNA, 601 bp, Human
tatgaatttactgaatttaacatttattcctcttgtccttacaggttaaaggtaaactaaaatttatattcctagtctttaagacagtggtcttactcaccaacaagaatattttgttatgtcatttataaacaagtcattttacgaatcagacatttggggaaggggttaaatattacgtaagtgcagagctcttagtttctcaatgtatgaataacaaaatcattccatgccaaatctccattattgtatattggcaaatgttaagtttgaatcataaagaaaaatctcccaattattytaaatagcttgaataaaataatataaatgttattttttaatatgctcaagccttctagaaaaatattagtgcacccattgaaagaaaggtaggagaaagaatcatattagatattatgtgtggggctcagatgggaggattgcttgaggccagaagtttgagaccagcctgggcaacacagtgagaccctgtctgtaaaaaaaaaaaaaaaaaaaaaaaaaaaaaaattagccaggcgtggtggtgtgcacctggagttccagctcctaggatgctgaggtgggaggatggctcgaatgc

SEQ ID NO: 39114 - DNA, 601 bp, Human
cagtatctcaaaagattgtcataaagattttatgacttaatatacgtaaaggcttacaagagtgactggcatgaaatgaacactatgtaattggttgcttttattgtgtaatttttaagaaaactgtgtaatttttaagaaaactgaaagttgcaattcaatacattacttatttactaaatggtaagggtctgacttttcttacctgatatggtatttccgtcttaaaagatgtgatgcccagtatcctgttttccagaaacgatatccatccatttccctgcggctatcacaaaatggrgtatacccataaggagctccatccagatcgaaatctcgaagttcttttagatcatgtctcacaatctaaataattaaaatagactgtctgataaagactgtaaaataacataagcccttttttatgggaatctcaaatcattattactctactacagaaatccaaagagctgtattgtcctcacagtgctttcatgtaatatgaatttactgaatttaacatttattcctcttgtccttacaggttaaaggtaaactaaaatttatattcctagtctttaagacagtggtcttactcacc

SEQ ID NO: 39115 - DNA, 601 bp, Human
taagtagaaatatccaatagataattacataaacagcagtaaattgagaaaaaactcaaaatataagactttaaagtttatgagcacggagttggaacagtctatgtacacacactcaaaattattctgttaacattttacttacctgatctaggtttgaaagactgtttggatcttgactgagagcttgatactggctcctgagcctgtcacctgctccaattctcctgaacttcttgagatccactacatataaagcactgcaaaaatgaattacttcttgatagcctatgttgtttaygtagttttagttttactttcctccagtgagtgtctacagtgacggtattaactacagatatcctaggatctaataacaattaatcctttcataaatttgctcctaatatctaatactgtttcccaagagttttaagtttgttttaattttggtagaacccataatcttttagggtcaccccaagattttccaagttgtcatgaaactcatggccttacaaaaggccatgaggctttgaagacataatcttaattttatttcacaaaccaagtttaaatcttctggagtagttaggagcca

SEQ ID NO: 39116 - DNA, 601 bp, Human
ctactaaagacaaggtagtagtggaatataaaatctaaatggacaacaaataaattactttgaaatattttatgtttaggagagttaaactgcacagcataaactgctttaaatgaaaatctaggaaaaataatctcttaaaaataagtaagaaaaaagcatgtatgatatattttaagtagacaaaattgtcttgtttgcctttatttgggggaaaatattggcaggataactaaactgaagacatgtcaagatgatagctaatccacaaacattttcagctagctctcagccctttttktttgtttgtttgtttttttgaaatggagttttgctcttgtctccaggctggagtgtagtggcgccatctccgctctctgcaacctctgcctcccaggttcaagcaattctcctgcctcagcctcctgagtagctgggactacaggcatgtgccaccacgcccagctaattttttgtaattttagtagagatggggtttcatcatgttagcaacgctggtctcgaagtcctgacctgaggtgatccacctgcctcggcctcttaaagtgcagggattacaggcgtaagccaccgtgcccag

SEQ ID NO: 39117 - DNA, 601 bp, Human
tttttgttcaaaattgtgtgaattctaacattttaatagcttattcgtcagtgaagatcttgtaaacaattttctacacttagcacattaaaaacaatatactaggaaaaaaacttattatacctactaaagacaaggtagtagtggaatataaaatctaaatggacaacaaataaattactttgaaatattttatgtttaggagagttaaactgcacagcataaactgctttaaatgaaaatctaggaaaaataatctcttaaaaataagtaagaaaaaagcatgtatgatatattttargtagacaaaattgtcttgtttgcctttatttgggggaaaatattggcaggataactaaactgaagacatgtcaagatgatagctaatccacaaacattttcagctagctctcagccctttttttttgtttgtttgtttttttgaaatggagttttgctcttgtctccaggctggagtgtagtggcgccatctccgctctctgcaacctctgcctcccaggttcaagcaattctcctgcctcagcctcctgagtagctgggactacaggcatgtgccaccacgcccagctaattttttgta

SEQ ID NO: 39118 - DNA, 601 bp, Human
tagtctattctaatctcattaatgcaacgcatgtttcagacatcacaacacgttgatgacttacttgtatcttgcttcttgttttcaagatgatctaatagttgtcttatctcagcatcatactccacccattctgggacaattctggcagcagcttttagtttggattcttttgttttgggattattgcactaaaagtttaagtaaattttgttaatgaaagaccatgctcctggaaacataaggacaatgctgtgtcactagggcaaacaaaatacattttataaaaagcagagtcctrctaagtactggaagtttaatacacacaggatcaggtgaaatgatatatcacaacttatgtatgtaataattgcttaatacaaatacctcaatcagaaatttaaataaaaattgttgaaagacattctgatgactcataagtctgtcaaaaaaaaattatgtaaaactttttgacaaaagatctaattacattaccactatgtagaagaacatagcagactagtgtgctttgtaggcacagtagaaaaacatggaaatggcatctcggttctcagggttccaactccatatttactagtag

SEQ ID NO: 39119 - DNA, 601 bp, Human
tcccaagccccacctttgtgtaaatctatgcgagcaccgatggggcatgtcccagacccattggctccgcccacctcacctcctcgcctatcgttagttctctgcgaaaccgcgaactgggggcgcggcctatcttcagccccgcccctgatgggcctatacaagggggcggttccgcgcgcgcccgcccagttggagccagacagcggggtggacaagtggcgtgtgtgctgcgaccccgagggaagatgaacgggacgcggaactggtgtaccctggtggacgtgcacccagaggaccrggcggcggtaagaaaaagcgctctcgctgtcttctccgttttgtattcccggtttctaagtccgccccttccgtgccccgcgccgtgttggctgacatcacctggtgcccggctcgcgcggtcagccctgcgcggcgcttctctctttttattcttttgcctgcgacgggcagtgggagtcgcggggtgaagactcctttgaggctggagggttcggggcgtccctgccctttggtaggacactgcggctcctgcctgggactcggcgccggcgagcccgtgcttgggccgcgggtctca

SEQ ID NO: 39120 - DNA, 601 bp, Human
ctcgagcaatcgtcctgtctcagcctcccaaaatgctggtattataggcgtgcaccagcccacctggctgatggaacttattttttaaaaaataaaatgatttttgttatttctctctctctttttttttataaaacagcttttttagatataaatcccataccacatgattgactcagttacagttttggtcagtgcataacaaaactgcataacaacgttttggtcagtgatggactgcgtagacaacagtggtcccataagattattatactccatttttactgtattttttctgggkttagatacattaccattgtgtgacgatcacctacagtattcagtacagtaacatgctgtgcaggtttgtttgtagcctaggagcaatagggtacaccatacagcctaggggtgtaggaggccatgccatctaggtttgtgtgtgtacactctgtgatgtttgtacaaggatgaaattgcctaatgatgcatccctcagaatgtattcctatgattaagtgatgcatgactgtatatatgtgagtgtttatgccaatacagctatatagcattgagctaaatttattgcattagggtaaat

SEQ ID NO: 39121 - DNA, 601 bp, Human
atacaggtaataggaaatggtccatggttgggtccccaccgaggaggtggggttgtgccaggcagtctcatttaccaattacccagtgtgtgctaaatctagcatccctgccaggaatggagaaaatagaggtgatgctggcttctctggagcactcacaatctggttaggactctccagccgatgagcacttacatttacacatgtcagcttaaacataagtacacctgctcctgaaacactgtacagaaattgaacttatataaattaaatatcatcagttgttagcaaacctcttatytataaggattctgtgatcaagcttcttataataatagaattttgtaaagcagacaatcacctgtaaatccacacttctcataagctgatcttgcttagtttgggtgatacctgtagcgtaaattgaagtccgtgccctagcctgttattaatcttgtatatagttatgtctaacctgggatgggaagttcctcaaggttaggagttcaccccaccccaccccacctcgtgtctgtatcctcaccctcccattccccccaggtctgggatgtagaaggcatcagtaaatgtttgttagact

SEQ ID NO: 39122 - DNA, 601 bp, Human
ggggttgtgccaggcagtctcatttaccaattacccagtgtgtgctaaatctagcatccctgccaggaatggagaaaatagaggtgatgctggcttctctggagcactcacaatctggttaggactctccagccgatgagcacttacatttacacatgtcagcttaaacataagtacacctgctcctgaaacactgtacagaaattgaacttatataaattaaatatcatcagttgttagcaaacctcttatctataaggattctgtgatcaagcttcttataataatagaattttgtaargcagacaatcacctgtaaatccacacttctcataagctgatcttgcttagtttgggtgatacctgtagcgtaaattgaagtccgtgccctagcctgttattaatcttgtatatagttatgtctaacctgggatgggaagttcctcaaggttaggagttcaccccaccccaccccacctcgtgtctgtatcctcaccctcccattccccccaggtctgggatgtagaaggcatcagtaaatgtttgttagactgaacagattgggtaagtctttcctgggagggataatcctgggatcctg

SEQ ID NO: 39123 - DNA, 601 bp, Human
atgtgtgcagagactggcccaaagtccagcccccttgtttgcacaaaccggctgtcatatgatgaataatcaggctttgggtcagaaataattgaaaaagatcttccctttgtaatttttgctttgtcaaactttatcaggatccctgggggcaagggaagctctttgtttgtggcaggcagctgcatgtattccctggctaagaagaatgggctacacatacttttccatctgctgaaagattttagcctgaggtttttttcatcctccctacaagactttcaaggccctttcaaggccrcataacatctctccaccccctcttgtttctattttctcatggaacgctagaaatcttttcttctttcgcttcgttccttcttcctcttctcctttcttcattccttcctttttctccctccctttctttttctctctccctcccccctccctttcaccttcctctccctctccctgtccttctctttctaagatttgagtgttaggagaataatgtttcaaagttggttgctttcatctgttttaactaccaattttatttttctttgaacaggtggtgctagaaaagccaaatggcttt

SEQ ID NO: 39124 - DNA, 601 bp, Human
atatgatgcctgggtcccatccctagagcttgtcatttcattgttccaataggtggcctgggcatcaggacttttaagagctcttcaggtgatactaatgtttagctaaagttgagtgccagtattctagaatatttttatatacatagacaaccatatttaaatatcatgtatatgttatatacacaccatatatacatgataaatatatgtatataatatacatgtgcttttctcaactataagatcatggtaaatacattattctttgcttgctttttttttcttaactaaagagtayattataaccttctttccatgtcagtacatatagatctacctcattcttttgaataactacatagtatttccttccatggctgtacttgattgattgactgattgattgattgattgactgactgacagagtctcaccctgtcacccaggctggagtgcagtggcaatcatggctcactgcagcctcgacccccggggttcaagcaatcctcccacctcagcctacccaatagctgggactatagggcacgcgccattatgcctggctaatttttgtagagatggggttgcccaggctgct

SEQ ID NO: 39125 - DNA, 601 bp, Human
gcttggcctccatgactgtactttatttgttattttttgagatggagtctcgctctgtcacccagggtacagtgcagtggtatgatcttggctcactgcaacctccacctcctgggttcaagcaattctcgtgcctcagcgtactgagtagctgggactactggcgtgagccaccacgcctggctaatttttgtatttttagtagagatggggtttcaccatgttggccaagctggtctcgaactcctgacctcaggtgatcctcccaccttggcctcccaaagtgttaggattacaggcrtgagccactgcaccccgccaccattactgtatttttaaaaagtgtgttattatgtttttttgtgattatataatacaaaacattcatattgtagaaaatttggaaaattcagaaacacaggaaagtgaaagaagaaacaaatatcacttgtaatctactcagagaaaaaccacagtgaaatttcatctttccccgaatgcaaatatatatttaccatgtgaatacattgtacagtatgtagcatttctttataattttttttttgtttctttagttgggtatgtttttgcattcggtgtt

SEQ ID NO: 39126 - DNA, 601 bp, Human
gtgcagtggtatgatcttggctcactgcaacctccacctcctgggttcaagcaattctcgtgcctcagcgtactgagtagctgggactactggcgtgagccaccacgcctggctaatttttgtatttttagtagagatggggtttcaccatgttggccaagctggtctcgaactcctgacctcaggtgatcctcccaccttggcctcccaaagtgttaggattacaggcgtgagccactgcaccccgccaccattactgtatttttaaaaagtgtgttattatgtttttttgtgattatayaatacaaaacattcatattgtagaaaatttggaaaattcagaaacacaggaaagtgaaagaagaaacaaatatcacttgtaatctactcagagaaaaaccacagtgaaatttcatctttccccgaatgcaaatatatatttaccatgtgaatacattgtacagtatgtagcatttctttataattttttttttgtttctttagttgggtatgtttttgcattcggtgtttttggccctcaagtataggttgaatcagacccacccattagttcatgacacatcatcctcatgggtcctgt

SEQ ID NO: 39127 - DNA, 601 bp, Human
gatgatgcagagactgggacactgtcttcctccagtgtctggtgcctgtgcagcagagacgggggtgagaccctacatgttagctcatctctaaccaccagcccacagttgggtgtgtctgggagagactgagcagttacctcgatgagacacctttttccacatcgaatcagattcgtggactcattgcatgcttttgccctaaacctgtccatccatcagtaaccctttatatgctgctgtcagtgccaaaagctgagaatggtaaaggatgtgcttttggaccactccctttgtgatkggcgcgacatagtccctgtcctgtgggaactctagtccaaaggggaacatggtctctgctctcagagagctgtaggcagatagagggaagcaggatgcacacctacagacagcatccacatattcaccaagaaatcgattagtggatacatacatgaaatattactgagcatgtcctaaaataattgggtgttttgaggctagcagggttctttagggtatgaagggacaatgtttcattgaataactcagaattcctggctgcctaaggtaactctccccttgtgtgatgacagttctt

SEQ ID NO: 39128 - DNA, 601 bp, Human
agggaagcaggatgcacacctacagacagcatccacatattcaccaagaaatcgattagtggatacatacatgaaatattactgagcatgtcctaaaataattgggtgttttgaggctagcagggttctttagggtatgaagggacaatgtttcattgaataactcagaattcctggctgcctaaggtaactctccccttgtgtgatgacagttcttttttgagggtggtctggacgagatggtccaaaccagtgtgtgcctgggaggggggaccttttcttactgagtcagaaacttgakggcttccccttcccttccttgttctggctgtaggtggacacctgtataaatgaggatgttgagagcttgaggaagacggtgcaggacttgctggccaagcttcaggaggccaagcggcaacaccagtcagactgtgtggcttttgaggtgagatttgggatttggggagaaggtgccctaagggatgggctactgaacacaggtgccagtgatgtctcagcttggacttcctgtctttctggctgagtgccacaaactggaaaggcaaggctgtgaagcctggaacgcttgtctgctttt

SEQ ID NO: 39129 - DNA, 601 bp, Human
cttcctgtctttctggctgagtgccacaaactggaaaggcaaggctgtgaagcctggaacgcttgtctgcttttccctctcctggacgtttacactgtttactgtccaaggccagcccatagttcaaaggtcagctcgggattctctgctctgatgagtttgagggtggtgcccatctggggcagccggtgattcagaagtcatttctgtctgtgtcgtggtaagaatccctgggctcttgagactccgtgcaggcaaggactgctgctgacatgtcacccccgagtctccagtgtctggygcaatacctggtattagataggtgcttcataaacgtggactggatgagtgactaaatctgtgttgttgtagaaagaactgtacccatcgagttggaggatttgggctctaaactcagctttgctatgcagagctttgtggtctggaatgagtatctttttttcactctgctgccaagctggagtgcagtggcgcaatcttggctcactgcaacttctgcctcccggattcaagcaattctcctgcctcagcctcccgagtagctggtactacaggcatgcgccaccatgcccaactaatt

SEQ ID NO: 39130 - DNA, 601 bp, Human
ggttggcacacctttttataattaagaggttcccttgcgggcagggttggctggagctacagagtcaaatgtggaaggggagtctattttttttaaccttttgctccgacagtggggtgcaagaatcagaccatggccttattaacactgtgcttgagctcacatcaacctaggtgcagtgtttatttatgtacagaaatgtacataaataaacataaataaatgtacataaataaaatttttttaaaaggccttacttttaagttcctgcctatggggatggcctatttcaggttaatawgggtcatatgaaggcttgtctcagtctctcctagtgaattggactccttggtctacttttctgaacctatgggtaggaaaggcaagatgatcaattaccatgaaaataacttgccattaagcatgggtttcctgttctactggctgcttgctgtcaagaaggatttgcagtgagagtgagtttgctctggacatggctggtgtgtagcatggacacgtcccatcacacatcacctgtgccgtactttctcctccccagttctgaccttgggaggggctggacgaactggctgctgatgtt

SEQ ID NO: 39131 - DNA, 601 bp, Human
tcccatatcctcttttcaggtttgataacttgctgtaatgggtttgctgtcatagaactcaggtaaacattttccgtatttatttatttatttttcgagacggagtctcactctgtcgcccaggctggagtgcagtggtgcaatctcggctcactgcaacctccgcctcctgggttcagcctcagcctcccaggaggtagctaggactacaggcgtgtgccaccacacccggctaattttgtgtatttttagtagagatggggtttcaccatgtcggccaggctggtcttgaaatcctgayctcaagcaatctgcccgccttgacctcccaaagtgctgggattacaggcatgagccaccgcgcctggactacttatttttttaatttaaaaagtttttcattgacacagggtcttgccatgttgcccaggctggtctcgaactcctgggctcaagcaatcctcccacctcgccttcctaaagtgctgggattatattcatgagccactgcacctggccaacatttcacttattactggcttatgataaaggataatataaaggattcaaatgaacaaacagatgaggtacatagggcaag

SEQ ID NO: 39132 - DNA, 601 bp, Human
agtgcttccaatgtgatattctaaggtacccaccacctactcttcagagcagcctaccggggaatcaggcaaagggaatcatattaatgggaacctcccaagctcaaggctcttcctgtgactgggtaaataagtgatcttgttccattgcctcagccttctggtctttatccccagggctgctaccctggaaaaggaagtggccgggttgcgggagaagatccaccacttggatgacatgctcaagagccagcagcggaaagtccggcaaatgatagagcaggtaagttgggctggtttrtaacctgccctcggggagtcaccccaagtctatgctcttatttgtttcctagggagcttgacttatattcatgcatttcccatgtcaaacatttatagctaccaattaccaggttcaggttattaggatttgcttttctcccatctttcccctactgttttgtttgtttgtttgccatttggcctctgctttccaataggaaaggaaggaaaaggttaatttgtcatatactctgtgaagagtgtgggtaaatgagtagttgagtcataataaactctgttatctgtgcagattatcagt

SEQ ID NO: 39133 - DNA, 601 bp, Human
aaagctaatgaagtcatatggagttgcagggctctgctgccttccccagcagctggggtgaagtctggtgagtgtgtaatgagtcattgcaaaatgagctccagtgtctcccacacctttgcagctccagaattcaaaagctgtgatccagtcaaaggacgccaccatccaggagctcaaggagaaaatcgcctatctggaggcagaggtgtgtgtgctgggcagcccagcaggggaacaggactcttgaagagaaggtggacataagggagacagaggttatgggaggggtctttgtcagtcttgctgttgctctgaagtgaatacctagggtggttggttgactttcagttcagctgaataaacattttctgagaaccttcaggaagctgctaacaatgatgagatgaccacccccctggccccaccttcaacggacatgtcatcatggtgcaagccacatgccatggctgcacacggctaattctgaccctccaggctttgcaaaggagctggcagtggtgctgggctgtgaaggaggaggaggcattcatacagatggagccttttccagggctagattacgtaacgagttgccttc

SEQ ID NO: 39134 - DNA, 601 bp, Human
agtgtgtaatgagtcattgcaaaatgagctccagtgtctcccacacctttgcagctccagaattcaaaagctgtgatccagtcaaaggacgccaccatccaggagctcaaggagaaaatcgcctatctggaggcagaggtgtgtgtgctgggcagcccagcaggggaacaggactcttgaagagaaggtggacataagggagacagaggttatgggaggggtctttgtcattcttgctgttgctctgaagtgaatacctagggtggttggttgactttcagttcagctgaataaacatttwctgagaaccttcaggaagctgctaacaatgatgagatgaccacccccctggccccaccttcaacggacatgtcatcatggtgcaagccacatgccatggctgcacacggctaattctgaccctccaggctttgcaaaggagctggcagtggtgctgggctgtgaaggaggaggaggcattcatacagatggagccttttccagggctagattacgtaacgagttgccttcctagtctaatttccactttgccacagggccctacctgtctgttgactacctgaagatcactttgcgaacg

SEQ ID NO: 39135 - DNA, 601 bp, Human
tttaaatccaactttcctccctcagtctgacccactgtttgccggaaccattttctagcccaattagagtagaacctgttaacacaagcccagggaggtccatgaatggcttctagagatgtatgaaccacctgaaatggtaggaaaaatttagttataatgtttgcatatttctagggagagggtattttgcctctaagagattcagaaaaggacccatgatcttgacaaaatcgagaatcacagctatatccacttctcagttgtttaactgcccctctcttttcttcacccttgctayaagacacatgtatcatgccccaaatcttcccctagttgtcactgataattactgttttaaagcacttggaacccaagtgatcagccagcactgcagtgtaagattccagaggccaatgtgaagattccaggggctctgtgaagggtgggccacaacacagctgttcccagcacaactcagtgtttccaaccttcttttcagtattaggatatccaagccgcctagcccgaagcccatgcctgtcatccgagtggtggaaacctgagctgcctggagatggttgctgccattgctgctgcc

SEQ ID NO: 39136 - DNA, 601 bp, Human
gggcttgggagggcggcttgggagagagctccggctccggaacgaggtgtcctgggaacactcccgggtctgtaacttcggacaaatcacgctcgctttcccggcctcagtgtgccgttctgtaacttgggtctaaccccggctcgcacacacggcggggacgcgcacagagttgggctggggccggggcgcggtgggcactcacctccgccgtacatctggcacaggtacgggaatcgccacacgttgcccaggcccacggcgtacgagatgcaggcgaacacgaactgtagcgagttgscccacagcggccgcgctttctccatggccccggcctcggcgcgctcggctccggctcgggggtccggcacggcagtctcagtgcgcggtcgccaggcgcgccgtcccaccccggctcggcttgggggtggccccgcgcctccgccgccgacgcagctagctggtttttaaattgctaatctcattaacggcgcgcccgtccgagaggcgaggctggtaaatggatgacggcgagccccaccccgcccgatcgtcgcggccgggaaggcacccgagattgcagaggacagggcggagtccc

SEQ ID NO: 39137 - DNA, 601 bp, Human
caggagaaacggttgaatccgggagtggaggttgcagtgagccgagattgtgccattgcactccagcctgggcaataagagcgaaactccgcctcaaaaaaaaaaaaaaattaatagccattcaagacaaggaggcagtctgggtttggagatgatttgtgagaacactggacacatttcttctgcatctgcaaccaggtcacatataagcttccaccctctttgctcctgaaacgtcactctgctttcctgcctgccttcctttctggggtgggaggggtgagcatcacaggctatggcyacttctggtcagggttccttctgcatgcagaggcagccctgggtcataagcaatgtgcagggcaggtggaggttgtcctggaagtgcctggggctctggctcaaggtcactcaggagaagcatgagatgaaacagtcctctcctgctgtccgtgcgggcctcagcttccgcaccccagagacattaatggcactccacaacacctcagcggtgtaaagaagattaaatgagctcatgcacatatatcctataggctggctcccagcatgtagtaggtgcttgctaaaagagagctgttat

SEQ ID NO: 39138 - DNA, 601 bp, Human
tatctttcctatgatgcagaagatgcctctgagaagtcctctgtgattgcttattcaggcagattgtaaaactacacacttctgtgttaaaaattaatagcctagcgaaaccccatctctactaaaaatacaaaaaattagccaggtgtggtggcgggtgcctgtaattccagctcatcaggaggctgaggcaggagaaacggttgaatccgggagtggaggttgcagtgagccgagattgtgccattgcactccagcctgggcaataagagcgaaactccgcctcaaaaaaaaaaaaaaattaatagccattcaagacaaggaggcagtctgggtttggagatgatttgtgagaacactggacacatttcttctgcatctgcaaccaggtcacatataagcttccaccctctttgctcctgaaacgtcactctgctttcctgcctgccttcctttctggggtgggaggggtgagcatcacaggctatggccacttctggtcagggttccttctgcatgcagaggcagccctgggtcataagcaatgtgcagggcaggtggaggttgtcctggaagtgcctggggctctggctcaaggtca

SEQ ID NO: 39139 - DNA, 601 bp, Human
cggtcaggcctgcacaaaacccagggtgcggcctgagagcacagagaggggtgggaggcagcagggctctggggctggcccacaccagcccttgagaaccagcgtcccctcctctccccagccgcaagtgctgggacactcggtagtagaaaccggccatggtgcctgtatttaccccataggcatccgcaaatgctataaaccagggcttcccctccccacccccactccactctgagcactggttgttaaatattcaccagcatcccctggttggcacaaatatctggtatctttcctrtgatgcagaagatgcctctgagaagtcctctgtgattgcttattcaggcagattgtaaaactacacacttctgtgttaaaaattaatagcctagcgaaaccccatctctactaaaaatacaaaaaattagccaggtgtggtggcgggtgcctgtaattccagctcatcaggaggctgaggcaggagaaacggttgaatccgggagtggaggttgcagtgagccgagattgtgccattgcactccagcctgggcaataagagcgaaactccgcctcaaaaaaaaaaaaaaattaatagcca

SEQ ID NO: 39140 - DNA, 601 bp, Human
cagaagcccttcacgtggtttggggtgcatggcttcccctccacctcacaccacccaccggctccccgccccgaggctgctcaccttgccccacacccccttccccgagcgggtggccctgtttttctctccctttctcgctcctactcctgttctggcacgggccccccggctcacctggaaggagtggaagaggtaccagaaggcccaggcgttgatgacgttgtagtacatggagaggaagaaagagaccaccacgctggcgacccctgcgaggaagcagagggccgcgctgaggacygaggatggcccttccccctccgccaggcccagcgtgtgctcccaggacacacctgtggcgaccgccccggggtgggcgaggcctccctccaccaggtttgtgtggtgagtattaagcgagaccaggcacctgtgaacacttgggaagggtgatttctttttctccaacctccctcctcaccttctgggacaggaggctgatgacatgtttttgagatctaactgccaggcactgtgctaaataagtactttatttacctttggtccttacaacagtattatcttcatatcgcagaagaga

SEQ ID NO: 39141 - DNA, 601 bp, Human
atccctccccaccagtcctctccacagatttcctcctaggcacactgtgcagtagttcttaatagtgtgtgtgtggggtcacatccatcagagagaatccactgaaagccagggaccttctctccaagaacacgcacactctcaccggtggactcttgcttacagcgtaaggggcccgtggagcccgggttcagaagcccttcacgtggtttggggtgcatggcttcccctccacctcacaccacccaccggctccccgccccgaggctgctcaccttgccccacacccccttccccgagygggtggccctgtttttctctccctttctcgctcctactcctgttctggcacgggccccccggctcacctggaaggagtggaagaggtaccagaaggcccaggcgttgatgacgttgtagtacatggagaggaagaaagagaccaccacgctggcgacccctgcgaggaagcagagggccgcgctgaggaccgaggatggcccttccccctccgccaggcccagcgtgtgctcccaggacacacctgtggcgaccgccccggggtgggcgaggcctccctccaccaggtttgtgtggtgag

SEQ ID NO: 39142 - DNA, 601 bp, Human
tgtttaggaatggccctattgtgttacagggtgacaatggtccttctaggagaacttaggggtctgcagggaaaagaagaggctcaggctggagtcagaaacctggaagcacgagtggccctgaggaaagcgggagaaggggacggggaggaagaggacaggccgttgctgtcttgctggattgagggaatccctccccaccagtcctctccacagatttcctcctaggcacactgtgcagtagttcttaatagtgtgtgtgtggggtcacatccatcagagagaatccactgaaagccakggaccttctctccaagaacacgcacactctcaccggtggactcttgcttacagcgtaaggggcccgtggagcccgggttcagaagcccttcacgtggtttggggtgcatggcttcccctccacctcacaccacccaccggctccccgccccgaggctgctcaccttgccccacacccccttccccgagcgggtggccctgtttttctctccctttctcgctcctactcctgttctggcacgggccccccggctcacctggaaggagtggaagaggtaccagaaggcccaggcgttgatga

SEQ ID NO: 39143 - DNA, 601 bp, Human
gggccagttcccagtctgacctccctcactcacctctgaaccagcaggtgaggacaaggatccccgcatttgtgtgcataacagcccaggtgctcctgctgagaagggctggacacaaggctggaaagcctggccagggagtgagtagacaggagcacagactccggggccaggtccctgagtccaaccccaccagctatgagctactcggctcccctctgctcgggtgctcagtgtgctcagcctcgtggggtggctgttttgattacatgagtgaacacttctaaagtgctgggacctrtgtctggcccaaagcacatgtaagtgaatgtctgcagctactattcctctcattattatgggaccatggaggagggcttcaaagtagagggactaagggataagtccacagacctatgaaggatggaatgaatgaatatttaagtgattttcatgaatcgctggcccccatacttctgactattagaaaaagatgcccctttcttgaggcactttatttttgcttttgggggatgagcaaattattctgattttgttaggacaagacacattacttccacttttggaaacttgtcttaat

SEQ ID NO: 39144 - DNA, 601 bp, Human
tttcatctgtttgggatagggcctggtcattggatttttcacacctccccaccctgcaccccgcaccccgcaacttcatctccccagtgtgcagccaggttgaagaaggtttagcgtataggagaacttgttaaatgggccagttcccagtctgacctccctcactcacctctgaaccagcaggtgaggacaaggatccccgcatttgtgtgcataacagcccaggtgctcctgctgagaagggctggacacaaggctggaaagcctggccagggagtgagtagacaggagcacagactcyggggccaggtccctgagtccaaccccaccagctatgagctactcggctcccctctgctcgggtgctcagtgtgctcagcctcgtggggtggctgttttgattacatgagtgaacacttctaaagtgctgggacctatgtctggcccaaagcacatgtaagtgaatgtctgcagctactattcctctcattattatgggaccatggaggagggcttcaaagtagagggactaagggataagtccacagacctatgaaggatggaatgaatgaatatttaagtgattttcatgaatcgctgg

SEQ ID NO: 39145 - DNA, 601 bp, Human
ggaagtcttggggtgaggctgggctttgccctcactagctgtgcccttgggcaggtcaatttacctctctaagcttcaggtaactgggatcatgaaatctaccatgaaaggctgttgccagaatgacacaatgtgggtgctcaagccgtggtgggtctactgtgagaagtgacagtgaatgagacagggtgtgctaggctccgagacatctgctgaagcttcaggcaggtggcgggtgatgggaacactgaaagcaaaccttctacgtggagcagactagagatgaaggaacatgtcagcyccagtgaaagtgtgagccttgggatgcaccaagaaaggattatggagatcaagcccgacagctctggagggtgattggaagcagcttagaacaaagggtctcaaactcagctgcaaattagaatcacctggcgagcttttaaacctcccctgcctccccacccagtgctcaggacacaccccagactggttactgcagaattttggggggcggggctaaggcatgagatttttgaaaactctccagaaaataccaatgtgcagctgagttggagagccagtggctagggtgtctcgagga

SEQ ID NO: 39146 - DNA, 601 bp, Human
tacgatgggactgagtgggctgctgcaggttctaagctctctcggggaaagagcacctgtgctcactcgtccctttcctcagccatggcacaggggactttgggggctaagaggctggtcatcaggggctcttagaaaccaaaataaaatgccctaccaggcatgatactggagttgtcccatgggccctggaataccatgggtagctctggtctaatgcctcaagaaatacatggggggtggggtgtggctggaggagacaactcaggtagtcagagggtgaggacaggtgggctcctakgactctcagcaggtgacagttggaattgatgacatcattaaggcatagagagagctatgtggctaccaaaccaagacaatgggaagtcttggggtgaggctgggctttgccctcactagctgtgcccttgggcaggtcaatttacctctctaagcttcaggtaactgggatcatgaaatctaccatgaaaggctgttgccagaatgacacaatgtgggtgctcaagccgtggtgggtctactgtgagaagtgacagtgaatgagacagggtgtgctaggctccgagacatctgctgaagc

SEQ ID NO: 39147 - DNA, 601 bp, Human
atgtctttgtattttgggcaaggggccacagaaagtgaatcctgcaatctctgtggctcagctagaggcttcttggttacttctgaggtgggggagatggggtagaagaaacaaaatttgatcgttgtatgtcctattatgctaagtgctcacaacacgctaacgtgccctcatccctgccaggcagatgttgacatgccccaggccctccagcaactggtggtggtgtagggagtccaaatgtgagccctggattgaggactccaaaactggtgcactttgccccagcccttgcccaggygacccttcagctcagagctcagggaggcctgggactcggtgggacagcccaggcttacttcttcaagcagttttcataattgaaggtggccttgaagccatagatggagaaggtgacaatgctggcaaatatggaggtgaagctgttgatgagggacacgatgatggcgtgcttctggcagttgttggatggctcattgtagctggcgaaggcgatcaggctgccgaagcccaggccaagtgagaagaagatctgggtggctgcattgatccaggccttggggttggccagctgctctat

SEQ ID NO: 39148 - DNA, 601 bp, Human
acactctctaggaataatctctagaagtatttgcattaaatataagaattaggcaaatatgcccactatcacttctactcccatgtgctagaagtcctagtgaatacaataagaaaaagggaatgagatataagcattgaaaagaaaaatgcaaaatttgatctgcaggagatatgatagtttacatagaaaactgaagcaaatctatacataaatatgagaattaataagagaattcatcaagattgctagatacaaggtcaacatataaaatatttagctttcttttgcaacaaaaacwaatgatagaaatgaggggaaaaaacaccattcacaatacaataaaacagtaaggtaatagaaatctaatgaaagatgtgccaagacattcatagagaaagttagctgaagaatgttttaaaagacttgactgaacaagagaaagtatgttcctgagtcaaatatcacaattcaaaagatattaattctccccaaattacactataaaatcaatgcaagtctagtaaaaattccctagattttttttttccaatgaaacttatcaaactgatcctcaaaacaatgtgaaaaaataaaggtc

SEQ ID NO: 39149 - DNA, 601 bp, Human
caaacatgtaggtaaatacaagagctgtataaaataaccataatgtcatgtccaatgtatggggttaaggagacagaactagaaaacaatcatttaaaatgggagataaaatgaaagtactctaaagtccttttgaattttgggaaggaggtcaagatactgtttaactttagactttattaagttaaatatgaaaggaaaatttcaagaagagaaatcaagcaaccaaattccaaacagcagggaataaagtggaatggggaaagaaaagaaagaaaaaaaaaagaacaaagcaacaggraaaatgaagtctagataaatcaataaccaaccatgtaattcttggctgtagagccaagctcaaaagtaagtgaggaaaactcccaggtgccatccataaaggaaagttgaagtgagagcactgaacaagtgctgaagccaaaggacctcatgggtcacctgaacaggacctaggccttgagggctggggtttgtgggctggggtctgatgcctgcctggggaagcaggctcatgccacaggccaataacaagcatggagctagggctgaacaaccaggagaaaaaagcattgtcccaccc

SEQ ID NO: 39150 - DNA, 601 bp, Human
aacaaataaaatggcaaacatgtaggtaaatacaagagctgtataaaataaccataatgtcatgtccaatgtatggggttaaggagacagaactagaaaacaatcatttaaaatgggagataaaatgaaagtactctaaagtccttttgaattttgggaaggaggtcaagatactgtttaactttagactttattaagttaaatatgaaaggaaaatttcaagaagagaaatcaagcaaccaaattccaaacagcagggaataaagtggaatggggaaagaaaagaaagaaaaaaaaaagracaaagcaacaggaaaaatgaagtctagataaatcaataaccaaccatgtaattcttggctgtagagccaagctcaaaagtaagtgaggaaaactcccaggtgccatccataaaggaaagttgaagtgagagcactgaacaagtgctgaagccaaaggacctcatgggtcacctgaacaggacctaggccttgagggctggggtttgtgggctggggtctgatgcctgcctggggaagcaggctcatgccacaggccaataacaagcatggagctagggctgaacaaccaggagaaaaaa

SEQ ID NO: 39151 - DNA, 601 bp, Human
gggaggatcacttgagctcaggagtttgagatcagcctgcgcaacatagcaagaccttgtctctactaaaagtaaataaaagaaaataaatttatgttgtttaagccacccagcctatattttgttatggcaggctgcactgactaatataagaacacaggtcaattctatagtataccagttgctcaggggcatactgaaaatagttggctttatgtgctgacaacaagggagtgatcacttgtagagaacttaaaaacaatagtaaaaatctacaaaaagttgatatactttttatgaytatcatgagccagcaattctaaatagtgttaaaatactgctctccttctcttgcctatggccaccactgaaacagttacgtatgaaatgtttaaagaaacaaaggataacattacaaaaataaacatgtatcaataaactattgggatggacaagtaaatctgaaaaaaatagcatctatataaaaaatatagttattgaattaaaaggctcaattgacagttaaataccagattagatgcagctgaaaagagagttagtgaactgaaagatatatccagaaatgaatcaataaaataaa

SEQ ID NO: 39152 - DNA, 601 bp, Human
tcataaacagggatttacaaacccacaaggagagaagtcactatgagtgaagaactagcaagataagaaatcagatttagaacatccctccccgaggtggcagatgttggactgtcagattcagaattgctatggactgaaccatgtccacctgaaatttgtatgttgaaaccctagctcccaatgtgactgtatctggagatagggtctttagggggtaattaaggttaaattgagttataatattggagccctaatctgaccagactgtagccttataacaagaggaagagagagagasagaactctctattatgtgaggacacagtgagaagataggtgttcacgaaccaggaaataggtcttcatcagaaaccaaaccctgctggcccttgatcttggacttctcagcctctaggattgagagacaaattcctgttttttgctgggcacagcggctcatgcctgtaatcccagcactttgggaggcttaggtgggaggatcacttgagctcaggagtttgagatcagcctgcgcaacatagcaagaccttgtctctactaaaagtaaataaaagaaaataaatttatgttgtttaag

SEQ ID NO: 39153 - DNA, 601 bp, Human
agatcgcaccattgcactccagcctgggtgacagagtgagactgtttctttaaaaacaaaaaaaaaaaaaaaaggaaaaaaacccctaaaatgtagaagtcagaatagaggtgaactccaggggtgcatactgcctgggaaggggtgtgaaggaactgtctagggtgtggaaaatgttctgtatcttgacctaggtggtggttccttgggtggatacatatgtaaaatccactgagtttgtacttaagaaatgtacactttataatggtcatacttcaggccaggtgtggtggctcacacctgtaatcccagcactttcggaggctgagatgggcgaatcacctggggtcaggagttcgagaccagcctggccaacatggtgaaaccccttctctactaaaaatacaaaaattagccaggtgtcatggcgtgcacctgtaatcccagctactcgggagggtgaggcaggagaatcacttgaacctgggagatggaggttgcagtgagccaagatcacgccactgaactccagcctgggcaacagagcgagactccgtctgaaatatatataatatacttcaatgaaaatgaacagaaacaa

SEQ ID NO: 39154 - DNA, 601 bp, Human
gactcatgcctgtaatcccagtattttgggaggccaaggcaggcagatcacttgaggtcaggagtttgagaccagcctggccaacacggggaaaccccatctttactaaaatacaaaaattagccaggcatcatggtgtgcacctataatcccagctactcaggaggatgaggcacgagaatagcttgagcctgggaggtggaggttgcagtgagccaagatcgcaccattgcactccagcctgggtgacagagtgagactgtttctttaaaaacaaaaaaaaaaaaaaaaggaaaaaaamccctaaaatgtagaagtcagaatagaggtgaactccaggggtgcatactgcctgggaaggggtgtgaaggaactgtctagggtgtggaaaatgttctgtatcttgacctaggtggtggttccttgggtggatacatatgtaaaatccactgagtttgtacttaagaaatgtacactttataatggtcatacttcaggccaggtgtggtggctcacacctgtaatcccagcactttcggaggctgagatgggcgaatcacctggggtcaggagttcgagaccagcctggccaacatggtga

SEQ ID NO: 39155 - DNA, 601 bp, Human
caggcgcaatgactcatgcctgtaatcccagtattttgggaggccaaggcaggcagatcacttgaggtcaggagtttgagaccagcctggccaacacggggaaaccccatctttactaaaatacaaaaattagccaggcatcatggtgtgcacctataatcccagctactcaggaggatgaggcacgagaatagcttgagcctgggaggtggaggttgcagtgagccaagatcgcaccattgcactccagcctgggtgacagagtgagactgtttctttaaaaacaaaaaaaaaaaaaaaaggaaaaaaacccctaaaatgtagaagtcagaatagaggtgaactccaggggtgcatactgcctgggaaggggtgtgaaggaactgtctagggtgtggaaaatgttctgtatcttgacctaggtggtggttccttgggtggatacatatgtaaaatccactgagtttgtacttaagaaatgtacactttataatggtcatacttcaggccaggtgtggtggctcacacctgtaatcccagcactttcggaggctgagatgggcgaatcacctggggtcaggagttcgagaccagcctggcc

SEQ ID NO: 39156 - DNA, 601 bp, Human
ctgatgttgactcactgagctgccctgcaggggtggcagagcttaaagctcaatgaacaagcagacgtagtgggcactgtcattccaggatcccgcccaggctgtgggtctacaattataacccccgctgtttatcccaacaactcagccctggagctcatgagaaatgaatcaggggaggaggcttgaatatggagtggccccatcaggacttcctagagaggacttgcctccacccagaagagggtggggcagggaagagacaaatgtccacccagatcctcccttgtgccaggcactygcaatgcgttggacccttaggcctctgaggcaggtgtccggagccccctttcacagatgggaaggcaaggctcagagatgtctaaggctcccccgacatcccatagcacatccatggcagagtgaggattcagacccaggccctttagcctccagaacctgggccttcatcccaggcccctccagctgccttccctggggaccccatgcatgtctgagtctagagcccacacctgccctttccactagcacaccgtacactgccagctaccgagccctcctgctatcccgacggggacac

SEQ ID NO: 39157 - DNA, 601 bp, Human
aatcgtctccaccagcacgatgagcagcagggacagtgtggccgcgtagtcgttgaatatgtcaaaccagtagttcccagcctccatcgtgaacaccatgccaatggcacagttgacaaggcacaccagacctgggggccacaagaccagctgctcacctgcccgagacccccccactactgcttaccagttctctacaggacagtggggtcgtcggccctcagggaattttggctgattgcttcatccacatgggttgaaagagctgtcatggtttggactctctgaaggtgtgtgccaygtgtgtggggcagggggcacaatggtgtcccgaagcgtgttggcaggggtcactgatgttgactcactgagctgccctgcaggggtggcagagcttaaagctcaatgaacaagcagacgtagtgggcactgtcattccaggatcccgcccaggctgtgggtctacaattataacccccgctgtttatcccaacaactcagccctggagctcatgagaaatgaatcaggggaggaggcttgaatatggagtggccccatcaggacttcctagagaggacttgcctccacccagaagagggt

SEQ ID NO: 39158 - DNA, 601 bp, Human
gcatccagtgcctggaggcacaattccctgccccagtaagctgtgggggtccagcagggtcaaccctaaaacagcctatgatacaaagcaaaagtacagggaatagagaaaaagatattcactgaagcaaactgagcatggaatagaggcagagcataagctgagatctgcgggcaaagaacaaacgttgagtcatgatgcgaagcttaaagaagaggtgaagatgtgcatcaagaaacagctgttttccttgaggggcgtggcctctgtggctgtgttttccctatgcaaatgagggtcytgggcctcctcacctcctcagcccgtacacgtagcacacggcaatcgtctccaccagcacgatgagcagcagggacagtgtggccgcgtagtcgttgaatatgtcaaaccagtagttcccagcctccatcgtgaacaccatgccaatggcacagttgacaaggcacaccagacctgggggccacaagaccagctgctcacctgcccgagacccccccactactgcttaccagttctctacaggacagtggggtcgtcggccctcagggaattttggctgattgcttcatccacatgggtt

SEQ ID NO: 39159 - DNA, 601 bp, Human
acctgctagaaatgtgaattcttggccctcccctggcctgcctgatcagaaccctgggggtgagtctcacagctgtgtttgaccagcccaagggactctgaggcacactcgagtttgaaggttgctctagaccagtggctcttgccccagctgcacattccatcacctggggagaactaaaacattccagtcccgtgctgtgcactgggattgagaacctcactgactaaattttgaatctgccaaattttctaaggtctaagttatcaactggactttggtcagggttcttggaaaataytgatgttggccgatgatcagagcatccagtgcctggaggcacaattccctgccccagtaagctgtgggggtccagcagggtcaaccctaaaacagcctatgatacaaagcaaaagtacagggaatagagaaaaagatattcactgaagcaaactgagcatggaatagaggcagagcataagctgagatctgcgggcaaagaacaaacgttgagtcatgatgcgaagcttaaagaagaggtgaagatgtgcatcaagaaacagctgttttccttgaggggcgtggcctctgtggctgtgtt

SEQ ID NO: 39160 - DNA, 601 bp, Human
gtctttaagattctgagaagtcctacgggaaagacatcaatttggctttgtttaacttatgtcctgatggatcatgggagatccctcagcatggcacgggaccctggcctttccggggacacagcagggattgctgcttcagggatgcctgcctcccagagtgttgtcaatgtctccctccccaccctgaaccagcacagaggatcaaaaagactggggaagagggcagaaaacaacgtggcacagcctcctcgcccaaaccgcacccactagagcagcgctgcccaaactgtgatgtgcytcaggccccctggacatagtgtgaagatacaggatctgattcagcaggatggggtgggcccgagcttctgcagtcccaacgagcgccttgttgctgctgctcccgctctagggaccacacttgaggtagcaaagctctctaggccagtggttctcaaagtgtgggtgccagactcatctgggaacctgctagaaatgtgaattcttggccctcccctggcctgcctgatcagaaccctgggggtgagtctcacagctgtgtttgaccagcccaagggactctgaggcacactcgagtttg

SEQ ID NO: 39161 - DNA, 601 bp, Human
tctttgggatccacaactgtctttaagattctgagaagtcctacgggaaagacatcaatttggctttgtttaacttatgtcctgatggatcatgggagatccctcagcatggcacgggaccctggcctttccggggacacagcagggattgctgcttcagggatgcctgcctcccagagtgttgtcaatgtctccctccccaccctgaaccagcacagaggatcaaaaagactggggaagagggcagaaaacaacgtggcacagcctcctcgcccaaaccgcacccactagagcagcgctacccaaactgtgatgtgcctcaggccccctggacatagtgtgaagatacaggatctgattcagcaggatggggtgggcccgagcttctgcagtcccaacgagcgccttgttgctgctgctcccgctctagggaccacacttgaggtagcaaagctctctaggccagtggttctcaaagtgtgggtgccagactcatctgggaacctgctagaaatgtgaattcttggccctcccctggcctgcctgatcagaaccctgggggtgagtctcacagctgtgtttgaccagcccaagggactct

SEQ ID NO: 39162 - DNA, 601 bp, Human
ggattttcccaattttagtactgaaagttccacgtcccagaaaacccctcaatcctggggaaacagggagagttggtccccttaacactagtgtcctcaaaatgttagtagctaagggtgggagtcgggtgagaggagggtgaaaaggcattccttgaccaagtaagtctggaaatgctgcaattctaaccctctctttgggatccacaactgtctttaagattctgagaagtcctacgggaaagacatcaatttggctttgtttaacttatgtcctgatggatcatgggagatccctcarcatggcacgggaccctggcctttccggggacacagcagggattgctgcttcagggatgcctgcctcccagagtgttgtcaatgtctccctccccaccctgaaccagcacagaggatcaaaaagactggggaagagggcagaaaacaacgtggcacagcctcctcgcccaaaccgcacccactagagcagcgctgcccaaactgtgatgtgcctcaggccccctggacatagtgtgaagatacaggatctgattcagcaggatggggtgggcccgagcttctgcagtcccaacgagcgcct

SEQ ID NO: 39163 - DNA, 601 bp, Human
ggagcagaatcacttggtccattgaaaccagagcaggttttctgggacagaggaagagccaacctcggactgaaggaccgtagccctggcctgctggagctggtctagagtggccagggcagtgagtcccaaaggcgttgcccacagccaccatcaccacctccatcatgcctgtagctctcttttccctcttctttacttttaaacctacggttagcagcagcacaacagcagccagtttctcatcgacttgacaaactaagtacgtgtgtttttgaatacacgtacacagtataaaaartatctttggcattttgggagatgttggcccaacgaaactccccatttcacacaggaggaaccaaggcccagggctgcgatgccttcttccttagggcttggtaaagaccaggcccagaacctgggttggcctcctgcctccagcccagagcctttaaacctgctccctacagcggaagaggcagccttggcgggaggggctggggtggtgtgggtgtgacgtcaccagctgcagccacagcccctccctccctgggacctgctgcatgtcctgggtgtccatgcgaggctgtgtggcgac

SEQ ID NO: 39164 - DNA, 601 bp, Human
gcacaggcagcaggggatggacatttgtcaggctggtcatcaatgacagggacttcttgggcggctttgcccacccccctacccagcccgcccctgtcaatcagtgactccctttcccagtagaaacaccacggagcagaatcacttggtccattgaaaccagagcaggttttctgggacagaggaagagccaacctcggactgaaggaccgtagccctggcctgctggagctggtctagagtggccagggcagtgagtcccaaaggcgttgcccacagccaccatcaccacctccatcaygcctgtagctctcttttccctcttctttacttttaaacctacggttagcagcagcacaacagcagccagtttctcatcgacttgacaaactaagtacgtgtgtttttgaatacacgtacacagtataaaaagtatctttggcattttgggagatgttggcccaacgaaactccccatttcacacaggaggaaccaaggcccagggctgcgatgccttcttccttagggcttggtaaagaccaggcccagaacctgggttggcctcctgcctccagcccagagcctttaaacctgctccct

SEQ ID NO: 39165 - DNA, 601 bp, Human
gtacagatgaataatttaaaattaattgtaagtggtatttgtggtcttgatagagttggccacgatgtccaaatgtaatattaagcctatgggaaagtcagagccacttttttttttttttttttttgagtcagagtcttgctctgtcgcccagactggagtggagtggcatgatcttggctcacagcaaccgccacctcctaggttcaaatgattcttgtgcctcagcagccagagtagctggaattacaggcctatgccaccactcccagctaatttttttgtatttttagtagaaatsgggtttcgccatgttggccaggctggcctcaaactcctgacctcaagtgatccacccaccttgacccccaaggtgctaggattacaggcgtgagccaccgtgcccagctgagatccactttcattctcacctcacagtggctcctgactccttttccaatgcaccaagacacacaccacggagggatgtctgcacagacttctaatgtggtttggggttgcaaactgtagttggggcaattttttgtagagaggtctggtcctggacccactgtcagagaccttagagaaaggatccctt

SEQ ID NO: 39166 - DNA, 601 bp, Human
cagtgtgctgggggcctgacctagtgtcatgggaagaggcagcaggagagatccagtcccttgcctattcgccatcgttgctggctgggcctctcagggtatgtggcaatggacgtgcgcctgggagcttgcttccctgccgtgtctccaggaggaagccctgagtgcccgcaggtgacttgcacatggccttggagagctcacttggtgctggacaccccagcttgacctgtcgctgccaggaaatgggcaggggccaggctgggtgggagaggggaccagtggttcccaggcagcctcragtgacaccctccttgtgccaaacagagaattcagcaaagagccagagctgatgcccaaaacaccttctcagaagaaccgacggaagaagagacggatttcttatgttcaggatgaaaacagagatcccatcaggagaaggtaggaggggttgggggagagtgagctgagcagtgggctctgcggaggcttggtgccatctgggagtttgattctgaaggtgttgatttggaagtagcagcctgtaggaggggtggtgggtaccaccgcgggtactgcgtgggccatgctgagaggggtt

SEQ ID NO: 39167 - DNA, 601 bp, Human
agaaccgacggaagaagagacggatttcttatgttcaggatgaaaacagagatcccatcaggagaaggtaggaggggttgggggagagtgagctgagcagtgggctctgcggaggcttggtgccatctgggagtttgattctgaaggtgttgatttggaagtagcagcctgtaggaggggtggtgggtaccaccgcgggtactgcgtgggccatgctgagaggggttgggatgccacagggaactatagcttgacccaagaccctggagtccaaatctgtggctgtgtgttgggggtgggkgtgtttgatctgggccctggagaatgggaaagatttccgtaggtgggatgagaaagagaagccatccttctgttaggtgagtgtgaccaggggtgtagaccacgtgccttgtcccagccgtcatattgtcatgcttgttttagtccccctcaggaatgattggggctgcagagtgctagggaaagaggctgggtcttggggttaggcttgggtgtgaaccccagctctgccccttagcagagcagtacggctttgaattgaatttctgcctctctgagcctccgttcctcatccctaaaa

SEQ ID NO: 39168 - DNA, 601 bp, Human
agtggtctctgcctctcaagggcgtgctctggattaaggcagagcgtgtgtaaggctttcagcaggggctcggtgtggtgtaacttcagtcagccggaggtttggatgaatataatcttcctagccagttctgtgcggactgtggcatgatccccaatttacagttaggaagactgcggctcagacaagaatggcctggggcctcatggctagaggtggcagaatctggcctggaacccagatcttttgccttcaccttctcttatcatactctatccaagctggtggctcttggagagaytgggtgccaccctgtcctgctgcccgtctcagcctctgccctgctgcccctgccaggttatcccgcagaaagtctcggagcagccagctgagctcccgacgcctccgcagcaaggacagtgtagagaagctggctacagtggtcggggagaacggctccgttctgcggcgtgtgacccgtgctgcggctgcagctgccgcggctaccatggcattggctgcaccttcttcacccacccctgagtctcccacgatgctgactaagaagcccgaggataaccacacccagtgccagctggtg

SEQ ID NO: 39169 - DNA, 601 bp, Human
agttaggaagactgcggctcagacaagaatggcctggggcctcatggctagaggtggcagaatctggcctggaacccagatcttttgccttcaccttctcttatcatactctatccaagctggtggctcttggagagactgggtgccaccctgtcctgctgcccgtctcagcctctgccctgctgcccctgccaggttatcccgcagaaagtctcggagcagccagctgagctcccgacgcctccgcagcaaggacagtgtagagaagctggctacagtggtcggggagaacggctccgtyctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacct

SEQ ID NO: 39170 - DNA, 601 bp, Human
cggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtgagtctgggggcttggcagtggcgggtggtccttggtgccaggctcagatggaggctttctgagggatcatctagcaaggagctgtccagagagctttctgcagtgaggtagatgttacacatctgtrctgtcctgggatggtggccgctagctggcctcatctggcgattgtgtcctcaaaatgtggctagtgtgattgaggaactgaattttaaattgtattgcattctacttcttttagatttaaatagttacatgtagctagtggcttccacgttggatggtgcaggtctgacccaacctacttgctttacaagtgaggaaactgagcttcgggaaggtcggccactgtgtggctgtggttactggccatgttgaggctggagcctgggcctcttccgcagggccagctcattcctcccaaccc

SEQ ID NO: 39171 - DNA, 601 bp, Human
attgaggaactgaattttaaattgtattgcattctacttcttttagatttaaatagttacatgtagctagtggcttccacgttggatggtgcaggtctgacccaacctacttgctttacaagtgaggaaactgagcttcgggaaggtcggccactgtgtggctgtggttactggccatgttgaggctggagcctgggcctcttccgcagggccagctcattcctcccaaccctatgctgcagaggccacttaaattcaccgggtttgcgcgccgcctattggcgacactgtgtttgatctrgaggagggaattatggcagcaggctccttcggggagatcagatgactgggcatctgatgggagccaggagggggaaccaagctgactctggagctggccggcctgggtctgagtgccaactcagccattcacccaccctgcagcctggggcaggtcctggaaacttcacgggcctccactccttgcctgtcaacgggggctaatcgcgtcacttcaaagggtcgttgtgaggttttctttggtcaccccacacagggagtttagaagggtgcctggcatataggaaggactcggtaatgt

SEQ ID NO: 39172 - DNA, 601 bp, Human
ggcctcttccgcagggccagctcattcctcccaaccctatgctgcagaggccacttaaattcaccgggtttgcgcgccgcctattggcgacactgtgtttgatctagaggagggaattatggcagcaggctccttcggggagatcagatgactgggcatctgatgggagccaggagggggaaccaagctgactctggagctggccggcctgggtctgagtgccaactcagccattcacccaccctgcagcctggggcaggtcctggaaacttcacgggcctccactccttgcctgtcaackggggctaatcgcgtcacttcaaagggtcgttgtgaggttttctttggtcaccccacacagggagtttagaagggtgcctggcatataggaaggactcggtaatgttagctgctctctcagatctcagcttagggggccattgcccactggagcaggtgtctggaggggcaggctggctgcatgaggaggtgaatctgagctgggagggttctgaaggatggctgcgcttttgctgagtggaaaaaaaatgcggggatatgtgttattggcagagggaacagcttgtacgaagaccctgat

SEQ ID NO: 39173 - DNA, 601 bp, Human
ctagaggagggaattatggcagcaggctccttcggggagatcagatgactgggcatctgatgggagccaggagggggaaccaagctgactctggagctggccggcctgggtctgagtgccaactcagccattcacccaccctgcagcctggggcaggtcctggaaacttcacgggcctccactccttgcctgtcaacgggggctaatcgcgtcacttcaaagggtcgttgtgaggttttctttggtcaccccacacagggagtttagaagggtgcctggcatataggaaggactcggtaaygttagctgctctctcagatctcagcttagggggccattgcccactggagcaggtgtctggaggggcaggctggctgcatgaggaggtgaatctgagctgggagggttctgaaggatggctgcgcttttgctgagtggaaaaaaaatgcggggatatgtgttattggcagagggaacagcttgtacgaagaccctgatgcctaaagcaacaagtgatgggtgtctggggctcatgctcacacaagagcttgaacttgaccccactgaagcaaaagaagtggcttgatgatgggaaagtgag

SEQ ID NO: 39174 - DNA, 601 bp, Human
aagggtcgttgtgaggttttctttggtcaccccacacagggagtttagaagggtgcctggcatataggaaggactcggtaatgttagctgctctctcagatctcagcttagggggccattgcccactggagcaggtgtctggaggggcaggctggctgcatgaggaggtgaatctgagctgggagggttctgaaggatggctgcgcttttgctgagtggaaaaaaaatgcggggatatgtgttattggcagagggaacagcttgtacgaagaccctgatgcctaaagcaacaagtgatggrtgtctggggctcatgctcacacaagagcttgaacttgaccccactgaagcaaaagaagtggcttgatgatgggaaagtgagggaaacagggagaccagataggaggctgctgtaaggatgcaggcagaggacgggcgaagcagcggattggtggcgaggataggccaggatttatctttttttttttttgatacagagtctcgctctgttgcccaggctggagtgcaatggcacgatctcggctcactgcaacctttgcatgcatctcaggttcaagcaattctcctgcctcagtctccc

SEQ ID NO: 39175 - DNA, 601 bp, Human
tctggaggggcaggctggctgcatgaggaggtgaatctgagctgggagggttctgaaggatggctgcgcttttgctgagtggaaaaaaaatgcggggatatgtgttattggcagagggaacagcttgtacgaagaccctgatgcctaaagcaacaagtgatgggtgtctggggctcatgctcacacaagagcttgaacttgaccccactgaagcaaaagaagtggcttgatgatgggaaagtgagggaaacagggagaccagataggaggctgctgtaaggatgcaggcagaggacgggcraagcagcggattggtggcgaggataggccaggatttatctttttttttttttgatacagagtctcgctctgttgcccaggctggagtgcaatggcacgatctcggctcactgcaacctttgcatgcatctcaggttcaagcaattctcctgcctcagtctcccgagtagcagggattacaagtgcccgccatcacaccaggctaatttttgtgtttttgttttttagtagagatggggtttcaccatgttggccaggctggtttcgaactcctgacctcaagtgattcacccgcctcagc

SEQ ID NO: 39176 - DNA, 601 bp, Human
acagcttgtacgaagaccctgatgcctaaagcaacaagtgatgggtgtctggggctcatgctcacacaagagcttgaacttgaccccactgaagcaaaagaagtggcttgatgatgggaaagtgagggaaacagggagaccagataggaggctgctgtaaggatgcaggcagaggacgggcgaagcagcggattggtggcgaggataggccaggatttatctttttttttttttgatacagagtctcgctctgttgcccaggctggagtgcaatggcacgatctcggctcactgcaacctytgcatgcatctcaggttcaagcaattctcctgcctcagtctcccgagtagcagggattacaagtgcccgccatcacaccaggctaatttttgtgtttttgttttttagtagagatggggtttcaccatgttggccaggctggtttcgaactcctgacctcaagtgattcacccgcctcagcctcccaaagtgccgggattacaagtgtgagctactgcgcccagcccaggttttatctcaacgcatgttaaatagtagctggcatctgcctggcactttaagatttataaaatgaaaggt

SEQ ID NO: 39177 - DNA, 601 bp, Human
cacaagagcttgaacttgaccccactgaagcaaaagaagtggcttgatgatgggaaagtgagggaaacagggagaccagataggaggctgctgtaaggatgcaggcagaggacgggcgaagcagcggattggtggcgaggataggccaggatttatctttttttttttttgatacagagtctcgctctgttgcccaggctggagtgcaatggcacgatctcggctcactgcaacctttgcatgcatctcaggttcaagcaattctcctgcctcagtctcccgagtagcagggattacaagygcccgccatcacaccaggctaatttttgtgtttttgttttttagtagagatggggtttcaccatgttggccaggctggtttcgaactcctgacctcaagtgattcacccgcctcagcctcccaaagtgccgggattacaagtgtgagctactgcgcccagcccaggttttatctcaacgcatgttaaatagtagctggcatctgcctggcactttaagatttataaaatgaaaggttatttcatttggtccttacagcagcattgttagcttgtgaggaatttttcactttacagaggag

SEQ ID NO: 39178 - DNA, 601 bp, Human
ggcgaagcagcggattggtggcgaggataggccaggatttatctttttttttttttgatacagagtctcgctctgttgcccaggctggagtgcaatggcacgatctcggctcactgcaacctttgcatgcatctcaggttcaagcaattctcctgcctcagtctcccgagtagcagggattacaagtgcccgccatcacaccaggctaatttttgtgtttttgttttttagtagagatggggtttcaccatgttggccaggctggtttcgaactcctgacctcaagtgattcacccgcctyagcctcccaaagtgccgggattacaagtgtgagctactgcgcccagcccaggttttatctcaacgcatgttaaatagtagctggcatctgcctggcactttaagatttataaaatgaaaggttatttcatttggtccttacagcagcattgttagcttgtgaggaatttttcactttacagaggaggaaactgaggcttaaggaggccatggagtctgtaaatcgggaagctggggcttgagcgctgtgtgtttcattctgtccagaaagtcaggtgcttgcagaagaggctttgtgcaa

SEQ ID NO: 39179 - DNA, 601 bp, Human
gggggtggaggagagagaggaggatacaggatctaggatctggagtcacacagaccctgggtgaccttgggcacaccccttctctcaacctcagcttttctgtgaaatggtgataacacttgctttgaatgtgaatagataactcatcttagtgcttgagtgtagtggatactcagtacatcttatttgagaaaactcaccaatggctgatgctcagtttgggtgcgacaaggccgacccctagtgaggagctgcaagggtgtcagggagtggggcggtgacaggggaggaggcttcctgrgggtcttcctgataccaggctctgggagaggctctcgggcagctccaaggtggggtcttggtttgggtgttccccacgagcagcccttgacacaaggatttgagttcaatttgttaatttttgggaaattaacaaatttaatttcccaaaaattaaattcaggatgggaaggaaacacctgcaccagaggaatggaaaaatgagataggaaaaaaagccagcagtcagcgtgggtggagggggcttctggaagccagagtgtggccccggggcgtggaactgctgtgtgtcagcaggaat

SEQ ID NO: 39180 - DNA, 601 bp, Human
gtagtggatactcagtacatcttatttgagaaaactcaccaatggctgatgctcagtttgggtgcgacaaggccgacccctagtgaggagctgcaagggtgtcagggagtggggcggtgacaggggaggaggcttcctgagggtcttcctgataccaggctctgggagaggctctcgggcagctccaaggtggggtcttggtttgggtgttccccacgagcagcccttgacacaaggatttgagttcaatttgttaatttttgggaaattaacaaatttaatttcccaaaaattaaattcrggatgggaaggaaacacctgcaccagaggaatggaaaaatgagataggaaaaaaagccagcagtcagcgtgggtggagggggcttctggaagccagagtgtggccccggggcgtggaactgctgtgtgtcagcaggaatcccctgcctcctggcctggtgcgcacctgcctgcggggcccatcgggcagcagttctgaagtggataggaagggacaggcccactgcctcaggactccaccttggggcgttcgagccacctctgcattggagaagagtccttccatccctctgccagtgct

SEQ ID NO: 39181 - DNA, 601 bp, Human
agaggctctcgggcagctccaaggtggggtcttggtttgggtgttccccacgagcagcccttgacacaaggatttgagttcaatttgttaatttttgggaaattaacaaatttaatttcccaaaaattaaattcaggatgggaaggaaacacctgcaccagaggaatggaaaaatgagataggaaaaaaagccagcagtcagcgtgggtggagggggcttctggaagccagagtgtggccccggggcgtggaactgctgtgtgtcagcaggaatcccctgcctcctggcctggtgcgcacstgcctgcggggcccatcgggcagcagttctgaagtggataggaagggacaggcccactgcctcaggactccaccttggggcgttcgagccacctctgcattggagaagagtccttccatccctctgccagtgcttaggccacttccctaccaccagaccagctctgaggcctgaatggcgtgcagatggcacttagcattccagagaatgcttgtgctggtgggagagccatgtagtcacatgggcgtcttcatcagggagcacgtgagctgggatgacacagcatggggagatgaggag

SEQ ID NO: 39182 - DNA, 601 bp, Human
aatttaatttcccaaaaattaaattcaggatgggaaggaaacacctgcaccagaggaatggaaaaatgagataggaaaaaaagccagcagtcagcgtgggtggagggggcttctggaagccagagtgtggccccggggcgtggaactgctgtgtgtcagcaggaatcccctgcctcctggcctggtgcgcacctgcctgcggggcccatcgggcagcagttctgaagtggataggaagggacaggcccactgcctcaggactccaccttggggcgttcgagccacctctgcattggagaasagtccttccatccctctgccagtgcttaggccacttccctaccaccagaccagctctgaggcctgaatggcgtgcagatggcacttagcattccagagaatgcttgtgctggtgggagagccatgtagtcacatgggcgtcttcatcagggagcacgtgagctgggatgacacagcatggggagatgaggaggatgtatcttctgggtataaaccccttaaatgggggtcatcaccacccatgactgtcagcccggcgctgcagctgctcccaccacctccccaaacctggctgctatac

SEQ ID NO: 39183 - DNA, 601 bp, Human
ataggaaaaaaagccagcagtcagcgtgggtggagggggcttctggaagccagagtgtggccccggggcgtggaactgctgtgtgtcagcaggaatcccctgcctcctggcctggtgcgcacctgcctgcggggcccatcgggcagcagttctgaagtggataggaagggacaggcccactgcctcaggactccaccttggggcgttcgagccacctctgcattggagaagagtccttccatccctctgccagtgcttaggccacttccctaccaccagaccagctctgaggcctgaatgkcgtgcagatggcacttagcattccagagaatgcttgtgctggtgggagagccatgtagtcacatgggcgtcttcatcagggagcacgtgagctgggatgacacagcatggggagatgaggaggatgtatcttctgggtataaaccccttaaatgggggtcatcaccacccatgactgtcagcccggcgctgcagctgctcccaccacctccccaaacctggctgctatacccaggaagggtcctggcttcccttctctgtgcctggcctgttgtcttccctcttttcctgagaccctgtg

SEQ ID NO: 39184 - DNA, 601 bp, Human
accaccagaccagctctgaggcctgaatggcgtgcagatggcacttagcattccagagaatgcttgtgctggtgggagagccatgtagtcacatgggcgtcttcatcagggagcacgtgagctgggatgacacagcatggggagatgaggaggatgtatcttctgggtataaaccccttaaatgggggtcatcaccacccatgactgtcagcccggcgctgcagctgctcccaccacctccccaaacctggctgctatacccaggaagggtcctggcttcccttctctgtgcctggcctgytgtcttccctcttttcctgagaccctgtgcaccccaacctcccgctggccacctcccagcctgaactctgaccaagcccccatggctcaggatgcgccagctcagctaccttctctctgttccccaaaaaagcctctttttttcctgcctcatggccttggccctccttctccctagaccagtggcactgggaacaggcatgctcccagctaggaagaagccggggacataaagctagcagctgtggtgaggataccagggtgagtgctgagggtgagggacctgggcttcctgttttta

SEQ ID NO: 39185 - DNA, 601 bp, Human
gccggggacataaagctagcagctgtggtgaggataccagggtgagtgctgagggtgagggacctgggcttcctgtttttaatgattaagcctcagcctcaaaaagcttttgacagcctggacaacatggccagaccctatctctaccaaaatggaaaaaattagccaggtatggtggcatgtgcctgtagtcccagctactcaggaggctgaggtgggaggattgcttgaacccaggaggtcgaggctgcactgagctgagattgtgccactgcactccagacagagtgagactctgttaaaaaaaaaaaaaaaaaagctttgattatgaggttatatctattgatcgttactgtattaaaaattaaaactgaggagtttaaaagtattttaaatattaatatttttatatgaatatttagtactttaaagatttaaaaatattgtttaatattttaacattataaaatgcaagtaccaagcctatcacctgtttacattaagactttttatgaaaaaataacttttccaaaacaaaaatgtactgaagacactggcattattctacattttgcaaatctctttattgtatgactttaaa

SEQ ID NO: 39186 - DNA, 601 bp, Human
gctagcagctgtggtgaggataccagggtgagtgctgagggtgagggacctgggcttcctgtttttaatgattaagcctcagcctcaaaaagcttttgacagcctggacaacatggccagaccctatctctaccaaaatggaaaaaattagccaggtatggtggcatgtgcctgtagtcccagctactcaggaggctgaggtgggaggattgcttgaacccaggaggtcgaggctgcactgagctgagattgtgccactgcactccagacagagtgagactctgttaaaaaaaaaaaaaamaaagctttgattatgaggttatatctattgatcgttactgtattaaaaattaaaactgaggagtttaaaagtattttaaatattaatatttttatatgaatatttagtactttaaagatttaaaaatattgtttaatattttaacattataaaatgcaagtaccaagcctatcacctgtttacattaagactttttatgaaaaaataacttttccaaaacaaaaatgtactgaagacactggcattattctacattttgcaaatctctttattgtatgactttaaataagccacattctg

SEQ ID NO: 39187 - DNA, 601 bp, Human
actgagctgagattgtgccactgcactccagacagagtgagactctgttaaaaaaaaaaaaaaaaaagctttgattatgaggttatatctattgatcgttactgtattaaaaattaaaactgaggagtttaaaagtattttaaatattaatatttttatatgaatatttagtactttaaagatttaaaaatattgtttaatattttaacattataaaatgcaagtaccaagcctatcacctgtttacattaagactttttatgaaaaaataacttttccaaaacaaaaatgtactgaagasactggcattattctacattttgcaaatctctttattgtatgactttaaataagccacattctgcgtttgatctgttgttgcattgtgttgtttgggttaaagtaactgaagaactggacgggcgaggtggctcacacctgtaatcccagcacattgggaggccgaggtgggcagatcatgaggttaagagattgagactgtcttggccaacatggtgaaaccctgtctctactgaaaatacaaaaaattatctgggcgtggtggcacgtgcctgtagtcccagctactcaggaagctgag

SEQ ID NO: 39188 - DNA, 601 bp, Human
ataaccattgtcagtcgttcttttaattaataatagtggttcaggtgaaaaagtggctagtgcagctggcagcttagagacgagcgcttttcacagagagttgggtttgcagcaacaggcattgtgcacacttcccacgtcagcacacagaagagtagaatggcatgtacttgagtttagatttagtaaaattaggacttttgcaggcgcagtggctcacgcctgtaatcccagcactttgggaggctgaggcaggtggttcacttgaggacgagttcaagaccagcctggccaacatagygaaaccctatctctactaaaaatataaaaaattagctgggtgtgatggtacatgcctgtaattccagctacttgggaggctgaggcaccagaatcccttgaacccatgaggtggaggttgcagtgagctgagattgcgccactgcattcagcctgagtgacagagtgagagtctgtctcaaaaaaagaaaaaaaattagtactttttacaccttcatcaaggacattcctcagtgaaactggacatctctccttcccgtgagtgtgtggtccgaggatagtgtttgatgctctggccttg

SEQ ID NO: 39189 - DNA, 601 bp, Human
tccccctcaggtcacagttacctggagaggctcctgaatgttgaggtgccccagaaagttgggtgagttcagttccagggcttcggaggtaggcagggcataccaggacagggagccaaggtgagcaccagggctggaagcaattcctgggctgagtcttccccactgagccttgaccgcccaggagctgccccgttttccctgtctgaccaggcagtgagtgatgtgggtgttggccacctggtctccttgcagcacccgtcagcgttgctggttgcctggctagacctgaccctggggsgtgggctccagaggttgggggtgaggcggggctgccaggaagagctacattcaaactggctggggtaggataggagtgctccaggattacacccagtgctgcttcgggccaggacacagactccttttcctggaggccgtgtcctgccatcactaaaaccagccccctccctccttgctgcagagcagagggtttgttcttgggacggggaaacagggtgacagggcagacctgctggccttgccagccccatggtgaatagagaacagaccacaaaagagatgcagctcacctgggccc

SEQ ID NO: 39190 - DNA, 601 bp, Human
taaaaccagccccctccctccttgctgcagagcagagggtttgttcttgggacggggaaacagggtgacagggcagacctgctggccttgccagccccatggtgaatagagaacagaccacaaaagagatgcagctcacctgggcccaagaggtggaggcggagctgaggacagggctcacatcctgagacagctctgtggtggggtgccagggagatgaagccacattctgaagctgacatccctcgtctgtccatggagccattgccgggagctgccatcctcctatcctacagggggctgtgggttcgtggccctggccagggcaccttgtgttgacctcttgggtccccatccctggaatggtagagggactccctagggggagggcttggactagctgggcagtcccctcagagtccctcttctgttttcagttctgagcagaaggaaccccccgaggaggctgagcctgtggcggcagctgagccagaggtaagacggctgcctggggaagggaggactcacctctggggctcccgctctgcactgcggccatcctgggccttgggttccaggtcaagacccctaaagccttggt

SEQ ID NO: 39191 - DNA, 601 bp, Human
cagaggtaagacggctgcctggggaagggaggactcacctctggggctcccgctctgcactgcggccatcctgggccttgggttccaggtcaagacccctaaagccttggttctttccacaggtccctgagaacaacggaaataactcgtggccccacaatgacacggagattgccaacagcacacccaacccgaagcctgcagccagcagcccggaaacaccctctgcagggcagcaaggtgaggcttcctgacctgccgtgtgcagtgcccggagccacagcgggccttggcggcctcrgcctgaccttctctctggggataaggaagccccattttctgggccagtaggctaaagagaaattaaacctgggggtgcagagatcccttttgagtctgtagacttcacctcccaccgttgggctggagctgtcactgagtgcagcatggggggctgtggctggttgggacaggaagcagaggaaggggctgcatcggggtatggatatgaagaggccaggtcaaggccttgaccttgactccaggggccagtgggaagagctgtgggctggggattgaacaccccacctggcctcctgct

SEQ ID NO: 39192 - DNA, 601 bp, Human
gaagccccattttctgggccagtaggctaaagagaaattaaacctgggggtgcagagatcccttttgagtctgtagacttcacctcccaccgttgggctggagctgtcactgagtgcagcatggggggctgtggctggttgggacaggaagcagaggaaggggctgcatcggggtatggatatgaagaggccaggtcaaggccttgaccttgactccaggggccagtgggaagagctgtgggctggggattgaacaccccacctggcctcctgctttgcctcccccgccagctcctttctracctttgtatgtccatccttgtctaaagagggctggagagcagtgggtttgggagtgtcccagggtcctgctcacatctccctgagaagggtgcctctctctggtggaaagtgcactgtagctgtgagatcttgaacacggcctcctcctctttacgacgtggtcagggacaatggtcatgccagccctgcagccccaagggctgctgtgaggaacttttggagtaaggtgcaccttctcctagcagtgaaacaaaacaatactgaccctacaccctccatgttgaccctgcagcgggag

SEQ ID NO: 39193 - DNA, 601 bp, Human
cgtttctgcagccttgctgaaattgctgtcttcacagaggccaagacggaccaagcagatggacccagagagccaccgcagagtgccaggtttgcatccgggaaggggtgtgtaggtaactctgagggccctggaggatgtggccttgtgtccttgctcagggaaggtggatgtgtgctcaggggcttcagagcctctctgctggggtgtggcctggtgttgtgacttaaccaaggaggcggctccatgctgtggatgagcgcaaacctgggaatagggcgacccgattgttgaccccgtyttagtgtggtctcctggccatgtgaccttggactgttcacctcccttcctctgagtgggcagcagagggttgcttaggctctgcagcctctttcagtctagaggcctgtggcctgggcccggtattgttcaccggggtgacttttgatggggtgtggctgggctgtggcgggctgccctgtgatgccgccgcccgcgccttggcaggaggaagcgcagctacaagcaggccgtgagtgagctggacgaggagcagcacctggaggatgaggagctgcagccccccaggagcaagacccct

SEQ ID NO: 39194 - DNA, 601 bp, Human
ggctgccctgtgatgccgccgcccgcgccttggcaggaggaagcgcagctacaagcaggccgtgagtgagctggacgaggagcagcacctggaggatgaggagctgcagccccccaggagcaagaccccttcctcaccctgcccagccagcaaggtgagccaggcacctgccctctcctggagccctgacccccttcagtaccctgccccgcctgcccacttctgaccctggtcctcgtctgcaggtggtacggcccctccggacctttctgcacacagtgcagaggaaccagatgctcaygaccccgacctcagccccacgcagcgtcatgaagtcctttattaagcgcaacactcccctgcgcatggaccccaaggtgaggggcctgtgcccaggccgggctttgtgggagctgggcagtgtggctgaaggtccagtctgtcctgtaagatactgggagtagtgtgagcctgggcggaggcaagtgtggcctggcactgttaggggccggttgaagcctctgtggccaccagctgtcttgacctctgagggcactgtcctgcacttgaccttgtgggctctggactacagcctggaggc

SEQ ID NO: 39195 - DNA, 601 bp, Human
tttgaagagaacagacaggttgtctgtggtccccagagctactgagatttattggttcacagacctgagcagtagccttgaggcagtggggtgatgggggagcgcaagtgtgggtctgaactgaggtggaagtgctgggtcttgctgtgctgggtgacagtagaacagtgggtggtagcgtctagaaacaagtcgcagaagctgttctcttctcagacacctcagagctgagccgagccaggctggccctgagcaaggaccctcagatggggacatgcttagcctgcagccccagctcccygtgccatttgccaaggccacagacacctcattcctttagttcctgcaagccttctgaagggtcctctgcagccacacagggacacctgtgacagccgggagggcttctgcctccagttgagggcctcggcaggtgagaggggcttcccagcagctggccaggtgggccctgagctggcttctccgcatggaggcctgttcccctcttgttggagagggtgactgacagtataccttccagtggccttaccacctgtgccgattagagccctgcaggtctcacagggtgatagagaagacc

SEQ ID NO: 39196 - DNA, 601 bp, Human
tgctgggtgacagtagaacagtgggtggtagcgtctagaaacaagtcgcagaagctgttctcttctcagacacctcagagctgagccgagccaggctggccctgagcaaggaccctcagatggggacatgcttagcctgcagccccagctccccgtgccatttgccaaggccacagacacctcattcctttagttcctgcaagccttctgaagggtcctctgcagccacacagggacacctgtgacagccgggagggcttctgcctccagttgagggcctcggcaggtgagaggggcttcscagcagctggccaggtgggccctgagctggcttctccgcatggaggcctgttcccctcttgttggagagggtgactgacagtataccttccagtggccttaccacctgtgccgattagagccctgcaggtctcacagggtgatagagaagaccaggaagtggtcccctttcctgctttggggatcccaggtccctgcacaaggcatctagtgggtggggacagtccatagttaggagaccagggggctacggagtcattttggactgcatcctgaacattctgctatgagtctctgggtc

SEQ ID NO: 39197 - DNA, 601 bp, Human
ggatggtattaccttggagccagatttctaggcgagagtgctcctccagttaggctcagaagccaaggagaaatcgatagtaaccagtacaggaagagggggaagctattggacactgtgcctaaaggtgggagtctactgggagccaggttggggtgatgggtgtggggcttccctctgggtcccagcctccacccagccccagactgttcaaggggaaagcactagccttgtccttggccagggagggcttagagcccctgcccatccctgctggctgcccattgctgtggctgtgccyctgggactttctgtgtctgcccaggagggggtgccagcatcaatcagcttttcagccaactagtacttttttaaagttgccttaaaaatgaacatagccagctgggcgtggtagctcacacctgtaatcctagcactttggaaggccaaggcaggcggatcccttgaggtcaggagttcagcaccagcctggccaacatagtgaaaccccacctctactagaaatacaaaaattagctgggtgtggtggcacatgcctgtagctccagctactcgcgaggctgaggcacgagaattgctt

SEQ ID NO: 39198 - DNA, 601 bp, Human
tgtagcagcagtaatttgagggttaagtgcttgtacttggagccagactgcctatctcagctctgccatttattagctgtgtgactttctacaggctgcttgacctctctgcttccatgtcttcaagtagcagtgagggttaaatgtgttaatgtctgtaaaatgctcagtagtgtctgatgcctgctaagagttctatacaatggctgttatggtccaccccctgactgttctgcctataagagtaagggcccacctcttcccagccagtcttaggactctagagaaggcaaatccaccrttaggggttatgtgactagtcaccaaggtcagttatttactgtgtgctaggccctgctgtgtgttgtgcgtatcaacccagcaaccccatgaagtgtgggaataactgcagtctccattttatagacgagtaaacaggccagagggtttaaatgcttgcccgttgtttcatagctagcgagtttggctccgaggttcctttctgctaaatctacagcagcagcagctgtcacaagatgccttttcaggctgctgctggtggttctggcagagccttgctcgggatgtcccacggcgccat

SEQ ID NO: 39199 - DNA, 601 bp, Human
cttgacctctctgcttccatgtcttcaagtagcagtgagggttaaatgtgttaatgtctgtaaaatgctcagtagtgtctgatgcctgctaagagttctatacaatggctgttatggtccaccccctgactgttctgcctataagagtaagggcccacctcttcccagccagtcttaggactctagagaaggcaaatccaccattaggggttatgtgactagtcaccaaggtcagttatttactgtgtgctaggccctgctgtgtgttgtgcgtatcaacccagcaaccccatgaagtgtrggaataactgcagtctccattttatagacgagtaaacaggccagagggtttaaatgcttgcccgttgtttcatagctagcgagtttggctccgaggttcctttctgctaaatctacagcagcagcagctgtcacaagatgccttttcaggctgctgctggtggttctggcagagccttgctcgggatgtcccacggcgccattcctgggttgtccgtggtggtggctgatatgaggggcacctgggcttcaggggagtagggctgctgtcctgcctctctggcctgggcctggccgcagc

SEQ ID NO: 39200 - DNA, 601 bp, Human
agtgagggttaaatgtgttaatgtctgtaaaatgctcagtagtgtctgatgcctgctaagagttctatacaatggctgttatggtccaccccctgactgttctgcctataagagtaagggcccacctcttcccagccagtcttaggactctagagaaggcaaatccaccattaggggttatgtgactagtcaccaaggtcagttatttactgtgtgctaggccctgctgtgtgttgtgcgtatcaacccagcaaccccatgaagtgtgggaataactgcagtctccattttatagacgagkaaacaggccagagggtttaaatgcttgcccgttgtttcatagctagcgagtttggctccgaggttcctttctgctaaatctacagcagcagcagctgtcacaagatgccttttcaggctgctgctggtggttctggcagagccttgctcgggatgtcccacggcgccattcctgggttgtccgtggtggtggctgatatgaggggcacctgggcttcaggggagtagggctgctgtcctgcctctctggcctgggcctggccgcagcacctgaccttgctctctgtttcaggaggaggaa

SEQ ID NO: 39201 - DNA, 601 bp, Human
aggccctgctgtgtgttgtgcgtatcaacccagcaaccccatgaagtgtgggaataactgcagtctccattttatagacgagtaaacaggccagagggtttaaatgcttgcccgttgtttcatagctagcgagtttggctccgaggttcctttctgctaaatctacagcagcagcagctgtcacaagatgccttttcaggctgctgctggtggttctggcagagccttgctcgggatgtcccacggcgccattcctgggttgtccgtggtggtggctgatatgaggggcacctgggcttcrggggagtagggctgctgtcctgcctctctggcctgggcctggccgcagcacctgaccttgctctctgtttcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgcgagcaggagcggcgcgagcaggagcggcgggagcaggagcggcgcgagcaggagcgacagctggcagagcaggagcgtcggcgggagcagga

SEQ ID NO: 39202 - DNA, 601 bp, Human
tgctgtcctgcctctctggcctgggcctggccgcagcacctgaccttgctctctgtttcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaggcygagaggtgagggacctgctggcccgcctgcctgccttccatgtgtgtggaagagagacggtgtgaaccttgcctggacacagccccacctgcatgtgacggtttgcaggtgctttccttggcaccaaacccagaggcccacctgaatacactgcccattggctatgggagatccaaggagtggtaggtgggcttgcttagggcttggcttggttctgcctccagctgcatgtgctgacctcttaggtgtctttttgtaactgtcaggagtgtggtgctcagaggatgagctgatatttct

SEQ ID NO: 39203 - DNA, 601 bp, Human
caaacccagaggcccacctgaatacactgcccattggctatgggagatccaaggagtggtaggtgggcttgcttagggcttggcttggttctgcctccagctgcatgtgctgacctcttaggtgtctttttgtaactgtcaggagtgtggtgctcagaggatgagctgatatttctcagcagggccaccatgggcattttgggcaggaaagatctttgtgttacattgcaggatgtttggcatccttggcccctgtccccactaaatgcatctcccctggtgaggacgataactcagattrccccctaccgatattttcagactgttcccctgccttgggaaccgtggacccaggagccctgggattttccagctgtgcagatgcagtggtctctgtacaatagacaagagttccatgtttagttttacaggcatttgtccctggcctaccctgtgcctggttgttctgagagtcgtggggatgccaaggaggaaaagccacactcactgttggtcaggagatacatgggatcctgtgtctgtgtgcacagaagtagagcacaaggcccgtgtgtgtgagacacgcaggccccgtagctgt

SEQ ID NO: 39204 - DNA, 601 bp, Human
cagctgcatgtgctgacctcttaggtgtctttttgtaactgtcaggagtgtggtgctcagaggatgagctgatatttctcagcagggccaccatgggcattttgggcaggaaagatctttgtgttacattgcaggatgtttggcatccttggcccctgtccccactaaatgcatctcccctggtgaggacgataactcagattaccccctaccgatattttcagactgttcccctgccttgggaaccgtggacccaggagccctgggattttccagctgtgcagatgcagtggtctctgtwcaatagacaagagttccatgtttagttttacaggcatttgtccctggcctaccctgtgcctggttgttctgagagtcgtggggatgccaaggaggaaaagccacactcactgttggtcaggagatacatgggatcctgtgtctgtgtgcacagaagtagagcacaaggcccgtgtgtgtgagacacgcaggccccgtagctgttccctctcccgctctacctcctgggaaacaccgggcagcacgttttttccgtgtccatcttcgtgggtggcttcaggtttatcagataagtgaagag

SEQ ID NO: 39205 - DNA, 601 bp, Human
gggccaccatgggcattttgggcaggaaagatctttgtgttacattgcaggatgtttggcatccttggcccctgtccccactaaatgcatctcccctggtgaggacgataactcagattaccccctaccgatattttcagactgttcccctgccttgggaaccgtggacccaggagccctgggattttccagctgtgcagatgcagtggtctctgtacaatagacaagagttccatgtttagttttacaggcatttgtccctggcctaccctgtgcctggttgttctgagagtcgtggggwtgccaaggaggaaaagccacactcactgttggtcaggagatacatgggatcctgtgtctgtgtgcacagaagtagagcacaaggcccgtgtgtgtgagacacgcaggccccgtagctgttccctctcccgctctacctcctgggaaacaccgggcagcacgttttttccgtgtccatcttcgtgggtggcttcaggtttatcagataagtgaagagtcacagccagggggctgcactgagtcagggctgcttgatggggacaaagctgtccttggtcctctgggcagagtctgggaaggc

SEQ ID NO: 39206 - DNA, 601 bp, Human
ggacgataactcagattaccccctaccgatattttcagactgttcccctgccttgggaaccgtggacccaggagccctgggattttccagctgtgcagatgcagtggtctctgtacaatagacaagagttccatgtttagttttacaggcatttgtccctggcctaccctgtgcctggttgttctgagagtcgtggggatgccaaggaggaaaagccacactcactgttggtcaggagatacatgggatcctgtgtctgtgtgcacagaagtagagcacaaggcccgtgtgtgtgagacaygcaggccccgtagctgttccctctcccgctctacctcctgggaaacaccgggcagcacgttttttccgtgtccatcttcgtgggtggcttcaggtttatcagataagtgaagagtcacagccagggggctgcactgagtcagggctgcttgatggggacaaagctgtccttggtcctctgggcagagtctgggaaggcgagaaggcgtagggtgtagctaatgtgcagggtgctgggcagagcagggggctttgagggtggcggtgtgatagtcatagtgtcggcagctttggtgggtac

SEQ ID NO: 39207 - DNA, 601 bp, Human
aaaggacagatacacttggcccaattgtttttacttctttttatattctttgttattctaaaagtagaatttgttgaggtgggggataaaaaggaactaaactttatagaagagtatacagttttaaaaaaagggaccctcaggaaaactctactaagcgcgttgtatatccttctagatttttacttatgtaacccttttaacacacacacagatatcctctctctctctctctctctttcacccatacacatacatatttaaaatgggcacataccatttggtggcttgatttccaggyccccaacccccatggttttttttcacttagtatattatagacatctgtctatttcaacacaggtcaatttcttagttttgatgactgtgtaccttaattgtgctggaattcagccggctcctcttgatgagcatttgatctattttcacttcactgctgttaccaaacaaaacaatgttttcattgcagcattgttaagatgtggaaaacttggaagttagtatggtatctgtcaatgatggatggttacgttgcaaatcctggagtctccttagtggttcccgggaggattctagacac

SEQ ID NO: 39208 - DNA, 601 bp, Human
gctgagccggaagtcagggaggggtgcagacgccccagagggaagggcctggaatcccatagctggtaggcacactacagaaacttgtttttgtgagtttcacctcatctgaaccctacagtaactggcatgtgctttaagcctcttaactactagtgtcaagtcatttgggagatggcagtgagcaggagccagctcgcttgcaaagccatctaatcggaggtgactttgaacagcttacttaaatagtttcctcatccgtgaaaggggggtgaagacaagacccagctgaggagttctrttgagagtgacatgagtgagctcacggctggcccttagagccgcacctggtgctgagcaagtgctggtgcatgtctggcctcctgatcccctgggtcttcctcagccccgttgtcaggactgtgccttcccacatccactgcccagaggccccctcagcactgcaccagggcctgtggggtctgtgagaagcagctggccaaggtggtcaaggatggcatcctatgcttaagctctggaactgggcttgtcttcaaacacaggctctgccattattagctgtatgcctttgggcaaatct

SEQ ID NO: 39209 - DNA, 601 bp, Human
gatggactcaaaaacacaatgttgaggaaaaaggtttaaagaaaaatcacagcatattatattgaagaattcgaaaccgctatatagatttcaaagtaacacttgcacaaatttacccaaggtggaccgtaaagccacttatataacacaccagagtggctgtctgaaaaggggagtgaaaggggtctgggaataggaacgaagagaggaagtgataaaataaacaaggagccttgcattggcccacagggtgtcaagaactgagaaggatcaactcaattttgtgcacctgaggttcttyttttcaaaaaaagaatgccagttgcgagggtgagggtcccacaccgcaggagatggcacaagtccggccaagaacggagggggccgcggccggtgcggagcggcctagagcggcgggagggcggacgccccttcgagagctcctctttctctcagaagtcacgggggcgagacgggggcgccagggcggcggacgaggcacggagggcaggaaagcccattccctacagcccggaactcctgctcccaaacctcctccccgaccgccctgcttacctggcgccagctccgggcgcgggcc

SEQ ID NO: 39210 - DNA, 601 bp, Human
acacagcacccctcatgcaagcactcagaagtgaaaacaagatgactagcatggatggactcaaaaacacaatgttgaggaaaaaggtttaaagaaaaatcacagcatattatattgaagaattcgaaaccgctatatagatttcaaagtaacacttgcacaaatttacccaaggtggaccgtaaagccacttatataacacaccagagtggctgtctgaaaaggggagtgaaaggggtctgggaataggaacgaagagaggaagtgataaaataaacaaggagccttgcattggcccacrgggtgtcaagaactgagaaggatcaactcaattttgtgcacctgaggttctttttttcaaaaaaagaatgccagttgcgagggtgagggtcccacaccgcaggagatggcacaagtccggccaagaacggagggggccgcggccggtgcggagcggcctagagcggcgggagggcggacgccccttcgagagctcctctttctctcagaagtcacgggggcgagacgggggcgccagggcggcggacgaggcacggagggcaggaaagcccattccctacagcccggaactcctgctccc

SEQ ID NO: 39211 - DNA, 601 bp, Human
aagagtgagcaggtggtagcccccctactgaatgaggggtaggggaggaggccattctgcaagaaagcactgttcaaaggctgggaggtgtgacatggtgccagggtgagtcacagcctcggtcccgcagaggaggagcagcagctctggctgctgagccgttttaatgagctgccggaaataagagttctaggaaggaaaggggcaatgatcagttctgctaaatgctgaattaaaccagaacctgtggcctgggcccaggagtggaaacatctgaggaatcagtcccacgtgggccaayagcaagatcaacgtgcttaataaaggcaactatccctttagttcccagaaaagggaggaaacacacccccacagcttgcttcctgcttcctggaggctaagttccactaggcattacggtcacactggactggagaggacgagagacacagagagagggaaagatcttaccgtggagttcagaacaatgagcatgacagccaggaatgtcagagtcttaaacccttccaagtctttgtttcccaggaccccatagtactgactggggatcaggccaacctggtagatcacaaattgctct

SEQ ID NO: 39212 - DNA, 601 bp, Human
tgctaagcactagggacattatgagctcacagtttagccagaaaacaattacaagcgtgtgaggagtgttacagcgaggtaaactcaaggaattcgttaagtacagaaaaagggcagagtttggtggaggagacacaaaggagaaagctgagaaagacttgaaagaggtgacaacggagggatgacgaagagtgagcaggtggtagcccccctactgaatgaggggtaggggaggaggccattctgcaagaaagcactgttcaaaggctgggaggtgtgacatggtgccagggtgagtcamagcctcggtcccgcagaggaggagcagcagctctggctgctgagccgttttaatgagctgccggaaataagagttctaggaaggaaaggggcaatgatcagttctgctaaatgctgaattaaaccagaacctgtggcctgggcccaggagtggaaacatctgaggaatcagtcccacgtgggccaatagcaagatcaacgtgcttaataaaggcaactatccctttagttcccagaaaagggaggaaacacacccccacagcttgcttcctgcttcctggaggctaagttccactaggca

SEQ ID NO: 39213 - DNA, 601 bp, Human
agatccccttccttaactattatgccccagcccagaaacctcaagtgagggagacacacctaaaatctccctccagcttctcctgatgcaccagcttcatcacaatggggcccatcaaagttttgttcaccacggtccccaggatgaaatacccgaagatgctcacaggcccgagccagcctgtgctgaaatagagagagagggagagaagggagagggtgtggggtgccacctatccccacatgcctcagccctgactcctgttccctctcaggtagcccctgtccaatctgagtggccyaatgggccctctgctcctatgtgggggcatctggtatgagctctcagagccaggatatctgtgacactgcaacacagggccaaaggaagggcaggggcctgagcacgtgggatgggtgagcacgtggtaaggtacggtgggagagaggggaaataagcttctcttggaccttgacctgggagagctgactgagggccctctggggaaacaccaggctggggaggagggaggcttcacctttggaagcactggtaagtgtagtagacgagggtgaacggggagatgatgagcttgctggcc

SEQ ID NO: 39214 - DNA, 601 bp, Human
atttcagaggcctcacataaggcagagcacagggaccggttctggccctggagggaagggatgggatttcatgccgctgctgctgctcctgctgctgccgtcaggagaccagacgcttggctccattagacagcattgtggggagcaggtctcctggttttctgagaagctcccattccatcccacgctacggagacaaaggatcaggcttgaacctcaggcactggcaagaaagcttcttaacagacagaagagcagaggcagacggatgtcttacagtcaccagcaagaggatgaggcrttcattcatttgacaatttcaggccccacgctaggccactaagactaaagctggccacagtaaggaaccaccagcttcagaagcaaacccctggacctaaggatgaggcaggcaagggcagggggaggtagagggagagggtcacagccaagtgtgacaacactcagcccctgagctcggtggtggtgggagggttgaggattcatctttccttctccactctcagctctggcaaggcagaaggggaaccatctctccagactcacctgtagaaagcagcaggctccgcattcacccgaa

SEQ ID NO: 39215 - DNA, 601 bp, Human
ggcaggcaggcacactgcattcttcacttggaatcaggagtactaagtgtgccctcagggccatggcagcagataggcttagccattaagggagtctgggaaggctctccagaggaggtgatctggggtttcaaggatgggaagaaattcgctaggcagaaaaggtggagggagatttcagattttgcacagaggccacagaagaactcatctgaaactctacaaactaacctgccttccccagagcttcatgagcagaggctgcagaatccaaaagcaacttttttctttttttttttttgagacggagtcttgctctgtcacccaggctggagtgcaatggcaggatcttgccttactgcaacctctgcctcccggattcaagtgattctcctgcctcagcctccccagtagctgggattacaggtgcccgccaccatgctcagctaattttttgtatttttagtagagacagggtttcaccatgttggccatggctggtctcgaactcttgacctcaggcaatccacccgcctcggcctcccaaagtgctgggattacaggcatgagccaccatgcccggcctccaaaagcaactttt

SEQ ID NO: 39216 - DNA, 601 bp, Human
ccactcgctctcgcccaggatctcgcagtcctgtgacttcagggacatgtccagaagcgtctcccgaagctgcccaattctgaacaagaaaagaaaatctgaggcagggtctgggagccaggtgaaggtgaactccttttcctatctcacacccacgagtacatggtatgtctctgttccttttttcactcagccacttctgccagcagcacacactttgctcaggagccagaggggtgggacacggcctcacctgtgcgtgtagccagccacatctgagagcgtcgtggacaggtcgatkagctgggtgaagcagctgatgaggtagatgcacacaaaggcattctggacaggatgggaagaggtcaagcaggtctcgactcgagcccacagacactgggccaaggacagagagggacagcatgtggggtgaccaagagggagtctcaccttgctgaccagggtgctaagctctgcgggactcaggtctccatagaccccgctgaaaatggggattgcgatgacaacgtaactcaggatgctgcccagatagtcaaaggtgttgatgccgactgtagaaaacacatctgtgagacaccca

SEQ ID NO: 39217 - DNA, 601 bp, Human
gggaggaggaagcacaggaaggggaggacactgcagattcctgttatctcaggcagaaggtgtgtgtactttgcttccactggccggggaatggtgtaaattaacacaacagatgccggaacagcaacatcgactgtgaacttacatgtgcctggcattccatttccatttactccttacaactctgctgcccagctgggaaagggcaggactccagggtaacccaagccaggtgatgccacagcctgcagcctcaactactgctctgccagcccgctactcacgtgtccaagccccactygctctcgcccaggatctcgcagtcctgtgacttcagggacatgtccagaagcgtctcccgaagctgcccaattctgaacaagaaaagaaaatctgaggcagggtctgggagccaggtgaaggtgaactccttttcctatctcacacccacgagtacatggtatgtctctgttccttttttcactcagccacttctgccagcagcacacactttgctcaggagccagaggggtgggacacggcctcacctgtgcgtgtagccagccacatctgagagcgtcgtggacaggtcgatgagctg

SEQ ID NO: 39218 - DNA, 601 bp, Human
actagactgacctgctcccgaagggtcccgtcagtgaagaatggcttttgtggcaggaatagcaccccatggggcccaaagtccgtcagcatctgcactgagcctgcagagcccacagaaacctccattgtgagatctcccagaagaggcaactgcctgtctcctctcttccttgttccccaacagaaaagaatggattctaccacaccgtccccgccttcaccccacccctagggcccaggctgggtcagaggcagggagggcctggctctcaccccgtgtactcgtccagaggccaccyagaacccggagcaaggaggtcttgccagtgcccgtgttgcctgtgatgagcaggctctgtccctcggagatctttaggctcagatccttgattaggggtttgtcagaggagggggcagagatggagacccgctcaaggagaaatgctgtgtctgctggctctgccgctggccaccctgggggtctgtgtcagagaagagagggggcgtgaggaagatgggcagggtcagtattgctgtgggggaggcactgctcccgggagccaccacctgtggattattatgggctgacttgcatcctc

SEQ ID NO: 39219 - DNA, 601 bp, Human
gtgtgtttagggggaacagtctgacagcctcctgagggcaggggccccagaatccgaccttgggtgtttgacatacgcgtgtggtatttggcgtgagtccttgccccatttacctgcctcaggagctgctatgagtagtgggcccaatccatggatgtgaatagaaggttcttagagccagcagttcccaggcccgggccacttcaccacctcaccttttgccctgactctaggacctgagacttgtcacagtgccagaggtcccagctgtgggtgggcggggttgaggagggaggagtgrgccccctgaactagactgacctgctcccgaagggtcccgtcagtgaagaatggcttttgtggcaggaatagcaccccatggggcccaaagtccgtcagcatctgcactgagcctgcagagcccacagaaacctccattgtgagatctcccagaagaggcaactgcctgtctcctctcttccttgttccccaacagaaaagaatggattctaccacaccgtccccgccttcaccccacccctagggcccaggctgggtcagaggcagggagggcctggctctcaccccgtgtactcgtcca

SEQ ID NO: 39220 - DNA, 601 bp, Human
accacaccaacctaggagggcgagcaaaagacggagctgcacacagcccaccctccctccagaacccactggaacctcccaaggaggagaggtgggaacgcctggcctgggtcagatgggagaggctctggccggcagacagcagggcaaggtccctacaaccttcagaagtgtgtttagggggaacagtctgacagcctcctgagggcaggggccccagaatccgaccttgggtgtttgacatacgcgtgtggtatttggcgtgagtccttgccccatttacctgcctcaggagctgctrtgagtagtgggcccaatccatggatgtgaatagaaggttcttagagccagcagttcccaggcccgggccacttcaccacctcaccttttgccctgactctaggacctgagacttgtcacagtgccagaggtcccagctgtgggtgggcggggttgaggagggaggagtgagccccctgaactagactgacctgctcccgaagggtcccgtcagtgaagaatggcttttgtggcaggaatagcaccccatggggcccaaagtccgtcagcatctgcactgagcctgcagagcccacagaaa

SEQ ID NO: 39221 - DNA, 601 bp, Human
agagtgtgcttcccttcccaccaagctgtcaaatacaaatctggagattcaataaaaaagatcattccatgatagagaagacagaaagctgtaattctttttaatgtttaacttttctttgtaaaaaacttattaaaaaacttaaatggtcagttaaagttaaaaatctattgctgcacaatttaactgattaaaagatttccagatctcttgactccaagagtcatttctttcatttcttacagatctcacacttccagatttctctttagcaaacatgatctgaaatcatttgtaggtmatcagcacttcaagcatatggaggctctggctgaggcagcagagtcctgggagactgaacactgggagattcagtgtcccccacagaaacctagacctgggctcagcccaccactgctaggggtcctgcacaggacccatgtggctcctgcacgggatctatgtggcgaacctgagctcgatcttcgctgtcagtcctcctggtctctcctgagggccgccgacccgccacagtgtggctctccttccaaaagccagagcttcattccactttgattctcatcagctcccatcttcctcc

SEQ ID NO: 39222 - DNA, 601 bp, Human; identical to SEQ ID NO: 39209

SEQ ID NO: 39223 - DNA, 601 bp, Human; identical to SEQ ID NO: 39210

SEQ ID NO: 39224 - DNA, 601 bp, Human; identical to SEQ ID NO: 39211

SEQ ID NO: 39225 - DNA, 601 bp, Human; identical to SEQ ID NO: 39212

SEQ ID NO: 39226 - DNA, 601 bp, Human; identical to SEQ ID NO: 39213

SEQ ID NO: 39227 - DNA, 601 bp, Human; identical to SEQ ID NO: 39214

SEQ ID NO: 39228 - DNA, 601 bp, Human; identical to SEQ ID NO: 39215

SEQ ID NO: 39229 - DNA, 601 bp, Human; identical to SEQ ID NO: 39216

SEQ ID NO: 39230 - DNA, 601 bp, Human; identical to SEQ ID NO: 39217

SEQ ID NO: 39231 - DNA, 601 bp, Human; identical to SEQ ID NO: 39218

SEQ ID NO: 39232 - DNA, 601 bp, Human; identical to SEQ ID NO: 39219

SEQ ID NO: 39233 - DNA, 601 bp, Human; identical to SEQ ID NO: 39220

SEQ ID NO: 39234 - DNA, 601 bp, Human; identical to SEQ ID NO: 39221

SEQ ID NO: 39235 - DNA, 601 bp, Human; identical to SEQ ID NO: 39209

SEQ ID NO: 39236 - DNA, 601 bp, Human; identical to SEQ ID NO: 39210

SEQ ID NO: 39237 - DNA, 601 bp, Human; identical to SEQ ID NO: 39211

SEQ ID NO: 39238 - DNA, 601 bp, Human; identical to SEQ ID NO: 39212

SEQ ID NO: 39239 - DNA, 601 bp, Human; identical to SEQ ID NO: 39213

SEQ ID NO: 39240 - DNA, 601 bp, Human; identical to SEQ ID NO: 39214

SEQ ID NO: 39241 - DNA, 601 bp, Human; identical to SEQ ID NO: 39215

SEQ ID NO: 39242 - DNA, 601 bp, Human; identical to SEQ ID NO: 39216

SEQ ID NO: 39243 - DNA, 601 bp, Human; identical to SEQ ID NO: 39217

SEQ ID NO: 39244 - DNA, 601 bp, Human; identical to SEQ ID NO: 39218

SEQ ID NO: 39245 - DNA, 601 bp, Human; identical to SEQ ID NO: 39219

SEQ ID NO: 39246 - DNA, 601 bp, Human; identical to SEQ ID NO: 39220

SEQ ID NO: 39247 - DNA, 601 bp, Human; identical to SEQ ID NO: 39221

SEQ ID NO: 39248 - DNA, 601 bp, Human; identical to SEQ ID NO: 39209

SEQ ID NO: 39249 - DNA, 601 bp, Human; identical to SEQ ID NO: 39210

SEQ ID NO: 39250 - DNA, 601 bp, Human; identical to SEQ ID NO: 39211

SEQ ID NO: 39251 - DNA, 601 bp, Human; identical to SEQ ID NO: 39212

SEQ ID NO: 39252 - DNA, 601 bp, Human; identical to SEQ ID NO: 39213

SEQ ID NO: 39253 - DNA, 601 bp, Human; identical to SEQ ID NO: 39214

SEQ ID NO: 39254 - DNA, 601 bp, Human; identical to SEQ ID NO: 39215

SEQ ID NO: 39255 - DNA, 601 bp, Human; identical to SEQ ID NO: 39216

SEQ ID NO: 39256 - DNA, 601 bp, Human; identical to SEQ ID NO: 39217

SEQ ID NO: 39257 - DNA, 601 bp, Human; identical to SEQ ID NO: 39218

SEQ ID NO: 39258 - DNA, 601 bp, Human; identical to SEQ ID NO: 39219

SEQ ID NO: 39259 - DNA, 601 bp, Human; identical to SEQ ID NO: 39220

SEQ ID NO: 39260 - DNA, 601 bp, Human; identical to SEQ ID NO: 39221

SEQ ID NO: 39261 - DNA, 601 bp, Human
tgtttatttgctgatcaaaacttgtgggaaaaattaaagtaaaaaaatattgggagaagaatggaaagcctttggataaatgattagctggttaaataaatgagcctgtgttactgaatgagtatggattgcccggttactttttttgtttcttgacactctttgctttgggtcgtttactttcaatgtttgctttagattcttcctgtccagtttttgctttagattcttcctgtccagtttttgcttcagattcttcctgtccagtttttgttttagattcttcctgtacagtttttgytttagattcttcctgttcagtttttgctttggatagtggcattttttcctgtttgggttttaagtggtttcctatcacttgccggaaaaacacaaaaaccactgaaaggattaataaaataaggcgaaacattatgatggacacaacccaaattgacgagggaatcgcccctctgagcagtcctggaggcccactgtcaatgcttcctccataccccacttcctcacagaatggaggtgcccacccatacatgcagtggcagttttttctgttgttgcaaacaccccgggtattgcattt

SEQ ID NO: 39262 - DNA, 601 bp, Human
agaaggagaccctttctctagaataaataaatgtgcacttagtaggaatgcctgtatcatggaagaaactcaataaacagtataaaatgcatcttagttaatttctagcctatgtatgctctgataggatttatgttacatatgattcattcaggcactggtgttcagaatgcaagtgtgatgataatttaatcagagctgcaaaggtgtgttctaaatactgcataaacctaatcatctttgtctccacctttctgaatgctctaaatacccataaagaggtgggtgtggtctccacagrttcttataaaaggacacggaagagacaagctcagttttctctgaaggagaaggactgcacttagaactgcattttggcgacctctgaaattcagtactgcagtgaatgagcttctgatcttgaggtgaacttaacaaaattatttttggaaaaatcgttgtgggaaccattaaaagaactccagggtgagtgaaacatattgataaaattatatcatctttcctttacacaataataaattagagtgttaaaaatatctcattatctgaaatctacacaatgataccatttgtaactcat

SEQ ID NO: 39263 - DNA, 601 bp, Human
tagaataaataaatgtgcacttagtaggaatgcctgtatcatggaagaaactcaataaacagtataaaatgcatcttagttaatttctagcctatgtatgctctgataggatttatgttacatatgattcattcaggcactggtgttcagaatgcaagtgtgatgataatttaatcagagctgcaaaggtgtgttctaaatactgcataaacctaatcatctttgtctccacctttctgaatgctctaaatacccataaagaggtgggtgtggtctccacaggttcttataaaaggacacrgaagagacaagctcagttttctctgaaggagaaggactgcacttagaactgcattttggcgacctctgaaattcagtactgcagtgaatgagcttctgatcttgaggtgaacttaacaaaattatttttggaaaaatcgttgtgggaaccattaaaagaactccagggtgagtgaaacatattgataaaattatatcatctttcctttacacaataataaattagagtgttaaaaatatctcattatctgaaatctacacaatgataccatttgtaactcatgttcttactatagatttt

SEQ ID NO: 39264 - DNA, 601 bp, Human
agtataaaatgcatcttagttaatttctagcctatgtatgctctgataggatttatgttacatatgattcattcaggcactggtgttcagaatgcaagtgtgatgataatttaatcagagctgcaaaggtgtgttctaaatactgcataaacctaatcatctttgtctccacctttctgaatgctctaaatacccataaagaggtgggtgtggtctccacaggttcttataaaaggacacggaagagacaagctcagttttctctgaaggagaaggactgcacttagaactgcattttggygacctctgaaattcagtactgcagtgaatgagcttctgatcttgaggtgaacttaacaaaattatttttggaaaaatcgttgtgggaaccattaaaagaactccagggtgagtgaaacatattgataaaattatatcatctttcctttacacaataataaattagagtgttaaaaatatctcattatctgaaatctacacaatgataccatttgtaactcatgttcttactatagattttatgaattataaggatactaattgttgttattttgtgctttctatgattgtttaatatagt

SEQ ID NO: 39265 - DNA, 601 bp, Human
tgagaaaaggaagattttgttcctcatttctaatccggcaggcctgagaaggtcttgatacatagttccctgactaaagaaagccatcatggtggagaagttccttgggaaatggatatgacttggggtgtttgctcagtcagatatctgagacctaaacagaaatggtactgagcaataactcagtaggactcaaaagttccaaggcagttggtaaatgacagttatgaataaagcaagggcagaaaaaaacatgtaggggagagaatgaggaactaggtccaggagatgctgaaactgrataataaagacgtcatatcacaccccttggggtatccatctgagagcttgctttccattgccagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaaggtaggctggaccttgaagagctctctcaaatgtggcatcctctacctctggtttgggagaagataacttgagccatcattt

SEQ ID NO: 39266 - DNA, 601 bp, Human
cctcacttgatcctattcttttgtgggttgtaggtaactagaatgagaacactagcaatagatcagatctacaatcaggaaaacatgacacttacctacctctcatgtatactttttcctatataatgtctttccatttgagaagatgctagtttttgtttgtttgtttgtttgtttgtttttgaggtggagtttcgctcttgttgctcaggctcgagtgcaatggcacgatttcagctcactgcaaccttcacctcccaggtacaagcgattctcctatctcagcctcccaagtagctcrgattacaagcatgcactaccacgcctggctatttttttttttttgtatttagtagagatggggttttaccatgttagttaggctggtcgtgaactcctgacctcagatgatccaccagcctcagcttcccaaagtgctgggattacaggcgtgcgccactgtgcccgacctgccagtttttaatttattatgttttttaaacgttcagtttattgaaagttttgttttgtttggtttggtttggttttgtttctgagagagtctcactctgtcacccaggctggagtacagtgatgcgat

SEQ ID NO: 39267 - DNA, 601 bp, Human
tcatgtatactttttcctatataatgtctttccatttgagaagatgctagtttttgtttgtttgtttgtttgtttgtttttgaggtggagtttcgctcttgttgctcaggctcgagtgcaatggcacgatttcagctcactgcaaccttcacctcccaggtacaagcgattctcctatctcagcctcccaagtagctcggattacaagcatgcactaccacgcctggctatttttttttttttgtatttagtagagatggggttttaccatgttagttaggctggtcgtgaactcctgacytcagatgatccaccagcctcagcttcccaaagtgctgggattacaggcgtgcgccactgtgcccgacctgccagtttttaatttattatgttttttaaacgttcagtttattgaaagttttgttttgtttggtttggtttggttttgtttctgagagagtctcactctgtcacccaggctggagtacagtgatgcgatctgggctcacttcaacctctgcctcccaggttcaagagattctcctgcctcagcctcccgagttgctgggattgcaggttcccaccaccacacccagctaat

SEQ ID NO: 39268 - DNA, 601 bp, Human
tgaactcctgacctcagatgatccaccagcctcagcttcccaaagtgctgggattacaggcgtgcgccactgtgcccgacctgccagtttttaatttattatgttttttaaacgttcagtttattgaaagttttgttttgtttggtttggtttggttttgtttctgagagagtctcactctgtcacccaggctggagtacagtgatgcgatctgggctcacttcaacctctgcctcccaggttcaagagattctcctgcctcagcctcccgagttgctgggattgcaggttcccaccaccacacccagctaattttttgtatattttagtagagacgagggttcactatgttggccaggctggtctcaaactaacctcaagtgatccacccgcctcagcctcccaaagtgctgggattacaggtgaaagccactacacctggctgaaagtattgaaagtgaatttctttgtcttttatccttctcatcattttagaggtaactggaatacttttttttttttttgccatccaattcttgaaattgagtagcaaattactattcttggttaccactgccagttcacccccgtcttaactctt

SEQ ID NO: 39269 - DNA, 601 bp, Human
cttgtttcccaggctggagtgcaatggcgcgatctcggctcactacagtctttgcctcccaggtttaagcaattctccttcctcagcctcccgagtagctgggattacaggtgcttgccaccacagccggctaattttttgtatttttagtagagacagggtttcgccattttggccaggctggtctcgaactcctgacctctggtgatccgcccaactcagcctcccaaagtgctgggattacaggcacgtgccactgtgccctgcttgaggacactttttggaaaactgtgagaaggcwgagcgtagagaacttcatgagctccacccatttcttccactctttgcagctcataaaatttagaatctttttcagatgaggacttgaaaagatctgtggaagagcaaacagccattagtggctgtatcatctcccttcactgctgctactgaacatgagaactaggggaaagagcacttgtgaagtcatacaggtccttgtttacattttggagtagtttctgctgctggcattttactactaccaacaactgttttatggagaatcattattactttacctgtcatatttatactccct

SEQ ID NO: 39270 - DNA, 601 bp, Human
ccacattggaactagaaaagaccagggacatgcttattctgcagcgcaaaatcaacgtgtgttatcaggtgcaaggaaagatggtacaggaaggggatggataacaggaacgtgggaaccactcacaggactgggaatgaagcaagacctaagtttccagggctgataccaggtgatgtgctatcctgagcaaacacacaatggctgtcctttgaagaacttgaggactcacacatgcccacggcaccttggcactaggagccagtgatggggccagcccatgccaatggcaagcgtaagrcttctgggttcaaattttgccagtcctaggaaccaccctacctcaatgatagcacaactagtcttggaggggtctgcaaggaaatcaaaccttcttctagtgggtgaacctgcccagctaaggatagcagtcttcttgacctagccagtgccacattttttatgctctttggttttaggccactgagatagaaaagttcagacattattttgtttcaggaggaactggaggcaatgatgacaaaagctgacaatgataatagagatcacaaagaaaagctggagaggttgactcgactac

SEQ ID NO: 39271 - DNA, 601 bp, Human
agcgattctcctgcctcagcctcccaagtagctgggatgacagttgtccaccaccatgcctggctaattttttgtatttttagtagagatggggtttcaccatgttggccaggttggtctggaacttctgacctcaggtgatccacctgcctcagcctcccaaagtgatgggattacaggtgcgagccactgcgcccggcccatctttgttgttttaatacatgttagcagcttctttccctccatcatgtttttctgatttctctgtagagtttcaagtgggcccagcaattgcttccaggggcttaattctgttgtgagaatgagtatcactgttggctctcagggtggtggtgtaacacacaatctctctctctctctctcattctttctctcttgctcctctcccctgtccctctctcctagtcactgtttcctcaaagcagttttagtcggataatagaacttcatcactcatctcctgttattcttgtcagtgatttctctcttaaaagctctaaaatctttgttgcaatttgaggatgctgacagtgacagggcagctggctggacactgaatgcaagtttcatattgtggtgc

SEQ ID NO: 39272 - DNA, 601 bp, Human
cagggcagctggctggacactgaatgcaagtttcatattgtggtgcctcctatacttagtgtagtcactgctgaccagagcctggtctcaggcttgtttgtcaagacacttggctttgttattatacccagtggtgaaagatctgactcacgaaaaccaaattaaccagaagctgatatttaaacccaaatgtttgttattttacaatagtggctattccactgcttccatgaggaacttggaaccacagttcagggcagccctctttcgggaagcaaaatcagtaagtaggtttcttagygagcatggaatagaataaagggacatggctgggcacggtggctcacacctgtaatcccagcactttgggaggacgaggagggcggattgcctgaggtcaggagttcgagaccagcctgaccaacatggtgaaaccccatcgctactaaaaatagaacaattagctgggcatggtggcgggcacctgtaaccccagatacttgggaggctgagacaggagaatcgcttgaacccgggaggcaaagttgcagtgagccgagaccaggccattgcattccagcctaggcaacaagagcgaaac

SEQ ID NO: 39273 - DNA, 601 bp, Human
gcctggtctcaggcttgtttgtcaagacacttggctttgttattatacccagtggtgaaagatctgactcacgaaaaccaaattaaccagaagctgatatttaaacccaaatgtttgttattttacaatagtggctattccactgcttccatgaggaacttggaaccacagttcagggcagccctctttcgggaagcaaaatcagtaagtaggtttcttagcgagcatggaatagaataaagggacatggctgggcacggtggctcacacctgtaatcccagcactttgggaggacgaggmgggcggattgcctgaggtcaggagttcgagaccagcctgaccaacatggtgaaaccccatcgctactaaaaatagaacaattagctgggcatggtggcgggcacctgtaaccccagatacttgggaggctgagacaggagaatcgcttgaacccgggaggcaaagttgcagtgagccgagaccaggccattgcattccagcctaggcaacaagagcgaaactctgtctcaaaaagaaaaaaaaaaaagaataaaagcacataagtgtctctgggccgtgatttatccatgtcagcgtgag

SEQ ID NO: 39274 - DNA, 601 bp, Human
aaatacaccagaggtaagaccttaaaaactctgaagcactaaattgtgggttgtagtgtccccagatgtattattctcagaggtagaagcagaagcagaagcagacacacaagataagcactaatcggccgggcatggtggcttcggcctgtaatcccagcactttgggcagttgaggtgggcagatcacctcaggtcagcctggccaacacggtgaactcctatctctgctaaaaatacaaaatgaggcctggtgcagtggctcacgcctgtaatcccaacactttgggaggccgaggtsggtggatcacctgaggtcaggagttcgagaccagcttgaccaacatggtgaaaccctgtctctactaaaaatacaaaaattagccaggcatggtggtgtgtgcctgtaatcccagttactcgggaggctgaggaaggagaatcacctgaagctgggaggtggaggttgtggtgagctaagatcgcgccattgcactccagcctgagcaacaagtgagaaactccatctcaccaaaaaaaaaaaaaaaaaattagccaggcatggtggtatgtgcctgtaatcccagctactcagtcggga

SEQ ID NO: 39275 - DNA, 601 bp, Human
gaaagaaaaccaagatattaccagctatgtagtattgttgttcttattctgaagcaggtgaattacactgagtggaagttctcagagactaacagcttcataggtgatggctttaaaaatcagcacgaggaagaggaaatgacattatcccattcagcactgaaacagaaggaacctctacatcctgtaaatggtattgtcttttaaaatctattttttttcctagcactttgggaggccgaggtgggcagatcacgagatcaggctttcaagagcagcctggccaacatgatgaaacccstctctactaaaaatacaaaaattagccgggtatggtggcaggcgcctgtaatcccagctacgtgggcggcggaggcaggagaattgcttgaacccaggaggaggaggttgcagtgagccgagattgcaccactgcactcctccagcctgggcgacagagcgagactccatctcaaaaaaaagaaaaaaatatatattttttctgtttaatcatttaattgttttgccaagctagttatttacttttctccttcaccttagaatgctaaagttttcatggaaaattagtatgtaagacctg

SEQ ID NO: 39276 - DNA, 601 bp, Human
aaagaaaaccaagatattaccagctatgtagtattgttgttcttattctgaagcaggtgaattacactgagtggaagttctcagagactaacagcttcataggtgatggctttaaaaatcagcacgaggaagaggaaatgacattatcccattcagcactgaaacagaaggaacctctacatcctgtaaatggtattgtcttttaaaatctattttttttcctagcactttgggaggccgaggtgggcagatcacgagatcaggctttcaagagcagcctggccaacatgatgaaacccgwctctactaaaaatacaaaaattagccgggtatggtggcaggcgcctgtaatcccagctacgtgggcggcggaggcaggagaattgcttgaacccaggaggaggaggttgcagtgagccgagattgcaccactgcactcctccagcctgggcgacagagcgagactccatctcaaaaaaaagaaaaaaatatatattttttctgtttaatcatttaattgttttgccaagctagttatttacttttctccttcaccttagaatgctaaagttttcatggaaaattagtatgtaagacctga

SEQ ID NO: 39277 - DNA, 601 bp, Human
ttaccagctatgtagtattgttgttcttattctgaagcaggtgaattacactgagtggaagttctcagagactaacagcttcataggtgatggctttaaaaatcagcacgaggaagaggaaatgacattatcccattcagcactgaaacagaaggaacctctacatcctgtaaatggtattgtcttttaaaatctattttttttcctagcactttgggaggccgaggtgggcagatcacgagatcaggctttcaagagcagcctggccaacatgatgaaacccgtctctactaaaaatacaaaaattagccgggtatggtggcaggcgcctgtaatcccagctacgtgggcggcggaggcaggagaattgcttgaacccaggaggaggaggttgcagtgagccgagattgcaccactgcactcctccagcctgggcgacagagcgagactccatctcaaaaaaaagaaaaaaatatatattttttctgtttaatcatttaattgttttgccaagctagttatttacttttctccttcaccttagaatgctaaagttttcatggaaaattagtatgtaagacctgaggcccagttttgtgtt

SEQ ID NO: 39278 - DNA, 601 bp, Human
tgtagtattgttgttcttattctgaagcaggtgaattacactgagtggaagttctcagagactaacagcttcataggtgatggctttaaaaatcagcacgaggaagaggaaatgacattatcccattcagcactgaaacagaaggaacctctacatcctgtaaatggtattgtcttttaaaatctattttttttcctagcactttgggaggccgaggtgggcagatcacgagatcaggctttcaagagcagcctggccaacatgatgaaacccgtctctactaaaaatacaaaaattagcygggtatggtggcaggcgcctgtaatcccagctacgtgggcggcggaggcaggagaattgcttgaacccaggaggaggaggttgcagtgagccgagattgcaccactgcactcctccagcctgggcgacagagcgagactccatctcaaaaaaaagaaaaaaatatatattttttctgtttaatcatttaattgttttgccaagctagttatttacttttctccttcaccttagaatgctaaagttttcatggaaaattagtatgtaagacctgaggcccagttttgtgttacaagtgtga

SEQ ID NO: 39279 - DNA, 601 bp, Human
gtattgttgttcttattctgaagcaggtgaattacactgagtggaagttctcagagactaacagcttcataggtgatggctttaaaaatcagcacgaggaagaggaaatgacattatcccattcagcactgaaacagaaggaacctctacatcctgtaaatggtattgtcttttaaaatctattttttttcctagcactttgggaggccgaggtgggcagatcacgagatcaggctttcaagagcagcctggccaacatgatgaaacccgtctctactaaaaatacaaaaattagccgggyatggtggcaggcgcctgtaatcccagctacgtgggcggcggaggcaggagaattgcttgaacccaggaggaggaggttgcagtgagccgagattgcaccactgcactcctccagcctgggcgacagagcgagactccatctcaaaaaaaagaaaaaaatatatattttttctgtttaatcatttaattgttttgccaagctagttatttacttttctccttcaccttagaatgctaaagttttcatggaaaattagtatgtaagacctgaggcccagttttgtgttacaagtgtgatggt

SEQ ID NO: 39280 - DNA, 601 bp, Human
atacctgtaatcccagcactttgggaggcatgggcgggtagatcacctgaggtcgggagtttgagaccagcctgaccaacatgatgaaaccccatctactaaaaatacaaaaaattagctgggcatggtggcatctgcctgtagtcccagctactggggaggctgaggcaggagaattgcttaaacccaggaggcagaggttgcagtgagctgagattataccactgcactccagcctgggcaacagagcaagactccgtctcagtacaaaaaacaaaaaacaggacagtgtttgtcttgrttattgagtttttggcaccccttcaaattttatgcctaaggtcagtgcctcacatgccttcctctacttctgacagtggtcagaatagtggttactgctaggagaaggggaagagggttatcaggaaaggacaccctttgggcatctggagtgctaccagtgttctatttcttggctgaacggtgatagagatgttcattttacaacaatttaataagttgaacatttatatttcatgggcttttctatgtgcttgaaaaatttaataatgagaggaaaaatataaaggtagatatggaa

SEQ ID NO: 39281 - DNA, 601 bp, Human
taaataatgacagtggccagtcatgggggctcacgcctgtaatcccagcaccttgggaggccgaggcaggcagatcacctaaggtcgggagttcgagaccagcctgaccaacatggagaaaccccatctctactaaaaatacaaaaaaaattagccaggcatggtggagcgtccttgtaatcccagctactcaggaggctgaggcaggagaattgcttgaacccgggaggcagaggttgcagtgagccaagatcacgccattgcactccggcctgggcaacaagagcaaaactctgtctcmaaaaaaaaaaaaaaaaaaaaaaaagcaataatgacagtgtgcttagtggccacacaagtgaagggcaatccagttttaatgaagctgatggaaaatgcaaattgtttagttaaatttatgtttcgtgtgaatgaaggtcggctggtacagtcagataaaaggatcattttcttgagatagtgtaaatgatgacttgcttcaatacttctgtcctatctggatcctttgcctcttactcccatatcctccattgtgtcctgtaattcatgcccagcctgaatggtacccctgcctttaagt

SEQ ID NO: 39282 - DNA, 601 bp, Human
acacacgctgtcacgtccagctaatttttttgttttgagacctagtcttgctctgtcacccaggctagagtgcagtggtgcgatatcggctcactgcaacctccgccccccaggttcaagcaattctcctgtctcaccctcccgagtagctgggactacaggcgcacgccaccatgcctggctaattttttgtatttttagtagagatggggtttcaccgtgttagccaggatggtctcaatctcctgacctcgtgatctgcccgcctcggcctcccaaagtgccgggattacaggcgtgrgccaccgctcctggcctccctcttcttaacagttactaatgaggagggagcaatcattttcatttgctctatggtcccagattactgtttctttagcaatagtgaatatcgagaacctcaaaattttttctcttatcgtgtcaatttcaggtgtcaggaatttcctgacccttatgtatgccaggtagtaagttttggcagccctgccccccagccaaattaggtggcacatctgagctaataagccaaagggtgttatctggcactaatccttgcagggtttctgccagcaagttcaaa

SEQ ID NO: 39283 - DNA, 601 bp, Human
tgttcaaagtgttgtgtgcatgtggtttaaaaacatcgaatggggctaaacattttacatgaagcaggcctttgtcccagctcttcacagatcacttcgcctgttcccacccttcctcaatccacggcttcccacatttcagctatatttatttttactttttgaggtggagtctcgctctgttgcccaggctagaatgcagtggtgtgatcttggctcactgccacctctgactccgagattcaagcgattcacgtgactcagcctcccaagtagctgggattgcaggtgtgcgccaccrtgcctggctagttttttgtgtttttagtagaggcggggtttcaccattttggccaggctggtctcaaactcctgacctcaagtgatctgcctgccttggcctcccaaagtgctgggattataggcgtgagccaccaagcccatcctatctcagccatttcttctgttatttacttccatcatatttctgagtattgatttttgttcttcctcttttcctgtttttttttttttttttttttttttttttttttttttttttgagatggagtctgaacatgttgctcaggctggtttcaaa

SEQ ID NO: 39284 - DNA, 601 bp, Human
tagctgggatgacaggtgcacgccacttgcctggctaatttttgtatttttagtagagacagggttttgccatgttggccaggctgatcccaaccccaggtgatccttctgcctcagactcccaaagtgttgggattacaggcgtgagtgaccacacctggtcaacaggaattttttgatgttgacataactaagtgaattttagatctcctttaaagttttaggaaagctggttgtccttattattccaataatctgaagaaggcctcctttcagagtttccagataaaatgtgggacaaacccaaaaaaaaattatttggtcgggtgcagtggctcacatctgtaatcccagcactttgggaggctgaggcgggcagatcacttgaggccaggagtttgagaccagcctggccgacatggtgaaaccccatctctactaaaaacacaaaaaaatcagctaggcatggtggcacatgctggtaattctagctactcaggaggctgaggcatgagaatcatttgaatttgggaggcggaggttgcagtgagctaagattgtgccactgcactccaacctgggtgacaaagcagactctgcc

SEQ ID NO: 39285 - DNA, 601 bp, Human
tggtctttcagctcctgggctgaagcagtcctcctgccctgcctcccaaagtgctgggattataggcatgagccactgtgcccgacctggtgttttaattactttttgaaaggcccaatacttttgtttcatctgcttttactttgtctttggttagtcatagaaagaactgaaaaaggagccagatgaaataaacagtgactctgacttcagcatcactgtgggcttaaacagatgtaagcttacagagaacttttggacatggaaagtgatttggttctttcctttctgtgctaatgtyaaatttagctttcacttttttttccccagcatttccagaactctctcttcctttattcccttacagtgataatcattttctactcaattttagattcgattggtattacctttggctttctttttgccagtatggtctagcagacagagcaggctttgtaatcagaccaaccttgtttttattccagactctttgacttactagctctttgatctttttgatattacttaatttgaaggctcttgtgagaataaaattgagctaatatagtttacataaagcacttggtattgtgcccgg

SEQ ID NO: 39286 - DNA, 601 bp, Human
caggctggtctcgaactcttggactcaagcaatccaccctcttttgcctcccaaagtgttggcattacaggcataaaccactgcgcccggcctccttaaatataattactataatttctttcttttttttttttttttttgagatggagtcttgctcttgttgcccaggctggagtgcaatggaccgatctcagctcaccacaacctctgcctctttcttaatcaagcgattttcctgcctcagcctccctagtagctgggattacaggcatgaaccaccacgcccagctaattttgtatwtttagtagagatggggtttcttcatgttggtcaggctggtctcgaactcccaacctcatgtgattcgccctccactcagcctcccaaagtgctgggattacaggcgtgagccaccgcgcccggccatataatttctaaactggtcttcctgccaccggtttcttctaccccatttccatctactatagtaaatacataatacatttgatcactgccttcttcttaaatccttttacagtttgctatagatcagcatgttttaaaaacatttgtatttgagtacctttagttgggactgcg

SEQ ID NO: 39287 - DNA, 601 bp, Human
ttttttttttttttttttgagatggagtcttgctcttgttgcccaggctggagtgcaatggaccgatctcagctcaccacaacctctgcctctttcttaatcaagcgattttcctgcctcagcctccctagtagctgggattacaggcatgaaccaccacgcccagctaattttgtatttttagtagagatggggtttcttcatgttggtcaggctggtctcgaactcccaacctcatgtgattcgccctccactcagcctcccaaagtgctgggattacaggcgtgagccaccgcgcccrgccatataatttctaaactggtcttcctgccaccggtttcttctaccccatttccatctactatagtaaatacataatacatttgatcactgccttcttcttaaatccttttacagtttgctatagatcagcatgttttaaaaacatttgtatttgagtacctttagttgggactgcgctgtccagtcttcactgttcccattaccttacatagctgggatgtcacctatcttatctgctaggaccttcagacacttaagattatccactagatcaatgtttttcaaacttccagacaca

SEQ ID NO: 39288 - DNA, 601 bp, Human
gaagccgtttttgcgcaaggccgagcactgcatagggtaagtgctggaagccccggcatctccagtagtgaaatcaatttcgtctgccatggtgggcaggggagatggtagtttttccgtgggaactacacaaaaagtttgtgtttgctttttaacaacgggtatgtaggcagggaaacgtctcatttcggacaagttatgtgccaagcatcatgggcccgttatttctgcatgtaaggaacacccaccctagactagtggccactttctaactctggcctctacaaacttttccagctaytgcttggggaggtgggatgagaagtcgcagaggagctcgctgagggtggggacacccgccctgggcgctcctccgtgctggaaacagcaggttgcggcccccatcgccccaccgcagaagccggcgaccttcccccgccgcccagccctcggccgccgccccgaaccctactgcgggggacccagcccaggccgcaggtccccgcgaaggatgcggggtaacagaacctggccagcagcacccggccctctgctagctggcgcgcaccccgccctccacccttcaacgtcgccgccgcgg

SEQ ID NO: 39289 - DNA, 601 bp, Human
ttgcacacatgacagacacctagaaggaaaaaagcaggcaaaacgttattcagaagacaatacatatagaagatataattagttcctcatatattgtatatttgtggatattttgtacatatggacttctgaaaggggtattccaaaacaagctactttctttacagttttctaaagcagaatttctcagagtggtttgtaagacaacttccagggaacaggaaaaataactataaatgtttgaacacttactacccgttacatttctgaaagttgtaacgaagacagtaaatctccttcrctctttaacattccactagcatcatttcttacctgtaagaatagctcagggctgggcgccttgctcaggcctgtaatcccagcacttttgggaggccaaggttgggggatcacctgaggtcaggagttcaaaaccagcttggccaacatgctgaaacccaatctttactaaaaatacaaaaattagccagatgtggtggcacgcgcctgcaatcccagctactcaggaggctgaggggagaatcgcttgaacctgggacgcggaggttgcaatgagccgagatcacgccactgcactcca

SEQ ID NO: 39290 - DNA, 601 bp, Human
gaccagcctagacaacatggtgaaaccccatctctactaaaatacacaaaaaagtagctgggcgtggtggcatgcacctgtagtcccagctacttgggaggctgaggcaggagaattgcttgaactcgggaggcagaggttgcagtgagccgagattgcaccactgcactccagcctggctgatggagtgagactcagtctcaaaaaaaaaaaaaaaaaaaaggaagttggaaaggagtatttactgataaatattactatttattcaacatagttggaaaacaagcattgcatagtatcmtgtaaagcagatcactccctttaaacgttgggggcaaagttaaaagcaaaaacaactgagaaacaacttttcatttttatgctgacttacaaagtcctcacataaaaacttatagatttaatcaaccctctttgccactgtcttttgtgtcttccttataatcttacttgctaactaactttcacccaacagttcagtgcccttctgccaaccataagaagggactaaaaccaccatataaggttacatcaagtttgccaacaatttggtaaatagtatgaccaaagtaatcacatggtt

SEQ ID NO: 39291 - DNA, 601 bp, Human
tgggaggctgaggcaggtggatcacctgaggtcaggagttcaagaccagcctagacaacatggtgaaaccccatctctactaaaatacacaaaaaagtagctgggcgtggtggcatgcacctgtagtcccagctacttgggaggctgaggcaggagaattgcttgaactcgggaggcagaggttgcagtgagccgagattgcaccactgcactccagcctggctgatggagtgagactcagtctcaaaaaaaaaaaaaaaaaaaaggaagttggaaaggagtatttactgataaatattamtatttattcaacatagttggaaaacaagcattgcatagtatcatgtaaagcagatcactccctttaaacgttgggggcaaagttaaaagcaaaaacaactgagaaacaacttttcatttttatgctgacttacaaagtcctcacataaaaacttatagatttaatcaaccctctttgccactgtcttttgtgtcttccttataatcttacttgctaactaactttcacccaacagttcagtgcccttctgccaaccataagaagggactaaaaccaccatataaggttacatcaagtttg

SEQ ID NO: 39292 - DNA, 601 bp, Human
gcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaaygggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgag

SEQ ID NO: 39293 - DNA, 601 bp, Human
gtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcrtcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctct

SEQ ID NO: 39294 - DNA, 601 bp, Human; identical to SEQ ID NO: 17663

SEQ ID NO: 39295 - DNA, 601 bp, Human; identical to SEQ ID NO: 17664

SEQ ID NO: 39296 - DNA, 601 bp, Human; identical to SEQ ID NO: 17665

SEQ ID NO: 39297 - DNA, 601 bp, Human; identical to SEQ ID NO: 17666

SEQ ID NO: 39298 - DNA, 601 bp, Human; identical to SEQ ID NO: 17667

SEQ ID NO: 39299 - DNA, 601 bp, Human; identical to SEQ ID NO: 17668

SEQ ID NO: 39300 - DNA, 601 bp, Human; identical to SEQ ID NO: 17669

SEQ ID NO: 39301 - DNA, 601 bp, Human; identical to SEQ ID NO: 17670

SEQ ID NO: 39302 - DNA, 601 bp, Human; identical to SEQ ID NO: 17671

SEQ ID NO: 39303 - DNA, 601 bp, Human; identical to SEQ ID NO: 17672

SEQ ID NO: 39304 - DNA, 601 bp, Human; identical to SEQ ID NO: 17673

SEQ ID NO: 39305 - DNA, 601 bp, Human; identical to SEQ ID NO: 17674

SEQ ID NO: 39306 - DNA, 601 bp, Human; identical to SEQ ID NO: 17675

SEQ ID NO: 39307 - DNA, 601 bp, Human; identical to SEQ ID NO: 17676

SEQ ID NO: 39308 - DNA, 601 bp, Human; identical to SEQ ID NO: 17677

SEQ ID NO: 39309 - DNA, 601 bp, Human; identical to SEQ ID NO: 17678

SEQ ID NO: 39310 - DNA, 601 bp, Human; identical to SEQ ID NO: 17679

SEQ ID NO: 39311 - DNA, 601 bp, Human; identical to SEQ ID NO: 17680

SEQ ID NO: 39312 - DNA, 601 bp, Human; identical to SEQ ID NO: 17681

SEQ ID NO: 39313 - DNA, 601 bp, Human; identical to SEQ ID NO: 17682

SEQ ID NO: 39314 - DNA, 601 bp, Human; identical to SEQ ID NO: 17683

SEQ ID NO: 39315 - DNA, 601 bp, Human; identical to SEQ ID NO: 17684

SEQ ID NO: 39316 - DNA, 601 bp, Human; identical to SEQ ID NO: 17685

SEQ ID NO: 39317 - DNA, 601 bp, Human; identical to SEQ ID NO: 17686

SEQ ID NO: 39318 - DNA, 601 bp, Human; identical to SEQ ID NO: 17687

SEQ ID NO: 39319 - DNA, 601 bp, Human; identical to SEQ ID NO: 17688

SEQ ID NO: 39320 - DNA, 601 bp, Human; identical to SEQ ID NO: 17689

SEQ ID NO: 39321 - DNA, 601 bp, Human; identical to SEQ ID NO: 17690

SEQ ID NO: 39322 - DNA, 601 bp, Human; identical to SEQ ID NO: 17691

SEQ ID NO: 39323 - DNA, 601 bp, Human; identical to SEQ ID NO: 17692

SEQ ID NO: 39324 - DNA, 601 bp, Human; identical to SEQ ID NO: 17693

SEQ ID NO: 39325 - DNA, 601 bp, Human; identical to SEQ ID NO: 17694

SEQ ID NO: 39326 - DNA, 601 bp, Human; identical to SEQ ID NO: 17663

SEQ ID NO: 39327 - DNA, 601 bp, Human; identical to SEQ ID NO: 17664

SEQ ID NO: 39328 - DNA, 601 bp, Human; identical to SEQ ID NO: 17665

SEQ ID NO: 39329 - DNA, 601 bp, Human; identical to SEQ ID NO: 17666

SEQ ID NO: 39330 - DNA, 601 bp, Human; identical to SEQ ID NO: 17667

SEQ ID NO: 39331 - DNA, 601 bp, Human; identical to SEQ ID NO: 17668

SEQ ID NO: 39332 - DNA, 601 bp, Human; identical to SEQ ID NO: 17669

SEQ ID NO: 39333 - DNA, 601 bp, Human; identical to SEQ ID NO: 17670

SEQ ID NO: 39334 - DNA, 601 bp, Human; identical to SEQ ID NO: 17671

SEQ ID NO: 39335 - DNA, 601 bp, Human; identical to SEQ ID NO: 17672

SEQ ID NO: 39336 - DNA, 601 bp, Human; identical to SEQ ID NO: 17673

SEQ ID NO: 39337 - DNA, 601 bp, Human; identical to SEQ ID NO: 17674

SEQ ID NO: 39338 - DNA, 601 bp, Human; identical to SEQ ID NO: 17675

SEQ ID NO: 39339 - DNA, 601 bp, Human; identical to SEQ ID NO: 17676

SEQ ID NO: 39340 - DNA, 601 bp, Human; identical to SEQ ID NO: 17677

SEQ ID NO: 39341 - DNA, 601 bp, Human; identical to SEQ ID NO: 17678

SEQ ID NO: 39342 - DNA, 601 bp, Human; identical to SEQ ID NO: 17679

SEQ ID NO: 39343 - DNA, 601 bp, Human; identical to SEQ ID NO: 17680

SEQ ID NO: 39344 - DNA, 601 bp, Human; identical to SEQ ID NO: 17681

SEQ ID NO: 39345 - DNA, 601 bp, Human; identical to SEQ ID NO: 17682

SEQ ID NO: 39346 - DNA, 601 bp, Human; identical to SEQ ID NO: 17683

SEQ ID NO: 39347 - DNA, 601 bp, Human; identical to SEQ ID NO: 17684

SEQ ID NO: 39348 - DNA, 601 bp, Human; identical to SEQ ID NO: 17685

SEQ ID NO: 39349 - DNA, 601 bp, Human; identical to SEQ ID NO: 17686

SEQ ID NO: 39350 - DNA, 601 bp, Human; identical to SEQ ID NO: 17687

SEQ ID NO: 39351 - DNA, 601 bp, Human; identical to SEQ ID NO: 17688

SEQ ID NO: 39352 - DNA, 601 bp, Human; identical to SEQ ID NO: 17689

SEQ ID NO: 39353 - DNA, 601 bp, Human; identical to SEQ ID NO: 17690

SEQ ID NO: 39354 - DNA, 601 bp, Human; identical to SEQ ID NO: 17691

SEQ ID NO: 39355 - DNA, 601 bp, Human; identical to SEQ ID NO: 17692

SEQ ID NO: 39356 - DNA, 601 bp, Human; identical to SEQ ID NO: 17693

SEQ ID NO: 39357 - DNA, 601 bp, Human; identical to SEQ ID NO: 17694

SEQ ID NO: 39358 - DNA, 601 bp, Human; identical to SEQ ID NO: 17663

SEQ ID NO: 39359 - DNA, 601 bp, Human; identical to SEQ ID NO: 17664

SEQ ID NO: 39360 - DNA, 601 bp, Human; identical to SEQ ID NO: 17665

SEQ ID NO: 39361 - DNA, 601 bp, Human; identical to SEQ ID NO: 17666

SEQ ID NO: 39362 - DNA, 601 bp, Human; identical to SEQ ID NO: 17667

SEQ ID NO: 39363 - DNA, 601 bp, Human; identical to SEQ ID NO: 17668

SEQ ID NO: 39364 - DNA, 601 bp, Human; identical to SEQ ID NO: 17669

SEQ ID NO: 39365 - DNA, 601 bp, Human; identical to SEQ ID NO: 17670

SEQ ID NO: 39366 - DNA, 601 bp, Human; identical to SEQ ID NO: 17671

SEQ ID NO: 39367 - DNA, 601 bp, Human; identical to SEQ ID NO: 17672

SEQ ID NO: 39368 - DNA, 601 bp, Human; identical to SEQ ID NO: 17673

SEQ ID NO: 39369 - DNA, 601 bp, Human; identical to SEQ ID NO: 17674

SEQ ID NO: 39370 - DNA, 601 bp, Human; identical to SEQ ID NO: 17675

SEQ ID NO: 39371 - DNA, 601 bp, Human; identical to SEQ ID NO: 17676

SEQ ID NO: 39372 - DNA, 601 bp, Human; identical to SEQ ID NO: 17677

SEQ ID NO: 39373 - DNA, 601 bp, Human; identical to SEQ ID NO: 17678

SEQ ID NO: 39374 - DNA, 601 bp, Human; identical to SEQ ID NO: 17679

SEQ ID NO: 39375 - DNA, 601 bp, Human; identical to SEQ ID NO: 17680

SEQ ID NO: 39376 - DNA, 601 bp, Human; identical to SEQ ID NO: 17681

SEQ ID NO: 39377 - DNA, 601 bp, Human; identical to SEQ ID NO: 17682

SEQ ID NO: 39378 - DNA, 601 bp, Human; identical to SEQ ID NO: 17683

SEQ ID NO: 39379 - DNA, 601 bp, Human; identical to SEQ ID NO: 17684

SEQ ID NO: 39380 - DNA, 601 bp, Human; identical to SEQ ID NO: 17685

SEQ ID NO: 39381 - DNA, 601 bp, Human; identical to SEQ ID NO: 17686

SEQ ID NO: 39382 - DNA, 601 bp, Human; identical to SEQ ID NO: 17687

SEQ ID NO: 39383 - DNA, 601 bp, Human; identical to SEQ ID NO: 17688

SEQ ID NO: 39384 - DNA, 601 bp, Human; identical to SEQ ID NO: 17689

SEQ ID NO: 39385 - DNA, 601 bp, Human; identical to SEQ ID NO: 17690

SEQ ID NO: 39386 - DNA, 601 bp, Human; identical to SEQ ID NO: 17691

SEQ ID NO: 39387 - DNA, 601 bp, Human; identical to SEQ ID NO: 17692

SEQ ID NO: 39388 - DNA, 601 bp, Human; identical to SEQ ID NO: 17693

SEQ ID NO: 39389 - DNA, 601 bp, Human; identical to SEQ ID NO: 17694

SEQ ID NO: 39390 - DNA, 601 bp, Human
aggtcaggggcgcatgagcacattgctcacctcactgctgtggttcagaggggtacacgtggcccatctaatgctgtccaggtggaaaggccactggtccctccctgtgggtgaacagcttgcccttggggctcccagagcacttggctcaccctaatggtccaaacactggggcctccacactctcatcccacatcctcaaactctgccaccacctccttctgctctccaggcccttcccactcagcagtcctcatctgacaaggtggtcattctctccccctcaagacacattctcccrtggctcctggaaggtgctagcctggcgtctcccccttcctctctggccgctgttgttccatgtcctctgcttgttcctcctagctttcctgacttctgaacataggagcaccccggggtgcagttctcagacctcaccgctgtccacatccacttcctaagcaagctcattcatcccatggttccaaagcccatctctacactcagcgtgcctggatgtgtgtctccagcttggctctcctcctagacctacagctgtgtgcaccccgctgcctcctccacatctttactttgttgttgt

SEQ ID NO: 39391 - DNA, 601 bp, Human
aaaggcaggccttgcccttgacttctagagaaacggaagcaccaccacaagtgttaaaggaaggggatatgcttagctcagggcttgagtgcctgagaggcagccctggagtcccggccccttccgatgctgggaaggaacagcagcacgcagctcccctcgggctctcacctgcaccacttgggtgaaggtgttcttggcctcctgcacctgctcttcttggccttgctgcctccggtccctgtcggcctgggagctctcagcctcgggctgttctgtccacgtgtgctcacttacagayaccaggaccttctcgtactcctgagatccaccgggctctagcccttcagtcatggtacttgttccctggaatgagtgtggaccttgcgtgacctcctcttgccaggaaccttgtgcagcatcttgcaggtatgagacaatcgagccgtctgcatcccagtcctgcagtctggggtccagaagaagcagcagatggccggccggggagagagaaaagacacctggtcacccatcagtctcattccttttagacactctccccacccagagctctggctcatcaaggacacagaccgtcctc

SEQ ID NO: 39392 - DNA, 601 bp, Human
agaattccagagccaagtaactttggcgacattccaatcactccctcctttaccagtgaggaccctgaggtgctgggaagagagcgccttgggcacgtcacccaggtcaccataggaggagagtaagcccaacgcccagtgctcggttcctagccctttctaaaacgcgacagaacaagaaaaccaacaaaagccacaactttggagtcagccagacccagcttagagcccacttctgaaactgtgatcttgagcaagttgctcagccactctgatcagcagctgcccaacaggtacaggygccttagcagggatccaggaggcagaaaggcaggccttgcccttgacttctagagaaacggaagcaccaccacaagtgttaaaggaaggggatatgcttagctcagggcttgagtgcctgagaggcagccctggagtcccggccccttccgatgctgggaaggaacagcagcacgcagctcccctcgggctctcacctgcaccacttgggtgaaggtgttcttggcctcctgcacctgctcttcttggccttgctgcctccggtccctgtcggcctgggagctctcagcctcgggctgtt

SEQ ID NO: 39393 - DNA, 601 bp, Human
gtgtgaccctggagaaagcccttggctcctctggtccacagtgccctcatttataattgagggagttggatgtgtgatctagaaggcccttccagttcccctcaccaaaggctgaccacagaggggcagtggaaaaaagtgctgtaggcgtctttctctttccccagggattcaggagaagagacccagttaagatcatgtgtgctctgggagcaggagaactaggcgcccaggagggcctgatggaagaaacggacgggccgcctgtggtgaggagtgcacacaggcgctggccctgccyggggcacatacttggcaggggagcattctaaataaaacctgactgaattcctagcagttctatggctggcagctcagggccttccttccagagccaccctagtcctggagtctaaggttcaggtaggaaagaagggagacaaggaaagaaagagaggaaggagaggagaggaggaagcaccatgcctggatgaggcgtgaaaacagagacagaacatgtcgttcatgtacatactaaacacacgcatgtggagaacagtggtgcatgttttataagaacacaaatggaaaagacacccat

SEQ ID NO: 39394 - DNA, 601 bp, Human
ggcatccttatcagccctcggggcctgtgagatgggcaccggcagcagcctgccaggccctctgatcggcgtctccagttccgggctgggcatgctggccttgcacgtgcatgctggacgtgaggatgtagggcttgggaactgagggatctggaccctcctggtccctgacattggtccactgtgtgaccctggagaaagcccttggctcctctggtccacagtgccctcatttataattgagggagttggatgtgtgatctagaaggcccttccagttcccctcaccaaaggctgaccrcagaggggcagtggaaaaaagtgctgtaggcgtctttctctttccccagggattcaggagaagagacccagttaagatcatgtgtgctctgggagcaggagaactaggcgcccaggagggcctgatggaagaaacggacgggccgcctgtggtgaggagtgcacacaggcgctggccctgcccggggcacatacttggcaggggagcattctaaataaaacctgactgaattcctagcagttctatggctggcagctcagggccttccttccagagccaccctagtcctggagtctaagg

SEQ ID NO: 39395 - DNA, 601 bp, Human
tctatctccatcactgttttcagaggtccagtggaaatactaataagtgggtgctttgcaaaccatcaatcaccttcaagggcatccttatcagccctcggggcctgtgagatgggcaccggcagcagcctgccaggccctctgatcggcgtctccagttccgggctgggcatgctggccttgcacgtgcatgctggacgtgaggatgtagggcttgggaactgagggatctggaccctcctggtccctgacattggtccactgtgtgaccctggagaaagcccttggctcctctggtccrcagtgccctcatttataattgagggagttggatgtgtgatctagaaggcccttccagttcccctcaccaaaggctgaccacagaggggcagtggaaaaaagtgctgtaggcgtctttctctttccccagggattcaggagaagagacccagttaagatcatgtgtgctctgggagcaggagaactaggcgcccaggagggcctgatggaagaaacggacgggccgcctgtggtgaggagtgcacacaggcgctggccctgcccggggcacatacttggcaggggagcattctaaataaaa

SEQ ID NO: 39396 - DNA, 601 bp, Human
aaataatacagtccgagaaagcagctacttgtgtgtctccttgggctgctactgcggtgatccaaatgctgttccccggcatggtagggatgagaccagctaataccctgggtacttagcggtctgtttcaaaaattgctccaaaagggtgagtgatgggctcagggacagtcaagtgagcccagcaggggcccagcacaggtggtggggccacctggaagccggtctgtaattcctgtcagcccacaggcccttgcacccttcctttatggggtacagcctcccaaaactgaagcatggrgctggtgtgtctatttaaggcctgttcttaaaggctcttccagggctgggctatcaacgcccactgagcaggaacaacgcgtattaaacttgtatttacagagctgattcacaaatgtagccgcagcagctgcggctggaaaaaatttcactttctagatcaggttgttcctctctgagtggcaatgcagcatggcagaaagaacacagatctgggacacagcagactaaccctgcaactcacctactgtggggtcttgggaaggctggggaccttctctgtgcctcagtttcctcatct

SEQ ID NO: 39397 - DNA, 601 bp, Human
tcactgtttctctctctgtgggcaggacaccgaatggccctctcggctgaagcagcccggcccaagtgcccttctgcccagcagccaggctctgccctgagtggcccgggtgacatcacgctcctataattttacctccccaaaccagctgccggagctgtccaaccgggctagaaggaagccggcaggtgcccatgtcctgagcactgaaagcacaagtgaaagtcactgtgtgagtgacacccgctgctgcctaaccccgccctgcccagagacctggaagtgggggctcggcctctcrcctatcctgcccatccccatgggaactagaaagagttctgcccagggaaagtttcttactttcagaaaataatacagtccgagaaagcagctacttgtgtgtctccttgggctgctactgcggtgatccaaatgctgttccccggcatggtagggatgagaccagctaataccctgggtacttagcggtctgtttcaaaaattgctccaaaagggtgagtgatgggctcagggacagtcaagtgagcccagcaggggcccagcacaggtggtggggccacctggaagccggtctgtaatt

SEQ ID NO: 39398 - DNA, 601 bp, Human
gcccaataactcccccagcaggaaacccggctcagcatgtagcaggagccatgccagggctcccagggcgtgggcggcgcccctgagggtctgggaggcctgaagacgaacggtcgagctcacaattgtgcacttggccctcacaacaccccctgggaacctgcaaaatgggggcaattatgcaagtctgacggaggaggccctgagagaggaagtgaggcacctgtttcctatttttacagcactttgcagtatagaaaagcccttcgacaggcagcatcacccagaatgtgacttgctygaaaccccagagccagttggtgacagaaacaggacgatccgggtgcaatcccatggtggctcacgcctgctatcccagcactttgggaggccaaggccggaggaccacttgagcccaggagttcaagaccaatttgggcaacatagcgagcccccatctctacaaaaatttttttaaaatagccaggcatggtggtgtgtgcctgtagtaccagctactcagaaggctgaggcaggaggatcacttgagcccaggaatttacagtaagcccaggttacagtgagccatgagcatgccact

SEQ ID NO: 39399 - DNA, 601 bp, Human
gcacccaccttcttggtgacaatgttgccctgctcatccgtgaattgctcctctgtcacctgctcccctggaatattctgaaactcattcccctggaattagagaaagggagaaaatgcaagattggtgagtgggagtctgggaggaagggtggaggacgaggaaatgaaacagcagtagccacaatagccatggcccaataactcccccagcaggaaacccggctcagcatgtagcaggagccatgccagggctcccagggcgtgggcggcgcccctgagggtctgggaggcctgaagasgaacggtcgagctcacaattgtgcacttggccctcacaacaccccctgggaacctgcaaaatgggggcaattatgcaagtctgacggaggaggccctgagagaggaagtgaggcacctgtttcctatttttacagcactttgcagtatagaaaagcccttcgacaggcagcatcacccagaatgtgacttgcttgaaaccccagagccagttggtgacagaaacaggacgatccgggtgcaatcccatggtggctcacgcctgctatcccagcactttgggaggccaaggccggaggacc

SEQ ID NO: 39400 - DNA, 601 bp, Human
aggtgcctgtaatcccagctactcaggaggctgtggcaggagaatcacttgaacctggtggatggaggttgcagtgagctgagattgcatcactgcactccagcctggttgacagagcaacactctgtgtcaaaaaaaaaaaggcgggggggctggtcaagccctcaagacagagcttcagaacagcagttcccaggaatgagctccgagggggaggtagcttttgtcctaggagcccctccttgagaggccaagaagagggacagcctttgccccattgcttaatggaaaaccctctgcyagacagccctgaaggggccttggcagtgtcatttcatgaccaaggtgtgactgggtgtgacctccccctcgagcccacagccttctgttttgctttttgatatggatgggagtttgtgctcttccccattctactcccatgagcctaagggcagagggcatctctttttcacccacccattcccgtattcacctgtccaaatcttcaaaccctttactctgtatctgccgtgtgctctgagtgggaggtgaaacatcagtgagacactgtccctgcctgcaagcagctcacagtgcagga

SEQ ID NO: 39401 - DNA, 601 bp, Human
ctcccgagaggctactccaaggagagcggctcggggtcactgtttcccccttttcaggctggcccgcttcactatctgcgcccccttcctgccctctatcaggtccggctgtaggccactccctctcagctccacctgcagacagcagcagagacagaaagcaggacagatcgcaaagacgggcagaacacaggcagaagatcgaaaggaggccacacggaggtggcagacacactgcccaccagggagaagagagactggagagagagctcataaagaggtgagtggagggaggtgtcaygcagacggcccggcagagcaaggcagcagtgatggcgctgggtcccccagggccgcgggcgcctcagtaccttggagtgtttcataaagtaatcaatatcgacctccagctcactgggatcctccaggggcccctctacagtcacctcctcgtgctcctgggcggcatcggcgctggacaagtctatctgtcgaaccaccttgcgaatgatctaggaaaggaagggaaggaggaaagggctggtcaggccgggctcgggggctcatgtctgtaatctcagcactttgggaggctgacgtg

SEQ ID NO: 39402 - DNA, 601 bp, Human
caccacacacacctgctggagatggtcgcacagcgtcttcatgtcccttcctcatggcacggcacggcacggcatgcccctgctctgtggccacactgccccatgctcacacacatgcaccacagcccaggccccggccccaaccctgacggtctcctgacttgcagaaagcacgtcgtccaccccttaggcctgtcggctcagccctttcctagaaagcaagggagcaacgtgtttcacaaaacaccaaagagaagctaagccttggcctggtgagaactgtagctgggctccaggttcwagagacagtccagtcctcagtcttggagctcttatgttgaagcatcacagcccagaccaactctcctgtcctcttcaatgccctgtccactgctttctagatccccattgcttggtttccaagataatattaccacttagatttacagagtgcttttacttttcaaagagcatttttttctttctggcttttttttttcttttttttgtgatggggtcttgctctgttgcccaggctggtcttgaactcctggcctaaagcaatccttttgcctcgacctcacaaaatgctgggattaca

SEQ ID NO: 39403 - DNA, 601 bp, Human
ccattccctccttaaggaacatcccagccttcttgcacttcgcaccagacagcacttcagcactgccctcaggggccattctaaacaatgaaaccaaaaatgtgaaaaatgtggcactacacaagctgcaaggaggacacttatttatagtatgaggcacagaggcagagtgtggcattgttcatcctcagctgggattgcacgtgttgggcgactcaaactttctgcccttgtgtgtgtgtccatgaatgagccaaagcacggtgagtgccagctttggggctacagataaatgttagcragtggacgaattcgcaaatgcagaatccgtgaatgatgaggatcgactgtacatgcttgtcggggatgcggatagtaaattaggaagcctttgggccctcaaccgtcttctctgtagcctttgccctggttgggagggtagggcatttaatgctgtcccctaaccctctgggactttggcaggagcttttctccgcctctccctcaccactgctctcgccccaccgccccacccccctgccaccctcacacttgtccctgtgcctgtcactgacagagggccaagtgctgtcccagagcc

SEQ ID NO: 39404 - DNA, 601 bp, Human
cactgctcctaagggaaatacaaggttaggctcccatgagcctctggccacaatattttggtcaactgatgaatacataactttgtgttaaatgcgtttctgtttcaagacgccttatgtaatatatagggttgactcattaacactgacttcaccaccacaagcactctaactcatccctgagcagagcttatctgatgtccattccctccttaaggaacatcccagccttcttgcacttcgcaccagacagcacttcagcactgccctcaggggccattctaaacaatgaaaccaaaartgtgaaaaatgtggcactacacaagctgcaaggaggacacttatttatagtatgaggcacagaggcagagtgtggcattgttcatcctcagctgggattgcacgtgttgggcgactcaaactttctgcccttgtgtgtgtgtccatgaatgagccaaagcacggtgagtgccagctttggggctacagataaatgttagcgagtggacgaattcgcaaatgcagaatccgtgaatgatgaggatcgactgtacatgcttgtcggggatgcggatagtaaattaggaagcctttgggccct

SEQ ID NO: 39405 - DNA, 601 bp, Human
acatgcctgtaatcccagctactcaggaggctgaggcaggaagatcacttgaacccgggagatggaggttgcagtgagccgagatagtgccactgcactccagcctgggcgacagagcgagactccctctcaaaatataaataaataaataaataaataaataaataaataaatagtcgctgtgaacacggaattagcaaatactgaaccactgctcctaagggaaatacaaggttaggctcccatgagcctctggccacaatattttggtcaactgatgaatacataactttgtgttaartgcgtttctgtttcaagacgccttatgtaatatatagggttgactcattaacactgacttcaccaccacaagcactctaactcatccctgagcagagcttatctgatgtccattccctccttaaggaacatcccagccttcttgcacttcgcaccagacagcacttcagcactgccctcaggggccattctaaacaatgaaaccaaaaatgtgaaaaatgtggcactacacaagctgcaaggaggacacttatttatagtatgaggcacagaggcagagtgtggcattgttcatcctcag

SEQ ID NO: 39406 - DNA, 601 bp, Human
gcgggttgcttgaggtgaggagctcgagacgagcctgaccaacatggtgaaaccccgtctctactaaaaatacaaaaattagccaagggtggtggcacatgcctgtaatcccagctactcaggaggctgaggcaggaagatcacttgaacccgggagatggaggttgcagtgagccgagatagtgccactgcactccagcctgggcgacagagcgagactccctctcaaaatataaataaataaataaataaataaataaataaataaatagtcgctgtgaacacggaattagcaaatacygaaccactgctcctaagggaaatacaaggttaggctcccatgagcctctggccacaatattttggtcaactgatgaatacataactttgtgttaaatgcgtttctgtttcaagacgccttatgtaatatatagggttgactcattaacactgacttcaccaccacaagcactctaactcatccctgagcagagcttatctgatgtccattccctccttaaggaacatcccagccttcttgcacttcgcaccagacagcacttcagcactgccctcaggggccattctaaacaatgaaacc

SEQ ID NO: 39407 - DNA, 601 bp, Human
ttgaggctgtgcacagtggctcatgcctgtaatcccagcactttgggaggctgaggagggcgggttgcttgaggtgaggagctcgagacgagcctgaccaacatggtgaaaccccgtctctactaaaaatacaaaaattagccaagggtggtggcacatgcctgtaatcccagctactcaggaggctgaggcaggaagatcacttgaacccgggagatggaggttgcagtgagccgagatagtgccactgcactccagcctgggcgacagagcgagactccctctcaaaatataaataaataaataaataaataaataaataaataaatagtcgctgtgaacacggaattagcaaatactgaaccactgctcctaagggaaatacaaggttaggctcccatgagcctctggccacaatattttggtcaactgatgaatacataactttgtgttaaatgcgtttctgtttcaagacgccttatgtaatatatagggttgactcattaacactgacttcaccaccacaagcactctaactcatccctgagcagagcttatctgatgtccattccctccttaaggaacatcccagccttcttgc

SEQ ID NO: 39408 - DNA, 601 bp, Human
agagtctctttcattctttatttttatttcatttagagacagagtcttgccctgttgcccaggctagcgtgcagtggtataatcatagctcactgcagccttgaactcctgggctcaagcgatcctcccacctcagtttcccaagaaactggaactacaggtgtatgccaccatgtccagctaatttttaaactttttttgtagagacagggtcctaccacattgcccaggctcatctcaaattatcctcctgcctcagcctcccaaagtgctgggattacaggcatgagtcactatgccyggccctagacagccctttcacaaacataaactcagcaaccatcataaccatcctacaagggaaatgctggcattattgctagtttatggctaaggaacctgaggcttagggaagtcatttgacttgctccgagtcacactacaaacaagacctgcaattgtttgagtcccagagcatatatgttcttatttactctcttcacatcagtgctcacagttaccattattatttctaaacctttttcttgaagtgtagcacattcgaaagggacattttcatcctcccttgaggagactgaag

SEQ ID NO: 39409 - DNA, 601 bp, Human
gtgccttacctgctctgtgagtcagttttctctgctgtaaaatgagggcagtaatagggcctacccattagagaggtgtgatgtttaaaaaagctaagacacataggtgcttagcattgtatgaatgcaaacaattacttggctctctagaaatgttaccgtctctgtccatctgtgctttttgatgtctgcatatttccctgactagattagaaacactgagggcaagaacagcctcctggtgctccccacggtgcctgccccaagaagtgctcctcaaataagagaccatcatggaatrtgcagcctgggaaagacaggctaggatctcccatctactttaccgcccaggcactgagcagaagagaaagttcagacctcagagatcatgctggcatgactgcccatttcatcccttggtaaactgagactctagaggcacagtggcaagagcaggggtgagatgaggacctaggccacctcactctgcccaggactcctgcattgttctggcctcttctcctgggtcccctcacctttcaaaagcttagaaaagagtctctttcattctttatttttatttcatttagagacagagtct

SEQ ID NO: 39410 - DNA, 601 bp, Human
ctgcagaggttctgcctgccgccctcaacacctccaccccacaaaaccttcctgatccttcctggagcaggcccctctccactctggaagctctcccttttgtattttgtaaaaatacaaaatacaaaaaagaaaaaagctgccttttctgttcaggagatggcagagtcgagtgggtaagagcatgaactctggagccagaccacccgggttcaagtcccatgctgcctgacctcggtcaagtgccttacctgctctgtgagtcagttttctctgctgtaaaatgagggcagtaataggrcctacccattagagaggtgtgatgtttaaaaaagctaagacacataggtgcttagcattgtatgaatgcaaacaattacttggctctctagaaatgttaccgtctctgtccatctgtgctttttgatgtctgcatatttccctgactagattagaaacactgagggcaagaacagcctcctggtgctccccacggtgcctgccccaagaagtgctcctcaaataagagaccatcatggaatatgcagcctgggaaagacaggctaggatctcccatctactttaccgcccaggcactgag

SEQ ID NO: 39411 - DNA, 601 bp, Human
tgagaatgctaaagattaaaggggttaagctatttgtccaaagttacacagctagaattttcctgctgtttccaagctctcagtaaccttctgggtgtgtttgttatttctggaatgacaagggtataaataaatgcataaagaattgaagttgaaaggattcaaaatctgttttctgatgtaaaatcagcttcatttcttactaaaccctattgatacctctcacacctaccaccccttcctccgacatgcttattctttctttctttctttctttcttcttttcttccttccatcctcygattattttcctctctctttctctctctctctctctctctctctgtctctttcttccctctttctgcctttgttttacttaggtgatgttattttttgtctgtttagttacatctcaaagagtaatagaacattgcaccctaaaatttttaaaaatcattccatgaaaaacctctattatagtttataaaaagaatataggcaaattttgaagacacagcagagaatgtatttgttttttcccagctgccttaagtgacccaccaagaaagccctgggctctagctcttaattaccccag

SEQ ID NO: 39412 - DNA, 601 bp, Human
aattaccccagagagtctcctctctatgggtaacagtttcagtaacaactttccctcacgctactagcacaacctactgacatgagagtcccaggagtgttcagttttgtttcataaaatggcctgtattgtcacaaccacatttaattaacttttatttactgtctcaaaggatctttgttacaaagaccggcactggcatgaaggatgcttcaagtgcaccaaatgcaatcactctttggtggaaaagccttttgctgccaaggatgagcgcctgctgtgcacggagtgctattctaaygagtgctcctccaagtgcttccactgcaagaggaccatcatgcctggtagggtctcaagggggctcctgtctctaactgaagctgtgatgcttttcattaagtcccagcacatgaggagtgcagcagctcccaaaaccctggttttgagaaagatatctttcttactctctcaatcttcttccgtgtactttagaaataaaaagattattcattcattatccttgaacaggtaaattacagtgttctgtgtattttcatatagtctaattcatagaaacatttcaaaccagaatcttacc

SEQ ID NO: 39413 - DNA, 601 bp, Human
tctctcttagggaagacagggttcatgtatatcattccacttttggcaaggactaattctttatattttgatcttctcaatctctatggtcagcagcataagaacataattcattctctgccactcttgctctctcattttcttattatggattcagagaatttctagaaggccataactgcacagtatagtctcagtagttgtgctctgggcatttttaatacccttgtaatgattattatggcccaatttatccaaaccatgtgaaaccattaggagtctccattaaaagtacttttayatctccagattataggttatgcagagcttgaaaaagttttcagtctaagagtgattctccatcatcatggctaaactttattaaccatttttttttctccagatgaatgggtttttttgaacctgaaaaaatactatttttctaaaaggacaattcatttatcatcttaacttaaaacgtttttaagtaatttgatctgtatttgcttaaaaaataaaattatgcttgacttatactaacatggccttacttttggagtacaggttcccgcaaaatggaatttaagggaaactactggca

SEQ ID NO: 39414 - DNA, 601 bp, Human
ggtattccagttcatttcactgttttttgttgttgttgttgttttatttttttgggatggaatctcgctctgtcacccaggctggagtgcagtggtacaatctcggctcactgcaacctctgccttccaggttcaagagattctcatgtctcagccttccaagtagctgggattacaggtgcgtgccactgtgtccagctaatttttgtatttttagtagagacagggtttcaccatgttggctagtctggtctcgaactcctgacctcaggtgatccacctgccttggccttccaaagtrctgggattacaggcatgagccaccacactcggcccattcactgcttttatacaagatctcacgtattctgggagaaagcacaggtctctctttgaatacagatgtttcttaaaaaataatgtttgatctattcagtattaactgtttcagagaaatatggatttgcctcacaaagtgactaagggaaccaagttaaacaggatgtttaacttctcacattctttctcagcaatgcaaatgtcttcttgacttgaagcttttgtatttcctatgagtagggcaatcggctcaagagagtgc

SEQ ID NO: 39415 - DNA, 601 bp, Human
ctgagttggccaattttaggctgcatttcttaaagacagactaaaacagtaatgatatttgtgagaattatcctaaaatcatttatcagacacaataatgaagactctttcaatgctataacaattcaagagtgaaacttctttagtacatccatgctgagcactgtctgggccaagtgctgatgtttcccaggttattggagcctgtaactatatttaggatatgatttgaagtcatcaaaaatttacaaaatatttatattgggtagtagacagattatgacatgccagattatttttyatttagtttttaaaaccacaagtccttttctaaaaagctagatttgtttttgatcaagatgatccaatctaaacaatttttttcaacccaaaccaaagaccaaatattttcttaaaaaaaggaaaaactacttgacaaccaggctgttagaacttttaagctttaaaatccatagattttattttgttaaactaagatttattttctgccagaaagcaaatgattttaaactacaagtgcttcaaattcaaactcctcaaggttcaaaaggagttaaacgtcttcttcgatttttcatct

SEQ ID NO: 39416 - DNA, 601 bp, Human
aaaagaacatcctaacataaggtgaaaatagagtagccaaaagcaccagttgtggcatagaagacatgaaatgatcttttttttttctttttgcttccttttctccccagagatactaggatctcaaaagaatcatgaaatgatctgaattgtaatggctcccatggtcattgccttttctgtggtctttggcaggtgataacttcaggtgggataacattttgtgaccagctatggcataaagagtgttttctgtgtagtggctgtaggaaagatctctgtgaagaacagttcatgtccrgagacgactatccattctgcgtggactgctacaaccatctttatgccaacaagtgtgtagcctgttccaaacccattagtggtgagttcttcagttcaatatgatcatgccatgagacagttatgactttatgaaacactatctagttaatttaggaaaagcaattaaaaaatgggaagctttcctttatatttccttttgagataaacacaagtgggtgcatatatatgagtataaatattacatggattcctcaaggaaagtacaagagtataatttgggtgactatactctgtgaag

SEQ ID NO: 39417 - DNA, 601 bp, Human
acataaggtgaaaatagagtagccaaaagcaccagttgtggcatagaagacatgaaatgatcttttttttttctttttgcttccttttctccccagagatactaggatctcaaaagaatcatgaaatgatctgaattgtaatggctcccatggtcattgccttttctgtggtctttggcaggtgataacttcaggtgggataacattttgtgaccagctatggcataaagagtgttttctgtgtagtggctgtaggaaagatctctgtgaagaacagttcatgtccagagacgactatccrttctgcgtggactgctacaaccatctttatgccaacaagtgtgtagcctgttccaaacccattagtggtgagttcttcagttcaatatgatcatgccatgagacagttatgactttatgaaacactatctagttaatttaggaaaagcaattaaaaaatgggaagctttcctttatatttccttttgagataaacacaagtgggtgcatatatatgagtataaatattacatggattcctcaaggaaagtacaagagtataatttgggtgactatactctgtgaaggtaactacatacta

SEQ ID NO: 39418 - DNA, 601 bp, Human
gtgaaaatagagtagccaaaagcaccagttgtggcatagaagacatgaaatgatcttttttttttctttttgcttccttttctccccagagatactaggatctcaaaagaatcatgaaatgatctgaattgtaatggctcccatggtcattgccttttctgtggtctttggcaggtgataacttcaggtgggataacattttgtgaccagctatggcataaagagtgttttctgtgtagtggctgtaggaaagatctctgtgaagaacagttcatgtccagagacgactatccattctgcrtggactgctacaaccatctttatgccaacaagtgtgtagcctgttccaaacccattagtggtgagttcttcagttcaatatgatcatgccatgagacagttatgactttatgaaacactatctagttaatttaggaaaagcaattaaaaaatgggaagctttcctttatatttccttttgagataaacacaagtgggtgcatatatatgagtataaatattacatggattcctcaaggaaagtacaagagtataatttgggtgactatactctgtgaaggtaactacatactaaacctaa

SEQ ID NO: 39419 - DNA, 601 bp, Human
ctattcctagtattcttagaacatatttcaatttttagttgttcatataccatagaattaaagatcattttatccctttcctccttcttcatcttcaaatatgtggcaaaataaaagttgagtcttcatgcactttccaaccaaaagaaaaagtttcacagcaaaccccaccttggcaggctttcactgacttgcaaagggagggagggtgtcaccagaaaaaaacagcatggtcttatttgtctatatggagcaccatctgtgtcaggatctcacactggctcacgggctacatctggcmagcaggctgttgatgtttggcctgaacatgtttggaaataactaatgtaaaatccatctctgcagctaaaagtagaggaagagcctgccattgggtgagcagactgcctccacattccccagcagggtcaccatcatatggaactcgtggctgtccaattgcatggggcatgccctctctgtcccttgcaccctgtctgcatcactcagctagatcacctccctggcccttgcaagaacttgccttagcaatcccacaccactcggctccagggtccatgcttttaattaccctgctctc

SEQ ID NO: 39420 - DNA, 601 bp, Human
catctctgcagctaaaagtagaggaagagcctgccattgggtgagcagactgcctccacattccccagcagggtcaccatcatatggaactcgtggctgtccaattgcatggggcatgccctctctgtcccttgcaccctgtctgcatcactcagctagatcacctccctggcccttgcaagaacttgccttagcaatcccacaccactcggctccagggtccatgcttttaattaccctgctctcctgccttctacaaatttgacaattcctatagccaagagatctccactgattttarttagaaaatgggactttcagatatccaacaatacctggagctccagaatctcccaagtaaaatctgcaatcacagtccatttattttataacaacacttatcttgaattgggacagaaaaaaaaaggggacttcaatgagaaaataaggaaattaacaactcaaaataagtttcaaaattctctggagatccagatggctaatactgatctgcaaaaagcctacacaagccctgaacttgagtttcaattctggtatatcacagattcatgtgcctaagtgatttttttcatagattgtt

SEQ ID NO: 39421 - DNA, 601 bp, Human
aaggatacacaatttcagttaaacaggggaaataatttcaagatctattgtacaacatagtgactatagttaacaactatgtattatatacttgaaaattgctaagagaatagatttttaaatgttctcaccacacacacaaaaaagcatatgataaggtaatagatatgttaattgccttgatttagccattccacaatgcatacatatacaaaaacatgttatataatatatgtacaatttttatttgtcaattaagattaatcaattatttttttaaaaagctctgagaaatctaccyataaatcaccaagtgtaatttttaaaacccatcacattgaactgcttcatttgaacaaactccagatatagctaccatattttctcctcctttgagataggattaacctcttaaactatcagggataaatgaagctgcttgatgcagtgaaaggtgctctggactgaggagcaaaagacttggtcctccctgcccccactgctgtgtcaccatgggtgactaactcacctcaggggtggggggccttcatttgccttatttataaaacaagcagttgagcaggttggctttcttccatct

SEQ ID NO: 39422 - DNA, 601 bp, Human
agctgggtgacctggggcaagcggttaaacttctcacttctcagtttttgtctgcaaagtggggctgatgctaatatctgaccccatgaaggtaaggtgagggctgtatacggtaacacacataaaggacttagaatagtaattggcacacagtcaagcactcaacaaatgccagctcttattctactgacttgtcagaaacctatgaaaccagataacacaggtgtcaaagacctgcttcatgaatggctttcttactgcaaacaaccctcatgacctaagggagtaaacatattccttytggaacagtttacatacatctcacatgttggttcagccctttcttaaagttgccagatgcttctactttttcttatttgtaaaattccggaagaattgcttttatatttgccacttgtacaaggcttactaataaaattaagaaaaactcatgagcatcaaaatgctagacatgtaataattagttttatgaacagcataatttatgtatatacagaacattactcttgcagtcagcttattaatgttttgaataacattaagggaattaagtagtacataattaatttacatttattag

SEQ ID NO: 39423 - DNA, 601 bp, Human
cttgcatattagcattctgccttcttctgttgattatggcagaatttggctgtgaatctggttgggtggcataggtgtaactttcctacagtggatagttccagatggacacagggccaggaagcagcattcttttttgggttatttgcctctgcgttgttttgctcatagctctatctccagttcctagaggagcatctgctagaatgctcaatctgttccttgaaaggatagattaatctttttctccaattcctttacaggtctcacaggtgccaagtttatctgctttcaagacagscagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagt

SEQ ID NO: 39424 - DNA, 601 bp, Human
ttatggcagaatttggctgtgaatctggttgggtggcataggtgtaactttcctacagtggatagttccagatggacacagggccaggaagcagcattcttttttgggttatttgcctctgcgttgttttgctcatagctctatctccagttcctagaggagcatctgctagaatgctcaatctgttccttgaaaggatagattaatctttttctccaattcctttacaggtctcacaggtgccaagtttatctgctttcaagacagccagtggcatagcgaatgctttaactgcgggaartgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaag

SEQ ID NO: 39425 - DNA, 601 bp, Human
gggaaggcgacggtgctggagaaaaaaagaaatcgcataatgccttccacagtcgaacaggaacggcttaggagttatctgtgcttcccagagcaggagagggacccgtttgatccccccagaacagcccgggcagataggcctaggagggatgcctatggacatctttcagataaggaaactgaggcagaggggttaagtgcttcgcttcactgaagggccctaggagaccatggagtccgatccccgtgtttggtaagcggggagatgggcccacaggggagaattggcttcacagtcmggcagcgcaagaggcaggagagaggccagctgcggtgaccagagggtctgaattcccaaggggacccaggcccaggctgggtgggcctaatggtggcgttctcttcagcactcatcaaacctcctatggacttggggcttccttcaagggacactctgcgttctcacccattcaaggggacatggatggggaaggtggagatggggacagaggaagaggagggaggggagggacatagaagggtctggaatgaattggaacaaacagccctggaatcccatagcccttcctgagtccgat

SEQ ID NO: 39426 - DNA, 601 bp, Human
aagggacaagtctgtgatgacctcccaggtctgcgccagggtgagagcagatgacacagtcttggcaccgagtctggcacagggtgagccctcgatgaacataggcttttataatgatcattaacattgttactcacgtgtgttctctcacacagttactgtcacatgaacttcctctcaccagcgtgctcagaaacacacacatgcacacacacgcacgcatgtacacacacatgcacgcgcgtacacacacatgcacacgtgtgcgtgtacacacatgcacacacgcacacatgcacaygcgtgggtacacacatgcacacacgtgtgcgcgtacacacacgcgcgcgcgcatacgcacatatgcacacatctctgccacaggcacgagcacattgtgcatacttgagttctttcatgtccacgttcagcttctatggctctgaggacagaagaataataatattaataatgatgatgataacgacaccaacaggtaacatttatgaagggcctttcttgactttgggtagagttttcatctgggccttttgtgggggcctgtgattggaagtgtagacacggccccacttctctctct

SEQ ID NO: 39427 - DNA, 601 bp, Human
agagcctgaagggccagggcactgggtcctgatgaacgggggctccgcctcctgtagtcagtgtgattcgggcagattacttacttcgcctccacctcctcatttataacgtggggacaatcttagaactgctctgtgcagtgccatcattgggctgatagatgaaaaggccattttaccaacgagaaactgaatactctcagaggcaaagcaattctacgaagactgggggaggtctggcccagaccccctgctcttcatcaggctgcgtccttccctctgctcccgggaacttccgcaygctgggacgtgctccgcctgctctggctaattaacatggactaacgaatgctgctttaggtaagtgggcaggttaatttccattgtctcactggattctcaccacgccctggagtagatggaaggagcaggcatttgctaccccattttacagaagagaagcccaagccccagagaagggatatgcctcaccaagcgctgcacagctggttcgctgcattctgatatgggaggaggacagagttgggggagcagcgtgccagagtcagtttttgggcagcggagatgagagtggcaccca

SEQ ID NO: 39428 - DNA, 601 bp, Human
gcagtgccaggttgacaggtaaactacagatgcccacacccaggagggctgggaaggggcctgggagtcttgcccacctggattccctcagctcatcaccctgcactgcctagtctggtggacccggggcacttgaggacagggagtgttcttggcatctttctttttttgagacggagtctcgctgtgtcacccaggttggagcgcagtggcacaatctcagctcactgcaaactccgtcccccgggttcacgccattctcctgcctcagcctcctgagtagctgggactacaggcgccygccaccacgcccggccaacttttttgtatttttaggagagacggggtttcactgtgttagccaggatggtgtcgatctcctgacctcgtgatccgcctgcctcagcgtcccaaagtgctgggattacaggcgtgagccaccgcgcccggccaggcatctttctttctttcttgtttattctggtgaaatacacataaggtaaagtttaccgtcttaaccctttttaagcgcacaccttggtgacatgtagtgcattcacattgctgtgtggccatcaccaccaccactgccagaactccg

SEQ ID NO: 39429 - DNA, 601 bp, Human
gtctgcacctccgtccctctggggcaccccccaggaagctgtgggccacagtgtgagcggtccccaaggccagccagggtggccctgctggctcatgtgcagccgccttctcctccacagcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccgtgagtaccactccgagatgccagyacccttgagcccaagactgggccgggcccctgtgtttggtcctccaggcctcagagagccagttctctgctggtggggcaggggcgggtggctctcttgagccagaggccagtctgaggtggggggggggtgactctgatccctccacggtggcctagacctctctgggctcccagcctctgtcctgtgtcacctacactggagggcagaatggagctggcctcacttctttccccacatcgggcagtttttgtcatcttctgatctagcagcgatgccgatgtcctgggggccaggtgg

SEQ ID NO: 39430 - DNA, 601 bp, Human
tgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccgtgagtaccactccgagatgccagcacccttgagcccaagactgggccgggcccctgtgtttggtcctccaggcctcagagagccagttctctgctggtggggcaggggcgggtggctctcttgagccagaggccagtctgaggtgggtggggggtgactctgatccctccacggtggcctagacctctctgggctcccagcctctgtcctgtgtcacctacactggagggcagaatggagctggcctcacttctttccccacatcgggcagtttttgtcatcttctgatctagcagcgatgccgatgtcctgggggccaggtgggcaagccagggtgctcgcctgtgcggagagggtgagggttagggcagcaacccttccatcaccatcatctttgatgaacttgttggaactgctgaatgctgagagctgccttacatgtgtatgg

SEQ ID NO: 39431 - DNA, 601 bp, Human
ttctgtgtatgccctggggccctgcagtgattgtgtgttagcgtgtgtctgtgtgagcagctgctcttacagacgacgcctgtatcgtgtttggatgcctgcatgtaaatgtgtgacgtgtagttgagctcacatatataaaggattcgtcacatatattaaggattcttaggaggaggtgtgtgtgtgtgtacatctgggtacctgaaggggactcagaagtccttgtaaagcttgaatgagggtgtcttgtgagctcagcacgtgtgtgtgtgcgtgtgcacacctggccctgcaaggktgcatgtgcctggagagggtgtggctgcatgtgcacgtgccctgtggacctgaaggtatggggggattctgcgcccatgcctgcagggctgcgtgactgtcctaccttctgctgatgcagcgcctggattctctcctctcatgtgtcctaacgggccactcatactcccattccaggcctggggagggaccacagcctgctcagcccagcccagttgccaaccctgggctcttgtggtagggcaagaggcacttcagactgttctgattttgctctgaatctgcccaagcatcagccccc

SEQ ID NO: 39432 - DNA, 601 bp, Human
ctcttacagacgacgcctgtatcgtgtttggatgcctgcatgtaaatgtgtgacgtgtagttgagctcacatatataaaggattcgtcacatatattaaggattcttaggaggaggtgtgtgtgtgtgtacatctgggtacctgaaggggactcagaagtccttgtaaagcttgaatgagggtgtcttgtgagctcagcacgtgtgtgtgtgcgtgtgcacacctggccctgcaagggtgcatgtgcctggagagggtgtggctgcatgtgcacgtgccctgtggacctgaaggtatgggrggattctgcgcccatgcctgcagggctgcgtgactgtcctaccttctgctgatgcagcgcctggattctctcctctcatgtgtcctaacgggccactcatactcccattccaggcctggggagggaccacagcctgctcagcccagcccagttgccaaccctgggctcttgtggtagggcaagaggcacttcagactgttctgattttgctctgaatctgcccaagcatcagcccccatctcccgctcccatacatccatcaccacccagccccagcctccctgcacatggcaggcgagg

SEQ ID NO: 39433 - DNA, 601 bp, Human
cgacgcctgtatcgtgtttggatgcctgcatgtaaatgtgtgacgtgtagttgagctcacatatataaaggattcgtcacatatattaaggattcttaggaggaggtgtgtgtgtgtgtacatctgggtacctgaaggggactcagaagtccttgtaaagcttgaatgagggtgtcttgtgagctcagcacgtgtgtgtgtgcgtgtgcacacctggccctgcaagggtgcatgtgcctggagagggtgtggctgcatgtgcacgtgccctgtggacctgaaggtatggggggattctgcrcccatgcctgcagggctgcgtgactgtcctaccttctgctgatgcagcgcctggattctctcctctcatgtgtcctaacgggccactcatactcccattccaggcctggggagggaccacagcctgctcagcccagcccagttgccaaccctgggctcttgtggtagggcaagaggcacttcagactgttctgattttgctctgaatctgcccaagcatcagcccccatctcccgctcccatacatccatcaccacccagccccagcctccctgcacatggcaggcgagggcccaggtgc

SEQ ID NO: 39434 - DNA, 601 bp, Human
tgtgtacatctgggtacctgaaggggactcagaagtccttgtaaagcttgaatgagggtgtcttgtgagctcagcacgtgtgtgtgtgcgtgtgcacacctggccctgcaagggtgcatgtgcctggagagggtgtggctgcatgtgcacgtgccctgtggacctgaaggtatggggggattctgcgcccatgcctgcagggctgcgtgactgtcctaccttctgctgatgcagcgcctggattctctcctctcatgtgtcctaacgggccactcatactcccattccaggcctggggagkgaccacagcctgctcagcccagcccagttgccaaccctgggctcttgtggtagggcaagaggcacttcagactgttctgattttgctctgaatctgcccaagcatcagcccccatctcccgctcccatacatccatcaccacccagccccagcctccctgcacatggcaggcgagggcccaggtgcattcatgcccacatgcttgtgcacatacacacagacacacacacccaccctccctccactgccctgcccagatctgtgcattttccacatgtgggacctgttggggcagaaaag

SEQ ID NO: 39435 - DNA, 601 bp, Human
cgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgccycagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctctctgtgcctctgtttcctccctggtgcaatgggaataatagtacctgcctgaggtcctctcaggaggcttaaatgagaggaatgaa

SEQ ID NO: 39436 - DNA, 601 bp, Human
ccgctgtggtcaacatcaccacgaaccaggcaggtaggcggagaaactccgtcccgcagcgtcctggtcccccagcttcccctgccccagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctstctgtgcctctgtttcctccctggtgcaatgggaataatagtacctgcctgaggtcctctcaggaggcttaaatgagaggaatgaaattgcttagcccagcacctggcccgtggtaaatgctcaataaatgtcattaaaaaataaaatcactcggatgatcattttccagaacagctgctacagctgcccttgggatagacttggctgcactggcttggaccacagtagtttatctatcagtttctggccagttggtgggctgaattcacccccggaacctctttcttcccaaactctgg

SEQ ID NO: 39437 - DNA, 601 bp, Human
aagtaagagaaatcccaaaagctcagaggcaggctagtgtggccgtcgaaagcctaggttccagaactttccctctctgtgcctctgtttcctccctggtgcaatgggaataatagtacctgcctgaggtcctctcaggaggcttaaatgagaggaatgaaattgcttagcccagcacctggcccgtggtaaatgctcaataaatgtcattaaaaaataaaatcactcggatgatcattttccagaacagctgctacagctgcccttgggatagacttggctgcactggcttggaccacagtagtttatctatcagtttctggccagttggtgggctgaattcacccccggaacctctttcttcccaaactctggaggaccctgcccgtcaagtgacagcgtgacccaagagccctcctagggcagcttcctattaacagccaccctcacctgtgcccaagaccctcaggcccccacccaccatctcctcccaaaaccacacagccctggcctcgcagacaatatgcccaccacgtcacagaggaagaaactgaggcctggagagcacccagggccacctgacataggaagtggcagaggc

SEQ ID NO: 39438 - DNA, 601 bp, Human
gctccctgacgccagggcctcagcccttcagaagattccctcattcgacagccctcgtggaacacccactaaatgccaagtgtggtgccaggtgctggcaacacagagagagagtgagctatgtgccccgtggtagagcccagccctggcccacctgtctctaggcacctgaggcccctggcaggctggtcccaagtggaggggagagcaagagaagttcacagcattcaggcagcatccgggatgccccaacattaaagaggaaactagaccctgccttgaacctgccttcccctccggycaccagaccatttctcttcccatacgaccctctctgtccgtgcctggcgtatctacttcttcctctcctctgcgggacttctccatgtctttcctcacctcttcacagaaatcagcagccctgcgtggccacatccatgggcgcctcttccccctttcatttcctcctcctggaaacacttttctcttgctcgtgtgtcccagcccacgcccattttccattgacctgtgtggcctgtccctctctgtctttgtagccccacctcctttaaatggcctctaaaggccatgggtccctggg

SEQ ID NO: 39439 - DNA, 601 bp, Human
agcagccctgcgtggccacatccatgggcgcctcttccccctttcatttcctcctcctggaaacacttttctcttgctcgtgtgtcccagcccacgcccattttccattgacctgtgtggcctgtccctctctgtctttgtagccccacctcctttaaatggcctctaaaggccatgggtccctgggaatgtcctgggccctcctctctttcctgtgtgcccagatccatcttttctgggcggctgtttcagggcccatgactttgaattccacctttgtgctaacaacccccaactcgcsgtcaccagcgaagacctctcccctaggacccagctgcccactcctgtctccattcggttatgtgaaaaacaaacaaccctgccacacctgcacctgccccgccctaggacatggcacctccagacccaagctgtcatccttgactctcatgcatgtcacatccatccccccctaaagccccagggacctcccttcaaaatgaccaactgacttccaccccccacgagtccatgcctggaccaccacaggagacccctcttgcctcacccccacaagacattctccacaccagtcctgagt

SEQ ID NO: 39440 - DNA, 601 bp, Human
ctaacaacccccaactcgcggtcaccagcgaagacctctcccctaggacccagctgcccactcctgtctccattcggttatgtgaaaaacaaacaaccctgccacacctgcacctgccccgccctaggacatggcacctccagacccaagctgtcatccttgactctcatgcatgtcacatccatccccccctaaagccccagggacctcccttcaaaatgaccaactgacttccaccccccacgagtccatgcctggaccaccacaggagacccctcttgcctcacccccacaagacatyctccacaccagtcctgagtgagctttaaaaatagaagtgagggctgggtgtggtggctcacgcctgtaatcccagcattttgggaggccaaggcgggaggatcacttgaggccaggagtttgagatcagcctgggcaacatggcaagaccccatctctacaaaaaaaattttttttgagacaatgtctctatctgtcacccatgctggagtgtggtggcacaatcacggctcactgcagtcttgatctccggagcccaagtgatcctcccacctcagcctcccaagtagctgaccaaggg

SEQ ID NO: 39441 - DNA, 601 bp, Human
accctgccacacctgcacctgccccgccctaggacatggcacctccagacccaagctgtcatccttgactctcatgcatgtcacatccatccccccctaaagccccagggacctcccttcaaaatgaccaactgacttccaccccccacgagtccatgcctggaccaccacaggagacccctcttgcctcacccccacaagacattctccacaccagtcctgagtgagctttaaaaatagaagtgagggctgggtgtggtggctcacgcctgtaatcccagcattttgggaggccaaggcrggaggatcacttgaggccaggagtttgagatcagcctgggcaacatggcaagaccccatctctacaaaaaaaattttttttgagacaatgtctctatctgtcacccatgctggagtgtggtggcacaatcacggctcactgcagtcttgatctccggagcccaagtgatcctcccacctcagcctcccaagtagctgaccaagggcacacaccaccatgcccagtgatttttttttttttgtagagatggggtctccctatatttcccaggctgatctgaaactcctgggctcaagtgat

SEQ ID NO: 39442 - DNA, 601 bp, Human
cttcacagcctaggctgagcgcacatgcaattcagacattctcatggcctgtggacccacacagcttcacccctgcctgcctctccagagcacctctttccctggctcactctcttctggccatgatggtctccggtgccccctccttgaacacactgggtctttccctgctgctaggccgtggcctggcttctccttcggaatgactcactcttcccctgacattcctatgcctggctcctctgccctggaagctcccccgaccacctcagctgaaacgtgccagtgcccttccgggccytgcagtggtcttctccatcacagacagcaccccttcctacctttcccagcaccaaaagaacccccattctcctgtttattggacgccctgtctcctttcctgggacagaagctcctagagggatgtcttgggcactgcagagttcccggctcctagccccgtgcccagcatgtgataggcactcaggagtcctagaggatcaagcgacagctctaagcaaatgtggaggactgtgctcaaagaccacctgcccctcctgcctcaccatcaccacttctctacaaccaactcctccctgga

SEQ ID NO: 39443 - DNA, 601 bp, Human
gccaggccacgccaaccccaggggactgaccccaagtggccaccagcgatttgttgggagaactggagggtgctggctgtcctggggctggggcaggaccatcaggaagctgagcagggctggaaccaggatccccaggtggaacctgggaagggttgggagagaggccacgccttgtctcccctccgcccatctgacgggattggccgccccagccccgtcccaggtggtggtgatccgtcaagagcgggcggggcagaccagcgtctcgctgctgtggcaggagcccgagcagccgaayggcatcatcctggagtatgagatcaagtactacgagaaggtaccacgggcaggacggagtgggaggggctgggccagcagggcagggcccactgaccaccgtcccgtggcaggacaaggagatgcagagctactccaccctcaaggccgtcaccaccagagccaccgtctccggcctcaagccgggcacccgctacgtgttccaggtccgagcccgcacctcagcaggctgtggccgcttcagccaggccatggaggtggagaccgggaaaccccgtgagtgcagggagggggcgtgggc

SEQ ID NO: 39444 - DNA, 601 bp, Human
ccaggtgccaggaccctggggtcggggggtggccgaggagagagctagtgcaggctgagccagtgccaatgcaggatttctgctctccttgccctaccaagtggggttgtcggagttttttatttaattgagacagagtttcactctgccacccaggctggagtgcagtggtgcaatctcagctcactgcaacctccacctcccaggttcaagcaattctcctgcctctgcctcctcagtagctgggactacaggcacctgccaccacacccggctaatttttgtatttttagtagagacrgggtttcaccatcttggccaggctggtctcgaacacctgaccttgtgatccacccgcctcagcctcccaaagtgctgggattacaggcatgagccactgctgccagcctaatttttttgtgtatttaatagaaatggggtttcaccatgttgaccaggctggtcttgaactcctgacctcaggtgatctcccaccttggcctcccaaagtgctgggattacaggcatggaccactgcacccggcctctgtcagcatttgcacagatgaaaaaccgaggttaggagaaggacggtcgctcg

SEQ ID NO: 39445 - DNA, 601 bp, Human
aggcatgagccactgctgccagcctaatttttttgtgtatttaatagaaatggggtttcaccatgttgaccaggctggtcttgaactcctgacctcaggtgatctcccaccttggcctcccaaagtgctgggattacaggcatggaccactgcacccggcctctgtcagcatttgcacagatgaaaaaccgaggttaggagaaggacggtcgctcgcctgaggcggcagagatggtgacagccccccacacaccatggctggtactgagatgagtgtcagggtctgggaccagcagcatcrgtctcacctggggacttaccaaaaatgcgaattcccagtcctcaccccagcccttcagaaactctgtgggtgggcccagccatttgggttttaacaagtcctcggtgatccccaggcactgtcacatttgggaccctctgacttcgaggctgtccctttcactctcctcctgccccaatctccagccggagtcagggtctcctgtatgtgcacccactgcgtggtggaggtagggcagagctagtgaccgcccacctggcgctccctgggcgtctgagtgcctccagtgcttgtaggcct

SEQ ID NO: 39446 - DNA, 601 bp, Human
tccctgggcgtctgagtgcctccagtgcttgtaggcctggcaccccctggagaccacccagatgggaatcctgagccctccatcccatgtactgtgtggcctcaagtcaattcctcgagttctctgagcctctttccatctgaaaactgaagatagtgctggggtctctctggaagggacgtggggagggtttactggggcttgaaggtacagctctcagcacactccgtgttgtcactgtcaggataacagggaggacaggcatttattggctcagaggacacgcgactcttctccggtmccacagccacaagaagcagcggcaccagcattaggaagccgggcatccaggtctcacgaacttgaagaggaagcttagtagagggtggggtgggaacagaggaggaactggcctgcgccctgactctgggctggctcatggctctgggctccccactggccccagggtcacagccaggcaggctcagaggtctgccagacccctgggcccaaggccagggctgagagcctggtcccccaaccctggctttcccctgcagggccccgctatgacaccaggaccattgtctggatctgcctg

SEQ ID NO: 39447 - DNA, 601 bp, Human
ggagggaggtggagacaggatagtgtgtgggcttgggatcccagacaatgagaactgtaaggatcatctaactgatggagaaatggagacccagggaagagaaggggctggccaaggtcatccatgtagttggccacagaagcctcatctcccaatgcccccaccaagggtggtttcatataacatggggctaacagcattgtagactttgccaagagggtcaggtggacttgagggcattttgaggatcccacagtgcttgtgaccatcatggcggtcacagtttagctgggttgagagsctggagtcagggactctcccctgcagactttgtaaggagcaggagctgacctgtcaggggaaggggcatgaagagagaagccatgactcgttccctggttggggtcagatcccgggctagggatggcctggcctcaggcagggcggtgccctcctctgcaggcactgtggctacagcaaggccttccaggactcggacgaggagaagatgcactatcagaatggacagggtgagtgcaggggcccggtggtctggggcagagggaaggccacagggggacccagtgctggactgggggtg

SEQ ID NO: 39448 - DNA, 601 bp, Human
ggccaaggtcatccatgtagttggccacagaagcctcatctcccaatgcccccaccaagggtggtttcatataacatggggctaacagcattgtagactttgccaagagggtcaggtggacttgagggcattttgaggatcccacagtgcttgtgaccatcatggcggtcacagtttagctgggttgagagcctggagtcagggactctcccctgcagactttgtaaggagcaggagctgacctgtcaggggaaggggcatgaagagagaagccatgactcgttccctggttggggtcagrtcccgggctagggatggcctggcctcaggcagggcggtgccctcctctgcaggcactgtggctacagcaaggccttccaggactcggacgaggagaagatgcactatcagaatggacagggtgagtgcaggggcccggtggtctggggcagagggaaggccacagggggacccagtgctggactgggggtggcacagatgggaaggaggaaggtgcccagtgaaaaaaccagagcccaagaggcagattccagggtgtcacagagacctggtgccccagagggcagcgccgttcatgcct

SEQ ID NO: 39449 - DNA, 601 bp, Human
atgtagttggccacagaagcctcatctcccaatgcccccaccaagggtggtttcatataacatggggctaacagcattgtagactttgccaagagggtcaggtggacttgagggcattttgaggatcccacagtgcttgtgaccatcatggcggtcacagtttagctgggttgagagcctggagtcagggactctcccctgcagactttgtaaggagcaggagctgacctgtcaggggaaggggcatgaagagagaagccatgactcgttccctggttggggtcagatcccgggctagggrtggcctggcctcaggcagggcggtgccctcctctgcaggcactgtggctacagcaaggccttccaggactcggacgaggagaagatgcactatcagaatggacagggtgagtgcaggggcccggtggtctggggcagagggaaggccacagggggacccagtgctggactgggggtggcacagatgggaaggaggaaggtgcccagtgaaaaaaccagagcccaagaggcagattccagggtgtcacagagacctggtgccccagagggcagcgccgttcatgcctcctggactctcaga

SEQ ID NO: 39450 - DNA, 601 bp, Human
tagctgggttgagagcctggagtcagggactctcccctgcagactttgtaaggagcaggagctgacctgtcaggggaaggggcatgaagagagaagccatgactcgttccctggttggggtcagatcccgggctagggatggcctggcctcaggcagggcggtgccctcctctgcaggcactgtggctacagcaaggccttccaggactcggacgaggagaagatgcactatcagaatggacagggtgagtgcaggggcccggtggtctggggcagagggaaggccacagggggacccagygctggactgggggtggcacagatgggaaggaggaaggtgcccagtgaaaaaaccagagcccaagaggcagattccagggtgtcacagagacctggtgccccagagggcagcgccgttcatgcctcctggactctcagaccccattcaggatgctagagatcctctccccagggaagggcacacatttgtatgatttcggggtgggagtgcatatactcttggacaagaatccctactacggagagattttcaggatcctgtagagatcccagacaacaaggcgaatctggagatgcctcc

SEQ ID NO: 39451 - DNA, 601 bp, Human
ggggcatgaagagagaagccatgactcgttccctggttggggtcagatcccgggctagggatggcctggcctcaggcagggcggtgccctcctctgcaggcactgtggctacagcaaggccttccaggactcggacgaggagaagatgcactatcagaatggacagggtgagtgcaggggcccggtggtctggggcagagggaaggccacagggggacccagtgctggactgggggtggcacagatgggaaggaggaaggtgcccagtgaaaaaaccagagcccaagaggcagattccagrgtgtcacagagacctggtgccccagagggcagcgccgttcatgcctcctggactctcagaccccattcaggatgctagagatcctctccccagggaagggcacacatttgtatgatttcggggtgggagtgcatatactcttggacaagaatccctactacggagagattttcaggatcctgtagagatcccagacaacaaggcgaatctggagatgcctccctccacgccccactcctgtgcccgtggcagacagcatcaagcatggtgctgattcccaccaggcctgggtgcagcctc

SEQ ID NO: 39452 - DNA, 601 bp, Human
actgggggtggcacagatgggaaggaggaaggtgcccagtgaaaaaaccagagcccaagaggcagattccagggtgtcacagagacctggtgccccagagggcagcgccgttcatgcctcctggactctcagaccccattcaggatgctagagatcctctccccagggaagggcacacatttgtatgatttcggggtgggagtgcatatactcttggacaagaatccctactacggagagattttcaggatcctgtagagatcccagacaacaaggcgaatctggagatgcctccctccaygccccactcctgtgcccgtggcagacagcatcaagcatggtgctgattcccaccaggcctgggtgcagcctcagactcctccttaactactttttatttttattttattttattattttttattttttattattttttttttctgagacagagtctcactctgttgccaaggctggagtgcagtggctcaatctcagctcactgcaacctctgcctctggagttcaagcaattctcctgcctcagcctcccaagtagctcagattacaagcattcaccatgcactactaatttttgtatt

SEQ ID NO: 39453 - DNA, 601 bp, Human
gacatgcccagaactcactggagactccacagccccatagaaaccccagagcgactccagagaccccactttcacttgggaaatacttatggggtgcgtgttgtttgctaccacatccagagactcccagagacacccctcaccccaccccagacccatcccaggcccagggaatgtcaggaaaaagcaatctctcctgggccccactgaaggccctcctcccgcccctcagcacccccacctgtcttcctgcctctgcatcaccccccgggaaagctcccagagccccagttctatgcgsaaccccacacctacgaggagccaggccgggcgggccgcagtttcactcgggagatcgaggcctctaggatccacatcgagaaaatcatcggctctggtgagtctcaggggttgtgagggcggggccagcatggggcaaggtgggggcacccagggcaaggtgggggcacccagggcagagggagcgtgtgacccaggggtctggcaagcccagggggtccaagggcctgggaggctgggggagtctgagggtcccactgccctccctccacacctgcccctctcggggcctgcaggagac

SEQ ID NO: 39454 - DNA, 601 bp, Human
ctgagggtcccactgccctccctccacacctgcccctctcggggcctgcaggagactccggggaagtctgctacgggaggctgcgggtgccagggcagcgggatgtgcccgtggccatcaaggccctcaaagccggctacacggagagacagaggcgggacttcctgagcgaggcgtccatcatggggcaattcgaccatcccaacatcatccgcctcgagggtgtcgtcacccgtggtaggtgccgggcaaagacagcctccccctgcagtgcccctcctgcctggagaggcctctgggyccatcccctcatccatcctgctctgccccacctgaccctgtcctcctggttcaggtccctgaatgactcggggtgcccagagcctgggaccccagtggaaacccaaggcaccctggggtttccagtgctggcacaggtcctgagatggtggtatgctcctggggtctctgatcagcagccctgagccccaaaccaagagccaccctctccctactgcccgcccaggccgcctggcaatgattgtgactgagtacatggagaacggctctctggacaccttcctgagggtgcgtgtcccac

SEQ ID NO: 39455 - DNA, 601 bp, Human
tgcaggagactccggggaagtctgctacgggaggctgcgggtgccagggcagcgggatgtgcccgtggccatcaaggccctcaaagccggctacacggagagacagaggcgggacttcctgagcgaggcgtccatcatggggcaattcgaccatcccaacatcatccgcctcgagggtgtcgtcacccgtggtaggtgccgggcaaagacagcctccccctgcagtgcccctcctgcctggagaggcctctgggtccatcccctcatccatcctgctctgccccacctgaccctgtcctcytggttcaggtccctgaatgactcggggtgcccagagcctgggaccccagtggaaacccaaggcaccctggggtttccagtgctggcacaggtcctgagatggtggtatgctcctggggtctctgatcagcagccctgagccccaaaccaagagccaccctctccctactgcccgcccaggccgcctggcaatgattgtgactgagtacatggagaacggctctctggacaccttcctgagggtgcgtgtcccacccctgcctcttgcatgggcttggggagggaggtccagtctgggtgc

SEQ ID NO: 39456 - DNA, 601 bp, Human
gactcggggtgcccagagcctgggaccccagtggaaacccaaggcaccctggggtttccagtgctggcacaggtcctgagatggtggtatgctcctggggtctctgatcagcagccctgagccccaaaccaagagccaccctctccctactgcccgcccaggccgcctggcaatgattgtgactgagtacatggagaacggctctctggacaccttcctgagggtgcgtgtcccacccctgcctcttgcatgggcttggggagggaggtccagtctgggtgctgggagatagtgcaaagcyctctaagccccctccctggcttggacaccacaggccgggggacaggaggcaggtatagggaggaggtcttcgagttcagccagtcgaactgcctttcggcccccattgcatgaaagtccctctgctccatgggatcctgctgccctgcacacaggctgaggggggtgcctctgtgggaatccaggccccacccagctggggggcatgctggctgtggtggagacggctggattcccagctcctgcccacagtttctttgctgggtgctcttaggcacagagcttaacctctctgggcctc

SEQ ID NO: 39457 - DNA, 601 bp, Human
agccatgtccccctgcagacccacgacgggcagttcaccatcatgcagctggtgggcatgctgagaggagtgggtgccggcatgcgctacctctcagacctgggctatgtccaccgagacctggccgcccgcaacgtcctggttgacagcaacctggtctgcaaggtgtctgacttcgggctctcacgggtgctggaggacgacccggatgctgcctacaccaccacggtgcgtcgcccacactccttccggctagactggggagtggggagatggcgccggtggcacccagggcccaacmattctgcaagtagctgaatgaagttggcagtttcggggtggccctcaacctggggcacatcctgtttctcctcttcacgccagtgccttcctctgggaaatgggaacagccttgcctgcctttcctctgtcaccaggtggccaggggagaccccagggctggtccccacagtcactcaccaggagacttcaggagggttggaatctccccgaattgtacccagactccacatctgtctctaaagtttgcctaaaacccagctgttttcaaacacattccatggggatttggacctctcta

SEQ ID NO: 39458 - DNA, 601 bp, Human
caccatcatgcagctggtgggcatgctgagaggagtgggtgccggcatgcgctacctctcagacctgggctatgtccaccgagacctggccgcccgcaacgtcctggttgacagcaacctggtctgcaaggtgtctgacttcgggctctcacgggtgctggaggacgacccggatgctgcctacaccaccacggtgcgtcgcccacactccttccggctagactggggagtggggagatggcgccggtggcacccagggcccaacaattctgcaagtagctgaatgaagttggcagtttcrgggtggccctcaacctggggcacatcctgtttctcctcttcacgccagtgccttcctctgggaaatgggaacagccttgcctgcctttcctctgtcaccaggtggccaggggagaccccagggctggtccccacagtcactcaccaggagacttcaggagggttggaatctccccgaattgtacccagactccacatctgtctctaaagtttgcctaaaacccagctgttttcaaacacattccatggggatttggacctctctagaggtgccttaggggcagccttaaaggcaggagct

SEQ ID NO: 39459 - DNA, 601 bp, Human
acctggtctgcaaggtgtctgacttcgggctctcacgggtgctggaggacgacccggatgctgcctacaccaccacggtgcgtcgcccacactccttccggctagactggggagtggggagatggcgccggtggcacccagggcccaacaattctgcaagtagctgaatgaagttggcagtttcggggtggccctcaacctggggcacatcctgtttctcctcttcacgccagtgccttcctctgggaaatgggaacagccttgcctgcctttcctctgtcaccaggtggccaggggagamcccagggctggtccccacagtcactcaccaggagacttcaggagggttggaatctccccgaattgtacccagactccacatctgtctctaaagtttgcctaaaacccagctgttttcaaacacattccatggggatttggacctctctagaggtgccttaggggcagccttaaaggcaggagctgagtgcatgggggccagttttcaccctggccccaataggagccctcccttagcctctgtcccacagcctctgggtaaggtttcgcatggagaaaggatcctgtgacaacaaaagaa

SEQ ID NO: 39460 - DNA, 601 bp, Human
agccttgcctgcctttcctctgtcaccaggtggccaggggagaccccagggctggtccccacagtcactcaccaggagacttcaggagggttggaatctccccgaattgtacccagactccacatctgtctctaaagtttgcctaaaacccagctgttttcaaacacattccatggggatttggacctctctagaggtgccttaggggcagccttaaaggcaggagctgagtgcatgggggccagttttcaccctggccccaataggagccctcccttagcctctgtcccacagcctctgrgtaaggtttcgcatggagaaaggatcctgtgacaacaaaagaaagaaggaaggaaaggaaggagggagtggagagagggagggagggaggaagaagggaaggaaggaagggagggagggaaggaaggaaaggagggagggaggaaggagggaaggaaggaaaggagggagggaggaaggagggaaggaagggagggagggaaggaaggagggagggaggaaggagggaaagaagggagagagggaggaagggggagggaaaagaaaggagggaaggaaggagaaagaagaaaggaaggga

SEQ ID NO: 39461 - DNA, 601 bp, Human
ttcggggcggtgcaggagccccggggtgccgcggcgcccgcccggctgcatcgctggtcccccggctcgggctccaggcccggcgcctcccacccccaggccgcgcgcgtcccgccctcccgacgacccccagccccgggcctccgccacttacgagtccccgtcctcggtgagctgctgcttccagggctccgagccgcgcggcacctcctgcggctcgaggcggatctcctgcagctccttgaccatctgctcgtactcctcgtctttcatggagtccaggccgctgtcgtggcggtcrtccagtagccgctccttcttcagcccgtcgcgggggccctccatggcccactcctgggggcgctcggccgcctggaacatggcgcggacgagctgcgggcgctgctgcgggtgcgctgggccgcgggctgcgcgctgcttcctcgctggggcgctggcgggcgggacggcggcacggactgctgtgggctctgcagcgccgccgcggcgccctataaacgctggctggggatttctctggggcggggtcaggctcggggaatttccaagccagtcagaccagaaaaagagaactggcttc

SEQ ID NO: 39462 - DNA, 601 bp, Human
cccctcaacccgtgtctcctggttgggtgctgctcctcctagacaggggggtggggagggctggcaaatagcagaggctccaggtgggtcataaagacctcaccaaatcagtggaatttccttcactctctaggatgtgggctgatgtgaagtaaaaggtgagggtaaatagtgctcagtggccctgaattcagaaaggatctggggtgactctgctacatcagctacgtcccagggtcagagagaacccgggccaggcaagcggcgcacctgctgcaggttgttctggaagttgaggaargccaggtctcccttcacctggcggatcacttccatggtcagtgccttttcttcatggatgatggccaagtgcaggaacctgtggggaagagagggaaaaaccccaggggtggtgagtgcaccgcgtggggcccagggaggcgcgggctgcgggggattgcgcaaggccggggtttctggaggccgaggccgcggtgttttccgcgaggttattatgagctgagtgttcctggcaggcgcccagggactttccgcccccctccccccgcggccccggcgggcgccggccagaccgccccgc

SEQ ID NO: 39463 - DNA, 601 bp, Human
aggatcacagccagctcccagaagtgcctcagcaatttctggctggttggtgatcacagccaagtggagtggagtctacgaatgcaagagagaccagagaaagtaagccatggaccaaacccacaccccgagttcccctcaacccgtgtctcctggttgggtgctgctcctcctagacaggggggtggggagggctggcaaatagcagaggctccaggtgggtcataaagacctcaccaaatcagtggaatttccttcactctctaggatgtgggctgatgtgaagtaaaaggtgagggtraatagtgctcagtggccctgaattcagaaaggatctggggtgactctgctacatcagctacgtcccagggtcagagagaacccgggccaggcaagcggcgcacctgctgcaggttgttctggaagttgaggaaggccaggtctcccttcacctggcggatcacttccatggtcagtgccttttcttcatggatgatggccaagtgcaggaacctgtggggaagagagggaaaaaccccaggggtggtgagtgcaccgcgtggggcccagggaggcgcgggctgcgggggattgcgcaagg

SEQ ID NO: 39464 - DNA, 601 bp, Human
ggtatttcctcgaaagtctcggagctcaggatcacagccagctcccagaagtgcctcagcaatttctggctggttggtgatcacagccaagtggagtggagtctacgaatgcaagagagaccagagaaagtaagccatggaccaaacccacaccccgagttcccctcaacccgtgtctcctggttgggtgctgctcctcctagacaggggggtggggagggctggcaaatagcagaggctccaggtgggtcataaagacctcaccaaatcagtggaatttccttcactctctaggatgtgrgctgatgtgaagtaaaaggtgagggtaaatagtgctcagtggccctgaattcagaaaggatctggggtgactctgctacatcagctacgtcccagggtcagagagaacccgggccaggcaagcggcgcacctgctgcaggttgttctggaagttgaggaaggccaggtctcccttcacctggcggatcacttccatggtcagtgccttttcttcatggatgatggccaagtgcaggaacctgtggggaagagagggaaaaaccccaggggtggtgagtgcaccgcgtggggcccagggag

SEQ ID NO: 39465 - DNA, 601 bp, Human
caaaagctccacgatgcccaggtagccatggatagaggctaagtgtagacacgtgtggcctggaagaacaaaaggaaaaaagtataaccacctgtttcaaccctcactcctttcacctattcttttatggaacaagtagtcttatcttctgaattttaagaacccacagtctgggttctgaaagaactttataaaggcatccaataggcactttgcacacatattttctcaaccttccaaatgttaggagtttaagctcttgcctggactccttaagttggcccacctgccccttctccaygtcacctgccctccgagggggtggggcagggcagggaggcagacataccattgtagttggtagccttcaggatggagtggaggtgcggggtggtgcaggactgagtcaggactcccacgctggccaggcagccctgctcacaggcaaggtgtaggggggtatttcctcgaaagtctcggagctcaggatcacagccagctcccagaagtgcctcagcaatttctggctggttggtgatcacagccaagtggagtggagtctacgaatgcaagagagaccagagaaagtaagccatggacc

SEQ ID NO: 39466 - DNA, 601 bp, Human
tcaacaggagtgacaccaggtcaggattttgcaggtccactgcgaggtgaagggcagtccggccattacagggctcctgaaaccaaaaggaatttgagatgcttatggctgcatttggaatttctgctcacaacataagcacgaggagcctgactcagtgcgtcggaggcaggaagcaccaacctgagcattgacatcagcacccaaggacaccaaaagctccacgatgcccaggtagccatggatagaggctaagtgtagacacgtgtggcctggaagaacaaaaggaaaaaagtataaycacctgtttcaaccctcactcctttcacctattcttttatggaacaagtagtcttatcttctgaattttaagaacccacagtctgggttctgaaagaactttataaaggcatccaataggcactttgcacacatattttctcaaccttccaaatgttaggagtttaagctcttgcctggactccttaagttggcccacctgccccttctccacgtcacctgccctccgagggggtggggcagggcagggaggcagacataccattgtagttggtagccttcaggatggagtggaggtgcg

SEQ ID NO: 39467 - DNA, 601 bp, Human
ctctggcagcatctgaaggttttctagtgtcagctggcccagctgctgctgtatccgggtgcttgggcggccccaggtgagctggtagggagaatagccctggtaggtaactctgttgacatcagccccacacttcaacaggagtgacaccaggtcaggattttgcaggtccactgcgaggtgaagggcagtccggccattacagggctcctgaaaccaaaaggaatttgagatgcttatggctgcatttggaatttctgctcacaacataagcacgaggagcctgactcagtgcgtcggrggcaggaagcaccaacctgagcattgacatcagcacccaaggacaccaaaagctccacgatgcccaggtagccatggatagaggctaagtgtagacacgtgtggcctggaagaacaaaaggaaaaaagtataaccacctgtttcaaccctcactcctttcacctattcttttatggaacaagtagtcttatcttctgaattttaagaacccacagtctgggttctgaaagaactttataaaggcatccaataggcactttgcacacatattttctcaaccttccaaatgttaggagttta

SEQ ID NO: 39468 - DNA, 601 bp, Human
taaatataaaatgtggtccttccatgaaatttttgataaccttctccaaaaaccccacaaaggtgaggtttaaaagaagttttctcagaatttcaatgatctttctcgtcccctacaaaaagttcacaaaagcaacaaaatgagggctgatcctaccacaataagacgttttgggccaggcagtgtgcagtgtggatataagtacaccctttaaattttttcttcttttttctttttttagaaaaataaaactttttttttgtacaaatatacaagtccatgttctttcagcccctttgcrctcataacgtcagacgctggcctccaaacacacagtcatcatagggcagctgaaaacaaggggaaaaaagacacgttaagcttccggagcggagctctgccaagctaccgggatggggaggccactactggaaataactcttggactccattctccatagcccaaatataatgaactttacaggctgagggagtttgcctttaatgcttctctttaaaaaaagagtaagctattaaaaaaagggggggggcaggtacattcttgggatactggttatgcacagaaatttgagagactcat

SEQ ID NO: 39469 - DNA, 601 bp, Human
atttacaggagggtaacacaaaccttgacaggtagtaacttttcaccccacatcactgaacgcttaacactcctggctgttacatgtcacaggataccactggggtcagtcactcgaagcacaataaatataaaatgtggtccttccatgaaatttttgataaccttctccaaaaaccccacaaaggtgaggtttaaaagaagttttctcagaatttcaatgatctttctcgtcccctacaaaaagttcacaaaagcaacaaaatgagggctgatcctaccacaataagacgttttgggcyaggcagtgtgcagtgtggatataagtacaccctttaaattttttcttcttttttctttttttagaaaaataaaactttttttttgtacaaatatacaagtccatgttctttcagcccctttgcgctcataacgtcagacgctggcctccaaacacacagtcatcatagggcagctgaaaacaaggggaaaaaagacacgttaagcttccggagcggagctctgccaagctaccgggatggggaggccactactggaaataactcttggactccattctccatagcccaaatataatgaac

SEQ ID NO: 39470 - DNA, 601 bp, Human
aagcctgagattggtaatttcctataaccttgcaacagcctccctcccacacactgggcccagggtgcctgcaaagctttgctggaggctgggtgtcaggtgtgagaagctgctgggagttacctcctccctcacactgctccacctccacctctgccggaggatggaacttcagaaccggaggcccacggcagcctgaagaaaatgatcaggataactcatttgtaaaaatctgtttaataaatatacatcataaaagtaccaaaataattaccaacaatacattatgtacaccatttayaggagggtaacacaaaccttgacaggtagtaacttttcaccccacatcactgaacgcttaacactcctggctgttacatgtcacaggataccactggggtcagtcactcgaagcacaataaatataaaatgtggtccttccatgaaatttttgataaccttctccaaaaaccccacaaaggtgaggtttaaaagaagttttctcagaatttcaatgatctttctcgtcccctacaaaaagttcacaaaagcaacaaaatgagggctgatcctaccacaataagacgttttgggccaggca

SEQ ID NO: 39471 - DNA, 601 bp, Human
gttggttttgtttatcatctgccaccctgctagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagaggtaaatttggtatcttagcaagtgggtgactaccactgtctgggggaaagctgatacacgaggacttgacaataattacagcagtaacaatcgctactattttgttttgaratgaattttagtttctgaaattgtccaaagcacttttatcaatagaaacttgttacacatccctccaacagggagaagcagcacaggaagctgccccctcaaacactaaaggctcctggagctattcacagtgctggggaacaaccagaggaggaggaggacagagggagagaatactttttttaaaaatcccaaacaaaaccaaattctatacatgtatatctcgagtgagtaaatgtgtaacactcagcagtctcctacacttgccaggttttgtggcttcatgcagtaatataaaat

SEQ ID NO: 39472 - DNA, 601 bp, Human
gaggtcctgctttctttcctctctttccttcacacctacctcaacccactgtcgagtcctatcagctctgaaatagatccttcctccagcgccttctcacctctctctccaccattccagtccatgccgcctcatctcttactgggactttcacaacagcctcccgagtggtcttggcttctgctcgcaaatcctgcagtgccttctctgcggagccacaagctggatctttttaatccgctctcggtttctcacagcccttggaatgaaaccttggcctacagccctgtgtgacttgctrcctgtccttacctcctaacctcatctaatatccccttcccctcctcgtaccggcctttctgtttctcagacactccaggcttgttctgctcttggaccttcacgctgtctttctgtctcctgggaatctgtgccccctctgccagatcatgcagctggctctctctgcccaaataccctcttccgaggggtcttccttggccctgtgtctgacataggtaccctcctccatcactccagcccattacagtgccataacacttttattgccatctagagtaacatcagttggttttgttta

SEQ ID NO: 39473 - DNA, 601 bp, Human
tgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccaygcccggtcacctttgtcctgttttctacaggttagaagcaaggcacaagtcatacctacattcaaggagaggggaccatgcaaaggataaactgcaggtgaagaacttgagagctattttagaagctgccttccacactttacaatctactttgcagctatactgagctcttagcaactccctgggcctgctgagcacctcttgcctttctgcctttgcgtatgctgttccctctgcctggaattccatgtcttctgcctttgcccacctcatcttaaggcctctgcttagatgcaattt

SEQ ID NO: 39474 - DNA, 601 bp, Human
ttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctsttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtg

SEQ ID NO: 39475 - DNA, 601 bp, Human
cagggagctggcttcttgctgtcctgctggatcctgccctagtgtggccctccctggaaccaggggtggggctggagggcagggcactgagagagatctcctgggaactgtaccatctgcacaaagggcacctgctgggcactctgctgaaagctgtctgcaaacaccacttcctgcctgcctccctgggggctctaagctcaggagggggtgagggcctatgtctgcacgtggtgaggcccctgctgggtattgtaccacaccttcattgtgctcagggtggccagtggaggcccttccyagactcgagctctggtcacaagcccaaccccctccttgctcctgtctgggctcacctggaatctcctgcctcactctgtggccagaggcacctttggaagcccaggtcacccctactactcatgcccctcatttggaaattttcataatctacctcttgttaatgattccatcccatctataatgcttttctatttttctgaatttttccccgataggctataactgctgcaaagatagagaattgcaatgattaatatgcatttatgtatttccaaaaagttaccagaatatcaaactc

SEQ ID NO: 39476 - DNA, 601 bp, Human
accgggttctggctggctgcagctccactgctccactactgcactgtctgagagccaaaaggcaccttgtagtcaggcaggcagggagctggcttcttgctgtcctgctggatcctgccctagtgtggccctccctggaaccaggggtggggctggagggcagggcactgagagagatctcctgggaactgtaccatctgcacaaagggcacctgctgggcactctgctgaaagctgtctgcaaacaccacttcctgcctgcctccctgggggctctaagctcaggagggggtgagggccyatgtctgcacgtggtgaggcccctgctgggtattgtaccacaccttcattgtgctcagggtggccagtggaggcccttcccagactcgagctctggtcacaagcccaaccccctccttgctcctgtctgggctcacctggaatctcctgcctcactctgtggccagaggcacctttggaagcccaggtcacccctactactcatgcccctcatttggaaattttcataatctacctcttgttaatgattccatcccatctataatgcttttctatttttctgaatttttccccgataggc

SEQ ID NO: 39477 - DNA, 601 bp, Human
cacaggtttactgggtgttgcctcccatgcttggagccaggaggatgcagggaaatggggctgccaccatacccgctcttcttatgatcccatcacatcattgcaccctttggggcctggcaccatgctctggcactttgcctccatcatctcctttaacctctgagctctgtcaggaaggcattactactatccctggaatacagacaggaaaactgagttggattgaggctcagagaggttaagtcacttacccaaggtcacaaagctagagagtggcaggccagcatccaaggccagsaacacgagctccctctgatccaaatggtgactctatgtttgatcagtgctctgagaactctccaaagatctttatcaactgtcatctcttcattgcccaggcccagtcagggagccacttggctgcggtcccgctgagatttaggggcaggacccctgatgtgaggtggaatgcttggtcacgctgttcaagcctccaccagtcactcctgactggttatggacactcaatgtgccccgtcctgtgtgcaatgcagtgtgggaaggggatcaaggaccttggctaatcccaggcatttcc

SEQ ID NO: 39478 - DNA, 601 bp, Human
cctgcccagcccaccactgctagatgctctcccctgcatgtaagccccagtaaaactccatgtctccttcagcagccctgggtcctttcttcagcctctcaaacctgctgccatccccattggagtagataggggttcagcataacagcagccaccagctggggaaaggcgtggcatttggagctccctacatggtcttgactctaatatggagggaaagaaaacagattctgccctgctcagtaaagccccctactggcctcccaccctggactgtggacaaagcttttttttttttttttgagacggagtctcactgtgtcccccaggctggagtgcagtggcgtgatctcagctcactgcaagctccgcctccccggttcacgccattctcctgcctcaggctcccgagtagctggggctacaggcgcctgccactacacccggctaattttttttttttttttcatttttagtggagacggggtttcatcgtgttagccaggatggtctcgatctcctacctcgtgatctgcccacctcggcctcccaaagtgctgggattacaggcgtgagccactgcgcccggccaacaaagcat

SEQ ID NO: 39479 - DNA, 601 bp, Human
cagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataacyaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctaga

SEQ ID NO: 39480 - DNA, 601 bp, Human
caatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattg

SEQ ID NO: 39481 - DNA, 601 bp, Human
ttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccmaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttgagactgagtcttgctctgtcactcaggctggaatgca

SEQ ID NO: 39482 - DNA, 601 bp, Human
ccacactcatgggacacagctgcagctgcaggttctgaaaggaaaactaaaacttcagaacccagttcactatgccaaaaaggcaaaaaaaaaaaaaaaaaaaaaaagccaaaagctgagtcatgcaagaagctgactttccttttgctcctaagtagatagctacagataaaaggttaaatagctccacaggtagctactgtatgttcaccttatcttacgtaaactgctgatttattgagcatgagacaaatacgtaattgactatcccctacctactccgtttcctttgcaacatgtrgattcagtcatgtgaccatacactgcctttctcctctccagcctacttttccactttaaatatcaaagccctcaaaatcatctttggagaaaggcacagactagcgactgtttctgtgatttcgtgtctttttacttccagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaa

SEQ ID NO: 39483 - DNA, 601 bp, Human
agagggaggtgaggaatgggttgagaggatttggccccactttgaatgcagggcgaggggaaaccagcatctcagatgtgcctcagtttgtgcagggctaagtgggacccagagcaggaggggcagacttggacgggaggccagtgactctggagtttgcagtgaatatgcagggtcctgggtgtgatgcttgggttgtttatctggcctaggggaagcgaccagaaggcacgtgcctccagtccagccaggctgcaggtgttaaaaatctctgcagtcacattttctggcttctctgaayagcccctgtaggtgctcacacatgtacacatgcatgcatatatatttatatatatatacatttacatatttatatatatttaaatatatttaaatatttaaatatatttttatatatatttatattttatatatgtgtatgcatacacatgcacacagatgtacacacacatatgcacatacacatatgcacacacacaccctacaactcagacctttcctttcagagctacccctgaccgagacttccttgccatgttacaaatgagcatctcttttagagtagtgtaatagaacgtgg

SEQ ID NO: 39484 - DNA, 601 bp, Human
gtttcccttaaacacagcccccactttcagctgggaacccaccctttccttgccggtgctttgtgtcctcaagactggacataaggtgttgaggtgtggtgtgtggtttcaccacacaatcatttggggtctcctgagagaggtggggggaggggtgtggtctgcttgagcaggtgagggaaatggattggggtgctagctggtaactgtatactgactttcttttgtagaggcagggtctcattctgttgcccaagttggagcgtagagtcatgataacagctcagtgcagcctcgaacycctaggctcaagcaatctacctgcctcagcctcctaagtggctgggaccacaggcatacaccaccatgcccagctaatttattttttgtagagatggggtctcctatgttgaccaggttggtcttgaactcctgggctcatgtgatcctcctgcctcagcctcccaaagtgttgggattgcaggcgtgagccacggtgcccagccagtatactgactttcagtcaacctcatgctttcagtgccagttcttcttggtgcctgatgattgcaaacccaggatttattggagagtctctgtt

SEQ ID NO: 39485 - DNA, 601 bp, Human
agaatttctctcttggcctgaacacttgagctggaacgttggtcttctcttctctgtggactgggacttacaccatcggctctcctgagtctccagcttaaagacggcagatcatgggacttcttggcctccacaattacatgagccaattctttataacaaatctatatccatcagtctatgtcttctgtctatctacctatcagtctatcaaccagtccagccatccatctgtcatctatctatcttactggttctgtttttctggagaaccctgactagcaaagatgatgagcccaayttcttgttggggatccccagatatcagcgggcagagtgtctccttttggcaccttcagtttctccagaaatgaacctttccatttccatcctaagggattgcaagagctgtggacttgccaggagggaagggagcagaggcccccacagttcacaatgtaatgtttcccttaaacacagcccccactttcagctgggaacccaccctttccttgccggtgctttgtgtcctcaagactggacataaggtgttgaggtgtggtgtgtggtttcaccacacaatcatttggggtctcctgag

SEQ ID NO: 39486 - DNA, 601 bp, Human
ttaaaactgtatgtgggtgggattgtcacctagagtgcttttttggagagtaattggatggtgtgataattaattttatgtgtcaatttgacagggtcttggggtgtccagttatttggttaaacattatttctgggtgtgcctaagagggtgtttcctgatgagattagcatttgaatggatggactgaataaagcaagctgccctcctcaatgtgggcgggcaccatacccttgaaggcttgaatagaacagaaaggcaggagaatttctctcttggcctgaacacttgagctggaacrttggtcttctcttctctgtggactgggacttacaccatcggctctcctgagtctccagcttaaagacggcagatcatgggacttcttggcctccacaattacatgagccaattctttataacaaatctatatccatcagtctatgtcttctgtctatctacctatcagtctatcaaccagtccagccatccatctgtcatctatctatcttactggttctgtttttctggagaaccctgactagcaaagatgatgagcccaacttcttgttggggatccccagatatcagcgggcagagt

SEQ ID NO: 39487 - DNA, 601 bp, Human
agatgccagactgccttgatcctctaattatcttatctctttcttcttattttctatctttttgtcttttcattctactttcctcagctcttggttgaagaatttttcattctgcttatgccttaaaaatatctaagagcttttttttgttccctttttttaaaagcgttccattgttgtttgatgtgtgggctctcctgttttctttctgagcatattatatctaatttttgaaggttgtattttctcccttgttttaattttctgcagatacttttttcttttttactttccccaattwgtttgtttctgactttcttcctcaatctctcctgaaccattgtttctttttaagatcagagcagattcttaggaacttttaaaactgtatgtgggtgggattgtcacctagagtgcttttttggagagtaattggatggtgtgataattaattttatgtgtcaatttgacagggtcttggggtgtccagttatttggttaaacattatttctgggtgtgcctaagagggtgtttcctgatgagattagcatttgaatggatggactgaataaagcaagctgccctcctcaatgtgggcgg

SEQ ID NO: 39488 - DNA, 601 bp, Human
tggagtaagatgccagactgccttgatcctctaattatcttatctctttcttcttattttctatctttttgtcttttcattctactttcctcagctcttggttgaagaatttttcattctgcttatgccttaaaaatatctaagagcttttttttgttccctttttttaaaagcgttccattgttgtttgatgtgtgggctctcctgttttctttctgagcatattatatctaatttttgaaggttgtattttctcccttgttttaattttctgcagatacttttttcttttttactttcyccaatttgtttgtttctgactttcttcctcaatctctcctgaaccattgtttctttttaagatcagagcagattcttaggaacttttaaaactgtatgtgggtgggattgtcacctagagtgcttttttggagagtaattggatggtgtgataattaattttatgtgtcaatttgacagggtcttggggtgtccagttatttggttaaacattatttctgggtgtgcctaagagggtgtttcctgatgagattagcatttgaatggatggactgaataaagcaagctgccctcctcaatg

SEQ ID NO: 39489 - DNA, 601 bp, Human
ttcttccaggcatgtccttaaccttggcaaaataaacttctaaatggattgagacctgtctcagatattttttggttcacaaactctagggtgggaaatatttcccctcagaactttgaaggcattgccccctcatcttctagcactcaacatggccattgagatttgatggcattttaaattccaacatgtttattaatgagaccagttttttctcactagaagttacacataaaatacttaaaatagttcctggaatttaatgaactgaattaatgttagctattactatcattgaackattttttttctctgacattctttaatattttaatttttttttctaaaagacagggtctcactcttttgccctggctggagtgcagtggtgcaatcctagctcactgcagcctcgaattcctgggcctaagtgatcctcctatctcagcctcctgagtatctggggcaacaggcatgtgcaactatggctggctaatttttaaattttttgtagagatgtgatctcgctatattgcccaggctggtctcaaattcctggcctcaagcaatctttctagattataggacttcttggcttcca

SEQ ID NO: 39490 - DNA, 601 bp, Human
tgtgtggattaccatacccttcctctatcccctccagagatgaatttttccatgtctgtttcccccatttaaatattgaagccctcactatcatctttggagaaagggacagatcatagacttgtttctgtgattctgtgtccttttcttccaggcatgtccttaaccttggcaaaataaacttctaaatggattgagacctgtctcagatattttttggttcacaaactctagggtgggaaatatttcccctcagaactttgaaggcattgccccctcatcttctagcactcaacatggscattgagatttgatggcattttaaattccaacatgtttattaatgagaccagttttttctcactagaagttacacataaaatacttaaaatagttcctggaatttaatgaactgaattaatgttagctattactatcattgaactattttttttctctgacattctttaatattttaatttttttttctaaaagacagggtctcactcttttgccctggctggagtgcagtggtgcaatcctagctcactgcagcctcgaattcctgggcctaagtgatcctcctatctcagcctcctga

SEQ ID NO: 39491 - DNA, 601 bp, Human
ttgcaatgtgtggattaccatacccttcctctatcccctccagagatgaatttttccatgtctgtttcccccatttaaatattgaagccctcactatcatctttggagaaagggacagatcatagacttgtttctgtgattctgtgtccttttcttccaggcatgtccttaaccttggcaaaataaacttctaaatggattgagacctgtctcagatattttttggttcacaaactctagggtgggaaatatttcccctcagaactttgaaggcattgccccctcatcttctagcactcarcatggccattgagatttgatggcattttaaattccaacatgtttattaatgagaccagttttttctcactagaagttacacataaaatacttaaaatagttcctggaatttaatgaactgaattaatgttagctattactatcattgaactattttttttctctgacattctttaatattttaatttttttttctaaaagacagggtctcactcttttgccctggctggagtgcagtggtgcaatcctagctcactgcagcctcgaattcctgggcctaagtgatcctcctatctcagcc

SEQ ID NO: 39492 - DNA, 601 bp, Human
tcaccttatcttatgtaaagtgctgatttactgagcaggagacagatatgtaactgactattccctagctgctcttctcctcttgcaatgtgtggattaccatacccttcctctatcccctccagagatgaatttttccatgtctgtttcccccatttaaatattgaagccctcactatcatctttggagaaagggacagatcatagacttgtttctgtgattctgtgtccttttcttccaggcatgtccttaaccttggcaaaataaacttctaaatggattgagacctgtctcagataytttttggttcacaaactctagggtgggaaatatttcccctcagaactttgaaggcattgccccctcatcttctagcactcaacatggccattgagatttgatggcattttaaattccaacatgtttattaatgagaccagttttttctcactagaagttacacataaaatacttaaaatagttcctggaatttaatgaactgaattaatgttagctattactatcattgaactattttttttctctgacattctttaatattttaatttttttttctaaaagacagggtctcactctttt

SEQ ID NO: 39493 - DNA, 601 bp, Human
gccaaaaggaaaaaaaaaaaagaagctgaaagctgagtcatgcaagaaactgccttttcttttgctcctaagtagatggctacagataaaagattaaatatctccacaggtagctactccatgttcaccttatcttatgtaaagtgctgatttactgagcaggagacagatatgtaactgactattccctagctgctcttctcctcttgcaatgtgtggattaccatacccttcctctatcccctccagagatgaatttttccatgtctgtttcccccatttaaatattgaagccctcacyatcatctttggagaaagggacagatcatagacttgtttctgtgattctgtgtccttttcttccaggcatgtccttaaccttggcaaaataaacttctaaatggattgagacctgtctcagatattttttggttcacaaactctagggtgggaaatatttcccctcagaactttgaaggcattgccccctcatcttctagcactcaacatggccattgagatttgatggcattttaaattccaacatgtttattaatgagaccagttttttctcactagaagttacacataaaatacttaa

SEQ ID NO: 39494 - DNA, 601 bp, Human
tgttgaggtcaggagttcaagaccaggctggccaacatggcgaaactgtgtctctactaaaaaatataaaaaacttagccaggcgtggtggcaggtacctgtagtcccagctacttgggaggatgaggaaggagaattgcttgaacccaggaggtggaggttgcagtgagtcaagatcatgccactgcacttcagcctgggtgacagagtgagactctgtctcaaaaaaacaaaagcaaatcatgttttgttgagtttgtttagctgtgtattcacaagttgattggcatctctcagcccrtcccaaccccaccccggaatgctcttcccaggcttcctaacaggtattctcctttacctggattgcatttgtagaaaacactctgcttcagtgggaggcaaggaacagaatatttctctgtctagggcatactcttccatgttatctgattccaattctatgggacctattttaccattctgaaagctacagataaccgatagaaatgaaaaataattcttgtctatggatatgcaaatgcttatattttgaagagagacaacccttcctcacttccccccaaatcccctagtttgcttc

SEQ ID NO: 39495 - DNA, 601 bp, Human
ctgtaacctgggagcccccaacctccacccaacaattcaagttgtcccacctttctggacagaaccaatgtatttcttaaatgtatttgattgacatctcatgtctccctaaaatgtataaaaccaagctgcaccccgaccaccttgggcatagttctcaggatctcctgagggctgtgttacaggccatggtcactcatatttggctcagaataaatctcttcaaatattttacagagcttgactgtttttatttgttaatgatctcactctatcgtccaggctggagtgcagtggtgcratcatggattactgcagcctctacctccctgggctcacatgatcctcccttctcagcctcccaagtagctgagactacacacatgcgccaccatgcctggttaattttaaaactttttgtatagatggaggtcttactgtgttgcccaggctggtctcaaacttctggcctcaagtgatcctaccaccacagcctcccaaattggtgggattacagggatacgatttttattttatttttatagagatgggggtcacagtatgatgccctggctggtattgaactcctgtgttcaagcaa

SEQ ID NO: 39496 - DNA, 601 bp, Human
cccagatctttagataaacttaaccaattgtcaaccagtcaattttaaatctacctgtaacctgggagcccccaacctccacccaacaattcaagttgtcccacctttctggacagaaccaatgtatttcttaaatgtatttgattgacatctcatgtctccctaaaatgtataaaaccaagctgcaccccgaccaccttgggcatagttctcaggatctcctgagggctgtgttacaggccatggtcactcatatttggctcagaataaatctcttcaaatattttacagagcttgactstttttatttgttaatgatctcactctatcgtccaggctggagtgcagtggtgcaatcatggattactgcagcctctacctccctgggctcacatgatcctcccttctcagcctcccaagtagctgagactacacacatgcgccaccatgcctggttaattttaaaactttttgtatagatggaggtcttactgtgttgcccaggctggtctcaaacttctggcctcaagtgatcctaccaccacagcctcccaaattggtgggattacagggatacgatttttattttatttttatagag

SEQ ID NO: 39497 - DNA, 601 bp, Human
tgaagcctgctacccggaggcttcatctgcatggtaaaactttggtctccacaacctcctatcacagcacagacattttctttctattgagcccagatctttagataaacttaaccaattgtcaaccagtcaattttaaatctacctgtaacctgggagcccccaacctccacccaacaattcaagttgtcccacctttctggacagaaccaatgtatttcttaaatgtatttgattgacatctcatgtctccctaaaatgtataaaaccaagctgcaccccgaccaccttgggcatagtwctcaggatctcctgagggctgtgttacaggccatggtcactcatatttggctcagaataaatctcttcaaatattttacagagcttgactgtttttatttgttaatgatctcactctatcgtccaggctggagtgcagtggtgcaatcatggattactgcagcctctacctccctgggctcacatgatcctcccttctcagcctcccaagtagctgagactacacacatgcgccaccatgcctggttaattttaaaactttttgtatagatggaggtcttactgtgttgcccaggctggt

SEQ ID NO: 39498 - DNA, 601 bp, Human
ctgaatggacttcctcctgggccagggtacttttaacctgaaagactggttcaggccatgatggaaagtagaggtcagacaggactcattatacctctctgatgagaagcatttacaatctattttctctgaagcctgctacccggaggcttcatctgcatggtaaaactttggtctccacaacctcctatcacagcacagacattttctttctattgagcccagatctttagataaacttaaccaattgtcaaccagtcaattttaaatctacctgtaacctgggagcccccaacctccrcccaacaattcaagttgtcccacctttctggacagaaccaatgtatttcttaaatgtatttgattgacatctcatgtctccctaaaatgtataaaaccaagctgcaccccgaccaccttgggcatagttctcaggatctcctgagggctgtgttacaggccatggtcactcatatttggctcagaataaatctcttcaaatattttacagagcttgactgtttttatttgttaatgatctcactctatcgtccaggctggagtgcagtggtgcaatcatggattactgcagcctctacct

SEQ ID NO: 39499 - DNA, 601 bp, Human
caagcgatttatagtctcatcaaatatcgacaagtttgggttttcctttagagttgggcagggcctggctggacttctttctccaccagtctccgggaggctcaaacaagttctgattttcaggttctgaaaaagctctcagggaaaaagcagcttccattctgttttttttccctttctgcattctacttcccttttatttttggcctggtaatttctgtcttatcagcttttagatgtccttgagatttttcttttctttcatttttttttttttgagacagggtgtaaaccaaaaacycttttattctttttttttttcttttgagacaggatgtaaaccaaaaataaaattctaagccccgccctccctgcaaccatctgaatggacttcctcctgggccagggtacttttaacctgaaagactggttcaggccatgatggaaagtagaggtcagacaggactcattatacctctctgatgagaagcatttacaatctattttctctgaagcctgctacccggaggcttcatctgcatggtaaaactttggtctccacaacctcctatcacagcacagacattttctttctattgag

SEQ ID NO: 39500 - DNA, 601 bp, Human
gcaccagagagtgaaaagaggcaagcgatttatagtctcatcaaatatcgacaagtttgggttttcctttagagttgggcagggcctggctggacttctttctccaccagtctccgggaggctcaaacaagttctgattttcaggttctgaaaaagctctcagggaaaaagcagcttccattctgttttttttccctttctgcattctacttcccttttatttttggcctggtaatttctgtcttatcagcttttagatgtccttgagatttttcttttctttcatttttttttttttgaracagggtgtaaaccaaaaactcttttattctttttttttttcttttgagacaggatgtaaaccaaaaataaaattctaagccccgccctccctgcaaccatctgaatggacttcctcctgggccagggtacttttaacctgaaagactggttcaggccatgatggaaagtagaggtcagacaggactcattatacctctctgatgagaagcatttacaatctattttctctgaagcctgctacccggaggcttcatctgcatggtaaaactttggtctccacaacctcctatcacagcac

SEQ ID NO: 39501 - DNA, 601 bp, Human
ccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctgtctcagcttctcaaagtgctgggattacaggcgtgagccgctgcacccagcccagaatccagttttaaagagtttattcaagcyaaaagctgggaatggccatctgagaaacacagactctaggaaaatggggccagggccctgaagttaaaagttaaagtcttgcttacataggcagaaagcaaagacatttagtaaccttgtagaacattttcttgtataacttttcttgttttaactttcttgtttaacattttctatgcaaggctggtttatgagttacaacctataattaattataggttgttcccctgcctccaccttgttttcttttctctacagcttgttttcatttcctttccaatttaagaatgtgtttaacat

SEQ ID NO: 39502 - DNA, 601 bp, Human
ctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttggaatggaccttttcctttcttagcttgctgtagggattgtgcttcagctaagtaaagtggaaaaacagaagtacaaaagcaasagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatcggtctcactttattgaccaggctggtttcgaactcctgggcttaagtgatttctcctg

SEQ ID NO: 39503 - DNA, 601 bp, Human
ccaagcaaatggtcctgcaaactgtactacccaacgttcacagcaaggattccaacttctcaccagggcatggaaaatttgccttcatgtcaaccaccaccttagcccttgactacccaacggactcttcccaagtcaacagccacttcctccctggggcttaacaggcattccttgaagcctgccccgggcagttagtccttcccttttgtgtgaactctcggctgttttcgttgtctgcacacagagcagtggtctagggagcgaagggttttggaatggaccttttcctttcttagcktgctgtagggattgtgcttcagctaagtaaagtggaaaaacagaagtacaaaagcaacagccccagatctaagggcaccgtagctctggaatctggattttattccagattcaaccctcagcagggagttgaagtggtcagccctgtgctttacaaggctgattgggcagcacccatagtagaattgtcaatataaagtaattgaaaggatcagaatccagggttttcgttgtttttaagtttttaagttttaaaaacaaagttgtttttgttcgtttttaagtttacttctctttaatc

SEQ ID NO: 39504 - DNA, 601 bp, Human; identical to SEQ ID NO: 39471

SEQ ID NO: 39505 - DNA, 601 bp, Human; identical to SEQ ID NO: 39472

SEQ ID NO: 39506 - DNA, 601 bp, Human; identical to SEQ ID NO: 39473

SEQ ID NO: 39507 - DNA, 601 bp, Human; identical to SEQ ID NO: 39474

SEQ ID NO: 39508 - DNA, 601 bp, Human; identical to SEQ ID NO: 39475

SEQ ID NO: 39509 - DNA, 601 bp, Human; identical to SEQ ID NO: 39476

SEQ ID NO: 39510 - DNA, 601 bp, Human; identical to SEQ ID NO: 39477

SEQ ID NO: 39511 - DNA, 601 bp, Human; identical to SEQ ID NO: 39478

SEQ ID NO: 39512 - DNA, 601 bp, Human; identical to SEQ ID NO: 39479

SEQ ID NO: 39513 - DNA, 601 bp, Human; identical to SEQ ID NO: 39480

SEQ ID NO: 39514 - DNA, 601 bp, Human; identical to SEQ ID NO: 39481

SEQ ID NO: 39515 - DNA, 601 bp, Human; identical to SEQ ID NO: 39482

SEQ ID NO: 39516 - DNA, 601 bp, Human; identical to SEQ ID NO: 39483

SEQ ID NO: 39517 - DNA, 601 bp, Human; identical to SEQ ID NO: 39484

SEQ ID NO: 39518 - DNA, 601 bp, Human; identical to SEQ ID NO: 39485

SEQ ID NO: 39519 - DNA, 601 bp, Human; identical to SEQ ID NO: 39486

SEQ ID NO: 39520 - DNA, 601 bp, Human; identical to SEQ ID NO: 39487

SEQ ID NO: 39521 - DNA, 601 bp, Human; identical to SEQ ID NO: 39488

SEQ ID NO: 39522 - DNA, 601 bp, Human; identical to SEQ ID NO: 39489

SEQ ID NO: 39523 - DNA, 601 bp, Human; identical to SEQ ID NO: 39490

SEQ ID NO: 39524 - DNA, 601 bp, Human; identical to SEQ ID NO: 39491

SEQ ID NO: 39525 - DNA, 601 bp, Human; identical to SEQ ID NO: 39492

SEQ ID NO: 39526 - DNA, 601 bp, Human; identical to SEQ ID NO: 39493

SEQ ID NO: 39527 - DNA, 601 bp, Human; identical to SEQ ID NO: 39494

SEQ ID NO: 39528 - DNA, 601 bp, Human; identical to SEQ ID NO: 39495

SEQ ID NO: 39529 - DNA, 601 bp, Human; identical to SEQ ID NO: 39496

SEQ ID NO: 39530 - DNA, 601 bp, Human; identical to SEQ ID NO: 39497

SEQ ID NO: 39531 - DNA, 601 bp, Human; identical to SEQ ID NO: 39498

SEQ ID NO: 39532 - DNA, 601 bp, Human; identical to SEQ ID NO: 39499

SEQ ID NO: 39533 - DNA, 601 bp, Human; identical to SEQ ID NO: 39500

SEQ ID NO: 39534 - DNA, 601 bp, Human; identical to SEQ ID NO: 39501

SEQ ID NO: 39535 - DNA, 601 bp, Human; identical to SEQ ID NO: 39502

SEQ ID NO: 39536 - DNA, 601 bp, Human; identical to SEQ ID NO: 39503

SEQ ID NO: 39537 - DNA, 601 bp, Human; identical to SEQ ID NO: 18568

SEQ ID NO: 39538 - DNA, 601 bp, Human; identical to SEQ ID NO: 18569

SEQ ID NO: 39539 - DNA, 601 bp, Human; identical to SEQ ID NO: 18570

SEQ ID NO: 39540 - DNA, 601 bp, Human; identical to SEQ ID NO: 18571

SEQ ID NO: 39541 - DNA, 601 bp, Human; identical to SEQ ID NO: 18572

SEQ ID NO: 39542 - DNA, 601 bp, Human; identical to SEQ ID NO: 18573

SEQ ID NO: 39543 - DNA, 601 bp, Human; identical to SEQ ID NO: 18574

SEQ ID NO: 39544 - DNA, 601 bp, Human; identical to SEQ ID NO: 18575

SEQ ID NO: 39545 - DNA, 601 bp, Human; identical to SEQ ID NO: 18576

SEQ ID NO: 39546 - DNA, 601 bp, Human; identical to SEQ ID NO: 18577

SEQ ID NO: 39547 - DNA, 601 bp, Human; identical to SEQ ID NO: 18578

SEQ ID NO: 39548 - DNA, 601 bp, Human; identical to SEQ ID NO: 18579

SEQ ID NO: 39549 - DNA, 601 bp, Human; identical to SEQ ID NO: 18580

SEQ ID NO: 39550 - DNA, 601 bp, Human; identical to SEQ ID NO: 18581

SEQ ID NO: 39551 - DNA, 601 bp, Human; identical to SEQ ID NO: 18582

SEQ ID NO: 39552 - DNA, 601 bp, Human; identical to SEQ ID NO: 18583

SEQ ID NO: 39553 - DNA, 601 bp, Human; identical to SEQ ID NO: 18584

SEQ ID NO: 39554 - DNA, 601 bp, Human; identical to SEQ ID NO: 18585

SEQ ID NO: 39555 - DNA, 601 bp, Human; identical to SEQ ID NO: 18586

SEQ ID NO: 39556 - DNA, 601 bp, Human; identical to SEQ ID NO: 18587

SEQ ID NO: 39557 - DNA, 601 bp, Human; identical to SEQ ID NO: 18588

SEQ ID NO: 39558 - DNA, 601 bp, Human; identical to SEQ ID NO: 18589

SEQ ID NO: 39559 - DNA, 601 bp, Human; identical to SEQ ID NO: 18590

SEQ ID NO: 39560 - DNA, 601 bp, Human; identical to SEQ ID NO: 18591

SEQ ID NO: 39561 - DNA, 601 bp, Human; identical to SEQ ID NO: 18592

SEQ ID NO: 39562 - DNA, 601 bp, Human; identical to SEQ ID NO: 18593

SEQ ID NO: 39563 - DNA, 601 bp, Human; identical to SEQ ID NO: 18594

SEQ ID NO: 39564 - DNA, 601 bp, Human; identical to SEQ ID NO: 18595

SEQ ID NO: 39565 - DNA, 601 bp, Human; identical to SEQ ID NO: 18596

SEQ ID NO: 39566 - DNA, 601 bp, Human; identical to SEQ ID NO: 18597

SEQ ID NO: 39567 - DNA, 601 bp, Human; identical to SEQ ID NO: 18598

SEQ ID NO: 39568 - DNA, 601 bp, Human; identical to SEQ ID NO: 18599

SEQ ID NO: 39569 - DNA, 601 bp, Human; identical to SEQ ID NO: 18600

SEQ ID NO: 39570 - DNA, 601 bp, Human; identical to SEQ ID NO: 18568

SEQ ID NO: 39571 - DNA, 601 bp, Human; identical to SEQ ID NO: 18569

SEQ ID NO: 39572 - DNA, 601 bp, Human; identical to SEQ ID NO: 18570

SEQ ID NO: 39573 - DNA, 601 bp, Human; identical to SEQ ID NO: 18571

SEQ ID NO: 39574 - DNA, 601 bp, Human; identical to SEQ ID NO: 18572

SEQ ID NO: 39575 - DNA, 601 bp, Human; identical to SEQ ID NO: 18573

SEQ ID NO: 39576 - DNA, 601 bp, Human; identical to SEQ ID NO: 18574

SEQ ID NO: 39577 - DNA, 601 bp, Human; identical to SEQ ID NO: 18575

SEQ ID NO: 39578 - DNA, 601 bp, Human; identical to SEQ ID NO: 18576

SEQ ID NO: 39579 - DNA, 601 bp, Human; identical to SEQ ID NO: 18577

SEQ ID NO: 39580 - DNA, 601 bp, Human; identical to SEQ ID NO: 18578

SEQ ID NO: 39581 - DNA, 601 bp, Human; identical to SEQ ID NO: 18579

SEQ ID NO: 39582 - DNA, 601 bp, Human; identical to SEQ ID NO: 18580

SEQ ID NO: 39583 - DNA, 601 bp, Human; identical to SEQ ID NO: 18581

SEQ ID NO: 39584 - DNA, 601 bp, Human; identical to SEQ ID NO: 18582

SEQ ID NO: 39585 - DNA, 601 bp, Human; identical to SEQ ID NO: 18583

SEQ ID NO: 39586 - DNA, 601 bp, Human; identical to SEQ ID NO: 18584

SEQ ID NO: 39587 - DNA, 601 bp, Human; identical to SEQ ID NO: 18585

SEQ ID NO: 39588 - DNA, 601 bp, Human; identical to SEQ ID NO: 18586

SEQ ID NO: 39589 - DNA, 601 bp, Human; identical to SEQ ID NO: 18587

SEQ ID NO: 39590 - DNA, 601 bp, Human; identical to SEQ ID NO: 18588

SEQ ID NO: 39591 - DNA, 601 bp, Human; identical to SEQ ID NO: 18589

SEQ ID NO: 39592 - DNA, 601 bp, Human; identical to SEQ ID NO: 18590

SEQ ID NO: 39593 - DNA, 601 bp, Human; identical to SEQ ID NO: 18591

SEQ ID NO: 39594 - DNA, 601 bp, Human; identical to SEQ ID NO: 18592

SEQ ID NO: 39595 - DNA, 601 bp, Human; identical to SEQ ID NO: 18593

SEQ ID NO: 39596 - DNA, 601 bp, Human; identical to SEQ ID NO: 18594

SEQ ID NO: 39597 - DNA, 601 bp, Human; identical to SEQ ID NO: 18595

SEQ ID NO: 39598 - DNA, 601 bp, Human; identical to SEQ ID NO: 18596

SEQ ID NO: 39599 - DNA, 601 bp, Human; identical to SEQ ID NO: 18597

SEQ ID NO: 39600 - DNA, 601 bp, Human; identical to SEQ ID NO: 18598

SEQ ID NO: 39601 - DNA, 601 bp, Human; identical to SEQ ID NO: 18599

SEQ ID NO: 39602 - DNA, 601 bp, Human; identical to SEQ ID NO: 18600

SEQ ID NO: 39603 - DNA, 601 bp, Human
gagccccgcggcctcgccggcaattggtttcccccccgaagctgctccgggggtgagttcgggagagagaggcaggaccccgggaccagagcaccccgaccccgaccccagcccgggccccagccgccccagcgccccgcccgggccgctcacctgtcgtcgacgtgcaggctgggcgagcacttgatggccagccaggtcttccagtggacatggcgcaccttgtacacctgcccgaagccgcccgagcccaccttctcccagcccgtgaactcgcccgcgtcgaaggtgcgcagcagcsccagggcccatggggtcccgccgtcgccctccatcgcgcacgtctagccagcgccgcggcggctgcccaggtgcccaggtgcgcgctccgccctgttacgtcacttccgtaggtcgtcccgcccccaggccccgcccacttacccgccccccgggcgccctctctgccagcgcccggtgactgcggacggatgaatagacgctgcgggtcactgcgctctcccctgggtgagcagagcttctcacgcttctcacgggtctcgacgtgcgcatcagctgccctgcttttctttgctttttt

SEQ ID NO: 39604 - DNA, 601 bp, Human
ctctgcttgtcccctgcatgaactacatggatccggaccatggctctcggctccttctcactcccagggcagacaccagtgtcatgtggaccagcctatcaccctgggcctcccaagagcatgtgaacatcaccacgtggggaaaaactacaacgcgccaggtgtaaccaccacatgtcaacgacagtacaaccctagccacgaaggccatcaaaggagatacaaggaaatacagccctgatgcaaaggtgatgatgctaacacctgccaaggcccagaggcaacactggttttcagttayattatctctcttacttttctgtgtttcaaaaacctatcagcgaagcaaaagcaagctccatctcccaggcgttgcactaacgcaacacgctgccactccgcactctacgcaggggcagacagaggcaacgagcccctcctcacaagcctctttccacagcactttgaggaccccactgcagaggacccccacattcccaccaccccgagctcctgaaaacactgagggaaatgcgtccctttgttgcagagcctaaggtctcgcaaggacacacctggcccacgggctgaattctaacct

SEQ ID NO: 39605 - DNA, 601 bp, Human
aaggctctgctgctgcctgccccgactcctgagggcagaaaagccccaccctgtgtgaaggcccagccccaggagcactcccaccccctcccacagggccgcctctaggcccagcctgcgggccacacaccctgcccccaagtgactgctacgtgcagtggtcatttggtttctttcatgtcaagcacagtggcaggccaggtggaaatcaaggtctctgctccgtgacttacagctggacgatcctggctgctaatttactcactctaagcagagactcagcgagaaccagaggccaccrtccactctgcacctctgctctgaggatgagggcagctcccgcaggtgaagcctctagcatgtcctttccggtattcagtgcacgttggacggcagagcttactagtcattagggccccagagcctgtgctacctagaaacaagcccgtaaatgttggcgggaatggggggtccgcatgtgaggcccagccctgcccatcacaggaaacgggaatcccaggggtcccagaacataagcagatgcgggaaaccaccagagagcccgttcaagccaagtcatttgatttttgtctccattatc

SEQ ID NO: 39606 - DNA, 601 bp, Human
aagacagggaagccctgctgcctgctgcccctgcaggaaggcccagagctctctgcgtctcttgggctgtttccttcacctaaaggctctgctgctgcctgccccgactcctgagggcagaaaagccccaccctgtgtgaaggcccagccccaggagcactcccaccccctcccacagggccgcctctaggcccagcctgcgggccacacaccctgcccccaagtgactgctacgtgcagtggtcatttggtttctttcatgtcaagcacagtggcaggccaggtggaaatcaaggtctcygctccgtgacttacagctggacgatcctggctgctaatttactcactctaagcagagactcagcgagaaccagaggccaccgtccactctgcacctctgctctgaggatgagggcagctcccgcaggtgaagcctctagcatgtcctttccggtattcagtgcacgttggacggcagagcttactagtcattagggccccagagcctgtgctacctagaaacaagcccgtaaatgttggcgggaatggggggtccgcatgtgaggcccagccctgcccatcacaggaaacgggaatccca

SEQ ID NO: 39607 - DNA, 601 bp, Human
cgtaaaggtatttttcggtttgtttttgggcttcttgatggtgactaacatgcctgattaagaaggacgccacacaaaagcaatctttcctgcggcctgtcagggtacacagggccctaagatgtcccaggggcaccacacagagatgtcctgtcacttcctggccagcacccagcgtgccttcgacagcagcctccctgagaaagcagttccaggcagcatccgccccctgcagctgtcctgaaagacagggaagccctgctgcctgctgcccctgcaggaaggcccagagctctctgcrtctcttgggctgtttccttcacctaaaggctctgctgctgcctgccccgactcctgagggcagaaaagccccaccctgtgtgaaggcccagccccaggagcactcccaccccctcccacagggccgcctctaggcccagcctgcgggccacacaccctgcccccaagtgactgctacgtgcagtggtcatttggtttctttcatgtcaagcacagtggcaggccaggtggaaatcaaggtctctgctccgtgacttacagctggacgatcctggctgctaatttactcactctaagcaga

SEQ ID NO: 39608 - DNA, 601 bp, Human
gtgatatttccagtttgaatcgagccctgagcactgagggagcccatctcagaggcgaatggcagcactggaatggcaacttaggatctaattgcaggattctggattacagttttcctgcattgaataactgtctactgaggactgcccagaagcccagtggtcagtccatgcaaagcttccacacttcgtcttcaggaacaaaggcgctgactctcagaaccccgacacacactccctgctgccctctacgcacaccagtagctatttcacagaaaaaataagtatgtcacgtaaaggyatttttcggtttgtttttgggcttcttgatggtgactaacatgcctgattaagaaggacgccacacaaaagcaatctttcctgcggcctgtcagggtacacagggccctaagatgtcccaggggcaccacacagagatgtcctgtcacttcctggccagcacccagcgtgccttcgacagcagcctccctgagaaagcagttccaggcagcatccgccccctgcagctgtcctgaaagacagggaagccctgctgcctgctgcccctgcaggaaggcccagagctctctgcgtctcttgg

SEQ ID NO: 39609 - DNA, 601 bp, Human
aaaaaataataataaaaataaagaaagcatcacatactttctaggcaattcctcctccccctgtatggttgaatgtaggaaaaaaatatctccctcccacggttagttaaggatcagactcactgttctaatcttgcctgtacaagttagtagctccgtggccctggactattagcctctctgtgcctgtttccttttttcataaaaggaggcaatagcagtacccatcctgtagctttgttgtgaaaattaaatgacatctgagatcattaagaaagaaaagaaaagaaaagaaaaacgrcaggggtgcagagatctcagcctggtgcttccccaggcctgcagccttttctcctcctgtctttgtcagatagagccagccactccaaactatacttggtgaaaagaaaacgagcagaaattctctgtaaaacctctggcaacaaaatgcaagctcggaattgagaattctaggagggtcactgaccctctatgttctcctccctccatgtctcggactcctggccggctgcatttcccctccgcctttcctcatcttcccacccaagctgcccctcaccccgtgtcctcaacagcgagc

SEQ ID NO: 39610 - DNA, 601 bp, Human
aacatcacacgccgggccctgtcggtgcgtaggggaagagggaagggagagcattaggacaaacacctaatgcatgcgggtcttaaaacctaggtgataacctagatggtggatgggtgcagcaaaccaccatggcacatataaacctatgtaacaaactggcacattctgcacatgtatcccggaactaaaagtaaaataaaaaataataataaaaataaagaaagcatcacatactttctaggcaattcctcctccccctgtatggttgaatgtaggaaaaaaatatctccctcccacrgttagttaaggatcagactcactgttctaatcttgcctgtacaagttagtagctccgtggccctggactattagcctctctgtgcctgtttccttttttcataaaaggaggcaatagcagtacccatcctgtagctttgttgtgaaaattaaatgacatctgagatcattaagaaagaaaagaaaagaaaagaaaaacgacaggggtgcagagatctcagcctggtgcttccccaggcctgcagccttttctcctcctgtctttgtcagatagagccagccactccaaactatacttggt

SEQ ID NO: 39611 - DNA, 601 bp, Human
aggcagagctcacatgcggggtccgagtcacagtgctgctggataacagccacaatgggaggcttagtgcctgctcacacgctcccacccacttttcttctccaagaagtctgtgtgattaagacctttacaatttgaaaaaggaagggactaggtgacttggggattgatctctgaccaacaaaggttaagtgccatgaagaagatgagctgctcgcctcacaaaatcagagtgaatttcggaaagtacaaacacacatgcgtacagaccactgaaagcagcaggttcttccaacagacragccataaagcccacgggtcatgaaatcaccaaggctctgacagggcagggctgtcagcctggcccaaatgtggacctgggaacacccttcctccttggctagcaacactcacagcaaagaaatccctgaactctacaagcacccaccccttctatgtggacttagccccctttctgtttgtttgttttttagacagggtcgcgctctgttgcccaggctggaatgcagtggtgcaatcatgacttactgcaatctccacctcccgggctcaagcaatcccccaacctcagtcccgagta

SEQ ID NO: 39612 - DNA, 601 bp, Human
cttgctgagatttcagcgttcctaacagaggctcactgagagttcatcattagagggttgttaaagaaagtgcgcagaaaacgtaggagacaacacagctgaacgccccaaagcctttttcgggggctgcttagaaatatatagataatatgagggatacgttcatgtacattactctggatacaccaaaaaaagtgcccaaattgattaaaaaaaaaaaaaaaaaaaagaaaagaaaaacagaagtccgaaaactgagcctccaaggagcactgagttggtgagggctgtttatagacamcgaattcaccatcgaaaattagttcaaacggcaggttcaaaagctggaactccaaactctaaaataaatggagaggatctcaatctccccaaactctacaagctgtgactagtctccaaagtgacacttccaggcaactctcagcttaaagccccagctaagcacatgcacaatggccactgtcaaaccagtcagcctgggctgctggcggcggcagtgaccaaaaggcagagctcacatgcggggtccgagtcacagtgctgctggataacagccacaatgggaggcttagtgcctgct

SEQ ID NO: 39613 - DNA, 601 bp, Human
cacctcaaagacaggtccactcacctgcaaacggcttcttctgtgtgagcacgccccagatgacgatcgcaaagctggaagagaaaccaggcacgttagcatctgacagccagagactcaaagccaaatgcactcatgcacagcaacaggcgtgaagacacctgttctgaagccttccaaagacagagccatgacaccgagatatttctcctgtttttaaaaagagaaaattctctatagtgaagcccagcatgttgatagctcagatgtcagacagactcaagtaacttcgccaactgggctacaatcttcaggcagcttgagggacttccaaagagggtgccaccctatgcggggcgtgagctcctggggaacagcgcctgtgtgcctcactgatatcttctcgcaagcaccaggcacagagcacctgcgcaggcatttactgaagaaatggatgaatgaatgatgggcaactcccatgccctcccccaacaatgatttcattctctgaaaacacggattctggttctgatcagcgttcctaacgtaggcttgctgagatttcagcgttcctaacagaggctcactgagagttcatcat

SEQ ID NO: 39614 - DNA, 601 bp, Human
ttaaatggctaacatgaccaattttatgttatatatattttactaccacaaaaaaactagctggcacctaaaaacattccattgaacaggccccttcagatctgtgtcttttcctgcatgcaaattacaccacagagcagcacctatggcagcgtggatcacaggctctgttttaggatagagaaaggacaacaaggtgtccccccattattccaggaaagacaagcacattacacctcaaagacaggtccactcacctgcaaacggcttcttctgtgtgagcacgccccagatgacgatsgcaaagctggaagagaaaccaggcacgttagcatctgacagccagagactcaaagccaaatgcactcatgcacagcaacaggcgtgaagacacctgttctgaagccttccaaagacagagccatgacaccgagatatttctcctgtttttaaaaagagaaaattctctatagtgaagcccagcatgttgatagctcagatgtcagacagactcaagtaacttcgccaactgggctacaatcttcaggcagcttgagggacttccaaagagggtgccaccctatgcggggcgtgagctcct

SEQ ID NO: 39615 - DNA, 601 bp, Human
cacgcgggtacatgtaatgctcctgaactgtatgcttcacacggctgacatgctaagttttgttctgtgtattttatgactatttttttaaaaagtaaacaaaaaagaattagctggaaataccagcacaggcaaacccctggagacagaaagcaggtgagtggttgctggggcttgagcaggaggaagggcgagggactgcagaatggccatgggctttgccttctagcatgatgagaatgttctggaattagacagtggtaacgcttgttcaacactgccagtgtagttaatgtcactsaattatacactttaaatggctaacatgaccaattttatgttatatatattttactaccacaaaaaaactagctggcacctaaaaacattccattgaacaggccccttcagatctgtgtcttttcctgcatgcaaattacaccacagagcagcacctatggcagcgtggatcacaggctctgttttaggatagagaaaggacaacaaggtgtccccccattattccaggaaagacaagcacattacacctcaaagacaggtccactcacctgcaaacggcttcttctgtgtgagcacgccc

SEQ ID NO: 39616 - DNA, 601 bp, Human
cttgaacagtaggacacgaataattcccatatgattagcgttccaataagggaacactaggcatattcagcaataaagcacaagggcttgagccttgacctgtcccctgcgcctagcttcgggtgtcacatctatcagacactgcctcatttcacaagccttcgggctgtaggccactgtgcgggagaacgtacagaaggcaagaaaggcgacaggcggtcagacaacacagacggacaccggccagcagaggcctggcaggacgcgttctgtgctttctactgacattcttttaaagctsccaagatacttgatcttgcgatgctggaagatctcttctcaccccagcactttcccatacatcggctcctagtctgagccccgactaacaaggggctaggccttgactctcatcttcatttttagacattttcggtcacaccacaaaatatcatgagtagcccagaaatgtctttagaggaaaagggaatctgtccaacaaagctaaaaagtcctggatttttatgataagtaagtcaaggtgtgacaactttgaggatggtgttcggaatggtggctgcctggctggggaagcaaacac

SEQ ID NO: 39617 - DNA, 601 bp, Human
catggtgcgccatgctctctagtttcctggttttgaaatcgacctctttccctgggttctgatctaccagaaggagtcagtgtgtttggtcacagagcagatctttctaggcatcccatccaaaggaagatgaggttcaaaggagaacaatatcttatgaggctcattccatcaacagcccaagccagcaaagggaatgaggctcacgcaccatggaggagccacagcgtcctacatccacagagacccaactctctctacaatggcgaagaagtcttcctcagttccaactccaatcccmagctcaggtccccagctggcctcccctgccggtgcaccagggctgggatgtgtggaagggctctttcccctcaattcaccatgtggggccgcacctgtcctttccaactgccttcactagcatgcatgggctctagcttattattattattgccacaacttctaccctgactgggaagggcccagggtgacatccagtgggccaagttcttttttctgcttagcctggaaccctcaaggttcttgttcccaacagccctctctgccctccagatccaaacacacccacgcatggaatggc

SEQ ID NO: 39618 - DNA, 601 bp, Human
agacggctcccccactccgtttcaaaggcagagcttcctgtaaccctcaccctcatggtgcgccatgctctctagtttcctggttttgaaatcgacctctttccctgggttctgatctaccagaaggagtcagtgtgtttggtcacagagcagatctttctaggcatcccatccaaaggaagatgaggttcaaaggagaacaatatcttatgaggctcattccatcaacagcccaagccagcaaagggaatgaggctcacgcaccatggaggagccacagcgtcctacatccacagagacycaactctctctacaatggcgaagaagtcttcctcagttccaactccaatcccaagctcaggtccccagctggcctcccctgccggtgcaccagggctgggatgtgtggaagggctctttcccctcaattcaccatgtggggccgcacctgtcctttccaactgccttcactagcatgcatgggctctagcttattattattattgccacaacttctaccctgactgggaagggcccagggtgacatccagtgggccaagttcttttttctgcttagcctggaaccctcaaggttcttgtt

SEQ ID NO: 39619 - DNA, 601 bp, Human
tgctcaccttggaaggtgggcctaactcgcggatccccctgccagcaccgctgcatgaggcgtatcaggtggctgcaggcgcgcggccgggctctgcacacgggcggcagctcggggcggtggcccttcaccaccttcaccatgatgtgcaggatgttcttctcatctgccaagggaaggatgcgagtcaggggctctgcagggctgggtggcagcatctcacccttgggaggaaacgacacactcgccgggggccacaatggggccatccccacaccaccccagggagacggctcccccmctccgtttcaaaggcagagcttcctgtaaccctcaccctcatggtgcgccatgctctctagtttcctggttttgaaatcgacctctttccctgggttctgatctaccagaaggagtcagtgtgtttggtcacagagcagatctttctaggcatcccatccaaaggaagatgaggttcaaaggagaacaatatcttatgaggctcattccatcaacagcccaagccagcaaagggaatgaggctcacgcaccatggaggagccacagcgtcctacatccacagagacccaactctctctac

SEQ ID NO: 39620 - DNA, 601 bp, Human
tcatcagagtgcagaccatttatgggcagctataaaggaactggatccccgagccaggggtgcaaagacactcagacaccagctctccctccccggccggggctgggccttctgatccccgtggtccacacacatccaatgagtggctatttagtgtcagggaagcccttccgccactcacgcagaatcagacaggaggtggggcggggatgcagtcgggcaggtggacctgagcccccatgggacctacacttctaatggagttgggtgcgggatgggctcagaagagagggagagtggyccgggcggcgggggactctgcaaagaggagtggtttggaaactcctgcctggaagccgaggagacaaaagacccctgtgggaaggactcgttacctcgctcctgggctccggggggcttttcacgtccagatcatgagcagtttctttcacttcgtcatcaggcttttcacacaggtcctcggtttcagaagtaatttcttgtggggaagaaaggggacatgtcactcggatgatgacttctgcgtacacacgcgttccatataaacgcagggcccccacgagctgggggatttctcaca

SEQ ID NO: 39621 - DNA, 601 bp, Human
cacagcgccgcggagctcagaccccgcgcccgcacagtgccgggcagctcagaccctgcacccgcacagcacttgggatgctcagactctgcacccgcacagcgccagggagctcaaagacttggagctacaaagacttgcgctggccccacccagcacggagacatcttaaggaaagatagccttcataaaagtgcaaaatccagcctcatgcagctctggataccatctgctcagtaacactgcacagagcgtcacccagacaaaaggcaggcggtgtcaagctgcagaatgtgaggcmtgtatggcgggacacagctgcccagcacaggccagcgttggcaggaaacgagaggacagacaggaactgggcaggacccccacacgtggccacaactgcgacctccccgcggagccacgtggggctggcctgggggctgtgtggggacgagggaaaggggaaggacccggctacagggacgaggggtgatccaatccgacatacaccgatggggccttttaaagagtctcgcttcatggactgcaggggcagcaggtttctggtgggtaagtggaatctgacgggatttcacgcttcttc

SEQ ID NO: 39622 - DNA, 601 bp, Human
gcggctgagctcctcggggccctcgacagcctgggaaactccagagtccagctgtgagagcagctcggagaggctgtagtcgttatcgaaggtgggggcagaggcccgcttgagcctcgcaggcaccacctgcgaagatgcagaagagggggtgggtgaagaccctgccatagcccgcatggcccgcccatgacacaaacacagaagagcaaggtgggccacgggagggagatgggggaggaaaggacggaccctggaagcaatgcagataacctattggtcaccgagctcagaccccgcrtcggcacagcactagggagctcagacgccatgtccacacagcgccgcggagctcagaccccgcgcccgcacagtgccgggcagctcagaccctgcacccgcacagcacttgggatgctcagactctgcacccgcacagcgccagggagctcaaagacttggagctacaaagacttgcgctggccccacccagcacggagacatcttaaggaaagatagccttcataaaagtgcaaaatccagcctcatgcagctctggataccatctgctcagtaacactgcacagagcgtcacccagac

SEQ ID NO: 39623 - DNA, 601 bp, Human
ttgctgggtcaagaaactgtccccttgattccgtttagcttctcactgagtccagtccactgtcccgccaagcccagcatctctcgggacacagaggcgtccccactcaccgctggttgaaggttcccgctcaaaggacagcgacagtgatcctctggaagagaaggcggagtccaccgaggacacccccgagagcctcttcccactgccggacgatggcagcttggactcagaggagctgcggctgagctcctcggggccctcgacagcctgggaaactccagagtccagctgtgagagmagctcggagaggctgtagtcgttatcgaaggtgggggcagaggcccgcttgagcctcgcaggcaccacctgcgaagatgcagaagagggggtgggtgaagaccctgccatagcccgcatggcccgcccatgacacaaacacagaagagcaaggtgggccacgggagggagatgggggaggaaaggacggaccctggaagcaatgcagataacctattggtcaccgagctcagaccccgcatcggcacagcactagggagctcagacgccatgtccacacagcgccgcggagctcagaccc

SEQ ID NO: 39624 - DNA, 601 bp, Human
cctggaagccttggcacctgccacccacggacgccccaggcctagcagcctgcagagatggtgactagagctggaaggggctgctccagctcttgccccacctcgaagtggcacctcctgacctggggaggttaagtcggaagttttctatgataatcctgaagggaccgagcttctcgtttcaggaggacgttagtccagcactcaggatgaaaagttgtatttaccacaaaaatcctaccgtagtgcctggaatgctgaaaccctgcaacgagactctcctccgccctcatgtgaaacrcgtggggacttggaagtcggcggtgggaaggtgttaagaaaacggaaccctcccagtcaggcttggtgtctgaacactggcactccaagtggagccagtgaagtaattctctctcgagcatgaagacaagatgtcatttcagagtattagacccaaagagaatgttctagaacgtacttatccatgggagatggtggtatttctttctgctcagtcttagactttgccctgactctcctcctcaagcccatcacccactgcttatctgccgtcgaaccaggtcttccccactgtgtctat

SEQ ID NO: 39625 - DNA, 601 bp, Human
aaaaagggcacagactaaaaagaccaggccagagctcccattcgcctggaagccttggcacctgccacccacggacgccccaggcctagcagcctgcagagatggtgactagagctggaaggggctgctccagctcttgccccacctcgaagtggcacctcctgacctggggaggttaagtcggaagttttctatgataatcctgaagggaccgagcttctcgtttcaggaggacgttagtccagcactcaggatgaaaagttgtatttaccacaaaaatcctaccgtagtgcctggaatkctgaaaccctgcaacgagactctcctccgccctcatgtgaaacgcgtggggacttggaagtcggcggtgggaaggtgttaagaaaacggaaccctcccagtcaggcttggtgtctgaacactggcactccaagtggagccagtgaagtaattctctctcgagcatgaagacaagatgtcatttcagagtattagacccaaagagaatgttctagaacgtacttatccatgggagatggtggtatttctttctgctcagtcttagactttgccctgactctcctcctcaagcccatcaccc

SEQ ID NO: 39626 - DNA, 601 bp, Human
cgatggcatccacaagcttcttcttctggacgtctgtggtgcccagatctgcagggagaggagaggcaaaggtcagagcgtggctgcacatccagggacgtggcgtctctgggagcctggctgtggcgctcaggtggaggagtgccatggcctccaggctgctcgctggtcacccgactgtgtttgagcgttgtctgtgcctcgtgattaaggtcagtcctagcgggagccccggggcaggctggcaaatgtctcccaggtgctcgttagtcggtttgcaaaataaaacccgctctccctrtcctgcggggtggtgagcccccttggtgcttagagatggcagtgactgcaaacatcccttcattaaagaaagaaggaaaaagggcacagactaaaaagaccaggccagagctcccattcgcctggaagccttggcacctgccacccacggacgccccaggcctagcagcctgcagagatggtgactagagctggaaggggctgctccagctcttgccccacctcgaagtggcacctcctgacctggggaggttaagtcggaagttttctatgataatcctgaagggaccgagcttctcgt

SEQ ID NO: 39627 - DNA, 601 bp, Human
ggtccacgtcctgcggctgcaggatcttcatcagtttgctggtgtccccggacacgatggcatccacaagcttcttcttctggacgtctgtggtgcccagatctgcagggagaggagaggcaaaggtcagagcgtggctgcacatccagggacgtggcgtctctgggagcctggctgtggcgctcaggtggaggagtgccatggcctccaggctgctcgctggtcacccgactgtgtttgagcgttgtctgtgcctcgtgattaaggtcagtcctagcgggagccccggggcaggctggcraatgtctcccaggtgctcgttagtcggtttgcaaaataaaacccgctctccctatcctgcggggtggtgagcccccttggtgcttagagatggcagtgactgcaaacatcccttcattaaagaaagaaggaaaaagggcacagactaaaaagaccaggccagagctcccattcgcctggaagccttggcacctgccacccacggacgccccaggcctagcagcctgcagagatggtgactagagctggaaggggctgctccagctcttgccccacctcgaagtggcacctcctgacctgg

SEQ ID NO: 39628 - DNA, 601 bp, Human
ctgcttggccagcagcttgacgatgggcaggtggccctgccaggcagcgtagtgcagtggcagccaggcatccttgccctgcaggctcacgtccacgcctcggcgcagcaggatgcgcacgatattctcctgcccgtgctggcaggccacgtgcatgggcgtccggccctcaaagtccacctcgttgaccgaggcgttcttctccaacagcagccgtgtgctagactcgtccccgttctgggctgcaaagtggagggctgtccactggtcctcatccttggcgttgacactgatcttccgygccagcaggagctccacgacaccccgcaccctcctctccacggccatgtgcaacggggtggagcccctacggttgctcaggttggggttggcattgttgagcagcagccacttggcgcactcctcttgcccggcctccaccgccaggtgcagcaggctggcaccgctgtccagtgccaggtccacgtcctgcggctgcaggatcttcatcagtttgctggtgtccccggacacgatggcatccacaagcttcttcttctggacgtctgtggtgcccagatctgcagggagaggagaggca

SEQ ID NO: 39629 - DNA, 601 bp, Human
cattaggagcacaacgaaatgattctgacccacggtcccttcagacagcaggtgcctagatcgatgatggagcgggcatgtgcacctgagccagcttcacctggaggggacactccggtcagcagcagccgcctcctgatggcaccatgtcacctctgcttggttaacatttaggtaagccacaacggggccccacgcaggatcgttccatccccacgaggaacacaggacaggacaagagccccacgtggacccccggtctccgcaggcagccagctaggtcttgcttcgccgcaggagygtggcggcggggccatggccgccctggaacttgaggctctgcaggttgatgtgggccccatgcctgagcagagtctccaccgtctgtgcgtgccggccctgggcggccaggtgcagcgcgctgagcccctgctcgtcgaacaggtcaatgacatcggcgctgaccaactcctccaccacctccgagtgcccgtgggcggcagccaggtgcagcgccgtctggttcaggggtccccgggccagcacatcggccttctcctcgacaagcagcttgacagtggccaggtgtccgttgcgggca

SEQ ID NO: 39630 - DNA, 601 bp, Human
ctggtgcactccagcgacctgagggggctcgcctcagtccccagcactgaggttacaaagggagaattttttaatgacttaggcctgtggctctagagttgccaaaacatcttaggcaacgagaaacgaacggcagctagtaccatgtgggcacgtgtgtgtggttgtccacaaggactcacccaagtaatagactggaatggttaagagctggccacacatacgccccgcaaagctggctgctaccattcgttccttgttgcataaaacattgttttcaaagccaaccccactacttagycatcatttagagactagactatccaatgttatgaacatttttaacaggtttcaagcaacagctgataaggtattcatctcttaagatattttataaaacaattccatggaaactttaagacaggcctctctgcccaccgtcatgtatgaagataaaaaacacagtttcccctgcacctccctcaagactggtgagctccagcaacccaaggtggctcgcctcaggagagagtggatgcttccacgcctggggcttcatcactgagagaccagcctcagcgacccattaggagcacaacga

SEQ ID NO: 39631 - DNA, 601 bp, Human
taccccaaaacactatccctatcccaaatcacctaacaaaaatgagagctgggaagggtgcaggtgagcagtgcatctacctaggtaatactgtctatgtctaggtaatactatgtaattttatcttcatactgcgtgtggagataaaaaacacagcttctcctgcacctcttccccaagactggtgcactccagcgacctgagggggctcgcctcagtccccagcactgaggttacaaagggagaattttttaatgacttaggcctgtggctctagagttgccaaaacatcttaggcaaygagaaacgaacggcagctagtaccatgtgggcacgtgtgtgtggttgtccacaaggactcacccaagtaatagactggaatggttaagagctggccacacatacgccccgcaaagctggctgctaccattcgttccttgttgcataaaacattgttttcaaagccaaccccactacttagtcatcatttagagactagactatccaatgttatgaacatttttaacaggtttcaagcaacagctgataaggtattcatctcttaagatattttataaaacaattccatggaaactttaag

SEQ ID NO: 39632 - DNA, 601 bp, Human; identical to SEQ ID NO: 18568

SEQ ID NO: 39633 - DNA, 601 bp, Human; identical to SEQ ID NO: 18569

SEQ ID NO: 39634 - DNA, 601 bp, Human; identical to SEQ ID NO: 18570

SEQ ID NO: 39635 - DNA, 601 bp, Human; identical to SEQ ID NO: 18571

SEQ ID NO: 39636 - DNA, 601 bp, Human; identical to SEQ ID NO: 18572

SEQ ID NO: 39637 - DNA, 601 bp, Human; identical to SEQ ID NO: 18573

SEQ ID NO: 39638 - DNA, 601 bp, Human; identical to SEQ ID NO: 18574

SEQ ID NO: 39639 - DNA, 601 bp, Human; identical to SEQ ID NO: 18575

SEQ ID NO: 39640 - DNA, 601 bp, Human; identical to SEQ ID NO: 18576

SEQ ID NO: 39641 - DNA, 601 bp, Human; identical to SEQ ID NO: 18577

SEQ ID NO: 39642 - DNA, 601 bp, Human; identical to SEQ ID NO: 18578

SEQ ID NO: 39643 - DNA, 601 bp, Human; identical to SEQ ID NO: 18579

SEQ ID NO: 39644 - DNA, 601 bp, Human; identical to SEQ ID NO: 18580

SEQ ID NO: 39645 - DNA, 601 bp, Human; identical to SEQ ID NO: 18581

SEQ ID NO: 39646 - DNA, 601 bp, Human; identical to SEQ ID NO: 18582

SEQ ID NO: 39647 - DNA, 601 bp, Human; identical to SEQ ID NO: 18583

SEQ ID NO: 39648 - DNA, 601 bp, Human; identical to SEQ ID NO: 18584

SEQ ID NO: 39649 - DNA, 601 bp, Human; identical to SEQ ID NO: 18585

SEQ ID NO: 39650 - DNA, 601 bp, Human; identical to SEQ ID NO: 18586

SEQ ID NO: 39651 - DNA, 601 bp, Human; identical to SEQ ID NO: 18587

SEQ ID NO: 39652 - DNA, 601 bp, Human; identical to SEQ ID NO: 18588

SEQ ID NO: 39653 - DNA, 601 bp, Human; identical to SEQ ID NO: 18589

SEQ ID NO: 39654 - DNA, 601 bp, Human; identical to SEQ ID NO: 18590

SEQ ID NO: 39655 - DNA, 601 bp, Human; identical to SEQ ID NO: 18591

SEQ ID NO: 39656 - DNA, 601 bp, Human; identical to SEQ ID NO: 18592

SEQ ID NO: 39657 - DNA, 601 bp, Human; identical to SEQ ID NO: 18593

SEQ ID NO: 39658 - DNA, 601 bp, Human; identical to SEQ ID NO: 18594

SEQ ID NO: 39659 - DNA, 601 bp, Human; identical to SEQ ID NO: 18595

SEQ ID NO: 39660 - DNA, 601 bp, Human; identical to SEQ ID NO: 18596

SEQ ID NO: 39661 - DNA, 601 bp, Human; identical to SEQ ID NO: 18597

SEQ ID NO: 39662 - DNA, 601 bp, Human; identical to SEQ ID NO: 18598

SEQ ID NO: 39663 - DNA, 601 bp, Human; identical to SEQ ID NO: 18599

SEQ ID NO: 39664 - DNA, 601 bp, Human; identical to SEQ ID NO: 18600

SEQ ID NO: 39665 - DNA, 601 bp, Human
caagctacttgggaggctgaggcaggagaatcgcttgaacccaagaggcagaggttgcagtgagccaagactgcaccactgccctctaagctaggcgacagagtgagaccctatctcaaaaaaccaaaccaaaacaaaacaaaaaactgggggccgagcgcggtggctcatgcctgtaatcccagcactttgggaggccgaggcaggtggatcacctgaggtcaggggttcgtgaccagcctgaccaacatggagaaaccccgtctctaataaaaatacaggattacatgcctgtaatcayagctacttgggaggctgaggcaggagaatcacttcaacccaggaggcagagattgtggtaagccgagatcacgccattgcactccagcctgggcagcaagagcgaaactctgtctcaaaaaaaaaaaaaaatccgatctaatgatacctgccaccctggtggtcccaagaacgaaaggaacatggaagtggaggtccttgggcactgagaggtttaggcagggggaggttttgctggtgcagcagccgacagcacccccagggaccaccggggaccccacacccacctcccgcatcaggg

SEQ ID NO: 39666 - DNA, 601 bp, Human
gaggtcaggggttcgtgaccagcctgaccaacatggagaaaccccgtctctaataaaaatacaggattacatgcctgtaatcatagctacttgggaggctgaggcaggagaatcacttcaacccaggaggcagagattgtggtaagccgagatcacgccattgcactccagcctgggcagcaagagcgaaactctgtctcaaaaaaaaaaaaaaatccgatctaatgatacctgccaccctggtggtcccaagaacgaaaggaacatggaagtggaggtccttgggcactgagaggtttasgcagggggaggttttgctggtgcagcagccgacagcacccccagggaccaccggggaccccacacccacctcccgcatcagggcccactctgtccctgggtgctctctgagtcacccgccgcttcttggctctctctccatctctcagtctgctggggtgcaggggtgtgggctccccaaggctcattgcccatgagccacatgggccctggaaaagtgacttcccagggacacagctactctctgaagagctttttccccaggtcccagcacccctacacttccctagggcttttttcc

SEQ ID NO: 39667 - DNA, 601 bp, Human
tttttccccaggtcccagcacccctacacttccctagggcttttttcctgcccaggcccctgcctttaattccctgggagaaatcctagacccctaagcccgactccactccttgtcagaaagggaaaccgaggcccagtgacgggtggggtggggcttacccggggtcacccagagggcagggacagaagcccagggctccagtgccttgggcctgagtgacagtcacagctgcccttctgtaaatagcagtgtctgctgccctcggagaaggggaaggagcagctggtgcccgcccccrccccactccaccgcttagtcccagcagagcccactaattttgctgctggcagagggcagcgttcctgcagggtcactgggcccttcccctcctttgtgtcatgcaaaggtgggggcatttgtgggtattcaggagtcattcccatgggagggcagctcctaccatgctaagaacttggttgagtttcccaaatgtgtctggtcccaggagacaggctcccagggtgagtgagccccctgggatgccctgaatgatacccccactgcctctgcacccacccacggtccagatctcttgcct

SEQ ID NO: 39668 - DNA, 601 bp, Human
ctacaggcactcatgccaccacactcggctaagttttttggtctctttttgtttcgtttttttttctgtgaaacggagtttcattcttgtcgcccaggctggagtgcaatggcgcaatctcagctcaccgcaacctccgcctcctgggttcaagcgattctcctgcctcagcctcccagatagctgggactacaggcatgcaccaccacgcctggctaattttgtatattttttagtagagatggggtttctccatgttggtcaggctggtctcaaactcccgacttcaggtgatccgcccgcctcggcctcccaaagtgctgggattacaggcgtgagccaccgcacccagcccattttttggtctcgagtaaagataaggtcttgctatgctgtccaggctgtccttgaactactggactcaggccatcctcctgcctcggactcccaaagtgctaggattacaggcatgagccaccatgcctagccaggaaaaatttctttcttgtttcaaagaaatgccttcctcagcttccccctctgtgaaatggggattgggatacctctgtaccagggtggctgtggcagtctatttgagggc

SEQ ID NO: 39669 - DNA, 601 bp, Human
ctgggttcaagcgattctcctgcctcagcctcccagatagctgggactacaggcatgcaccaccacgcctggctaattttgtatattttttagtagagatggggtttctccatgttggtcaggctggtctcaaactcccgacttcaggtgatccgcccgcctcggcctcccaaagtgctgggattacaggcgtgagccaccgcacccagcccattttttggtctcgagtaaagataaggtcttgctatgctgtccaggctgtccttgaactactggactcaggccatcctcctgcctcggmctcccaaagtgctaggattacaggcatgagccaccatgcctagccaggaaaaatttctttcttgtttcaaagaaatgccttcctcagcttccccctctgtgaaatggggattgggatacctctgtaccagggtggctgtggcagtctatttgagggccactctaacacctggcagcggggaggggatggaaagggtgtcgggaaatgctggggccactcactatccttcttctggcccccaggcctccaggcccaaggtcagcatcccactgtcagccatcattgaggtccgcaccacca

SEQ ID NO: 39670 - DNA, 601 bp, Human
gcctaaggcaggacagtagtgggagggagccctggtgtggggggttcccagaccctatgacagatgcctagcacatagctaagacttgagtctgggctccacagccaggtgcctcgggcgtcgcccaacatctgggccccttgctcccatttacccctgggcctgggcgaagctcatcagtttcacttcctgccctcccttcccccactggagctagcacacacccacctcgctggtggccagccggcagcagttatgcaaatgttcctgtcccagggcactggagtgtgggaactgggcrgtctcccacagagggcacaaaggcatcaagggggggcggggaggcaccccggtgggtctaggggcagcccagcctttcccaggccccacaccgctgccagggtggcctgcaggggtttctgaggacacggctccaggctgccagagctgtggtccctgggcatccgcaaaggatcagagggtgttggtgaagcaatgtccccggggaggcctggtcccacccactcatcctgcatgaagcccccaccctcttctcccagcttctggttgtgtttgtgtttctgcccgttctcatttgttt

SEQ ID NO: 39671 - DNA, 601 bp, Human
ctcggctcactacaacctcctcctcccgggctcaggtgatccttccatctcagcctcttgagtagctgggaccaaaggcacacgccaccatgcttggctaatttctgtatttttggtagagacagcgtttcaccatgttgcccaggctggtctcgaactcctgagctcaggagatctgccctcctcagcctctcaaagtgctgggattacaggcgtgagccaccgcgcccggcccagcaactgcattttgacagaggcacaccaccggaagccaacagcacgggacctgggtgtcccagaracctgggttcaggccctggccctgccactggctgctgtgtgactttgaccaagttccttggcctccctgaaccttggtcttctcatctataaaatgggggaaatggctcctctccctcacagggccgttgggaggagttgagcagaatgcagggttatgctctgggcctggccccagcagggatgtctcctgccctcttccccttcagaggcttcgtatctcaagcgcatggccatgccggtagaactccaggcactaagacatgcaagcccccctactcagtgtgcttggccagcctgt

SEQ ID NO: 39672 - DNA, 601 bp, Human
gcgggcagatcaccagtttgagaccagcgtggccaacgtggtgaaaccccatctctgcaaaaaatacaaaaaaaaaaaaaaaattagctgggcatggtggcgcatgcttgtgatcccagctactcaggaggctgaggcaggggaatcacttgaacccgggaggcagaagttgcggtgagctgagatcgtgccactgcactccagcctgggtgacagagcaagactcccatctcaaaacaaacaaacaaacaaaaaagatgggggtctcgctatgttgcccgagctgatctcaaactcctgrcctcaagtgatcctcccacctcagcctcccagaatgctaggattacaaacatgagccactgtgcctggctggataatttctttatgacaagtttttacatagaatatttttaggttggccgggcgcagtggctcacgcctgtaatcccagcatttttggaggacgaggcaggcagatcacgaggtcagtttgagaccagcctggccaacacagtgaaacctcatctctactaaaaatacaaaaaaattagccgggcatggtggcagatgcctgtaatcccagctactcaggaggctgagg

SEQ ID NO: 39673 - DNA, 601 bp, Human
ccctatctcaaaaaataaataaataaataaaattatttggctgggcgcagtggctcacacctgtaatcccagcactttgggaggccaagacgggcggattgcctgagctcaggagttaagaccggcctgagcaacatggtgaaaccctgtctctactaaaaatacaaaaattagcctggtatagtggtgcatgactgtaatcccagatacttgggaggctgaggcaggagaatcactagaacctgcaagacggaggttgcagtgagtcgagatcacgccactgcattccagcctgggcaasagagcaagactctgtctcaaacaaaaaaatattcaggccaggtgcagtggctcacacctgtaatcccagcactttgggaggccaaggcaggaggatcacttgagcctaggagtttgagaccagcctggggaacacagcaagactccatctctaaaaaataaaaaataaggctgggcgcaatggcttacacctataatcgcagcactttgggaggccgaggtgggtggatcatctgaggtcaggagtttgagaccagcctgaccaacacagtgaaaccccatctctactaaaaatacaaaa

SEQ ID NO: 39674 - DNA, 601 bp, Human
gactctgtctcaaacaaaaaaatattcaggccaggtgcagtggctcacacctgtaatcccagcactttgggaggccaaggcaggaggatcacttgagcctaggagtttgagaccagcctggggaacacagcaagactccatctctaaaaaataaaaaataaggctgggcgcaatggcttacacctataatcgcagcactttgggaggccgaggtgggtggatcatctgaggtcaggagtttgagaccagcctgaccaacacagtgaaaccccatctctactaaaaatacaaaaattagttrggtgtggtggtgggcgcctgtaatcccagctactcgggaggctgaggcaggagaatcgcttgaacccggaaggcagaggttacagtcagccaccgggattgcagcattgcactccagcctgggcgacaagagcgaaacttcgtctcaaaaaaaaaataaaaactaaaaaccaaccaactttttaaacattattccaacagcattttgcatgtaaaaaaaccaacaagacgtcacctctcttctcacatttatttatttgtccccctttctccttccccccatgttcctcacactgtcatc

SEQ ID NO: 39675 - DNA, 601 bp, Human
gcttacacctataatcgcagcactttgggaggccgaggtgggtggatcatctgaggtcaggagtttgagaccagcctgaccaacacagtgaaaccccatctctactaaaaatacaaaaattagttgggtgtggtggtgggcgcctgtaatcccagctactcgggaggctgaggcaggagaatcgcttgaacccggaaggcagaggttacagtcagccaccgggattgcagcattgcactccagcctgggcgacaagagcgaaacttcgtctcaaaaaaaaaataaaaactaaaaaccaacmaactttttaaacattattccaacagcattttgcatgtaaaaaaaccaacaagacgtcacctctcttctcacatttatttatttgtccccctttctccttccccccatgttcctcacactgtcatccccacctcaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggc

SEQ ID NO: 39676 - DNA, 601 bp, Human
taaaaactaaaaaccaaccaactttttaaacattattccaacagcattttgcatgtaaaaaaaccaacaagacgtcacctctcttctcacatttatttatttgtccccctttctccttccccccatgttcctcacactgtcatccccacctcaggggaacagggtgcagagacggatcccgaggctgaacccgagctggagctatccgactacccatggttccacgggacactgtcccgggtcaaggctgctcaactggttctggcaggggggccccggaaccacggcctcttcgtgatcygccaaagtgagactcggcctggggagtacgtgctgaccttcaacttccagggcaaggccaaggcaagtgtgtggggggcgccatgggggtgcagtggccagccctgagggagaggggtcatggtgaccccggtcctgaggctgtgccctggaagcagctgcaggcgaacaggtgtggcatgacttcccacgggccccactcaccccagccatgctccgtgagccacctgcgtccctcctacacatcactgagggactgcagtcagccctatttcagcctctgcattctccagaaggggag

SEQ ID NO: 39677 - DNA, 601 bp, Human
aaggaaaatttgacagcaaaggcaaatgattatgggggggtgcaatgtggccagagggggcaggaacctcagtgcccacccccgcatcccaggtttccgataaggaaacactcagcctgggctcctgccaggacggatttcctggcggcccctactagaggagggagaaccttaggactcctgctccaggcctgcagctgggggacagtgtctctctgcagggaccccggctgccctaacccctagtggctcagtgcagaacctctggtggcttctctcctcctccaggttggccccaccrtgcaggaggtagcacctccaccagggacatttccttggcaagcagccacccttacagttcctccgacaaccaggtgcttaaggccatccctggtgacgtgcaatttacttctcagccagtgctgctccaggcagcctcccagagggcctggatctgactcatgcccaagccagaggctaggatgggggaacaaagggtgggtggcaagctcctctccttcctggaacaagacccagccttgaacctgcctctcacctctctacccagctgctcttctcccagagtggagatgactgcccc

SEQ ID NO: 39678 - DNA, 601 bp, Human
gcggcccctactagaggagggagaaccttaggactcctgctccaggcctgcagctgggggacagtgtctctctgcagggaccccggctgccctaacccctagtggctcagtgcagaacctctggtggcttctctcctcctccaggttggccccaccgtgcaggaggtagcacctccaccagggacatttccttggcaagcagccacccttacagttcctccgacaaccaggtgcttaaggccatccctggtgacgtgcaatttacttctcagccagtgctgctccaggcagcctcccagarggcctggatctgactcatgcccaagccagaggctaggatgggggaacaaagggtgggtggcaagctcctctccttcctggaacaagacccagccttgaacctgcctctcacctctctacccagctgctcttctcccagagtggagatgactgccccaggcctgataagtaaatggtgggacaaagcaggaaccccagcctccagcttacatacctcctgggagggaagatcactaccttcccagaggcaactctttccaccttcacagaataaatgtctggaaggtctggcagaagattg

SEQ ID NO: 39679 - DNA, 601 bp, Human
agtaccttgagaataaaggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccargatgcagcctgagggagcagaaaagggaaaaagcttcaagcagagactggtcttgaagagcagcttagcgaaagaaaccctctctgagttcttgggcacgttcatcttgattgtaagtatttcctgatttcctacattcagacccaataatgcctccctagctgccaggctggtagtggagagttttgtttggtttgttttatttaagttaattgggatcagattcatcttttccaggaagaaacaagttactagaggctgtttgactatttaggggttgtgatattaagttttcaatta

SEQ ID NO: 39680 - DNA, 601 bp, Human
tggcttggaaaggcagtccttatctttctatctctatttggaatctagcacagttcaggctccctaaggactggtggctttgggaacattttgggaacatgcagcacaacacactggcccatcatgacatctgtgtggacaacagcatcagtatcagctttggcaggtgcaggaataggggaagattgtgtgtgggaggtgactttctcatcgtggctgcagctaacatactggtttgtgggcacatactggcttgtaaggtctgcttgaagattccaaaagtaaccaatttatactgagmataaatgtgaatgggatcctattttgtggtcaccgactagtgaggtcagcagatatttgtcttttaaatataaaacatcaccttattgtaaagaagttacagcatcctgctcccctgggaatgttccagtcaaatccagtcagtcagaggtcataataccctaattatgtagcatcctgcacaaagcatttaggctgtctaatggcaattgctattgatgtagtattttatgactaaaataaacttattgaaaaagcaaatagacttgctttcattacaaaatatagggttatcttgatc

SEQ ID NO: 39681 - DNA, 601 bp, Human
ggatttgaaaggaaaacacaacagttgaagtgtttataaggctttaggaaatcatctgtgcttcaatacactggcattttcttgctcattgtagccactgagtggcaggggcaggtgaagaaaggactcttgtggcttagccagcagccagaatcccccacccactgcaagtccattttgccctggagacttggaaaaagcatagctttctccacagggagtggtagaggcttctggaaacaagtgcacctattggttctgtgcaggatcatcatcatcatcatcatcatcatcatcatctccaccatcatccctcctttgtttacgactaaggccacagcctgaaagtccacatctcaatgtggtgtctctgattccccctccacaaaaaatgtcatctgtattcctcaaatgaacatctgttttcactaggaagtgagcctatatgctcagacaatttttttaaattctttatttatttttctgcccacaaaagcagagaagcctttataaacacggtgaagatgggctggaagtggtatagcagaaaacataggctctagaattcagataaacctgaatctgaatcctggttcttcca

SEQ ID NO: 39682 - DNA, 601 bp, Human
gcttcaatacactggcattttcttgctcattgtagccactgagtggcaggggcaggtgaagaaaggactcttgtggcttagccagcagccagaatcccccacccactgcaagtccattttgccctggagacttggaaaaagcatagctttctccacagggagtggtagaggcttctggaaacaagtgcacctattggttctgtgcaggatcatcatcatcatcatcatcatcatcatcatcaccaccatcatccctcctttgtttacgactaaggccacagcctgaaagtccacatctcartgtggtgtctctgattccccctccacaaaaaatgtcatctgtattcctcaaatgaacatctgttttcactaggaagtgagcctatatgctcagacaatttttttaaattctttatttatttttctgcccacaaaagcagagaagcctttataaacacggtgaagatgggctggaagtggtatagcagaaaacataggctctagaattcagataaacctgaatctgaatcctggttcttccatttactgaccatgtagccttaagaaacttactttccgtccatgcctcagttttctcatc

SEQ ID NO: 39683 - DNA, 601 bp, Human
aaacttactttccgtccatgcctcagttttctcatccgttaactggagtagtactcatctcattgggttcttaagaggatcaaatccacctactaaccctacaatggtgtctggtaagtatttgataaatgctgctgttgttgttactagcaaagccagctggggatgttagagaccaaccacagagccaactctctatttgattttatggctggatgcaagtcaaggaagccgatttctctagctggagcttgggctgggctcaggaaagggttgctacatttctgtataggagagaaawgcattgtttatgcagaggaactgagaacaagccactcacactgtgaccacctcaaaatcaactatgcccccaccctcagcaacccacagtcattttcctttaaagatacatctcttttgagctagtttttatatcctctgggcatggccggaggaactgctagatatagatttaaatcttatacatatattggataagcatattgacttttaaaagatatcgaagttaatagctacatcagtctgtttggggtgattgctttatagatagagggattcaagcctattaaaaaaacagcca

SEQ ID NO: 39684 - DNA, 601 bp, Human
gtcatggaagcccagaggagggagcttttactctgcaagagagagttggagaaggcattccagagaagagtgctcttgggggaacatgtgtcttttaatattaattaaaaattattttaacattattattttggaaagcagatgaaatgataatgaacttaaactttaaaatcagttgcctggttcccatcctgattcttctgcttacaagtttgacattggacaagtgtcttaaccttgttttactcgagttttcttatctataaactgagaataatagcaggatttacctcacagcatyactgtgaagatttaatgagataaagcatatgaagtacctggcacataataaatgttcaataaataatagctatcatttaactgttaaagtaaaacagtagtttggaaaactaataacatagaaaccagctataattggccaattcaaatacctattatcatttttgtttattgtcttaaaatttttcttttacgtatgtttttaagtagagtcaaccctacatatccatgaattctgcatccatggattcaaccaaccatggatcaaaaatatttttaaattgcatttgtattggacacg

SEQ ID NO: 39685 - DNA, 601 bp, Human
tgaacctgatacaacatgtccaatctgataaaagaaaaagcatccagccagtgaagaggacatgtaccctggctgatatcttggaccttcatctgctaaatgacaggaagaaatttgccataaaaggaaatgatggacccaacaggtagcttatactcccttcatgttttgacctctagagaagacttcaagtctttacagccaaacgggagaggcagccaccctccatgtgcctcccctagaaaaatccatctggatttggggcctggggaagggcactgtgagggcggccgagtacagyatcctcgctgccgtgtggtaagagtgacatctggtggctgccatgctcaggctcagtgctcttccatcaaccctgcaagggcaatggaggacttcggagaccacttaggtgccccaggtggaagggaccatgcagatgaaggaaatggagctcacgatggggaatgggggtttgatttgctcaaagaccttctagataatcttgagattagacttagtctcctggattctaggacagggttcttgtgtcctgcttatttcctttatcgttcttttctaatcaaagtttgagatatacaaa

SEQ ID NO: 39686 - DNA, 601 bp, Human
attcattgaaaaacatttcctgattgattagtttgattgtcctcatacactaatgatgcccaggaatctctccacattctgcttgtaatccacaggaatcattatttcaggatgagggaaaggcaattctgaataattgacctgaactttcttaggggccctcaatcttaacgatgggctcaggcactatattttataaaaagaaaataaataagacataatatctcacaaatattagtaggacaattaaatagatcatctgaaatcaggtgtagtggaaagtcaaggatggcagttgccwtgctgcactgagccccccttatacttagctcttgctgagttaagagggaaccatgagtgtgagaaagactaacaagtgagtgaaaaaactagacagtaataccaggaggaaggccaagaaatgtatcactaatttcttgtttgatttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaa

SEQ ID NO: 39687 - DNA, 601 bp, Human
tgtgcagttccttttctttgactctgacatttgatggcatcagagctatcactgctatgtcggtagtaagcaggggaggaagtcactacaattctgtgaacccataaaacagaggagactcccaatatccaaagataatcatactagaaaatcctggtaaaatcaagtgcatttaaaatggagagcaaaaggccatagtaaataattttgtaaagtttgattcagacttactcttaaaagataaaactggaaattataaaaataggcttatatgatttaataaaatgtaagttataactgkattcatatatgttctcagaatgaacaaagactaaaccaagtgttatttttcccaacaaaatgatatatgttgacattcttcactttttaattttcatagcataagcaaaaaagaccatcttttggaagaagtatttgccatccaaagatctcacttatctttttgtcttcatttaatctatgtattttcaaatcattcttatatgaaaccgctaacaggaaatcatcctaacttttcacatgcttcctagcctaatactgccagagtgtgccatgtacccacagctcagctgtgcaccca

SEQ ID NO: 39688 - DNA, 601 bp, Human
ctggtaattccgagcacaactgtaagtaacagggaatttcacatgttcttctgccttactgcatcataggtgtggaatgcgtataaattgaaattagaactaattaggattttatttcaactgcagtttctcccaaacattgccgagccagtttaaaaccatggctactctaaccattaatagtcaataatggatgtgatgtttgaaaggaggaggttgattaggttgattttttcctcccttgagaaaataataaaagaaatgaaaatggattaaagagttttcccactatctcagagcytaaaactacctagccacatttcagtaaaatattattggggtattttgaaaaacatccgtttaaaagcatgatgcttctattgtagtaagctggtctgtgtctctctcaaagtaccatacttgttgctattcaattttacatcattcctttctggaaaagcattattactccaagagaactctcctagggaatcagaataattggcatagatcatgtaacagggatctagaattaatttagagcaaatatacaagaaccatgcagttggaagcactgtgcagttccttttctttgactctg

SEQ ID NO: 39689 - DNA, 601 bp, Human
atgcaaatctgcagacttataattttgtagatagtactgaggcatgctgtctaatacacatcaaaatgaaataataagtattcctatgacttcatttggaaaagggcttaaatttcatccatgaaatttttctactcattctagttttctatggccagcctttgcacatcataaagtgctgtttttaactaagatgttaagggtatggtgaaagatttgcattgattcatatacgttactaattttcatgaaggtcagttagattagaggtgcaatataaggtcacagaggctcaatctgraccataaccaaagtcccatacttgtactgtctaactttgtcaggatccgactttcccaccatagggaatatcagagtacccagaaagaccaaggaggcactggctaacctaaagggtcttacctttgcaaacgccactagaaaaatctgttcactaaaaatactttggtagttaaaatattattggaaacagactttgcttctttataaattcagttggtattttatattataaagacagagaaggagagaagagtgggggatgtcatttgactgtgcagtttgagattttttcaatagc

SEQ ID NO: 39690 - DNA, 601 bp, Human
tcacccctattttctttcagagaattacctattccccattatgcaggtaggacttgtcctggatggactgagacagagaagcttgcccttcattaattacagggtagacacacatgcaggctatcttctgttttctcttttaggtccacccttgattctccctctccagtcttgattgacctgtaggaaccaggtcaaagggtaatcctactctctttcttctcactctgttctcccactctccaccccagctattgggtttccaaagctttctgaaagattctttagctttctattctcygtgttccttaactaattccaataaattccctcttgtgcttaagttagtttctctccctgtaattcaagtaacaccccaaaattacaaattttatgtctcaagaaatggtcaagacatgagaacacatacataaccatttagttatgattctagagagaaaattagaagtgttctttggaaagagcgaataaaaatattgccatcactccctagctcaaagaggttgaggcatcattaactcaatgtgttgtcattagacaacctagagccataactgtttgctgtgaaatggcacatgga

SEQ ID NO: 39691 - DNA, 601 bp, Human
attgataaaatgtttttggtgagtgtttcatggtggaaatttcaattttacagtggtcatttgtagtgcatgggtgtttgttttattttgctttagttttggtcaccagtgcccacacacccatttccccttcaggacaatgtcacccctattttctttcagagaattacctattccccattatgcaggtaggacttgtcctggatggactgagacagagaagcttgcccttcattaattacagggtagacacacatgcaggctatcttctgttttctcttttaggtccacccttgattcyccctctccagtcttgattgacctgtaggaaccaggtcaaagggtaatcctactctctttcttctcactctgttctcccactctccaccccagctattgggtttccaaagctttctgaaagattctttagctttctattctctgtgttccttaactaattccaataaattccctcttgtgcttaagttagtttctctccctgtaattcaagtaacaccccaaaattacaaattttatgtctcaagaaatggtcaagacatgagaacacatacataaccatttagttatgattctagagaga

SEQ ID NO: 39692 - DNA, 601 bp, Human
agtctcataagatctgatggttttataaatgggagtttccctgcacaagctctcttgcctgccaccatgtaaaatgtgactttgctccttatttgccttccaccatgattgtgaggccttctcagccatgtggaactatgagtcaattaaacttctttcctttataaattacccagtcttgggtatgtctttattagcagcatcagaacaagctaatacagatagggtcttgctcttattgcccagcctggtgtgtagtcgtgtgattatagctcactgcagccttaacatgggctcaagygattctccacccttagcttcctgagtagctaggactatgggcatgcactaccacatctggcttttttatttgtatttttgtggagatagggtctcactatgttgctgaggctagtctcaaattctggcctcaagtgatcctccttctttggcctcccaaagtgctaagatcacaggcatgaacactgtgcttggccttcttatgctatttctgctatctatattgataaaatgtttttggtgagtgtttcatggtggaaatttcaattttacagtggtcatttgtagtgcatgggtgttt

SEQ ID NO: 39693 - DNA, 601 bp, Human
gcctattctggatattctatataaacagaatcatatgatatctgtccttgaatggtctgatactatttctttaattttcttaagagatagtgatatgatttggctgtgtccccacccaaatctcaccttgacttgtaataatccccaggtatcaagggcggggccaggtggagataattgaatcatggggggggtttcccccacactgttcttgtggtagtgaataagtctcataagatctgatggttttataaatgggagtttccctgcacaagctctcttgcctgccaccatgtaaaaygtgactttgctccttatttgccttccaccatgattgtgaggccttctcagccatgtggaactatgagtcaattaaacttctttcctttataaattacccagtcttgggtatgtctttattagcagcatcagaacaagctaatacagatagggtcttgctcttattgcccagcctggtgtgtagtcgtgtgattatagctcactgcagccttaacatgggctcaagcgattctccacccttagcttcctgagtagctaggactatgggcatgcactaccacatctggcttttttatttgta

SEQ ID NO: 39694 - DNA, 601 bp, Human
ttcttgtttgtttttttttgttgagacagagtctcactctgtcgcccaagctggagtgcagttgtgagatctcagctcactgcaacctccacctaacaggtccaagagattctcctgcctcagcctcccaagtagctgggactacaggcatgtgccacctcgcccggctaatttttgtatttttagcagaggtggggtttcaacatgttggccaggatggccttgatctcctgacctcatgttccatctgcctcagcctcccaaagtgttgggattacaggcatgagccaccacacccacwttttttttttaattccaaaataagtgtttttctttcagacatgaatatcaacaagatatttatgtcaagacaagtaatgtcagttcgttctcaatgttggggtggaggtctgctgtggcccaagattgcctaagaaacactagtctatccacacatctctggctctagtgagtgtccactgttctcacagtttccttccagaaccaaccatttcaggatccatgaagaaagcccagactcaggcactgggttttaaggtaatgctttcttacagaccgggagtttctcaagagttattct

SEQ ID NO: 39695 - DNA, 601 bp, Human
gttcttgtttgtttttttttgttgagacagagtctcactctgtcgcccaagctggagtgcagttgtgagatctcagctcactgcaacctccacctaacaggtccaagagattctcctgcctcagcctcccaagtagctgggactacaggcatgtgccacctcgcccggctaatttttgtatttttagcagaggtggggtttcaacatgttggccaggatggccttgatctcctgacctcatgttccatctgcctcagcctcccaaagtgttgggattacaggcatgagccaccacacccacattttttttttaattccaaaataagtgtttttctttcagacatgaatatcaacaagatatttatgtcaagacaagtaatgtcagttcgttctcaatgttggggtggaggtctgctgtggcccaagattgcctaagaaacactagtctatccacacatctctggctctagtgagtgtccactgttctcacagtttccttccagaaccaaccatttcaggatccatgaagaaagcccagactcaggcactgggttttaaggtaatgctttcttacagaccgggagtttctcaagagttattc

SEQ ID NO: 39696 - DNA, 601 bp, Human
tgtatatatattttttctctagaataatgtatttcatatctatgaaatactatactattttaaaatcttattgcaagatataagcatcaaacaattttcaaactataattcttttattattattattttgagacagggtctcgctccattgctctgtatcaaaataataataataataaacaaatggagtgccggggtatcgtcacagctcactgcagccttaatctcctgggctcaaacgatccttctgcctcagcttcccaagtagctggggctacaggcatgcaccgccacacctggmtaatttatttttattttttatagagactgggtctccctgtgtcacccagcatgggcttgaactcctgagctcaagccatctgcctgccttggcctctcaaagtgcttgattataggtgtgagccactgcaccgagccagtaaattctttttgaatatacttttcagaatgcagttctatttaactgaatgttccagaaattttactgtatacattacgcaatttcaaagaataaaagtaaatatattctaaactacaatgttaccaaatattcaaccttttgtgattcaaaaagtttagg

SEQ ID NO: 39697 - DNA, 601 bp, Human
atgcacatatatttagtttgtatgtgtctgtgtgcctctctgaaatgtgcatcaactctcaaagaatttggattcaagcaaattaatatgcatattacatcttttcctactaaaaaaatgttgtatatatattttttctctagaataatgtatttcatatctatgaaatactatactattttaaaatcttattgcaagatataagcatcaaacaattttcaaactataattcttttattattattattttgagacagggtctcgctccattgctctgtatcaaaataataataataataamcaaatggagtgccggggtatcgtcacagctcactgcagccttaatctcctgggctcaaacgatccttctgcctcagcttcccaagtagctggggctacaggcatgcaccgccacacctggctaatttatttttattttttatagagactgggtctccctgtgtcacccagcatgggcttgaactcctgagctcaagccatctgcctgccttggcctctcaaagtgcttgattataggtgtgagccactgcaccgagccagtaaattctttttgaatatacttttcagaatgcagttctat

SEQ ID NO: 39698 - DNA, 601 bp, Human
atacgttaaatattaaaataatagcataattatagcatagaatcgggcatttaagagtagaaagagtatctatgcaacagaagatttgtaaaaattaaaagtagacttatagtaatgtatttcataaaacttatgaacccacacattaatataaaacttcaattgaaatactagtaggacaaattcacaactccaggttttcaaaatgccctataaatacgtgaactcacccacaggaaaaaaacagtatcttacctctgtggctaggctctggcttgcaccattgtcaagaagaaacttsacaacttccaggtgattttcctgggctgccatatacaatggcgtgaaaccattctgcaaaataagaaaaaaaatgtttgtctgcagctttccagagacaatctatttttccatggtactgatgatttatgctccaagaagtgctcacatacaataactttaataatactttcatatagatataaatatttattagaaaacccaagcaccatggcttaagctaaattcctgatctgtgtaattcaaaattatatttcataattcataatttgagtatagctcatagttaatagttcatagt

SEQ ID NO: 39699 - DNA, 601 bp, Human
cacacttgtaatcccagcactttgagaggccgaggcgggtggatcacgcggtcaggagttcaagaccagcctggccaagatggtgaaaccctgtctctactaaaagcacaaaatttagccatgtgtgggtggtgggcacctgtaatcccagctactcgggaggctgaggcaggataattgcttgaacccgggaggcggaggttgcagtgagctgagattacgcctttgcactccagcctaggtgacagagtgagactccatcccccctcccccccccaaaaaaaagtaccatagttttatytataactatgaattaagtctagttaacttaaaaaatacaaattcaatcattataattaggtaaacttaaatttggaaaaacaatttaaaactaatgttttattgaaaagatagttcacatcaattactccaaaacaatgattgcctttgcctataagccaaaattgtaagagacagaaaagaattctcaagcaaatacgttaaatattaaaataatagcataattatagcatagaatcgggcatttaagagtagaaagagtatctatgcaacagaagatttgtaaaaattaaaagtagac

SEQ ID NO: 39700 - DNA, 601 bp, Human
atgtgtaatagttttggctgggcgtggtggctcacacttgtaatcccagcactttgagaggccgaggcgggtggatcacgcggtcaggagttcaagaccagcctggccaagatggtgaaaccctgtctctactaaaagcacaaaatttagccatgtgtgggtggtgggcacctgtaatcccagctactcgggaggctgaggcaggataattgcttgaacccgggaggcggaggttgcagtgagctgagattacgcctttgcactccagcctaggtgacagagtgagactccatcccccctcccccccccaaaaaaaagtaccatagttttatttataactatgaattaagtctagttaacttaaaaaatacaaattcaatcattataattaggtaaacttaaatttggaaaaacaatttaaaactaatgttttattgaaaagatagttcacatcaattactccaaaacaatgattgcctttgcctataagccaaaattgtaagagacagaaaagaattctcaagcaaatacgttaaatattaaaataatagcataattatagcatagaatcgggcatttaagagtagaaagagtatctatg

SEQ ID NO: 39701 - DNA, 601 bp, Human
tctctacctcctgaggggctgggactaccggtgtgtgcccttgcacccggctaaatgtttgttattttgatatcaaccagtggttatttcctaactagctttaagaatactattacaaaaatagtacattctcatgataaaaattccccaaagcactgatgggtataaaataaaaaaatatgtataaaaattcccaacagtactgatgggtacaaaggctccctccgaattctcagggcaaaccactggtaacaatctactatggacattttcctatatcagtacatagagccttgcctcrtttttaacagtgctaacagcgtgttattgtataaatatatgaacatttactaacaggtttcttttttctttccaagccaaatagttctgaataaacaggattcttattggtgtaaatttagattctgatttttaaaaattgctattattaattgtgttgacaaacatcctttatactatttttgcatcctaatgcaaacatatctataatatatatttgatatatctaatatttctataatataactttttagaagtgcagctgctaagtaaaaaggcttgtaaatactagtttttgata

SEQ ID NO: 39702 - DNA, 601 bp, Human
tgtatcctcaaacttctaggctcaagtgcctcctgtctctacctcctgaggggctgggactaccggtgtgtgcccttgcacccggctaaatgtttgttattttgatatcaaccagtggttatttcctaactagctttaagaatactattacaaaaatagtacattctcatgataaaaattccccaaagcactgatgggtataaaataaaaaaatatgtataaaaattcccaacagtactgatgggtacaaaggctccctccgaattctcagggcaaaccactggtaacaatctactatggmcattttcctatatcagtacatagagccttgcctcgtttttaacagtgctaacagcgtgttattgtataaatatatgaacatttactaacaggtttcttttttctttccaagccaaatagttctgaataaacaggattcttattggtgtaaatttagattctgatttttaaaaattgctattattaattgtgttgacaaacatcctttatactatttttgcatcctaatgcaaacatatctataatatatatttgatatatctaatatttctataatataactttttagaagtgcagctgc

SEQ ID NO: 39703 - DNA, 601 bp, Human
atgaggatgggttttctcttaaccaacagtctctgcctgtctctatttcccctgtccgctaggacacaatgtgtgtatcgtagtgtgcttagaatagctactcttgagtgtgaagagaggcaccgttctctgcctagcaagtttgttcttttttgtttgtttagagacagggtctcactgttgcccaggctggagtgtagcgactactcacaggtgcaaccacagagcactgtatcctcaaacttctaggctcaagtgcctcctgtctctacctcctgaggggctgggactaccggtgtgkgcccttgcacccggctaaatgtttgttattttgatatcaaccagtggttatttcctaactagctttaagaatactattacaaaaatagtacattctcatgataaaaattccccaaagcactgatgggtataaaataaaaaaatatgtataaaaattcccaacagtactgatgggtacaaaggctccctccgaattctcagggcaaaccactggtaacaatctactatggacattttcctatatcagtacatagagccttgcctcgtttttaacagtgctaacagcgtgttattgtataaa

SEQ ID NO: 39704 - DNA, 601 bp, Human
ccatcttcacaaagaaagctatggaatcactttcattaggttatttacagtacttaatatttccatccaaaaaatgaggatgggttttctcttaaccaacagtctctgcctgtctctatttcccctgtccgctaggacacaatgtgtgtatcgtagtgtgcttagaatagctactcttgagtgtgaagagaggcaccgttctctgcctagcaagtttgttcttttttgtttgtttagagacagggtctcactgttgcccaggctggagtgtagcgactactcacaggtgcaaccacagagyactgtatcctcaaacttctaggctcaagtgcctcctgtctctacctcctgaggggctgggactaccggtgtgtgcccttgcacccggctaaatgtttgttattttgatatcaaccagtggttatttcctaactagctttaagaatactattacaaaaatagtacattctcatgataaaaattccccaaagcactgatgggtataaaataaaaaaatatgtataaaaattcccaacagtactgatgggtacaaaggctccctccgaattctcagggcaaaccactggtaacaatctactat

SEQ ID NO: 39705 - DNA, 601 bp, Human
cttgaaaactttaaaaagtactagagagctctgagagttactggtaattggtttacaatctaattctaatctattagcagtaaattggggttatgtttgcttctaaaggagagatacttagtgatccgtacatcacagtgtgaaaaaagagtcctacgccatcttcacaaagaaagctatggaatcactttcattaggttatttacagtacttaatatttccatccaaaaaatgaggatgggttttctcttaaccaacagtctctgcctgtctctatttcccctgtccgctaggacacaakgtgtgtatcgtagtgtgcttagaatagctactcttgagtgtgaagagaggcaccgttctctgcctagcaagtttgttcttttttgtttgtttagagacagggtctcactgttgcccaggctggagtgtagcgactactcacaggtgcaaccacagagcactgtatcctcaaacttctaggctcaagtgcctcctgtctctacctcctgaggggctgggactaccggtgtgtgcccttgcacccggctaaatgtttgttattttgatatcaaccagtggttatttcctaactagctttaag

SEQ ID NO: 39706 - DNA, 601 bp, Human
aaacgaacaaacaaatatactgtgtgcttcagaatcgtaattagcaaaaggaagattatatatagagagaaaagatatgagatgcagtacacagtaatacaaaaacgttttaaaaaccacaattatacttaagtcttgctacatatatacaagatttgaagtgtgccaggcttactgaaaaaaatacatttgaaagaatttggcaatatcccatcgtgtagtgaattaaagattctattaaaaacttgctatttaaaggatcctttaattgccccctactgtttgttctgtaaatacagasttctctataaataacaccaatattattgctaatgagagagcaatacagtaattagaatatcatttgaataaaatgtcttatttcctgttgttgttcttattctccaattccaataatccaaaagaagagaaaaaattcaaaggttcaaacatctctaggtaattagatgttgtttatatagcaatataacagcaacctccctgaagacatgaacgtgacttaatagacaccatgtttcttgttttttcccttaaaactacaaaaataacatgaaattaaatcaatgtaaaagagtaaaaa

SEQ ID NO: 39707 - DNA, 601 bp, Human
cctgtaatctcagcactttgggaggcagaggcggccagattgccagaggtcaggagttcgagaccagcatgatcaacattgtgaaaccccgtctctactaaaaatacaaaaattggccgagggtggtggatgcctgtagtctcagctatttgggaggctgagacagaggaatagcttgaatctgggaggtggagactgcagtgagccaagaccatgccatttcacctgtgtgacagagcaagactctgtcaaaaaaaaaaaagaaaaaaaaaatctcaggctaaatccaggcaaagttttsaaaggagatcatttaaataagatgtaaacatttccactgatttttaaaaactgagatgtatgtctgtctggttcattactgtgccctgttgcctcgcatattcctggtgctgtcaggataggtgaattcatgaactgtactcattgttgctttatgaaagatctatagaggctaaggtctctagagctaagagaaagactcttggcttctgtgaccattgagagaagacaacacaaagatcatgcaaaacatgactctatatatttattctggttattgtcttttttctttttaaatttt

SEQ ID NO: 39708 - DNA, 601 bp, Human
cataaaataatctcagggccaggtgcggtggctcatgcctgtaatctcagcactttgggaggcagaggcggccagattgccagaggtcaggagttcgagaccagcatgatcaacattgtgaaaccccgtctctactaaaaatacaaaaattggccgagggtggtggatgcctgtagtctcagctatttgggaggctgagacagaggaatagcttgaatctgggaggtggagactgcagtgagccaagaccatgccatttcacctgtgtgacagagcaagactctgtcaaaaaaaaaaaagaaaaaaaaaatctcaggctaaatccaggcaaagttttcaaaggagatcatttaaataagatgtaaacatttccactgatttttaaaaactgagatgtatgtctgtctggttcattactgtgccctgttgcctcgcatattcctggtgctgtcaggataggtgaattcatgaactgtactcattgttgctttatgaaagatctatagaggctaaggtctctagagctaagagaaagactcttggcttctgtgaccattgagagaagacaacacaaagatcatgcaaaacatgactctatata

SEQ ID NO: 39709 - DNA, 601 bp, Human
tgctttattcctgccaaaatattcttttgctttatgttttgatacagtcttagaggaaaacatgaagtaaacaagtgaacaaacaaaaaaatcccacaaaatctgagagaacaagtaatagtggagagtaaaaatgggaggcagtgtcaataaaaaaaaattctctagcaatgcaaaaacacaatgattgtgtggatgggaaacttaaagataattggagaaggacaagaaaacagtaaagaaaagatcatctgccctatggaaagaggtggtattacatatggtgcctgaaaatatggawccaatgtgatgggctttcttagctcagtaagatgaaattcttgaagaacgggtcagatggccttaaggctaggaatgtactcattcacttaatagtcattcaacaaatatttactgaagccctactgtgttctgcgcatgaaaataggtgcttgtgggtattgcactcaacaaggaaaagttcttgctttcattctattgaagagaaccagacagcaagcaagtaaacaagcatataatttcaagatggtgttaaaagctctaaagaaaataaaatatggccagatggcactggcaggag

SEQ ID NO: 39710 - DNA, 601 bp, Human
agagctcagcaaatatctaggtcaatttaaaggcctcgtacactgtcagcccatcaggatatttctgcctaaaaaatttccctcaaatattttaaaccgtagaaattaaggtgcaggaaaaggtaggaacatttcccatttgagatactgctacccacgagcatatggactgctttattcctgccaaaatattcttttgctttatgttttgatacagtcttagaggaaaacatgaagtaaacaagtgaacaaacaaaaaaatcccacaaaatctgagagaacaagtaatagtggagagtaraaatgggaggcagtgtcaataaaaaaaaattctctagcaatgcaaaaacacaatgattgtgtggatgggaaacttaaagataattggagaaggacaagaaaacagtaaagaaaagatcatctgccctatggaaagaggtggtattacatatggtgcctgaaaatatggaaccaatgtgatgggctttcttagctcagtaagatgaaattcttgaagaacgggtcagatggccttaaggctaggaatgtactcattcacttaatagtcattcaacaaatatttactgaagccctactgtgt

SEQ ID NO: 39711 - DNA, 601 bp, Human
agataagaaaaagtagtataagctccttgttaaccattctaacggcattatccactctctgacatatatttcaactatttgtgttccgtgaaggcaagaggtacatggttattattttttcattgcccagaagagagctttgcatatacagaaagagctcagcaaatatctaggtcaatttaaaggcctcgtacactgtcagcccatcaggatatttctgcctaaaaaatttccctcaaatattttaaaccgtagaaattaaggtgcaggaaaaggtaggaacatttcccatttgagataytgctacccacgagcatatggactgctttattcctgccaaaatattcttttgctttatgttttgatacagtcttagaggaaaacatgaagtaaacaagtgaacaaacaaaaaaatcccacaaaatctgagagaacaagtaatagtggagagtaaaaatgggaggcagtgtcaataaaaaaaaattctctagcaatgcaaaaacacaatgattgtgtggatgggaaacttaaagataattggagaaggacaagaaaacagtaaagaaaagatcatctgccctatggaaagaggtggtattac

SEQ ID NO: 39712 - DNA, 601 bp, Human
tcaattatcaagagaggctctatcaattattgtaacataatttaacatatattagggaaaagtaatttgacagcaaattcagtttctaaaaaaattgtcatcaatgaattttgacaatgacagatcaaatatgtaccaaggaaccagaggtttctgaatcctctgagccaagttatttgctctgaatttatcaatggatgacacaaagaaggagttcaagataagaaaaagtagtataagctccttgttaaccattctaacggcattatccactctctgacatatatttcaactatttgtrttccgtgaaggcaagaggtacatggttattattttttcattgcccagaagagagctttgcatatacagaaagagctcagcaaatatctaggtcaatttaaaggcctcgtacactgtcagcccatcaggatatttctgcctaaaaaatttccctcaaatattttaaaccgtagaaattaaggtgcaggaaaaggtaggaacatttcccatttgagatactgctacccacgagcatatggactgctttattcctgccaaaatattcttttgctttatgttttgatacagtcttagaggaaaa

SEQ ID NO: 39713 - DNA, 601 bp, Human
aataacccattatttgaatcattttgtttactatttaatctaataaaagaatctgctttttaataaattatgtcctaagttgtcctgcctgccgattgagactgtggcacgtatttcagctgccagtggagaactataaaataccagagtccactgtaaaagcttaggtcaaagtcactgcaggtgctttcaccgaggcttctcagaccatttggccacagtccatcccaggatgactggctacaacctccatatgttgtgaaatcttcagagtcagaggaaaatgagagtgggagcccaygccctgttttaggacttatttttttcttgtatggaaaaaagagtcatgactgctaatttcctttcctcccttctcagaattcagacacatttgatagactgggtgggtcaacagactgatcttgaaatgctgctttggtaaaaggttttagaattatagtggcaaggaggtgtctggggtctggagagtttctctttcgtcattctttcctgtccactctgaattttagagcccacagagtacaagaggtggtacggatctatccagacaggatgaccgcactctttggaaaggggcaaa

SEQ ID NO: 39714 - DNA, 601 bp, Human
ttacatttcttgacatggtgatacatttgcatcaaactcacccaccaacatgtttgtctgcttctcctagggactggcagccctcttcctaaagagttcagaatgcagtctatggccatgatatgcaaacaaactagctggtccctggagatggccctggggctctggctgctaaggctatactctcagtatctcaggactcccagaaatcttaactcttctcacctcggttacagcttggatggatgcaccgtgtttcagaaggagttccattactttaattcgattcttcttgcaggcratatgaagaggggtaaagccattctgcaagggacaaatacatatacctgcttgactacattccatcaaaatccagtttcactgtgtgcagtaaatagttttgctaaaatgatgtgtggtaaattgaaatgaacagaaagtaccagggttaagcagcatgtagattctattctagaagtagtccagctgccctgggaacccaaggtaccctgataattgtgaacaggaagtgaatttttattacactctcctggttagctgaggtaaaaatgatcattcatttcattattttattttggaa

SEQ ID NO: 39715 - DNA, 601 bp, Human
agcagagtgtgaggaaggcagtgtggggttgcgcagtatacctgtgcaaaggctcccagctgaagggtcagcaggggctgatgccctctgcttgccaggctgtgcatcctggcaagggctgcatctgtctaaactggagagccacctcactacaattcacccaagggcaggaggtactcaccaagtcctgatcccctagggtcttatccccaagtgggaggcgcaaatcatcttaatttgctcaaagatccctgtggtagtcctctaaatagaaattctctactgaattgtgataaggttyaggtaaatggtttaagtaggaaaggtagagaaacgaggctagaatagaggacaccattttggaagaataaggaggatgagggtcaatgtcaaagtaagaggggctatctaaccagtaggaagcatgaggagttagggagatgctgcaagggagaagaggaatattgaaagcagaaacgaataggtgccaaggaaaaatctcacatactgctactactgccaccccttacttgaaactagagactgcagacttgtgcaaatgtatatttacatattgtaggttgaaattaagtggtttatg

SEQ ID NO: 39716 - DNA, 601 bp, Human
tggtcatcctaaacagcaaggtagaaatgtaaggctgatgagctgaggaaacaatggtgcctttatgaaaaattcagggaatattagctgcttgatgtaagaggtacaatcaactttttgagtcaatgctaaaaaaactcatttgtctttttcttcaatgctcagaaatgaggagatggtagctctaagctaattaaatacctgtggagagtgactcattaataagaaaaccatgaaatgcagttgtctataaattacaccccacccacacctgccacagagaatcaaatttgaactttawttgctccttctttgggagataagagaatgtatcctagtaaaactcatatacctgggagggatattatacctccacaccagttattatgcactcacatggaatgaattattttgttggttctgccttcccatagacaaaagcagagtgtgaggaaggcagtgtggggttgcgcagtatacctgtgcaaaggctcccagctgaagggtcagcaggggctgatgccctctgcttgccaggctgtgcatcctggcaagggctgcatctgtctaaactggagagccacctcactacaattcaccc

SEQ ID NO: 39717 - DNA, 601 bp, Human
gaaatgaaatttgaggtagtcatcatttatcccgatagttttctatttgtaattgtcttctatattgattacacattaatctttcttatctgcatccaaataaaagagtgcagtaccagttactagctttggaagatgcgccacaagccaattcatcttgctatcacacttgcaaggcttatgtagtatcacaaaaaaaatgagctccaaattttgcattctgcacatgcagaacaactgtttatgttagggtattactctaaggcatcagagttgagataaaaataaatcaaaccataartcagacaagacaataatgacacaaaaaagaacaagaacaaacaaaaacaaccccaagaaaaattcactgccagttttgcaagtattataaaagcatctaccaaccgagctgtgataatgtggtttgtgtgcttggcctgagcattttgctaatctgtggctctgtttttaaactaccatttaaggccaccaaataatttacaagaaatctgactctggatatcagtaaggtttcattggaagataacatactaagaaacttaaggcaaaaaaccccccacaaaatactaccagttaccct

SEQ ID NO: 39718 - DNA, 601 bp, Human
acctagaacttaaaaacggatgagcaaggagcaggaccccaaacatgtttgtgaaataaagcaaagggctacaatttgcagcttcttctttgctatgttatggtgaagtaacaatggtgctctttgaattaacattataacaaaactttatgttactacaaaaacttcctggacttcatttttatggctatgtgtacatagagccacttccatatatactcattgtctgactgaattatctgaattatttatttaccattatctttctgtcttttttttttttttttttaaagagacaggstctcactctgtcacccaggctggagtataaagaagcaatcagagctcactgcagcctccatcttctgggctcgagcagtctacccgccttgtcttcccaaagtgctaggattaaatgcctgagccagagcaactggcgcattgaccatttttcttattgtttaaacagattgtttccaaatttttgctctgttaagtaacactttggtaaacaacttggtgcaatattacactttacacatcctatttgactcagatcttctgtgaattcttagtgacctttctgaggggtgaggttttg

SEQ ID NO: 39719 - DNA, 601 bp, Human
tcctctttgtcataaagacaaattgagttttgaggcaagccattacaattctggtctctaaattggtatataaaactatagaaaattcaaaagatcaaacaaatcttaactataatgacgattatgaaattgctttttgattcccattaatgctgagacatgcactcctaaaaggaatgtttaacaagaaaaaaataaaattaaaaaaatgtgtttgctctgtaatgaccaaaaaagattttcacaatactaaaactaaaaaaagatatccctggtctcctgtatatgtcttttggtctayagaatttgttaaataataaccttgagaattcagattgttatggagtaacctttttccaaaactgtaaaaactccaaaattaaaaaaacgattttttcttacttaaaagtgttgaatgttttctcagtgtatcctcaaagcaactcaagaagtcagtattgctatctccatgtactaaaggacaaaactgaggctcagagaggtaatataacttgcctaaatgacacaggaagaatccaacttaggattcaaactctctgtgatttcaaaacacaggcacacgtgttgaaagtatttaaat

SEQ ID NO: 39720 - DNA, 601 bp, Human
actcatagattaaatcagagaaaaaaaatcaaacatttttcttaggtagaacagtataaattatataaataacattttatttttatattcttggttataattcaaaagattttaaaaaacaatatgaaggtaaccacagccctgtttgagttcagaagttacctgttaatcttttatggcattttgatcattgctcattttaaaaatagcacttagggccgggcacagtggctcacgtctataatcccagcactttgggaggccaaggcggacggatcccctgaggttgggagtttgagascagcctgacctacatggagaaaccctgtctctactaaaaatacaaaattagccgggagtggtggtgcatgcctgtaatcccagctactcgggaggctgaggcagaagaatcgcttacaccctggaggcggaggttgcagtgagccaagattgcatcattgcactccagcctgggcaacaagaatgaaattctgtctcaaaaaaaaaaaaaaaggtatttatttgaaacagagaaaacatcaaattaaaatagcaacatctctgtttaatattctttcagttgtataaaaaatataagcat

SEQ ID NO: 39721 - DNA, 601 bp, Human
gaatgaaacctgtctcaaaaaaaaaaattatatgttatactgtcttagcactgtggcaacatgactatctgtaggctgcatgaaaaattgtaggcatactcgaaagtgtaagaaatggagtgagccttgtatactcatcacagacttagcaattatcaaagttttcctatatgtgtttcacctatccctcttttccttttcattcatttgtggcaatattaacacaaatctagacactataacatttacccccatacatttcagtgttcatctacaaaaattagacttttttttttttttrcaaaattatgcaagagttttaacatattgccaatgccactagctttaccaaaaattatttaaatgatatctgtttacaaagtgaacactgacatatgctgataatattttctccatattaattcccaaggtctaatgaatattttctgtatgtcactctgggtaggaaagatcgcctgtgaaatgtaatgtgaatgcaagatcatgacaatttccaggtcatttagatgatgtatggatttaacaagactgatacagtatttgaaactaaccctattagagaatttgcagaacacatggt

SEQ ID NO: 39722 - DNA, 601 bp, Human
catagccatgtttgagaaaccatttgtgaattctaagatggtaagccgagaatttctatgttagaaaaaacctatggaataaatttatatgcttgggaggctgaggcaggtggatcacatgagcccatgagtttgagaccagcctggccaacatggcaaggtcccatctctacaaaaattagccaggtgcagtggcatgcacctgtagtcccagctacttgggaggctaaggcaggagaattgtttgagctcggtaggtggaggttgcagtgagttgagatagcgccattgcactccagccttggtgacagggttgaatgaaacctgtctcaaaaaaaaaaattatatgttatactgtcttagcactgtggcaacatgactatctgtaggctgcatgaaaaattgtaggcatactcgaaagtgtaagaaatggagtgagccttgtatactcatcacagacttagcaattatcaaagttttcctatatgtgtttcacctatccctcttttccttttcattcatttgtggcaatattaacacaaatctagacactataacatttacccccatacatttcagtgttcatctacaaaaattagac

SEQ ID NO: 39723 - DNA, 601 bp, Human
gttaatatagggggaaattactgtgcagctagaatcaagtacccaggccgttaaagacaaaagtccctggaatacggcaaccggagactttagtgtcccttgcataaataaacatttaaaatactacgtagaaaagagatgattaaagggtttgttctcctgatacaattatagtttcttccttactgcagtcaccaaatggacacattcttttccgtgtggcaagggagggccgtatacctttgtctgggcgtccacatgagccccttggtttacgaggacttctgccacattcactcgrtcttcttgagcagccaaatggagtggggtcaggccgctctgcaaaagattcaaagggcacagtcatcgtacaggaaggaatgtcacacacatagccatgtttgagaaaccatttgtgaattctaagatggtaagccgagaatttctatgttagaaaaaacctatggaataaatttatatgcttgggaggctgaggcaggtggatcacatgagcccatgagtttgagaccagcctggccaacatggcaaggtcccatctctacaaaaattagccaggtgcagtggcatgcacctgtagtcc

SEQ ID NO: 39724 - DNA, 601 bp, Human
aaagtcaagaattatttcccgatgaaagtattcaagcagcataagaaaataagctaaattcagtctcattttggtgtcaatacccttttatctggctaatttggggtaatatttctgtattactagttacttcaatatgcccatatacctcagaacctgcctatattacatataaaaattttattcacaatatttagtagtcattctttttcatgtcaaacatggcatatagaaagaaagcatatgtggctgggtgcgggggctcacgcctgtaatcccagcactttgggaggccgaggcrtgtggatcacaaggtgaagagatcaagaccatcctggctaacatggtgaaaccccgtctccactaaaaatacaaaaattagttgggcatggtggcacatgcctgtagtcccagctactcgggaggctgaggcaggagaattgcttgaacgtgggaggtggaggttgcagtgagccgaggtcaagccactgcactccagcctggtaacagagtgagactccgtctcaaaaaaaaaaaaaaaaaaaccaaaaaaaaaacatgttagagtagatgacacaaatgacacaaatctgatatgaag

SEQ ID NO: 39725 - DNA, 601 bp, Human
acttagaatagtacccggcatagagaaaatgggtaatacattgttttattttattatgatgatgactttgttattataatactatgagttttgctctctaaactatgaattctatgagggcaaggaatatatctcccaggtaagaatttggtgaccagcaggaaatctacacataaatgtgaaataggtaagtatcacataagttctcaaagctttttatgcttttacacacatttaaagaaatccagtgtaactcctgatccctaattagtgtcctctaagaatcaatgcctttcagggrtggtctaaataaaatgcttccggacattatccttctgaaaagcaaaagcagtggcttcatctctatcaaacaacactgattattataccctgtggcacaatttagcttaaactcatttggtgaacttcaaatgcaaaaggggggtggggtataaagggtcagcaaactggaggggtgcggggggagaggactgcaaaggctgttaccaggattttctagtcttctcctcatcagggagaagaggtcttgatatttttattattattaattatttttgcatgtaagccaatgagttgaatg

SEQ ID NO: 39726 - DNA, 601 bp, Human
aactcttttagttaattcatatgtcccttcaacataccccctaccattgtgcctctgtattagtttatttacttttgttgggggagggaggagcatttccttactttttgacactctaagatgttccaggctcatcttatatatttactgtgctatccttagattcagccatttctccaaggagcactgtttgcttttagtagaaaatagtattagcaaccaatatctgtgtgctagaggtgttctgctccttacatatgaagtaattgggtattttaaacaatgcagttttgatagataacaattcacatcttttgaatatcagcttctatccattcagtttggtatgctgttttgattgtaatctaattaactaaaccgtctttctcagcattgccacatcatgtattttactcacatggaaaagacattctctttttgttttgaaaaactgaagtctgtttatagagtcaatggctgctggagtcccagtaactagctatacaaatatcatgcctgtggtggaggctgagctatagttattagcttaaagtcatagactccaccctgaattacatcagtcctgtctaagctagtttac

SEQ ID NO: 39727 - DNA, 601 bp, Human
atttctgggtctaggtctttgaggaattgccacactgtcttatatgatggttgaactaatttacatgcccaccaacagtgtaaaagcattcctatttttccacagccttgccagcatccgttgttttttgactttgtaataattgccattctgactggtatgagagggtatctcattgtggtcttgatttgcatttgactttccttgtttttgatgaccttgacagttttgcagtatactagtcagatatgtccatcaactggggcttgtctcatagttttttttttttttttttttttttaatagactggggctgtatgttttacggaggaagatcacagaggaaaagtgccatttcatcacattgtatcaagggtacaataccatcaacatgacttatcattgttgatgttgatcttgatcatatgtctgaagcagtatttgtcaggtttctccattgtaaagttactctatttccccctgcttccatactgttttctttgcaaaggaatcactatgttcagcccacatgtaagcagtggggaattatgttccacttcgagagtgaagtattttcatacattatttggaattcttttgc

SEQ ID NO: 39728 - DNA, 601 bp, Human
ctttccttgtttttttaaaaaaattaatttaagttccaggttaaatgtgcaggacatgcaggtttgttacataggtaaacaaatgtgtgccatggtggtttactgcacctatgaacccatcacctaggtattaagcctcgcatgcatgagctatttatcctgatgttctccctccccacccccaggccccagtgtgtgtccttcccctccctgtgtccacgtggtcttattgttcagctcccacttgtaagtgagaacatgtggtgtttggttttctgttcctccgttagtttgctgaggrtaacagcttccagctccatccatgtccctgcaaaggacatgatatcattccttttttatgactgcacagtattccatggtgtatatgtaccacattttctttatccagtctatcattgatgggcatttgggttgatttcacatctttgctattgtggatagtgctgcaatgaacatacacatgcatgtatctttgtaacagaataacttacattcctttgggtatatactcagtaatgggactgctgggtcaactgatatttctgggtctaggtctttgaggaattgccacactgtctta

SEQ ID NO: 39729 - DNA, 601 bp, Human
aagaacattttcataccttcatcatcagacatatcaagaacttcattcatcgtttctggaacattcattttgtgcttctctgtgacagtctagtaacaaaaaagcagtcattttagtgtgagcagactgtacattttaatgggtcttttcatttatctctgaattaatcagtttcttgtggaatgtatgtgttgaatatcttgaatctcccacatataaaataacatcaaaattgttgtcccttagtgtcacaaaggttgtcaccatatacaaagcacaggagtacaaaatgaaagaattmtagtggcaaagtaccacagcttaaaagatttaggtctctaataaagcttttcaaaggaaaagagaagattctgcccctcctactccactgctatactttttcatggtctgatgaatctgccgccccattccacgaaaggtctcggctgaagagaagccaaatgagctgcaagaaatatgtctctattacttgtgccaagctttccgtctattttgtgttctcctcttatatgtacttttaattcataggataaaacaaaatattaaaataatatttacaacaataatctttacaatattg

SEQ ID NO: 39730 - DNA, 601 bp, Human
aacaatataagtggatgaaaaatacatactcttgatattacaacaaaacgtttcaatattcctgataaacatttttgcaatggactttcttcaggaaacaaacaaaatacacagtcacttataattattgtgaactcaaagaacattttcataccttcatcatcagacatatcaagaacttcattcatcgtttctggaacattcattttgtgcttctctgtgacagtctagtaacaaaaaagcagtcattttagtgtgagcagactgtacattttaatgggtcttttcatttatctctgarttaatcagtttcttgtggaatgtatgtgttgaatatcttgaatctcccacatataaaataacatcaaaattgttgtcccttagtgtcacaaaggttgtcaccatatacaaagcacaggagtacaaaatgaaagaattctagtggcaaagtaccacagcttaaaagatttaggtctctaataaagcttttcaaaggaaaagagaagattctgcccctcctactccactgctatactttttcatggtctgatgaatctgccgccccattccacgaaaggtctcggctgaagagaagccaaat

SEQ ID NO: 39731 - DNA, 601 bp, Human
tgtaaacaaaataatggaacagttttagaagagatactcaaacacttggtggacaactttaataaacaacataattttttttcaaaaatgctctcttttaatcatgaattattatttcagtaacagagaatagtgaacaatctatacacatatttctcacttattagcaaataatactttctttcaatatggaacaaaacttaattttgaaatatgtgactcagattggttctcccagttttgtcagtgagctcttttgctactgtgctggcagcatgactgcaaagtgggaaaaaaaaaagaacacacaattaacatgttcaatcacatgaaattaacaaccgcaaaccacaaaagaaaatagcagagcatgtgtatttgcgtcgagaacatttcgctaaattcacatcttcatccaaagaacacattttgggataatgtgaaaaatgaacatgattttgatttatgacaaatcatggttgttttaaattaactatgaaagacagcaacaacgaagtacctggcagaacgcgctccgagactaaagcccatgtaaccctctgcaggcagggaatcatcacccaattccttaaggtcctgt

SEQ ID NO: 39732 - DNA, 601 bp, Human
gaataaactccagggtttactttgtgggaagtgccatttactattagacaatgaaactttctacaacagatccttaaactataggaaaatgtcctcagggctctggcttagaaggtttaattattagctttaaaatccacactagggcaaagaagtctccaaattctgcacaaggttctgtttctttcaactagtttaagaaaagtttgagtcaaggttttcccatacagaagttttccacttcagttgtaagaactgaatttgtcaccattcctgtctgtgacttttggtaaatcactgytatacttcttacatgtcccttgtaaacaaaataatggaacagttttagaagagatactcaaacacttggtggacaactttaataaacaacataattttttttcaaaaatgctctcttttaatcatgaattattatttcagtaacagagaatagtgaacaatctatacacatatttctcacttattagcaaataatactttctttcaatatggaacaaaacttaattttgaaatatgtgactcagattggttctcccagttttgtcagtgagctcttttgctactgtgctggcagcatgac

SEQ ID NO: 39733 - DNA, 601 bp, Human
aacttactaaaagaccattataagcataattcctgcacagaggaacttatctagtaagccacatgactctagccacttgcacagtcaggccctctgtgcccaatcatgggacccattactctcttttttccccagtttcaattgcaagcccttctttccgccattcctgtttctattctcttaccttctctcaaatacagtagaagcttcctaagagcaggaattctctaactcaacactgtccaacagaactttatcctatgaaggggatgtgctaaatctgagctatccaacaacagcrgctactgagcacttgaaatgtggctggtgtgaacgaacaaatgaatttaactaattttaatttaagtaactataggtggctagtggctacattattagtgcagcttctaagtattaataacaatgttaaattttgctccagtggtgtgatttgagagtcgccggccactctctgcattagacattcatttcttcaaattatggtccccatggcatgatatgttaacattggtggtgtatgaaacagttttctatgtagacaaacacttaaaagttttaaaaaataattacctattcattt

SEQ ID NO: 39734 - DNA, 601 bp, Human
tccccatctcacctgggaggctgtcatgagatagctttcatcacttcctctttctaatgatgtatgaggcttcctattctgctctccttggaatagagctgcagaatataaaaccatttagctgaagtctagaattggctcctcggcaatggggtatcccataactagcattgtagacatccagccccttttgttctggtgtccttttaggtgtaggggacaaggatcatgagaagctagcacctttcacttcttctttcactgcctatataattaaaaaaccatctggatctaaaagtgscttcttgtatctttaccagttgaaccagccagactttggctttggccttgccttttgtgtgcttgatggggaaatgaacaaagaagatacacataagaggtaaataaatgattctttgcatgaaacaatttcttttccccactgcctgctatactaaagaaaatcagaaagtgggtatccttttatcaaggtacagagcctcctgacattagaggcctcattctaagtgtctacacagataggtacgtacattcttctaggattggagccttcacttttatcagaatctcagatggacct

SEQ ID NO: 39735 - DNA, 601 bp, Human
gagaatggcttgggcccaggaggtagaggtttcagtaagctaagactgcaccactgcactccagcctggctgacagagccagacccagtcaaaaacaaaaaacaaaaacaactactaaatatttgagagaaattcttctattattaagggaagcacaaaagtcagttaaggtaaattaacaggcatacttacatatttaattttctattggaaagaaaaatcagatacctagaaaaacttcatttgaatagaaaagtaaaacggagaaaaatcattatgtttcaaattttaaaaaacttamaaaggaaattttctgaaaaggaaaattaaagacctagaagattagaacagccaggaaagtttgttgtactagtaatttcattatttttctaacaaaattaaatttttctcaaaaaaaaaactcatacagaattacttagaaaaaaacaatgatttacaaatacatctcacatatactaatgaatatacatttcatacatgaatgtattcatatatatgaagcttgttgatgtgaatttataactctaagtaataaatgcactgttcatgtagtaggataatgaaaagtgacatttaggtt

SEQ ID NO: 39736 - DNA, 601 bp, Human
tcccaaatttgaattacccaaagatgaagaatccagtatctaaagatacactaatttattaattcagtaattgaagcaggtccccttttagcctcctgcctcgaattccattgaccagggaggcaggatgaggaggctactcggtgtggtttttaaccacagcacttccagtgtagacactggtatgttttttttttaagtaaatatctttattctttttattcattttttaaaattacaatttaatacaacttaattgtaattttatttcagaaatgcagaggcaccaactcgaaagttyaaatttatatattcttttaaaaggaaaatcacacaaatcatttatcaaatcaaagacctgtatcatatgagaaaaaaatgacaataccagagcttactgctcatttaaaaactaaatatttgctaggtgtggcggctcatgcctgtaatcccagcagtttgggaggcaaaggcgggcagattgcttaagctcaggagtttgagaacagcctaggcaacatggcgagacttcatctctatgaaaaaatacaaaaattatccgagcatggtggtgcacacctgtggtcccaggtgctcaaga

SEQ ID NO: 39737 - DNA, 601 bp, Human
agcgtgattcaaaaaactcttcaacatctttgctccctgaatgtatcccagatgttatatagtttccttcttgaatctgattttttcttttgcttttccaatattagacccatatgcattgaatataaattatataaatatttttagcagtttaaaattataataattcaaggtttctctaattgagttaaagaaatgcaatgttactaactcaaaagccaccataaagtttataatttatgaaacactttcatgtcaattattcccatttgaacgatattgttctgtttctcagaattgyagtattacaaagccaaaatctataacggtattttaacctgaagcattcctctgagtctgattttttatttgtaaaatgaggataatgagtaatacgtatctcacagtatcattataaggttcaagtaaatataaatgagacaatacatgtaaaagatttagcacaatgccaggtacacgacaagaagtaagtaaacgttagctattacaatttattttaattaggagcagcagcaaatacttcatataatatatgaagcacttcacaaaagttaattgttgttaatttatttaattccaa

SEQ ID NO: 39738 - DNA, 601 bp, Human
atcattaatatttaaactatagcacaaattctacaaatgatcctaaaactaatacatgaatgtttctagttttaggaacagcaggatgacaaatgctgatatactacagacattgacacgatctaactatggcaaaaattcacataaattaaaaatacaaaaaggatggttcacataaaggacacagttatcaccttgaatcatactgaggaagtggagaagaatagctgcaaaataatttagaaagcaaatgggaagaattaatgtaatataattagaagcaagcaacagaaaatgtcartgacaagcaaaggaaaaataaaaaccatcagaaaatgaaaccagggcatctggcatttgtgggacaacctagaaaaatatctgccttatgtagctgcataaactgcaaggacctggcatcagtgaaatatttctaagtgcacaccaggtctatattttccttttcaaataagcccacacctgctgccattacttttgctttcctgcacatgtctattgtctctcttgtcttcaataacattcaaggtgaaggggagataacttgcatactcaaatacttcattgtttttaatgtatggga

SEQ ID NO: 39739 - DNA, 601 bp, Human
tgaggaaaagtgggactattcattaaacaggacatgggtcctattatttaataacattataaaatatagtgatttgttttacaaactcatgtcttacatattgtgtgaaaaagtcatgcaacataacttatagaacaaattaaaaaggtgatatataataatatttgtatcattaatatttaaactatagcacaaattctacaaatgatcctaaaactaatacatgaatgtttctagttttaggaacagcaggatgacaaatgctgatatactacagacattgacacgatctaactatggsaaaaattcacataaattaaaaatacaaaaaggatggttcacataaaggacacagttatcaccttgaatcatactgaggaagtggagaagaatagctgcaaaataatttagaaagcaaatgggaagaattaatgtaatataattagaagcaagcaacagaaaatgtcaatgacaagcaaaggaaaaataaaaaccatcagaaaatgaaaccagggcatctggcatttgtgggacaacctagaaaaatatctgccttatgtagctgcataaactgcaaggacctggcatcagtgaaatattt

SEQ ID NO: 39740 - DNA, 601 bp, Human
tcgattttgggagattgggaccactacgataatcaaggtaaaaggggaaaacactgactctctcaaaaacaaaaagaaaacaaaaatcactcctccctagtcaaagaaaaagatacttgttcacttgtacaagtgtcgggatgaattgttaccaatgctaaaagacatgaggctcacctgaaattgctctgggctgcctacattttcttagacatacgtatatttaacaactacttttattcaataatgaaggcaatatggcaatattataagacaaaaatcaaatcattccctgcacttmgtagttgtaactacaaaaatcaatttttcattaggaataatagtaacagaatggatttaaaacgattcacgacaaactctgggcttgaagattcagttgtgtcagtacacacatacacacatacacacacactggaatgtttccactgagaggggaatgtttgccctggcaaccgctgagtctcaacaatatagagagtaattctgattgggtctgtcttgttcactgattgacctgcagagccaagcacaattctagcacaaaatagggacgtgataaatgcttactgaatgaaccaat

SEQ ID NO: 39741 - DNA, 601 bp, Human
attagaaaattgtcggaattcttaaagtgtttttagaaaaaaaaagtcccatccatcaaaaatctttactattttttcccctaaaaacaatgctaacatcctgcaaacagattttaagaccttgcatggacttcctagctggggaccgtcttctgaagaatgctacctcttgaccttgaaagagtgaccttttcaagcaaactggcctgtgatccccacaggcagaggcaatgggctggcgatcatttttcagcctatcagattcctagaaccaactctgctcatcagtaaggtggactcrtcttcatacccttttgctcattttggatttaaccattttactctgaatgaatttatgtctcttacaacattctatcgattttgggagattgggaccactacgataatcaaggtaaaaggggaaaacactgactctctcaaaaacaaaaagaaaacaaaaatcactcctccctagtcaaagaaaaagatacttgttcacttgtacaagtgtcgggatgaattgttaccaatgctaaaagacatgaggctcacctgaaattgctctgggctgcctacattttcttagacatacgtatattta

SEQ ID NO: 39742 - DNA, 601 bp, Human
taaacataaatcaatgagttcaatgtgtggaagagttaaggtcagacaggggaacacaaatatatccctgtattctagtttccacgtatgaaaatacacagattactactagcacagtacaaaatggtgataattagaaaattgtcggaattcttaaagtgtttttagaaaaaaaaagtcccatccatcaaaaatctttactattttttcccctaaaaacaatgctaacatcctgcaaacagattttaagaccttgcatggacttcctagctggggaccgtcttctgaagaatgctacctsttgaccttgaaagagtgaccttttcaagcaaactggcctgtgatccccacaggcagaggcaatgggctggcgatcatttttcagcctatcagattcctagaaccaactctgctcatcagtaaggtggactcgtcttcatacccttttgctcattttggatttaaccattttactctgaatgaatttatgtctcttacaacattctatcgattttgggagattgggaccactacgataatcaaggtaaaaggggaaaacactgactctctcaaaaacaaaaagaaaacaaaaatcactcct

SEQ ID NO: 39743 - DNA, 601 bp, Human
tgtcttctatcacatatgcatggtcccactatcatcatcacagagttataacacagttatcgttatcacagagttataagtaaacataaatcaatgagttcaatgtgtggaagagttaaggtcagacaggggaacacaaatatatccctgtattctagtttccacgtatgaaaatacacagattactactagcacagtacaaaatggtgataattagaaaattgtcggaattcttaaagtgtttttagaaaaaaaaagtcccatccatcaaaaatctttactattttttcccctaaaaacmatgctaacatcctgcaaacagattttaagaccttgcatggacttcctagctggggaccgtcttctgaagaatgctacctcttgaccttgaaagagtgaccttttcaagcaaactggcctgtgatccccacaggcagaggcaatgggctggcgatcatttttcagcctatcagattcctagaaccaactctgctcatcagtaaggtggactcgtcttcatacccttttgctcattttggatttaaccattttactctgaatgaatttatgtctcttacaacattctatcgattttgggaga

SEQ ID NO: 39744 - DNA, 601 bp, Human
tgctgccatatggtctcttacaagtaagatgaaactccacagtatgtcttgatatttacgactcataaaataaatgtatttttaatcataccaacactaatttttactatgatgaagcagaatataagaataaaagcaggagatgactagatttgctacggtgattttgatggaaagagattaaatgttttcagtataaatatgggcttaaaagctgtctgaaataacctacatttgaatattttatacaatgattaaaaaagtggaacttagacttttagaaaatggctctaaataacakaattctgtcattggccttttattaaagctaataaggaaaaaactgtctgcatgtattaataggtatagaactataaagaaattaactgttatttttgggtagaagcatattggaatcactgtcttctatcacatatgcatggtcccactatcatcatcacagagttataacacagttatcgttatcacagagttataagtaaacataaatcaatgagttcaatgtgtggaagagttaaggtcagacaggggaacacaaatatatccctgtattctagtttccacgtatgaaaatacacag

SEQ ID NO: 39745 - DNA, 601 bp, Human
cggcttcctctcatggagccccctctcgcgtccaccataaagctaaccagaaacctgaggggagaagatcagaggccaattcaaggacggaaataaactgtgctcacagcaagtttggaaattaaatgtttaagtttatttaaagcgacagacaatgtagctatcatttcctctaaagataaatcagaagtcaatacagtggagtcacatcaaacatgcatttaacttgtgcactttgcaaaaactgaaacacaacttgtttttggtggaacatggcccccatagaaaagccaactacttyaccaggctcaaatggaaggaataaggaaggtttcaaaactggagtaaaatcggtctagtaacaggattctcatgcatttaaaacaaaaaaactgtggtctttatattcaaaggtcattttaactataagtggtttttgccatatgctgccatatggtctcttacaagtaagatgaaactccacagtatgtcttgatatttacgactcataaaataaatgtatttttaatcataccaacactaatttttactatgatgaagcagaatataagaataaaagcaggagatgactagatttgct

SEQ ID NO: 39746 - DNA, 601 bp, Human
gtatcttgtctataaaggtcctacccaataaattttgttccttgaggcccaagctgcaggattcggctaaccaagctctcaccctcatttacagggggaggattggtaggaagatgcagtttactgaataacatccatgcagcagaaagagaaacgagaaggggaaattgtgaacaaactgtcagtcacgacagagcctgcctgatttgtacccaagtgccacctcagaaaatgaattaaattcatttttcctttttgtaaaataccatatcacaatgaactgtttcccaaaaaattttcyttaaaaagacatgtccccaaagtagccatatattcaatgcggtaaaataattccagcatctgtattttttccctagaatggtgccttgacttctacagggaccactggggttccgtgcacttgctgagcagagaacatgcttctcggttagtaaaagccttgactagcaaactgagttaagaaagtatcagcctattagcctttcacagaatcacacagctttgtgacctttgacactttacaaaaagtatactcaatcaggtacaactaagcagttttaagagttatctccttgagtta

SEQ ID NO: 39747 - DNA, 601 bp, Human
ggcaaatacaacaatcaaacagacaagtgaacaaacaacaaataccaatgcatttcagctcaaacaaaaccaaacgaaacaattttataactttaaaagaatactctatctgctgcctatttaattttatttaaatatcttattttcccaacacttttcaaaatcagtttacttattgatgacttcttctcaaagcccataaaaaattacacagtactcatgtacttttaaaagatctaattacacacacacacacatgcgcacgcgcacacacacacacaggtgtacatacatgtaattkatagcaaatgttgactcaaagcctgcaaataccttctcttacactgggttaaagacttttgctgtcttaaaaagtatcatattcagaagaaacatttcaaataaaagaaaggtttacaaaagcacgaagttatgaaagcagaatgcttgcagtgaattccacatgcctgaaaagcacaagataggtagcggtgctacattaagtcaagccactatgatttttttttctttcagtgacacacatcaactgaaagcattaaaaaaaacttaaaaaataaaaataaacttaagacaagaatca

SEQ ID NO: 39748 - DNA, 601 bp, Human
ttagttcattttccttattcaataaagaaaaaaagaactaaagtctagctgaaataaatacaagaaaaatcttttgatccaagatttccagccagctttccaaaccaaatcaagttccaactggtttggataaaacccagtatttatgatttacttcaatcaaatcaaaacactaaagtctgcaggcttcactataactgatttttatgatgtggcatatcataaaccatggcttggtatgttgttccacatactgagaccaataacctatgatttaaaaaattatttttcatcagaaacyaactgagacttttaaacagaacaaccctaaaatatgtaccttatttaacaagccagtaagctaactttatacttgatgctttttatctgaaataggtaaatgattccccaaacggcctaattagcagtatcattaggatgttagaataactctttccagagcaaaacatgcactcacatgctctctgcgcatactgagggaaacaactttttgtgaacattacctggaggcccactcgaattcttttagttagggcaccctctgggaaagatgcttgaacaaggggcactgtggtgctgc

SEQ ID NO: 39749 - DNA, 601 bp, Human
taagtatgcttggctcaaaacaaacaaacaaaacccagttaactccattgggcaggagagtccagcctcacaagaagaacatgaaccttcagttaaactattaattacaatattaataacatctattaagttactttagttcattttccttattcaataaagaaaaaaagaactaaagtctagctgaaataaatacaagaaaaatcttttgatccaagatttccagccagctttccaaaccaaatcaagttccaactggtttggataaaacccagtatttatgatttacttcaatcaaatsaaaacactaaagtctgcaggcttcactataactgatttttatgatgtggcatatcataaaccatggcttggtatgttgttccacatactgagaccaataacctatgatttaaaaaattatttttcatcagaaactaactgagacttttaaacagaacaaccctaaaatatgtaccttatttaacaagccagtaagctaactttatacttgatgctttttatctgaaataggtaaatgattccccaaacggcctaattagcagtatcattaggatgttagaataactctttccagagcaaa

SEQ ID NO: 39750 - DNA, 601 bp, Human
ttggtaaaataacttggtatgggaggcaggtgaagggagcttcatacccctgaaatgtaaggtggtctcgttagtgctaactacttattaaaggtcatctcaggacttaagtatgcttggctcaaaacaaacaaacaaaacccagttaactccattgggcaggagagtccagcctcacaagaagaacatgaaccttcagttaaactattaattacaatattaataacatctattaagttactttagttcattttccttattcaataaagaaaaaaagaactaaagtctagctgaaataaayacaagaaaaatcttttgatccaagatttccagccagctttccaaaccaaatcaagttccaactggtttggataaaacccagtatttatgatttacttcaatcaaatcaaaacactaaagtctgcaggcttcactataactgatttttatgatgtggcatatcataaaccatggcttggtatgttgttccacatactgagaccaataacctatgatttaaaaaattatttttcatcagaaactaactgagacttttaaacagaacaaccctaaaatatgtaccttatttaacaagccagta

SEQ ID NO: 39751 - DNA, 601 bp, Human
ctttgtgaatcaataggaagtacagcagtgacttaaccaaacctgtaatgctacagagaagacgcagattgggtgtagtgtcccctttgtatccattggatacaccttctcctgagggcgggggcaccggaatggtcattgtgattggtttatggaatttccgtcttcttggttccacagtgacaattgggctaaaagttgctttgtttccaaggatctttttcacaatttcatctggaacaggctgggcctagagacagagaaaggactttaaatgaaagtgactttttttttttttttycccaatcatgaagtttactttttaagtgagaaggaaaaaaacaaaaacagacaaccaaaaaaaaaaaaaaaaacccaggtcttttttaacctttcttactattttaggaaagcatgaataaacgaaaccaaacactatgacaggaattggtcagtctgagtatttccccagtagaacacaaatagcactggcttgcaggaaagagaggggatccagtctcacggcatagaagtttcttagtctagtccagattaaaggacaataaatgctgagtccaatatattttaaacctatgcagga

SEQ ID NO: 39752 - DNA, 601 bp, Human
atttgagtattggccgggcgtggtgactcatgtaatgccagcgctttgggaggccaaggtgggtggatcacgaggtcaggagtttgagaccagcctggctaacatggtgaaaccccatctctactgaaaatacagaaaattagctgggcatggtggcaggcgcctgtaatccgagctacttgggaggctgaggcaggagaattgtttgaacccaggaggcggaggttgcagtaagctgagaccgcgccactgcactccagcctcggcaacagagcaaggctccgtctcaaaaaaaaaaaaattaaattaaattaaattaaaaaagataaaaaaatttgagtattaatctatatcaaattttttaaagtaaaagtaaaatcaataatgcacttggtattttatagtgagtgctattaagaccacaaaataaaacctcatatctggagtacgtaatgaaatgaacttgtttttgtgaacaaggtacctcaatatctttgcttcttgcgacttcctcaaaattctcttgttgctctaaagttttgtccactttgtcatctgtcatgcagaaacatcgcaaggaagattctacgggatcattcat

SEQ ID NO: 39753 - DNA, 601 bp, Human
gacaatttaaagcagtattaaaagatacctttttatgtgctggcagagtgatatttaagttgcaaaccgctgtttgaggcagtccttttgttgtctttggttctttcagaaaagacagacgaccacagggctcttggctggtgtctctaatctagaagaattttggtagttgatggttatagaatgagacttatctgaggatttttaactgtataagagttaagcatggttgttttatcaagccctatgagaggcaggaaaggtaaagggaaaagatgatgattacgattatgcagcaacyggggtggtcacatctgaactcagcaagagttagatgcccgattcctaaacgcaggattgttgtgtctgatgatctaatcctgacaattcatagtacagtctgagttatgtgcattttccttctaacagtttttttttctgaaagctccagcttttgcaacagtaacagcaaataataatgacaaaacaattttcctctctccttctgttcttggagagagaaggtgatccctctagaacgtccctgggctccaccagaaatgaaaatgaaacttgaatactgtatttgcatttcatccat

SEQ ID NO: 39754 - DNA, 601 bp, Human
tgtatgacagggttttcctgcaggcaatttttcttttgccattgagtttccaaatgataaaatttggtttgtatagaaaaaatgtctcttcttatgaaaatccacgtagattagtaaatgtgttaggaaactcactcattccaggctcagtcaagtagctgtagcgcttacgtaaagctaaggatgcgaagctctgtcgtctatctgttttctcaatctgaaaaggaaaaaaaaaaagacaactctatttccaacttccctgtgacatcttcagttttaagacattttgtaggatggcatrttgataacttgtttattttccttcttaggaaatgttaatttcccactgggattttgtaaccccaccccccatgtcttaaccaaaatcatcatttggcaaatttaagagcaccaacacagcagactacagggaagtacaagtaaaagacaagcattacagagacttctgatgctgagcattaaattttcctggaactgttcatattgaaagcacatatatcacaaagtacactcactctatgtgagtacattcaagggagaaaggcacacaaagtttattattccaattactgctggggat

SEQ ID NO: 39755 - DNA, 601 bp, Human
actaggatatgacaacctatctatactgagaaaaatgagatgacaaagtaactttatcatttttctaccattccaaatatttgagtaatttttttcatctgagcatagatctaaagcaacattcatatttatctcctagcatagttaatcaaagtaaaaatcaaggttttaaaagaaaagtaatacatgtttctaatttaaaaatagttaatggctttaaaaactgttttgaagtatgagctaggggcgtttttacctcacatcttcaactaggcacaaaatattacttaggttgtatgayagggttttcctgcaggcaatttttcttttgccattgagtttccaaatgataaaatttggtttgtatagaaaaaatgtctcttcttatgaaaatccacgtagattagtaaatgtgttaggaaactcactcattccaggctcagtcaagtagctgtagcgcttacgtaaagctaaggatgcgaagctctgtcgtctatctgttttctcaatctgaaaaggaaaaaaaaaaagacaactctatttccaacttccctgtgacatcttcagttttaagacattttgtaggatggcatgttgataa

SEQ ID NO: 39756 - DNA, 601 bp, Human
ccaaaacgatcattgagaaaagaaaagggtctaactggtctagtgaagaccagccttagaactgatattttaataaaggacaggaggagaggaagtgagagggagggagggaggaaagaagaactctgtaaacaagtgctacctcaagaaggtaaggaaacgtgattcttgcaaagtgggaagaaaaagaatcgggactaggatatgacaacctatctatactgagaaaaatgagatgacaaagtaactttatcatttttctaccattccaaatatttgagtaatttttttcatctgagcrtagatctaaagcaacattcatatttatctcctagcatagttaatcaaagtaaaaatcaaggttttaaaagaaaagtaatacatgtttctaatttaaaaatagttaatggctttaaaaactgttttgaagtatgagctaggggcgtttttacctcacatcttcaactaggcacaaaatattacttaggttgtatgacagggttttcctgcaggcaatttttcttttgccattgagtttccaaatgataaaatttggtttgtatagaaaaaatgtctcttcttatgaaaatccacgtagatt

SEQ ID NO: 39757 - DNA, 601 bp, Human
ttcagcccttatgtttctgggaggatttcgacatttctgctagaggagaacagagatctgaggaaacattcttgaatgtggtaggtttctttcatttctcttatattctccattttgtatttaaatattgaaacttctctaatagtcaaggagctaggctccagaagatgacgctaagaccatctcaactaagtggtgcagtagtgtcctgccgcagatcttatatgctatgctgttggcccataaaaacaagacttcagaaaaggtgggaaaagccaaagatgtgactcttactggcaartttccagacctccttgaacttaagaaactgtgtcagtgggaaacagctaggaatgattcactaattaaaaaataatttttgtataatttcccctcatttaaaatgaggagaatggttaaagtggcaccaatatgtcagtcaaatacaatgctgagctcaatacccttagttcctgctggtggagggggttatcttgagggctgtagagatcaccagaggtgatgattacaaggatgatggaaggaaagggaggaggaggcagacagaaagagagagagagagggagaatatataaacaga

SEQ ID NO: 39758 - DNA, 601 bp, Human
aagagaaaatgagaatctgcttcagcttttatgttcttcttcatgctgtgcccgtgccattgctacagtccagtctttggattagcagctactctcacaagggtgaagatggtcatttctagtgtacatttaaattcaaacattccaaacatatcctttcctaggcttacatattattctaaagaaagtggaagaactaaggaaaaactcgcctattcattaccccttcttgccataattctcaatattatattgctgaactcttttggaaatgccacgctgcaaatggaaggtttgcagrttccttcaaattcaatgatttgagcttagtctgtgtctcacaagcatttatttttgtaactatcagacactgacaaagcatctatcctttaccactgaaggctggctctatcaggcaaagaaatcttttgaaccacgtctatggttttatacttcgcaaggaacaaccaacctaccaatcagttacacattttatgctttaatgacatatattttgggatccctttataagagggaatttctggatgtcaggcaccgaactaatccagaatctttttcctggggggaaggggttggaaag

SEQ ID NO: 39759 - DNA, 601 bp, Human
ggatatgtggggtgtgtgtatatatgtttatcaatttcaaaggtaccaattctggtgccttcccataatattcatgggacttatggatatcacaaacactgaagcagtcacgagggagacctaccactaggaagaatggatatagtaataccagcatttcttctggcaatggagcaagaaacacacaaatgaagtaagcacacttgctggggagcacaaacacatacttggtcctctctgcttctacaactcaaacaaaccaaactggtcagagatttgcaaggcctgccaacggctaatrttctacatcaaaggtgaatacagttttgctccaagaaagccctggttcagaatagtgaaactcaaagagaaaatgagaatctgcttcagcttttatgttcttcttcatgctgtgcccgtgccattgctacagtccagtctttggattagcagctactctcacaagggtgaagatggtcatttctagtgtacatttaaattcaaacattccaaacatatcctttcctaggcttacatattattctaaagaaagtggaagaactaaggaaaaactcgcctattcattaccccttcttgccat

SEQ ID NO: 39760 - DNA, 601 bp, Human
actgaaaacattttatcatgcacaatatatcatggcaaacaagccaatgaagtaatacaattcgtatgccatattatgcacaatatataaactttaaagatactttcacaagggcatttagaaagaagagtacactttttccatgagatatgaagtcttggtaccttttgagattttaggaaaatattttctactgcaagttataaaatcacctgcaactacatacgtccatgtctgcaactcttcaatatggataaaagcatatagtttatctcagatattttttcataacctaatctayatttaattttcaaaagctatcatgggggacatctaaaaactacattcatatttttaacaccccatatttaagtacctacagtaggatatgtggggtgtgtgtatatatgtttatcaatttcaaaggtaccaattctggtgccttcccataatattcatgggacttatggatatcacaaacactgaagcagtcacgagggagacctaccactaggaagaatggatatagtaataccagcatttcttctggcaatggagcaagaaacacacaaatgaagtaagcacacttgctggggagcac

SEQ ID NO: 39761 - DNA, 601 bp, Human
tatggccttctgctgtttttctctagcaaaaacttggtagacgggtagcttgctctcctgtatttttttaactgggattctggactggccatctgactttctgtcttcttgagacatgtccttactttttgcgtgtgtgccttgttcaaattttaatctaatggaactgagtttagattgtttgagctggaatccagactggggcccatctggtgctttgctctgtgaaatacttcctttggcttccactgtggacttgctgtcctcagtctgttgggagagaaccatcttctctgggctrctgggcagactgggtgccttctcctcggccttggggaagccttgtccatcagggccatgctgtcttgccttaacccactcatcattggatgccagcagttctgtcagtagcactttctcagggctgctactggtagggctttgagaagaatattctttgccatttttagggcgtgcctttttctctggggactgcagttcatcatttagcttttcagttttgtcacgaaaaaactgtgacacttcagtcagtttttcttcagcctccttcacagtcctgtccaccctatcttcatatatc

SEQ ID NO: 39762 - DNA, 601 bp, Human
tttcacaacatattccctatataagacttttttggagggagattttacagtcatttctttaatttctgagagagagccgtttgttaacaatttgcgttctctctcagtcacagacataaattcattcttttgatcaacacttttactctcagggtgaccaatgtgattctctcttacatcatgaacaagtacatgcgaaagtttttctttctgagacttattgttagtggctcccgaactctcccatgttctaaagacctttttgtcccatggtcccctagttgctaaatctgaggttatrtgacatgccaagtctttagcctgctgctcagaaaaagagtcaggcattgctttacttgacatttcagttctctgttttttcacattatcagagccagaatcatttacaacaatttcgttgctttgggcatgctcatctttggtttttaataccataaaatctttttgcacagatacactttcatctgggaggtctatggccttctgctgtttttctctagcaaaaacttggtagacgggtagcttgctctcctgtatttttttaactgggattctggactggccatctgactttctgtct

SEQ ID NO: 39763 - DNA, 601 bp, Human
aaatgccgactgttcacaaaaaccatcgggaatattagaagacagcattctcctctcatcagcaactctgacgggaatgtgtgacactgctgagctctcgctcctcctggaaggctgatcaagcaatccgcctggatggtccccttctttcacaacatattccctatataagacttttttggagggagattttacagtcatttctttaatttctgagagagagccgtttgttaacaatttgcgttctctctcagtcacagacataaattcattcttttgatcaacacttttactctcaggktgaccaatgtgattctctcttacatcatgaacaagtacatgcgaaagtttttctttctgagacttattgttagtggctcccgaactctcccatgttctaaagacctttttgtcccatggtcccctagttgctaaatctgaggttatatgacatgccaagtctttagcctgctgctcagaaaaagagtcaggcattgctttacttgacatttcagttctctgttttttcacattatcagagccagaatcatttacaacaatttcgttgctttgggcatgctcatctttggtttttaatacc

SEQ ID NO: 39764 - DNA, 601 bp, Human
tacatcactagagggagattcctttcctgggctaaactctaaagaatcaggagatttggtgggggaggtttcggtttcctcgagaggtgggcataaacctacataactctggtgtttggaaactttgctgatttctgaataggtaactttttcatcttctatagaattaaagtgctgtgtctcaactgtctctttactcatgcttgactgggacaatttttgtgatagttcatgttttggaaatgccgactgttcacaaaaaccatcgggaatattagaagacagcattctcctctcatcrgcaactctgacgggaatgtgtgacactgctgagctctcgctcctcctggaaggctgatcaagcaatccgcctggatggtccccttctttcacaacatattccctatataagacttttttggagggagattttacagtcatttctttaatttctgagagagagccgtttgttaacaatttgcgttctctctcagtcacagacataaattcattcttttgatcaacacttttactctcagggtgaccaatgtgattctctcttacatcatgaacaagtacatgcgaaagtttttctttctga

SEQ ID NO: 39765 - DNA, 601 bp, Human
tttgaaggtatattttttaactgggactggctgataaatagattcgtcatcgcttgaatcactgacgtctgccccgggaggaactggtgaaggtggctgcactctaatgacaggttcagccagctggtacttgtcatgctcatcttgcagattgacttcaatcatgtcaacctctttttctgggagataatgatgcttcttatctgactcaatctggtccgcatccagtggtggaggagggggaaattcaatataggcaactctgttatttttgggtctttggttagagtctttgctcacrtcattaggcatttcacgctcaactgctgtttcctccactgtagtctgcttaagggaggttgacttggcctgttcctcctcctctgactcctcagaaacctcgggaattgggctgggtttgcctggtatataagctatgagcgagtcaggtgtcttagatgtaaattcataactcacttcctctgaactgggtgtttctggggttaaagggcttttcccagagctgtctagaaaggatacttgctctagagtatcatcttctggactaccttggggagaaggaggttgcttttgctgtcta

SEQ ID NO: 39766 - DNA, 601 bp, Human
gagacaatactcctactgcccaataagccttcatgacaaaactgtatccattgtctagagacttaataaagagcaaagacactgacactaggaattttaggtttatggcttttcgtctggctattaagccacatctccaaaaatttactctgactgtatttgcttaaggaaaataatctaacagttctaggcatataataatgcaaaacaaacatttgctccagtatattttcagattacaatgtccaatgttaaaatataaagttgatattagtaaatatgcatacataataaattactrttaactctcaactgcctacaaaacattattcagaccacctatctatcttttcagaactccactcagctcccaaccattagcagtatacctgagagcaagcagagactaggttgatgaagagaggagggtttgaaatggggtagtggtggtgggggtggacggggactgagggcattcaaaggaaaaaaaaaattagatgaaattgcttcctattatctagtttcatattctcccattaaatagagataactgtatggaatgtatgttgctaatggtatgcaggatgaatttagatgtgat

SEQ ID NO: 39767 - DNA, 601 bp, Human
ggaattttatagtcaagctcaagtacagcctcaggaattaatttttatatacttggcttcatagcaaagtagtgaccatacacaggctgtgacttaactctccttaggtaatgacttacaatcagattttttttagagaccatcttataaagatttttagacttaggctgggcacagtggcccatacctataatcccagcacttcaggaggctgaggcaggtggattgcttgcacccaggatttgagaccagcctgggcaacatggcaaaaccccggtctccatacacacaacaacaacarcaacaacaacaacaacaacaacaacaacacaaaaattatccaggtgtggtggcacatgcctgtggtcccagctactcaggaggctgagttggatcacttgagcccaggaggcagggggtgcagtgagctgagattgtgccactgcacttcagcctgggcaatagagcgagaccctatctcaaaaaataaaacaagatttttggagtttgcaaagaggatgttggatgattgttttaattcagccaaattctctataatttgagcaaattacaagatacgtagaggtatacaattcatgta

SEQ ID NO: 39768 - DNA, 601 bp, Human
agggaattttatagtcaagctcaagtacagcctcaggaattaatttttatatacttggcttcatagcaaagtagtgaccatacacaggctgtgacttaactctccttaggtaatgacttacaatcagattttttttagagaccatcttataaagatttttagacttaggctgggcacagtggcccatacctataatcccagcacttcaggaggctgaggcaggtggattgcttgcacccaggatttgagaccagcctgggcaacatggcaaaaccccggtctccatacacacaacaacaaaaacaacaacaacaacaacaacaacaacaacacaaaaattatccaggtgtggtggcacatgcctgtggtcccagctactcaggaggctgagttggatcacttgagcccaggaggcagggggtgcagtgagctgagattgtgccactgcacttcagcctgggcaatagagcgagaccctatctcaaaaaataaaacaagatttttggagtttgcaaagaggatgttggatgattgttttaattcagccaaattctctataatttgagcaaattacaagatacgtagaggtatacaattcatg

SEQ ID NO: 39769 - DNA, 601 bp, Human
gtaatgctcaattgccacaaaaagaaaagggaattttatagtcaagctcaagtacagcctcaggaattaatttttatatacttggcttcatagcaaagtagtgaccatacacaggctgtgacttaactctccttaggtaatgacttacaatcagattttttttagagaccatcttataaagatttttagacttaggctgggcacagtggcccatacctataatcccagcacttcaggaggctgaggcaggtggattgcttgcacccaggatttgagaccagcctgggcaacatggcaaaascccggtctccatacacacaacaacaacaacaacaacaacaacaacaacaacaacaacacaaaaattatccaggtgtggtggcacatgcctgtggtcccagctactcaggaggctgagttggatcacttgagcccaggaggcagggggtgcagtgagctgagattgtgccactgcacttcagcctgggcaatagagcgagaccctatctcaaaaaataaaacaagatttttggagtttgcaaagaggatgttggatgattgttttaattcagccaaattctctataatttgagcaaattac

SEQ ID NO: 39770 - DNA, 601 bp, Human
ttggatgaacctaacagttggcttatctaaaatattacatttatgcagttttgaaagttaaaataatataatttcggcatacttgtggcattttttccgtctctggtaacccatttttttaataacatgaagctctgagaaattaaagaatttggattttccacacgtatttgattgatttcatccactgaaaaattcagttcccttgccagttctgtagaaaagaaagagagttactaagattgcatattctacttttatcacacgtttcataaaagtaatgctcaattgccacaaaaaraaaagggaattttatagtcaagctcaagtacagcctcaggaattaatttttatatacttggcttcatagcaaagtagtgaccatacacaggctgtgacttaactctccttaggtaatgacttacaatcagattttttttagagaccatcttataaagatttttagacttaggctgggcacagtggcccatacctataatcccagcacttcaggaggctgaggcaggtggattgcttgcacccaggatttgagaccagcctgggcaacatggcaaaaccccggtctccatacacacaacaa

SEQ ID NO: 39771 - DNA, 601 bp, Human
accctcatatttggtacttagcattttaatgactttctagggtcaagttgacacaggcaaacccataataatttattccacattgttgtgggttggcacttgccaaaatataggactaccacccaatcccaccagccaacaaaaccaaacccaacaacagtagagccaaccaagctgaataaaactatttgctcccctaatatgatcctgtcttccctctctgcacatccacctccagccatagtggtaacttcggagtgtttctgatgactgtgtcccatgatttaacaactaaaattaygttttcagtttttatggtcacagagagaatgtcaggccagatgcgaaaaattccctgctacttgctttccaaaaagcttctgaagaatagaagtttagactgttaacactaaattaaacaagtataacttcaaaagacttgctattacctcatgatcacttagttttctatattaaagattacagaaaattacaacactacttggatgaacctaacagttggcttatctaaaatattacatttatgcagttttgaaagttaaaataatataatttcggcatacttgtggcattttttccg

SEQ ID NO: 39772 - DNA, 601 bp, Human
ctactcaaaattcattatagaggctgggtggggtggctcatgcctgtaattccagcactttgggaggcagaggtgggtggatcacttgaggtcaagagttcgagaccagcctggccaacgtggtgaaacccccatctttactaaaaatacaaaaaatttgctgggcacggtggtgcacgcctgtaatcccagctactcaggaggctgagacaggagaatggcttgaacccaggaggcagaggttgcagtgagccgagatcgtgccattgcactccagcttaggcgacagagcgagacttcrtctcaaaaacagaacaaaaattcattgtaggaataaattttcatttgtgagcctaagacaggactattttgaaaaacataggaagatatttattatgtttttcttaatatttcagtgaagaaagcacaatttacataatgaggaaaaaatgacaagatcattatataaattaagctaatgtgaaagaggaattgttgttagtaacatgtatgccgactgaattagaaattatgctgcctttgatatacaatagatcaagcagtttttccaaagaataaatggcagcatattcatgaagtt

SEQ ID NO: 39773 - DNA, 601 bp, Human
taaaagttcaacgaagaggagagacaggaaaaaagcaacaaaccacagtttctgaattgttggtctacaaaataaaagtctaatttttccatcagtcccaggtaaataccaacttagctgctgttgtaaactcaaattgctataggtaagtgaacatttttcagttatggtcatctataaaccagactcttgttgaaaagctggctaagattagctgaggtttataatctgcctaagtgaaattacttcatatacatgtttctaaatttccctaagaaattttgaaaaaggaatttaaaawtattaagatacagcaacaaaaagccatttcatttttgactgtattttaaggatattccaattttaaaatgttcaaattaaatgaagctttcaacacaactacttctgttgtgttctggtgatcttttttattagagttacttaacaactattttttccaataaagaatattagaagaatgtataaactataacttatcaataatttaaaatttgataagatgatctatatttatctagtgcaaaaagcatgtggttactaatatatggccttgcatataagacaaggcctcaaagggagc

SEQ ID NO: 39774 - DNA, 601 bp, Human
gaaatgattgtttgttagattttagagcagtggcactgggaaaaaaattttaaacgatgttaagaaaaggattgaaaaaacagaccaagtttaaaagactccatgtagttttagggtgttgtacaaaaacagatatgaccaagatgaaagggttgtggggtacatgaaggtcttggtgaagtcggtggtagggtccactcagaaccacgaatcaaataaagagaaatgatacacaacagagatagtaggaaaaccattcgcagggagcactctgaatattcacgacaatgctatgaaacayagagtttattaaccagcctacacaaaaggggaggggggaacgaatcccttgttttaaacattgctgcatggactatggaagcatttttctgcctcagcagagagaaaagtcaacaatggtctggtcatggtgaggaaaggaagtttcataaaagttcaacgaagaggagagacaggaaaaaagcaacaaaccacagtttctgaattgttggtctacaaaataaaagtctaatttttccatcagtcccaggtaaataccaacttagctgctgttgtaaactcaaattgctataggtaagtg

SEQ ID NO: 39775 - DNA, 601 bp, Human
accaatttttatcattaattacctacaacttttatattaattacctacaacttattttaagaactgtacatatgagcaaagcaacctagttcttctttcacatgaaattatagcacagaaaaacggatttaatctttggaaagaaatgattgtttgttagattttagagcagtggcactgggaaaaaaattttaaacgatgttaagaaaaggattgaaaaaacagaccaagtttaaaagactccatgtagttttagggtgttgtacaaaaacagatatgaccaagatgaaagggttgtggrgtacatgaaggtcttggtgaagtcggtggtagggtccactcagaaccacgaatcaaataaagagaaatgatacacaacagagatagtaggaaaaccattcgcagggagcactctgaatattcacgacaatgctatgaaacatagagtttattaaccagcctacacaaaaggggaggggggaacgaatcccttgttttaaacattgctgcatggactatggaagcatttttctgcctcagcagagagaaaagtcaacaatggtctggtcatggtgaggaaaggaagtttcataaaagttca

SEQ ID NO: 39776 - DNA, 601 bp, Human
caccaatcttaaaggagaagagatttcagaacgcttctctatcaccagtaaaaaataaactgctggccggactcagtggttcttgcctatattcccagcattttgggaggctgaggcagaaggatcccttgagcccaggaatttgagttcggcctgggtgatgtggtaaaaccatgtctctaccaaaaaactacaaaaattagtgggcacagtggtgcatgcctgtagtcccagctacttgggaggctgaggtgggaggatcgcttgagcctgggaggcagaggttgcagtgagcaaggaytgagctactgtacaaaaaattgcgccctgtctccaaaaaagaacaaaacaaattcctgtggtcaagactgtggtattcccccaagtaccccaaattccaattctttgtatatgttttcagtcatgaatcctgccgttacttttccaactctaatacctttacttgaatctcatttttctctactcttgacctctgctaatctcactagtgatttgagggttgcacacccttttctacctactgagagaactgtttttcccttaactattaaaactctttcctttccaatgctttctttta

SEQ ID NO: 39777 - DNA, 601 bp, Human
atgccctttaaaacacagcagccttattaacctaatatgacactgctagaatggttacaaatgattggcttactgaaaggtgtctacatcttatagccagtacacaatacagtaataattttacagcgtgctgccattctactagctaaggatttctgttcagtcctttttaaatacccccgactggggccttttatgagcaccatccacctctaaagcggcaagcatttacccccttttaagcactaacagatagcatccccccaccccctaaagcaactaccgtataggttattttttkttgttgtttttaggtcatttcattgaaaaattggcaatagcaacaaatattagatgaagggctttgtgtttacagataaaatcttttgtgttgcagtatactgtagtgtttgcaaaattggaaaagatttaatcaaaataaggtgatacacatgcatcaaaatattagtattctgaagaaaaaaatttttcacagaactacagaattcctcattttgggaattatttaaatttgcagcagattttaaagatttgtttttttttaaaatcaagctagcagttttgcatatacaaacattat

SEQ ID NO: 39778 - DNA, 601 bp, Human
aagcagctaaagcgtgtatgtggggcggagggtgggggcaacttcttggtcctagcacttccatatattgattttcttttctggctgcttagtgggaggagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcayggatatttcaggtcagtctttgagttgggtaggagcatgcatccctggcactgccacatcccactctgactctctcgggtctgcattctttctttgagaacacacagttccccattcttatcctgacctctgggctttcaggactgccaagaacattggggatcctgccagaaatgaggggagcttgagctttcgttggcttctatttggggtagaaggagattgatgtgcagagcagcttccactcatctgacttttcatgggtctctgggaacaatttccaaatggtaaactctctgg

SEQ ID NO: 39779 - DNA, 601 bp, Human
gagaacaagtcaagggataacataaaatcttaatccatggaagcctagcaggaggctggacatgggctggaactcctgcttctcgttattaggaggaactgttgctctctcctttccgtctcagaaccagaggcaaaggcccagcctcttctgctgtgagtggtgtggaactaccaacctgcctcgtattaactgcaacatctataaagtatgagctccagccaatgctgctctagattcctctttcttcagagatgatgaattattgtagctcctagccctttcttttttctttctttctttttttttttttttgagacagagttttgctctcgtcgcctaggctggagtgcagtggtgctaattcctgacctcaggtgatccaactgcctcagcctcccaaagtgctgggattacaggcgtgagccaccgcatctggcccctagccctttcaatgaatttcagggaattgtgaaaattcctttgttgagataattgtttaaatataatatagttcaccagccaggcctcaaaaaactcagtatttctcatttccttatttagaaatagagctttttgtaatgtaaacaattaaaaaaat

SEQ ID NO: 39780 - DNA, 601 bp, Human
cttttagccctgcatgagcccaaacccccaagcgtcccgactggctgcagctggcactcactgtaggggttctcctcgtgggtcccgctgatccggccgtcggggagcacctggaggtgaaagccgatgcccacgttgcagtagagcctccgctgccgcttgatccccaccaaatagccactttcccagttcaccccggcaatctctccagctagccccgcgcgagacctggacagcagggtgccccagcccctcgagtccagcagcgtgttgttggcacgggtgcctgcaggcgagggcrccaccatgcccactaggatgcctaggaagacgagagcccacagcgtgccctgcagacgtcctgctccccgggacatagtgatgaacagtttctgtcccagggccatccaccttgcctctcaggcacgtggtcagaattaatggccctaaaaataccgcccttcttgtttttctccctccggcatggcggcaggggcttatttttggaaggcagatgaaggctgctgacatgaaaccaaagcctccatcgggcactcgggttgagagcagagggacccaggctgagccgcggccggtagag

SEQ ID NO: 39781 - DNA, 601 bp, Human
cctaatggtcttacaaggcatcagatgggccagtaatgctgaaatagttagtgccactgaggatctaaccaaggcgatggcaaagaacaccaggatgcttggaccgcagtatattgagcttgcacccaggcagggtcacgtggaatcatctaagtggtgagcagcatttctgccccctttatcgtgcatcctgtccgctagagcagggccccttcaccttttagccctgcatgagcccaaacccccaagcgtcccgactggctgcagctggcactcactgtaggggttctcctcgtgggtyccgctgatccggccgtcggggagcacctggaggtgaaagccgatgcccacgttgcagtagagcctccgctgccgcttgatccccaccaaatagccactttcccagttcaccccggcaatctctccagctagccccgcgcgagacctggacagcagggtgccccagcccctcgagtccagcagcgtgttgttggcacgggtgcctgcaggcgagggcaccaccatgcccactaggatgcctaggaagacgagagcccacagcgtgccctgcagacgtcctgctccccgggacatagtgatg

SEQ ID NO: 39782 - DNA, 601 bp, Human
agtgggaacttgagccgacaagggcatctcagtccatcccccttctcctagaaagccagactctccatcgccctatccatgatccctctaactctaggagaccctggctgctggactcatcgagtgctgccattgtgctgttagaaatccagttctgcaagggaaggttctgatagcagagttaggggctgcagtgaccacttagctatctgtttaagatgagctttgaatctgggctttcagtgacataattacttgaggtccttgacttgagtaaaaaaataaattctgattcttcttmttcttcttaatgtgtactctacatgtttcaacaaatctcaacccacttaatcttgaaaacacagcagccacaccatagctgatggctttcttggatcctgcagcccccatcctttcttggataggagactaaccatacagcaagctggcagcttgcaggcagcttgcaggataagaacctggggacagagggagccgctgaaataaaaagaaggatgtgcttcagttggacattttgcaattgaatttcccttccttctccaagaaagaagctgaataaaaatgagcttgtgtcaaattt

SEQ ID NO: 39783 - DNA, 601 bp, Human
cagagtgggaacttgagccgacaagggcatctcagtccatcccccttctcctagaaagccagactctccatcgccctatccatgatccctctaactctaggagaccctggctgctggactcatcgagtgctgccattgtgctgttagaaatccagttctgcaagggaaggttctgatagcagagttaggggctgcagtgaccacttagctatctgtttaagatgagctttgaatctgggctttcagtgacataattacttgaggtccttgacttgagtaaaaaaataaattctgattcttmttcttcttcttaatgtgtactctacatgtttcaacaaatctcaacccacttaatcttgaaaacacagcagccacaccatagctgatggctttcttggatcctgcagcccccatcctttcttggataggagactaaccatacagcaagctggcagcttgcaggcagcttgcaggataagaacctggggacagagggagccgctgaaataaaaagaaggatgtgcttcagttggacattttgcaattgaatttcccttccttctccaagaaagaagctgaataaaaatgagcttgtgtcaaa

SEQ ID NO: 39784 - DNA, 601 bp, Human
aatcagagtgggaacttgagccgacaagggcatctcagtccatcccccttctcctagaaagccagactctccatcgccctatccatgatccctctaactctaggagaccctggctgctggactcatcgagtgctgccattgtgctgttagaaatccagttctgcaagggaaggttctgatagcagagttaggggctgcagtgaccacttagctatctgtttaagatgagctttgaatctgggctttcagtgacataattacttgaggtccttgacttgagtaaaaaaataaattctgattmttcttcttcttcttaatgtgtactctacatgtttcaacaaatctcaacccacttaatcttgaaaacacagcagccacaccatagctgatggctttcttggatcctgcagcccccatcctttcttggataggagactaaccatacagcaagctggcagcttgcaggcagcttgcaggataagaacctggggacagagggagccgctgaaataaaaagaaggatgtgcttcagttggacattttgcaattgaatttcccttccttctccaagaaagaagctgaataaaaatgagcttgtgtc

SEQ ID NO: 39785 - DNA, 601 bp, Human
acgcctcgctccacagtggaaatttccagcaggcctgacaaggaaaggggggccacattacctaaggcttgtgcaaatcagagtgggaacttgagccgacaagggcatctcagtccatcccccttctcctagaaagccagactctccatcgccctatccatgatccctctaactctaggagaccctggctgctggactcatcgagtgctgccattgtgctgttagaaatccagttctgcaagggaaggttctgatagcagagttaggggctgcagtgaccacttagctatctgtttaagaygagctttgaatctgggctttcagtgacataattacttgaggtccttgacttgagtaaaaaaataaattctgattcttcttcttcttcttaatgtgtactctacatgtttcaacaaatctcaacccacttaatcttgaaaacacagcagccacaccatagctgatggctttcttggatcctgcagcccccatcctttcttggataggagactaaccatacagcaagctggcagcttgcaggcagcttgcaggataagaacctggggacagagggagccgctgaaataaaaagaaggatgtg

SEQ ID NO: 39786 - DNA, 601 bp, Human
aaggatatgtctcttctgtctcatctcactcgccctccagctttcaggttcagtgtaacatggggagtgggtggtcccctgccctccagaggccatgtagcctgctgacccccaagcctgcctgttcctcagaaacacctggcaaatttaaaatacaaaaacaaatggatttccaggcccacacgccagctctgctgaataagaatctcctaggtaggtacctggaaatccatacttttaataagtttccaaggtgacagagatgcaaactgtccacagacccgtgtgggagacccactgrttgtagtgcatgccgtatgtccacataaaccaacccagactgagagatgttagcactaaagattatggggtggaggccacctggtgaacccgttcttgtatttcatagacctcctctgttgggacagctcccctgggacccagtgccagtcctggatctatttcttcacatcccagtcctcagtttatcctccaaggggcagtagatcagctctccacaccctccccataaataactttgatattttttgaggcctgctctgaggtcttcctttttagcttgcttatttctgtcaaagga

SEQ ID NO: 39787 - DNA, 601 bp, Human
aaagaaggggttctttgggatgccccaccctacagaggggaaacctgctccatcaaaacctgggttggtcccaggcctcttcctgtcctcgccatcactttcccagagagcggtaacaaggatatgtctcttctgtctcatctcactcgccctccagctttcaggttcagtgtaacatggggagtgggtggtcccctgccctccagaggccatgtagcctgctgacccccaagcctgcctgttcctcagaaacacctggcaaatttaaaatacaaaaacaaatggatttccaggcccacaygccagctctgctgaataagaatctcctaggtaggtacctggaaatccatacttttaataagtttccaaggtgacagagatgcaaactgtccacagacccgtgtgggagacccactgattgtagtgcatgccgtatgtccacataaaccaacccagactgagagatgttagcactaaagattatggggtggaggccacctggtgaacccgttcttgtatttcatagacctcctctgttgggacagctcccctgggacccagtgccagtcctggatctatttcttcacatcccagtcctcag

SEQ ID NO: 39788 - DNA, 601 bp, Human
agacaactagtagaggaagcttgtgttagaagccctaaccttccccttgctgctctctctcctccgccctcagcacccacatctgtggggtttggaaggccaggaggcctgtggcatgaaggagagatagtgcattttttctgaatgcttcaggctgatgggattttcccgatgcccagagtgatgctcaagacccagccccttaattcatcttcatcagagccctgagctttgagttctcatggcttgggaatgttggcccctcagctctggtgaagaacgcactcgagccaagtgaacrccatgttcataaaagcagctactgtatatgattacttgaataaatgaaaatcattccactgggtcacatttcctgggcctgccaggctcaagccccagcatgaaaatatcttcaatttgatgtaggtctattcagacttatgtgcatttggcactcactatggagaagggcatttctcagaggagcaagcatatccatggggtagaggtgcctccaaagtgtgaggtggacaagacagccaccctctcgcctttagagctaagtcacttggaccaacgaggatctaatcctgcttttaaa

SEQ ID NO: 39789 - DNA, 601 bp, Human
aacatgattgtttaagcatgcatgaccatggatgcgtagattgtactttgcttctctggtcattcgattttggatcattcaaatccactccccctcaacatacacactttttttttttctgtttctatttttttttcaagtttactacttttttttctttccattctgcccttttctctagcctgtctcatatccctggccttccccagaatcctgtacaaaactaaagtgaaaaaagacaactagtagaggaagcttgtgttagaagccctaaccttccccttgctgctctctctcctcygccctcagcacccacatctgtggggtttggaaggccaggaggcctgtggcatgaaggagagatagtgcattttttctgaatgcttcaggctgatgggattttcccgatgcccagagtgatgctcaagacccagccccttaattcatcttcatcagagccctgagctttgagttctcatggcttgggaatgttggcccctcagctctggtgaagaacgcactcgagccaagtgaacaccatgttcataaaagcagctactgtatatgattacttgaataaatgaaaatcattccactgggt

SEQ ID NO: 39790 - DNA, 601 bp, Human
cagaataaaggatgaatatagcaactgatcagcaattccactcctagaaatttatcttactgatatattcccacacacgcacaaaagttactacagcattaaataacaaaagaccaaaaacaatgtatctattaagagaggagtagctgaggtggctcacgcctgtaatcccagcactttgggaggccaaggtgggtggatcacgaggtcaggagattgagaccatcctggtcaacatggtgaaaccgcatctctaccaaaatacaaaaaattagctgggcatggtggtgcatgcctgtartcccagctacttgggaggctaaggcaggggaatctcttggaccggggaggtggagattgcagtgggccaagaccgcactccagcctggtgacagagcgagactctatctcaaaaaaaaaaaaaaaaaaaaaaaaaaagaggagtaactaactcaattatggtagatccacatgatggaattctataagccttgaaaagataagaagcctctctgtaatgacatgaaatggcctcaaagatacattgctaagtgaagacacaaggtttgaaaaagtgttggcatagtacgctcttgtttgt

SEQ ID NO: 39791 - DNA, 601 bp, Human
ttagtggccagatttcaaagagaaaagcgtttgacactatgctctcattagtgagggcacagaaactaggaattctcatttaatgtcctctgatgtgtatactgttataatctctataaagagcaatttggcagcatctaccagaataaaggatgaatatagcaactgatcagcaattccactcctagaaatttatcttactgatatattcccacacacgcacaaaagttactacagcattaaataacaaaagaccaaaaacaatgtatctattaagagaggagtagctgaggtggctcaygcctgtaatcccagcactttgggaggccaaggtgggtggatcacgaggtcaggagattgagaccatcctggtcaacatggtgaaaccgcatctctaccaaaatacaaaaaattagctgggcatggtggtgcatgcctgtagtcccagctacttgggaggctaaggcaggggaatctcttggaccggggaggtggagattgcagtgggccaagaccgcactccagcctggtgacagagcgagactctatctcaaaaaaaaaaaaaaaaaaaaaaaaaaagaggagtaactaactcaattat

SEQ ID NO: 39792 - DNA, 601 bp, Human
atacattttgttactatattcagaaccctaaactcactggagaatgaacagcatttataaaacagaaaattcccaggaaaagaactatcaatggcatttgagcagaagagaatatgcctaataagagaaatgtaagttataactgtgagatcccatttttagtggccagatttcaaagagaaaagcgtttgacactatgctctcattagtgagggcacagaaactaggaattctcatttaatgtcctctgatgtgtatactgttataatctctataaagagcaatttggcagcatctaccrgaataaaggatgaatatagcaactgatcagcaattccactcctagaaatttatcttactgatatattcccacacacgcacaaaagttactacagcattaaataacaaaagaccaaaaacaatgtatctattaagagaggagtagctgaggtggctcacgcctgtaatcccagcactttgggaggccaaggtgggtggatcacgaggtcaggagattgagaccatcctggtcaacatggtgaaaccgcatctctaccaaaatacaaaaaattagctgggcatggtggtgcatgcctgtagt

SEQ ID NO: 39793 - DNA, 601 bp, Human
tggggaaaaggacctggttcccaatgtgacaggtgaggccaaggagcctgggaccaacaaaaaaatggccctttccatgctaattttgtagagtgtgtgtggaccacctgttcagaacatgaacgctggacttcctgtcacatgaacactggacttcctgtcacatgaacgctggacttcctgtctcgcatgcacagattcattcccagtacatcaccccaagtcctcctctttcctctgcaacctgcctgggtggctgccctaagggagtatgcggggatttcctgctcttgtggggaarcagctgggtcggggctagaagaacagagagcgaggtgggagccagagacccgggatctactcttgaaaagaaatatagaatgagaaatggatggaggataacttctgactccttcttgcttgagtataaaaaaaaacccgctcgatggctactgggctgtgccagaggtgtcctctgaccttctgtaaaggaatcgtactgctagtgtcccatcttgctggcagtgtagctggacgagaacctcttgctgttctgaagggctggttagtagcttgctcctcagggccccaagactcccag

SEQ ID NO: 39794 - DNA, 601 bp, Human
tggaacagtttcatccccaaaccgtccccccatgtccccatcactcaccctgtccatggaaatagtcttccatgaaactggtccctggtgccaaaaaggctggggactgctgtccaagacaatcatagttctccagggacatgcaggaacagaaatggtgaggagcaggaatttttatggggaaaaggacctggttcccaatgtgacaggtgaggccaaggagcctgggaccaacaaaaaaatggccctttccatgctaattttgtagagtgtgtgtggaccacctgttcagaacatgaaygctggacttcctgtcacatgaacactggacttcctgtcacatgaacgctggacttcctgtctcgcatgcacagattcattcccagtacatcaccccaagtcctcctctttcctctgcaacctgcctgggtggctgccctaagggagtatgcggggatttcctgctcttgtggggaagcagctgggtcggggctagaagaacagagagcgaggtgggagccagagacccgggatctactcttgaaaagaaatatagaatgagaaatggatggaggataacttctgactccttcttgcttga

SEQ ID NO: 39795 - DNA, 601 bp, Human
gaccaggggtccccgacccccaggctgcagacccataccagtcagcggcccatacccgtgcgggacctgggctgtacagcaggaggtgagcggtgggtgagcgaagcttcatttgttttccagccactccctattgcctgcaagaccacctgagctccacctcctgtcagatcagcagtggcattagattctcataggagcaagaaccctgttgtgaactttgcatgtgagggatctgggttgcctgctccttctgagaatctaactaatgcctgatgatctgaggtggaacagtttcatycccaaaccgtccccccatgtccccatcactcaccctgtccatggaaatagtcttccatgaaactggtccctggtgccaaaaaggctggggactgctgtccaagacaatcatagttctccagggacatgcaggaacagaaatggtgaggagcaggaatttttatggggaaaaggacctggttcccaatgtgacaggtgaggccaaggagcctgggaccaacaaaaaaatggccctttccatgctaattttgtagagtgtgtgtggaccacctgttcagaacatgaacgctggacttcctgt

SEQ ID NO: 39796 - DNA, 601 bp, Human
aaaagtagtcccagggacattgccttggttggggaagcccctaggctggacagatcacctagcccagggtgtgctgggctcaagccacccgagccctagcaaggagtcactgacacatttcctggaagcaaaggctaagaagcatctgtacaggcataaagaggaaacatggctttatgtctgacaagaagttttgtcctccccaaggcatatggcatcaaggctgggcctaacccagtctcatgaccttgtgaatccagtccacaaacacagagacacgcgtgaagacagctggccagcrggaccttgcgcatactcggttggggattataattccttccaggacccagcagttgtgggtaaagcaggcaagtgggcccccgtagtcaccctggcaggtaggagaactgatgagggccccgggccacagcaatgactagcctgcttcatgataaaatagttcatttctagccccccatacccttccagggctggcccagggccctgccaccaacctcacaggcccccacaggggccaacagtccctcagtgcacatctcactctcacgcacacgtcctcggtgcttgatgttacactcct

SEQ ID NO: 39797 - DNA, 601 bp, Human
ctttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatrtagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatg

SEQ ID NO: 39798 - DNA, 601 bp, Human
aatgtttgtttgcctaatttctgaactgatgcagttatctgtgttttaacctgtgatttcaatttttttttagtattagaatatctagagtttgtttagacataggtatcagtatcattgtaactaattgcagtgagggttgtctttattggaagcttggttggcattgatttcctcatagagcataaacgagataatatactgaaagaactttttaaactaaattacatagcactacataaaaatttacaaaattctaagtgtcgttgttagtagtagtataatttgatttggtcaatcmctgagtaacttaacaccctgaaaattccccttcctcatatggaccatgtttctatgcctgattttcccagtatttttggttgttgattgctggttagttggttttaggtgtcagggaagaagatagaatatatttcttgtcttttccctttccactttagttcatagaattggactactttgtgttaaatattaagcttacacctttacataataaagtggaaaattcaagcaattccaagggttaaaacatttttacctcaaatatccatataattgacttacaaacataaaacttgca

SEQ ID NO: 39799 - DNA, 601 bp, Human
aagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatsattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaaca

SEQ ID NO: 39800 - DNA, 601 bp, Human
cacgaggtcaggagatcgagaccatcctggctaacacagtgaaaccccgtctctactaaaaaacacaaaaaattagccgggtgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaagactgttgaggaattaatgagcgtatgtatatatatatatatgtgtgtgtgtatatatatatattcatatatatatatataatgcctagtttagcatataatacatgctacaccctttcctacagatattataaatgacgtgtacagggttttatacattgctaacagcattaagactagaaaatcaaggcccttgacttgggttcagtgttctttctgccacactctgttctgttttgtcaataatgcttattaacttattctttgatttttttttaaacaaatgttgactttttaaaattcttctgagggtatatatttgatactcaaatatttaattatagcatttgaatacttagatgtct

SEQ ID NO: 39801 - DNA, 601 bp, Human
cagcactttgggaggccgaggtgggcggatcacgaggtcaggagatcgagaccatcctggctaacacagtgaaaccccgtctctactaaaaaacacaaaaaattagccgggtgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaagactgttgaggaattaatgagcgtatgtatatatrtatatatgtgtgtgtgtatatatatatatacatatatatatatataatgcctagtttagcatataatacatgctacaccctttcctacagatattataaatgacgtgtacagggttttatacattgctaacagcattaagactagaaaatcaaggcccttgacttgggttcagtgttctttctgccacactctgttctgttttgtcaataatgcttattaacttattctttgatttttttttaaacaaatgttgactttttaaaattcttctgagggtatatatttgatactcaaatatt

SEQ ID NO: 39802 - DNA, 601 bp, Human
cgcctgtaatcccagcactttgggaggccgaggtgggcggatcacgaggtcaggagatcgagaccatcctggctaacacagtgaaaccccgtctctactaaaaaacacaaaaaattagccgggtgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaagactgttgaggaattaatgagcrtatgtatatatatatatatgtgtgtgtgtatatatatatatacatatatatatatataatgcctagtttagcatataatacatgctacaccctttcctacagatattataaatgacgtgtacagggttttatacattgctaacagcattaagactagaaaatcaaggcccttgacttgggttcagtgttctttctgccacactctgttctgttttgtcaataatgcttattaacttattctttgatttttttttaaacaaatgttgactttttaaaattcttctgagggtatatatttga

SEQ ID NO: 39803 - DNA, 601 bp, Human
tctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataaggtagctagactttttttaaaaacataaaatgattttatgccatattaatcactactctagtatttaatcatcttagaatctgtaattctgaaaccagtttttggcacaaytgtaggatactgttcaccaattatgaaaatatatcataggaccactatgtagaaataaattacccaattaccatctctgcaagagttataagctgaatgtttagtcttactacttgagctttgtaataatgtggaagattatcaaaggtaaaaagattttatcagagtgcatgttttgaaagaaagagggtggggagggttaggcctcagtgtctataaatgaaaagcattttagagttttaatatttgaccatgtgatatctcagtacatttatgatatcctaatcctttgaaactaag

SEQ ID NO: 39804 - DNA, 601 bp, Human
cctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataaggtagctagactttttttaaaaacataaaatgattttatgccatattaatcactactctagtatttaatcatcttagaatctgtaattctgaaamcagtttttggcacaactgtaggatactgttcaccaattatgaaaatatatcataggaccactatgtagaaataaattacccaattaccatctctgcaagagttataagctgaatgtttagtcttactacttgagctttgtaataatgtggaagattatcaaaggtaaaaagattttatcagagtgcatgttttgaaagaaagagggtggggagggttaggcctcagtgtctataaatgaaaagcattttagagttttaatatttgaccatgtgatatctcagtacatttatgatatccta

SEQ ID NO: 39805 - DNA, 601 bp, Human
ccccctcaccttctgctggagctcctcaatggtcttgaagtaggactggtagctggggcacagcaagggctcctgctgctgggaccgctcctggatgagtttctccagctccgcgttgtcccgctccagctgacgcaccttctccaggtagctggccaggcggtcgttcaggaactgcatagtctccttctcgctgccattgaaggagccctcacagaaccagttgcagttgctcacattggcggggatgttgcaggccccaggcagggtgtagccgtggcagctggggggcacgcagggmcgggaggagcagctggtgcggcagcccaggctgggcaggcaacaactgtaagacatggtgctggaacaggtaatggaaaagcaggtaagctgctggaggtggatgtgggcaggtttgagtctctccttcctctgcagtccttttataccattaattgtgggtgggggcttggcatacagcatagtttcctttcctaatgcttcagctaatttttctccaaaatatgctagttagatgcttctaaagagtcccccctcaacccataaaattattccattcagcttatgtcacaccaggctc

SEQ ID NO: 39806 - DNA, 601 bp, Human
acatcttcactttcatcccttggaggtactgcatgcccagccatacccagatacaccctgccctgccacttctgtgtctttgttcaacctcttccctcagactgaaacacccaagtactggaatcctcctctttgcatctgagaagagttccctatctcctcttgggcagcctggattatttctagagcatactgcttgtacatctcatatggtacttgtttcactctgtcttgtttatatcactgtgtttatatgactgtctttctatactagactgtgagctcttttaagaaaagggcsatgtcttatttcttttttgtccctccatctccaccaccaaattcaggacctagcagtgatcagcagagagcagggctcaatgaatgatgtccctcctcagtaattccaacacctgcctaaccctcacccagccgctgaagaatgagcagctcactccactccttgatatggatgtagcaccgtcactctctgagaacatcttgagttcctcagagaagggtcccagaccagggatccagacagtaatcctctcctgattcccagtgctagtagcttagttctgaggcctgcttttgtgaa

SEQ ID NO: 39807 - DNA, 601 bp, Human
ttctgatcattcccaaagagtgacacacacattttatagcaataaactccaacagggatcacgtcaattgttgtcccatagaaacggaaacaacctcacaccttctacaagactaagtctaaactccttggcatatgcaagtccttcctcgcttcccatcacatcttcactttcatcccttggaggtactgcatgcccagccatacccagatacaccctgccctgccacttctgtgtctttgttcaacctcttccctcagactgaaacacccaagtactggaatcctcctctttgcatctgagaagagttccctatctcctcttgggcagcctggattatttctagagcatactgcttgtacatctcatatggtacttgtttcactctgtcttgtttatatcactgtgtttatatgactgtctttctatactagactgtgagctcttttaagaaaagggccatgtcttatttcttttttgtccctccatctccaccaccaaattcaggacctagcagtgatcagcagagagcagggctcaatgaatgatgtccctcctcagtaattccaacacctgcctaaccctcacccagccgctgaag

SEQ ID NO: 39808 - DNA, 601 bp, Human
tagatcacgccactgcactccagcctggtgacagagcatgactccgtcaaaaaaaaaaaagcactaaaaggaagattctgatcattcccaaagagtgacacacacattttatagcaataaactccaacagggatcacgtcaattgttgtcccatagaaacggaaacaacctcacaccttctacaagactaagtctaaactccttggcatatgcaagtccttcctcgcttcccatcacatcttcactttcatcccttggaggtactgcatgcccagccatacccagatacaccctgccctgmcacttctgtgtctttgttcaacctcttccctcagactgaaacacccaagtactggaatcctcctctttgcatctgagaagagttccctatctcctcttgggcagcctggattatttctagagcatactgcttgtacatctcatatggtacttgtttcactctgtcttgtttatatcactgtgtttatatgactgtctttctatactagactgtgagctcttttaagaaaagggccatgtcttatttcttttttgtccctccatctccaccaccaaattcaggacctagcagtgatcagca

SEQ ID NO: 39809 - DNA, 601 bp, Human
cctcccaagttcccatcgctcaccagcaggtctgaacaatacacaccaggttgtgctgggcctgcagctcgatctccagggcgttgactgtgcgtctcagctcgatgatctccgcctggcaggactgcagctgctctgagctggataccacctgcttgttcagctcctcggtctgaaacacccaagtggggaaaggatcagaccctgtctccagggccctggggcacctcgggtcctgagtggccatgtgcttagatgcccacctgcgtggcgaaccattgctccacttccctgcggttartttccaccagagcctcatactgactcctggtctcgttcaggacctggttcaggtccacagtgggggcagtgtccacctccacgttgaggcggtctccaagctgggagcgcagggtgttaacctcctgttggagaaaagggaaacaatgaacctacggcaatggatctgccattttcctgctccagggaaatgagcacaatactgcccaaaaagcactaaaaggaatattctgatcattcccaaagagtgacacacacattttatagcaataaactccaacagggatcacatcaattgctg

SEQ ID NO: 39810 - DNA, 601 bp, Human
ggacctggcctccttacagggttgggaggctcactccaaatcacgatccttttttaaaactgtaattttccctggtagagtgcttcacagtttacaagccccttaatttgaaaagctgaatgctctatgcaaacataagaggctctttcctagtaaatcaaagccggggattcatttccccagggcaaggggcagaggactgaataggaaaattgatttcagtgtccactcgtgggacgcacgagggcttgagctggtgtgagggctggatttctcagtgcctgggcctcctttgccctartctctggtaaatggatgacaaaactccagcctgtattcaaagatgcccccaggcgcagcttgaacaaggagctaatgcacaccagggcagcaaatgagaagaccgcacccacccccacgagtctcccggggagagaagcggttaactcccggcctgcatcctcttcatctgtgcttccagatgagaacagggctccctctccttcccgaggcttggcaaacgcctggatcctacgttgacaatccagctacatttcagtgggactccagaaagctcacatatcccctgtgctctttgctt

SEQ ID NO: 39811 - DNA, 601 bp, Human
gagccagtctgggctctctgagcgcacgcagcacccctcttggtcaattgtctcagcagaccttgcctgttgctttgaagcagctgaatgtcatctctcttaggagggaaaaaccctaatggcgacttgggcactttgttctatgaaatagcaacctgccaccagcttgccccagccctcccgaggtgataaataccatcttgaggctcctgctctaggtctctgtgtggggcaagttagggcatcaggctggccgagcttgctgtccctctttaggtccatcccttcttcctgttcactrcctcttccattaagcctggagcaaggacacggacctggcctccttacagggttgggaggctcactccaaatcacgatccttttttaaaactgtaattttccctggtagagtgcttcacagtttacaagccccttaatttgaaaagctgaatgctctatgcaaacataagaggctctttcctagtaaatcaaagccggggattcatttccccagggcaaggggcagaggactgaataggaaaattgatttcagtgtccactcgtgggacgcacgagggcttgagctggtgtgagggctgga

SEQ ID NO: 39812 - DNA, 601 bp, Human
ggcggggtgcagctggtggctggcactctccggggaggagtgcaggatggctcctgaccgtggcagcacaggcttgaaggctgtgggcctcactgcacccttctcggagccctgtagaggaaaaggaccgcggtgactcatgcctcccctgcgcgcgcattgcaccctccctccccaggcacgcgtgccgaccttgagccagtctgggctctctgagcgcacgcagcacccctcttggtcaattgtctcagcagaccttgcctgttgctttgaagcagctgaatgtcatctctcttaggarggaaaaaccctaatggcgacttgggcactttgttctatgaaatagcaacctgccaccagcttgccccagccctcccgaggtgataaataccatcttgaggctcctgctctaggtctctgtgtggggcaagttagggcatcaggctggccgagcttgctgtccctctttaggtccatcccttcttcctgttcactgcctcttccattaagcctggagcaaggacacggacctggcctccttacagggttgggaggctcactccaaatcacgatccttttttaaaactgtaattttccctgg

SEQ ID NO: 39813 - DNA, 601 bp, Human
cctggccccgcctgaactcaggcacggcttgttcttcttctgagcctcctgggagctgatggaagggaggtcagcccacagcctggctgggccttggtcatctggcttccggcttcatgatttaatggctcacttgggaaactgaaatctaggagccatgagggtgatggtggggacaggaggaagctcagatgtaagtcgatcccccaacatggtttgcagggagccccttctttgggtgataaagccagcacattagccccgcttgcctgcgcggtctgtgtttgcacgctattggccrgcaccagaaggagaggggggtactggcgccaaaccgctgaccacccaaacccatgagccctgtgtggcctcacctcccactgggtctcctccagcgcggggccgaagctggtcttctccctctcgtaggacctgagcttggtctccagcaggtcctgctccttcatgaggctctcgagctcctgccggagctgccgcttctcctgctgaagctgcagtacctgcaggtgcaggacctgctgcgcgcgctggctcttctgcgaggcctgcttgagcttgttgccgcctttgggctccgggc

SEQ ID NO: 39814 - DNA, 601 bp, Human
gggtgaggcaggcacgtggacagaccaagctgggtgcgagcatgtaaagagcctcaacgatgggcttgaactccatgagtcatccagaccaccaggctggtgagaaaagctgctttcccactaatagatgcagaggttatggggttctccagcacggtcaggtacagatgcctcatttccacgtgtgaccgggtgagtgagtgtgtgtgagtgtgtaagtgtgtgagtgggggactctttacttcctctcctaggtttccatctcagctcaccaaatagaagttccacttacacttcagcraggagtggccacttccatcactgaaacctgccaccaatagggtccctcttactagtgggtgcagtccctccctccaaagcaacaaatgcattctgtgctctcttgggcccctggccccgcctgaactcaggcacggcttgttcttcttctgagcctcctgggagctgatggaagggaggtcagcccacagcctggctgggccttggtcatctggcttccggcttcatgatttaatggctcacttgggaaactgaaatctaggagccatgagggtgatggtggggacaggaggaagctcag

SEQ ID NO: 39815 - DNA, 601 bp, Human
cccagatggccaagatccagagacacatgggtctaacctgtggcttcggttttcatcattgctcttggccaaattttgatgggggataggggtggaaatagagaagaagagcaagaggagaagaaaatgattcctcgtttgacagatgtggattgggctctgcatccaagccagcatgatactagtcactgggtacagcagtgaatttgtgaggtagtctttactccagtagacaggagagaggagggctgggtgcatgcaggggtgaggtcagaggatgtgggcataaacatcgatgacrgaaatcaggctgacaccaaaaccaataccattggtgttaaatgggggtgatacagctgccagcagtgggcaagttaaaccactggttgttgacttgcacatagccaggggtttgcgtgtagactgagatttggactctgaactgggggtgaggcaggcacgtggacagaccaagctgggtgcgagcatgtaaagagcctcaacgatgggcttgaactccatgagtcatccagaccaccaggctggtgagaaaagctgctttcccactaatagatgcagaggttatggggttctccagcac

SEQ ID NO: 39816 - DNA, 601 bp, Human
cggattttctccaggactgtgcagtgtttcactgagggcaaggggaaatttctactgtgaaaggaaatgtgaaggtggcttccaggctagttccaagaatccattctgtagagccacatgctctggacttcattcactcttaagattcagccagactggccttggtctcccatgaccccagatggccaagatccagagacacatgggtctaacctgtggcttcggttttcatcattgctcttggccaaattttgatgggggataggggtggaaatagagaagaagagcaagaggagaagamaatgattcctcgtttgacagatgtggattgggctctgcatccaagccagcatgatactagtcactgggtacagcagtgaatttgtgaggtagtctttactccagtagacaggagagaggagggctgggtgcatgcaggggtgaggtcagaggatgtgggcataaacatcgatgacagaaatcaggctgacaccaaaaccaataccattggtgttaaatgggggtgatacagctgccagcagtgggcaagttaaaccactggttgttgacttgcacatagccaggggtttgcgtgtagact

SEQ ID NO: 39817 - DNA, 601 bp, Human
ctgaggcacagagaggttatgatagcaaacagctggtgaagtgaccagcctgagggctaatatatatatatattatatatatatatatataaaatataaagtataagagtagagatttgatcccaacagtttaatcactataccccattgccaccatggctaatgtatttacaatcacctggatcataagtggtcaagctgaggttcaaagccaggcccatgcctcagccatgactgtgtcactcccttcgtggcatgaatacagggttggccttggaatgaaattcttggtcccaagcasgcatcctgggtagggtcggattttctccaggactgtgcagtgtttcactgagggcaaggggaaatttctactgtgaaaggaaatgtgaaggtggcttccaggctagttccaagaatccattctgtagagccacatgctctggacttcattcactcttaagattcagccagactggccttggtctcccatgaccccagatggccaagatccagagacacatgggtctaacctgtggcttcggttttcatcattgctcttggccaaattttgatgggggataggggtggaaatagagaagaa

SEQ ID NO: 39818 - DNA, 601 bp, Human
agctgctgcttcaggagggagatctcgcctgacttctggcacacctgccgagggtggggtggagacagagtgccaagaggtgagtgtccttacccagggaagtgacagctcagctgcctaaaataaccaagccactccggatgcggtggcccggtgttaggcattccagcctttgtccaatctgaaagtaagctgaacattgctgtgaccttttccccaggttatcgagctaggctatatagtaaaatgataaaataataatcatcatgtataatgacacatagtatattattattgttawtatttgagaagtctcgctttgtcacctaggctggggtgtagtggcgtgatcttggctcactgcaacctccgcctcccctctgattctcctgcctcagcctcccaagtagctgggattacagacacctgccaccatgcctggctgatttttgtatttttagtagagacggggtttcctcatgttggccaggctgatctcgaattcctgacctcaagtgctctgcctgcctctgcctcccaaagtgctgggattgcaggcgtgagccaccacgcctagccacacagaagtatattattataa

SEQ ID NO: 39819 - DNA, 601 bp, Human
ccccggcgctgtccccacgtgccagctgctgcagggccttctccaggcgctggttccgctggtacatggccacgtagctctgctgcagctgtttctggtactgaatcaccttctccttctcctccttccacacgagccgctcatgctggaagcccgaggacatctggtcatggccttgccgctcctcccgcagctcggcccgcagccgctccagctcccgctgcagggcagggacgtcctcggggaaggtgggcggccccatgtcgcgggccagggcggcctgggcccgcagctcctgcasctcctgctccagcaggttcaccttctcccgcagcagctccgcctcgttcttcttgcgctgcagctcattctcacagacctccagctccaggcccttggtgcgcagggcgccctccaggtcctgggtcctcagctccaggccctccagcttgccccgcgtgtccttcagctgtgccttgagacccaggatctcgctagccttggcgttcacctccgtctgggactccttcagctgctgcttcaggagggagatctcgcctgacttctggcacacctgccgagggtggggtggagacagagt

SEQ ID NO: 39820 - DNA, 601 bp, Human
cccttggattctccctctgccctcctctggctgtggcagggtctccacactgctgggctgcctgtctctcccctccttcctgtggcttgccggggctgggacagccctgaggtttcaaagccagcttccccgcggctcattccacccctacacctctgcggccagaggaaaatagctcaggttctgatggggctggttccaaggcttctggtcatatatggcttctttctatttccaaggcattccaatgtgtccaggaggaaaaagaggttgggatgagaagcggaggggagccgctgtwcttgctgtggccaccttccctggaggagggggagaggatatctatttcgaacaaaggccaaagtttagggagcccttaaccaaagcagacagacccctggacccatctcctgggaaagccagaggagtcagggcctgacgtctggtgggctgcagggctggtgagcactgggacatcagagagggaaggaaaggccatcctgccctcccctcgggggtcctgggtctgtgtcccagggagtggcgtctctcagaggggtctgaattgctgagcaggggggatgcacgggagagccctgcc

SEQ ID NO: 39821 - DNA, 601 bp, Human
ctgcttggggctctggcttcctggcgctctgaggagccgtcctgacctctagaaacccagaactcagccctgaaggtgctaagggggaaaggtttgccgctaaacctggctgtaggcagaggaggaaaatgcccagatcacatatatgccatcttagtgatatgggctcttctggatcaagcaaaagcttgattctggggagggaaaaacattccagagtagccgccggccaacgtgaagcaggtagggactcccagcctctggccccagctggacagatggggaggctccctgagggtgmctggaaagccacaccctctggttcacggtggtttcaaccctcccttcccagcacccagcccagggcctcagggtctatggcttaaagaagagtggtcaccgaggtcaaaggtcactggctgtccagaggctgctcagctcccatttgcaagaaccagtaaacaggggctgggccccaggggctggccatcacccgccactggctctcaacccttggattctccctctgccctcctctggctgtggcagggtctccacactgctgggctgcctgtctctcccctccttcctgtggcttgcc

SEQ ID NO: 39822 - DNA, 601 bp, Human
aaaagttagccaggcacggtggcgcgcacctgtagtcccagctagttggaaggctgaggcaggaggattgcttgagcccaggagtatgaggctgcagtgagctatgatcatgccactgcactccagcctgggggacagagcaagaccctgtctcataaaattaaaaataaaatccctgaaccaaacaacagagaaactccaccttttatctctctctaccaccgcctcccgctccgcacatctgcagagaaaccctggactccctggggcactgcccaagctcctgagaaagggagctgcyctctggatcctttagtctcggacaaatgggggtcttgaggtggagggaggatggctggtggccaggctattcacactgctgtgtgtatgcctctttttcgtcctgcttggggctctggcttcctggcgctctgaggagccgtcctgacctctagaaacccagaactcagccctgaaggtgctaagggggaaaggtttgccgctaaacctggctgtaggcagaggaggaaaatgcccagatcacatatatgccatcttagtgatatgggctcttctggatcaagcaaaagcttgattctgg

SEQ ID NO: 39823 - DNA, 601 bp, Human
ttgggggggggtctccagcctggggagggggagccagccctttcctctgtctccgtggggcagtctcactgggaggaaaaactcaaacaaggcacggcctggtggaaatgaaggaactgagggctgagtcgcaaggaatggggcatctttgacttgggtctggactgtgcccaatggagggtactgccctcaggcagggagggacttttggcttgtagattccaggtttaagcctagcttgggactaagagcaatggtttgaaattccagaaaagctcctctgtcgtttgaggatggcagsatgggcaccgtttaacctcagggacaggaaggtagagccagccacagaaaaggtgactctggcctcagcccgcactcagggaagggctaggacccatgagggcggggggcaaggagagaagcatctccccacccctacctcggggtctctaagggccagcggtgagcgaggcagaaatggggactggccttggactcgcaagttcccagacgctcccctcctcatctcagcaggcagcaggcgcaggcatgtgggaagggatgctgtcctgagaacagcagctgtggctacagtcaaaaa

SEQ ID NO: 39824 - DNA, 601 bp, Human
ctgtgctgccttcctcacccccttcgctggtggaagggacgtcatctttcctgttccaaggggagaagtcccagggagctgccacaccgcagcgaggggagaggagggcagatacacgtggctctagagggcgtgagaaatggcattctttattcataaataaaaacataaaattgccacaaatagtttacatggccaaaaagtgacgtcaaaaataaaatgaagctgtcaaaagcaaaccaaaccaaacaagaaaccacaaagagaaaaataactatgtacatcttccagatgctggtcygtcccagcctgcctctgctgggggctccagctctgcctgcaggcgcagcacaaaggccaccttgcacaagaggtgggtgagcagccccgctggcccaggggtgcagcctctgtcatggcagcacccaccgcatgatggcttgaggtctgcagggaaatccctctccccaagctgctgctcctccagccaggcctggcttagtttcgggcaactgtctcacctaagagatggcccaggctggggccaggcacaggaggctcactgagtgcctctctggggaagagatgcccccatatccca

SEQ ID NO: 39825 - DNA, 601 bp, Human
tgggacacaatacctttatgcatgaaaaggttgtcacttgtcacaactaacaggctttcacctcacggaaattttcttcccttgtgcacttttcccctggcagtggacatggctgcactcttccaagaagcaagcagctgtcccgtctgctcagactatctagagaaaccaatgtccctggagtgtggatgcgctgtctgcttcaagtgcatcaattcactgcagaaggagccccatggggaggatctactttgctgttgctgttccatggtctctcagaagaacaaaatcaggcccagtyggcagctagagaggctggcttcccacatcaaggaactggagcccaagctgaagaagattctgcagatgaacccaaggatgcggaagttccaaggtgagggatctgtatacactgcccccttcctacgaccagaccaggaaaaatcatctgtgcaactggcccctcattccatatggggattagctgctgtctggcacctaaaattgagatgcttcttcatcatcagattctcagccctgacaacatacagaatcacctggtgatctccaaaaaaaaggctggctgggcatggtggctcat

SEQ ID NO: 39826 - DNA, 601 bp, Human
gaagattctgcagatgaacccaaggatgcggaagttccaaggtgagggatctgtatacactgcccccttcctacgaccagaccaggaaaaatcatctgtgcaactggcccctcattccatatggggattagctgctgtctggcacctaaaattgagatgcttcttcatcatcagattctcagccctgacaacatacagaatcacctggtgatctccaaaaaaaaggctggctgggcatggtggctcatgcctgtaatgtcagcactttgggaggccgaggcgggtggatcacgaggtcagsagatcgggaccatcctggataacacggtgaaaccctgtctctactaaaaatacaaaaaattagccaggcttggtggtgggtgcctgtagtcccagctacttgggggttgaggcaggagaatggcgttaacctggggggggcggagcttgcagtgagccaagattgcaccactgcactccagcctgggtgacagagtgagactccgtctcaaaaaaaaaaacctgatgtctatgtcatgggttagacaagggattctctaaacttagtgtgctcagattacctggggatcttgttaaaatg

SEQ ID NO: 39827 - DNA, 601 bp, Human
agattacctggggatcttgttaaaatgcagatgctgaactgggaagtctcaggattgatcccgctggcttggggactttgctgagtagcaaaaacacagagcaacttaatttgaatttctctctagcaaaggttcccaggactctgacatttaaatgggcctggtaattctaatgcacagtgagtattggcacccactgtaccaaacaacctcaccccagggttgggaagagtttggaatggagcacctatggtgtttgtttctgtgagtggggcgagttgcagacgctggtctcctcatyggtgtgccatggacttcaacaggggtcctggctacagaaaatactatcactctccataactctggggaatagggacatttaaatgaagaggttatggtcagcctgggcaaagaattacacctataaatggtggtggcttctgccctgacacccatgatctctactcatccacctacccatacctgactgtgtctctgctgaaatatggaggacagattcaccctgcctaagtcatgtttggaaccctcttcctccttccttgtccatgtccactcatctcatttcattccctaattcacc

SEQ ID NO: 39828 - DNA, 601 bp, Human
tttcattccctaattcaccatcaaacagcaatcagtctcctcaagtcttactgtaatctataaaatctatattggtgatcatcagttttttgacttgaaggatcatatgttctgtagatttttttttcagaatgctctggacaattaattttctttaggccagatcacactgcctcctccatgagaattggcagcttcacctatcaaccacatacccaatgcattaaattattgacctttgtatttactgcccttattctctacgatcagtcagttatgacgaacaactttcttttttttwttattttttgagatggagtctcgctctgccgcctaggctggaggtgcagtggcatgatctctgctcattgcaagctccgcctcctgggttcatgccattctcctgcctcagtctaccgagtagctaggactacaggcacccgccaccatgtccggctaatttttttgtatgttttttagtagagacagggtttcacgtgttagccaggatggtctcgatctcctgacctcgtgatccacccgtctcggcctcccaaagtgctgggattacaggtgtgagccaccgcgctcagccaacaaa

SEQ ID NO: 39829 - DNA, 601 bp, Human
atctctgctcattgcaagctccgcctcctgggttcatgccattctcctgcctcagtctaccgagtagctaggactacaggcacccgccaccatgtccggctaatttttttgtatgttttttagtagagacagggtttcacgtgttagccaggatggtctcgatctcctgacctcgtgatccacccgtctcggcctcccaaagtgctgggattacaggtgtgagccaccgcgctcagccaacaaacaactttcaaatacctttctcttcactccaaaatttaccattgttttgcttaaggtytcacctcccatgtaggatggaaaacattctttcatctaaggcccccctcttcctcctggccttggagcctcctaatgtccaggaccggcacctctgtcatcacattgtcagctgcagagataccctacctgctgtcagaaccatgcacaattaatttgcttacaaacatggaaaacaaaggcctggaatcatgctctatatactgagttgagcaatacaagatggaagcagaaacatatttaacatcgaccatttgcattgtcttaattatcattcattttttcatgcatcaaggtggta

SEQ ID NO: 39830 - DNA, 601 bp, Human
aaaatttaccattgttttgcttaaggtttcacctcccatgtaggatggaaaacattctttcatctaaggcccccctcttcctcctggccttggagcctcctaatgtccaggaccggcacctctgtcatcacattgtcagctgcagagataccctacctgctgtcagaaccatgcacaattaatttgcttacaaacatggaaaacaaaggcctggaatcatgctctatatactgagttgagcaatacaagatggaagcagaaacatatttaacatcgaccatttgcattgtcttaattatcattcattttttcatgcatcaaggtggtagaaagggggtcatggtgtctgccttcagagaccctccactctaaatgaagaaaagtccaatgaagcaaacacgtgacataaagtaaaataattgctactgtgaataagagttgggtattgccacaaagcatacctatgagaatttgaactagtcagggaagttgcctcatgaaaagttttgattttgggggaagaagagaattaaagaaaccaaagtcaagagatatttgggcctttgaagtagaggagaggcatggggttggcttctgtcca

SEQ ID NO: 39831 - DNA, 601 bp, Human
ccttggagcctcctaatgtccaggaccggcacctctgtcatcacattgtcagctgcagagataccctacctgctgtcagaaccatgcacaattaatttgcttacaaacatggaaaacaaaggcctggaatcatgctctatatactgagttgagcaatacaagatggaagcagaaacatatttaacatcgaccatttgcattgtcttaattatcattcattttttcatgcatcaaggtggtagaaagggggtcatggtgtctgccttcagagaccctccactctaaatgaagaaaagtccartgaagcaaacacgtgacataaagtaaaataattgctactgtgaataagagttgggtattgccacaaagcatacctatgagaatttgaactagtcagggaagttgcctcatgaaaagttttgattttgggggaagaagagaattaaagaaaccaaagtcaagagatatttgggcctttgaagtagaggagaggcatggggttggcttctgtccattttctgatcaactttttttccttttcacagtggatacgaccttggatgccgacacagccaacaacttcctcctcatttctgacgac

SEQ ID NO: 39832 - DNA, 601 bp, Human
gacctcaggagcgtccgaagtgggtgcatcacacagaatcggcaagaccttgccgagagatttgacgtgtccatttgcatcctgggctcccctcgctttacctgtggccgccactactgggaggtggacgtgggaacaagcacagaatgggacctgggagtctgcagagaatctgttcaccgcaaagggaggatccatctgaccacagagcgtggattctggactgtgagtttgagggatggaagccgcctctctgccagcacggtgccgctgactttcctcttcgtagaccgcaagttayagcgagtggggatttttctggatatgggcatgcagaacgtttccttttttgatgctgaaggtggttcccatgtctatacattcaggagtgtctctgctgaggagccactgcacttgttttttgctcctccaagtccacctaatggtgataagagtgtcttgagtatctgtcctgtgataaacccgggcactactgatgctccagtccatcctggggaggccaaataagcccccactgcaaaaaaacaaaaaacaggttaagaaaattacttgggtgggcagacttaggaacgctctactc

SEQ ID NO: 39833 - DNA, 601 bp, Human
tggatatgggcatgcagaacgtttccttttttgatgctgaaggtggttcccatgtctatacattcaggagtgtctctgctgaggagccactgcacttgttttttgctcctccaagtccacctaatggtgataagagtgtcttgagtatctgtcctgtgataaacccgggcactactgatgctccagtccatcctggggaggccaaataagcccccactgcaaaaaaacaaaaaacaggttaagaaaattacttgggtgggcagacttaggaacgctctactcggtaaaagcgttatacaawgtcataggagaaaaatatgggacaattcatgattatacttaatctaatttgattagtttataaattgagtcctaagtattaattattgccaccatccaactcattgagtcttatggttcacatcttgtttcctatagaaatattctgtattctgggatcaatttccaaatgcttttttatttctgtaagttcaaattaatgtattatagaagttatgagttaaataaacattggaatatcacctaatggattatgtgactttctttcctcagcctcctgagtagctgggattacaggcaa

SEQ ID NO: 39834 - DNA, 601 bp, Human
ctaaatgctatttcgaagtgatttatttttcacatcctgaacatctatgatgtttttaagaaaacattttcagtgaaagttttctaggaataaataaatttgaagctgtgcttaattgttttgcttgctttcttttgaaattcccccacgggccactatttttctgtggatgcaactcaccttcgatttttcccctggtttctgtggtcatcttcaatgtcctggtcttcccacttttttcctaaaatgcatacccagaaagaccattaaaaattattagaaattatagaaaattgttacrgtctagtttcatgattagctgtgactgtctgattcaatcactgaaagattccctttccacatttcaaatcttggaacacagctgttgagcaagaaacacttgttctgtgttctatatttaactgaggaaagaaatgttgatatccttacctagacaaaccaggtttttgaaggtctcctgcatcacatcttcatagagctttttctgtgaagaatccagcaaagcccactcctccagggtgaagttcacggccacatcctcaaaggagactgagtcctgaaacattccacatatgtttac

SEQ ID NO: 39835 - DNA, 601 bp, Human
ctaattttttttttttttccgagatggagtcttgctctgttgcccaggctggagtacagtggcacgatctaggctcactgcagcttctgcctcctgggttccagcaattttcctgcctcagcctcctgggtagctgggattataggagcacaccaccacagctggctaatttttgtatttttagtagagatggggttttgccatgttggccaggctggtcttgaactcctgacctcagatgatctgcccgccttggcctcccaaagtgctaggattacaggcatgagccactgtgccaggycttttttttttttttttttttttccccagatgaggtcttgctatattacccaggctggtcttgaattccaggcctcaagtgatcctcctacctcagcctcccaaactgctgggattacctacatgaactattgtgcctggccaaaataataatatttataaaaggggtttctaaatgctatttcgaagtgatttatttttcacatcctgaacatctatgatgtttttaagaaaacattttcagtgaaagttttctaggaataaataaatttgaagctgtgcttaattgttttgcttgctt

SEQ ID NO: 39836 - DNA, 601 bp, Human
tcccatctcagcctcctgagcaggtgggactagagagtgccaccatgcctggctaattttttttttttttccgagatggagtcttgctctgttgcccaggctggagtacagtggcacgatctaggctcactgcagcttctgcctcctgggttccagcaattttcctgcctcagcctcctgggtagctgggattataggagcacaccaccacagctggctaatttttgtatttttagtagagatggggttttgccatgttggccaggctggtcttgaactcctgacctcagatgatctgccygccttggcctcccaaagtgctaggattacaggcatgagccactgtgccaggccttttttttttttttttttttttccccagatgaggtcttgctatattacccaggctggtcttgaattccaggcctcaagtgatcctcctacctcagcctcccaaactgctgggattacctacatgaactattgtgcctggccaaaataataatatttataaaaggggtttctaaatgctatttcgaagtgatttatttttcacatcctgaacatctatgatgtttttaagaaaacattttcagtgaaa

SEQ ID NO: 39837 - DNA, 601 bp, Human
taaccattttcagaaaaagtataggatatctgccctgtctgaattgttttaaagttaatatattcaatgctctggaagaagactcaaccatagttatgatcaaaacagtcaatttttttgttgttgttgtttaaataagagatggagtctcattctctcacccaggctggagtacagtggcatgatcacagctcactgaagccttgaattcctgggctcaaccaatcctcccatctcagcctcctgagcaggtgggactagagagtgccaccatgcctggctaattttttttttttttccragatggagtcttgctctgttgcccaggctggagtacagtggcacgatctaggctcactgcagcttctgcctcctgggttccagcaattttcctgcctcagcctcctgggtagctgggattataggagcacaccaccacagctggctaatttttgtatttttagtagagatggggttttgccatgttggccaggctggtcttgaactcctgacctcagatgatctgcccgccttggcctcccaaagtgctaggattacaggcatgagccactgtgccaggccttttttttttttttttttt

SEQ ID NO: 39838 - DNA, 601 bp, Human
aactgaatgatttgccacatcgtttacattcatatggtttttctccaatatgagttctttcatgcactcgacaggaattagaagagttgaaggctttcccacattctttacatttataaggtcgagccccagtgtgtattattacatgtgctcgaaagcttgcagaataaaagaaggcttttccacattctttacattcatagggtttctctccactatgagtccttttatgccttcgaaaagaactgagaaaactgaaggctttaccacattctttacatttgtagggtttttctccagwgtgagttctttcatgagttcgaaagtatgtgggacaactgaaagccttaccacattgcttacattcatagggtttctctccagtgtgagtccttttgtgtctttgaaaagattggtaacatataaaggctttcccacactgtttacattcatagggtttctttccagtatgagcatgtttttgaaaagactggtaatatataaaggtttttccacattgcttacattcatagggtttctgtccagcatgagtcctttcatgtctttgaaatggctggtaatatataaaggctttcccaca

SEQ ID NO: 39839 - DNA, 601 bp, Human
ggtaatttttagtagagatggggttacaccatgttgaccacgctggtctcgaatttctgacctcaaatgatctgcctgccttgcaccttggcctcccaaagtgctgggactataggcatgagccaacaagcttggccttttttaaaaaaacaaaaaacaaaaaacaaaacagatttcactgcagcacgagtcctgtctttgaaatgaattaggtcaactgaaggcttaatcacaatgtttacattcatactgtttctcaccagtgggaattctttcgtgctcaaaagaaactggaacaatyaagggctttagaacaatgtttgtattcacacagcttctgtccagtatgaactcttttgtgtattcagaaggagctggaacaaccgaaggcttcagaatgttgcttatattcttagactttctctcccatatgagtcctttcatgcagtcgaaagtgactggaagaaatgaaggcttttccacattgtttgcattcataaggtttctctccagtgtgagacctttcatgaattcgaacagaacttgaaaatctgaaggctttcccacattgtttacatcgatagggtttctctcccgtgtg

SEQ ID NO: 39840 - DNA, 601 bp, Human
actctgactcctttcatatattcacactctagaggacagttggaagattttcccacttttattttttcttgagacagtgtctcattctgtcgcacaggctggaatgcagtggcgtgatctcagctcactgcaacctctgtctccaggttcaagtgattctcctgccttagcctcctgagtagctgggattagaggcatgcactaccatgcctggttcattttttggtaatttttagtagagatggggttacaccatgttgaccacgctggtctcgaatttctgacctcaaatgatctgccygccttgcaccttggcctcccaaagtgctgggactataggcatgagccaacaagcttggccttttttaaaaaaacaaaaaacaaaaaacaaaacagatttcactgcagcacgagtcctgtctttgaaatgaattaggtcaactgaaggcttaatcacaatgtttacattcatactgtttctcaccagtgggaattctttcgtgctcaaaagaaactggaacaattaagggctttagaacaatgtttgtattcacacagcttctgtccagtatgaactcttttgtgtattcagaaggagctg

SEQ ID NO: 39841 - DNA, 601 bp, Human
aatagcagcatgaactactcaaccaagactcagccagattggatagaaaaaaataactacagaagtaaaaaatgctgttgctgaattggaaattagctctcatatggtttcttctgtagaatccactgaagaatgagtcacatctaaatcaatatgtcctttggaaagcataatgagaatatgttccagttttaaagaaaaatgttataatttataagattgtaaaattttattactgggctgtttacatgatactttctttcttattaaatataacctgacaatctttattaaatgaaawtatttttgtatcatcaacaacaacaaaagaactaggatgaagaatttcccacattcttaatatttatagggtttctctccagtatacattctcatgtgtgctcaaaaggctgtgtgaaggctttcccaaatgtcttacatttatagactttcaccccactctgactcctttcatatattcacactctagaggacagttggaagattttcccacttttattttttcttgagacagtgtctcattctgtcgcacaggctggaatgcagtggcgtgatctcagctcactgcaacctctgtctc

SEQ ID NO: 39842 - DNA, 601 bp, Human
ctgtcttaagtccccaccgctctgacaatgaaaggccccccctttctttttgagacagagtcttactctgttgcccaggctagagtgtagttcatgattatagctcactgcagcctccactcctgggctcaagtgatcctcccacctcagcctcccaagtagctgggactgcaggtgcatgccaccacacctgtccagtttttttttttttttaattttttgtaaagatggagtctcactatgttacccaagctgggtcttgaactcctgggctcaagcaatcctcctgccctagcctccsaaagtgctgggattacaagcgtgagccactgcattcagccaaagacttcttcttaagacctttatatatttgcaaacattctcttaatgccatagtcattataatgaaagccatgagtcccacagagtctttctgagttctactccatgagaaccactggcctaaaggcttacaacctgagagtgatgcactggcatgaaacccagagatatgggtaaggattgttttgtttcttaaataaaacaacattacaaaataaaacaattgcaggtaagtgttgtcttcttcaaagtaggctga

SEQ ID NO: 39843 - DNA, 601 bp, Human
ggtggcaggcgcctgtaatcccagctacttgggaggacaaggcaggagaatcgcttgaacccaggaggcagaggttgaagtgagctgagatcacgccactgcactccagcctgggcaacagagtgagactctgtctcaaaaaataaaaattaagtggccaggcatggtggctcacgcttgtaatctcagcactttgggaggccaaggcgggtggatcacgaggtcaggaatttgagaccagcctggccaacatggtgaaaccctgcctctactgaagatacaaaaaaaaattagccaggcktggtggcacgcacctgtaatctcagctactcaggaggctgagacaggagaatcacttgaacccaggcggcagaggttgcagtgagccgagatcacgccattgcacttcagcctgggcgaaagggtgagactttgtctcaaaaaaaaaaaaaaattaaaaaaaaatttaaaaaaaggaacagcctctgaaacagtttataagcctcgcaaaaatccatattcattccaatatacccacactttgctgtatgcctcaaatgttatgcctcagcttgaatctgctaccttattgagatatgac

SEQ ID NO: 39844 - DNA, 601 bp, Human
gccaggcatggtggctcacgcttgtaatctcagcactttgggaggccaaggcgggtggatcacgaggtcaggaatttgagaccagcctggccaacatggtgaaaccctgcctctactgaagatacaaaaaaaaattagccaggcgtggtggcacgcacctgtaatctcagctactcaggaggctgagacaggagaatcacttgaacccaggcggcagaggttgcagtgagccgagatcacgccattgcacttcagcctgggcgaaagggtgagactttgtctcaaaaaaaaaaaaaaattaaaaaaaaatttaaaaaaaggaacagcctctgaaacagtttataagcctcgcaaaaatccatattcattccaatatacccacactttgctgtatgcctcaaatgttatgcctcagcttgaatctgctaccttattgagatatgacttcaagtaatttttttactatttccaatataaaacccgctatgaaaaaataccattattatttaataccatgttgcacttcatttaaattagctccaaaccatcaccatccctacaaggtaggtaggggtcttccctttttattcatttaatttat

SEQ ID NO: 39845 - DNA, 601 bp, Human
tgaccgcagcctcaacctcctgggctcaagcaatcttcccacctcagcctcccgagtagccaggactacaggtgtgcaccacgacacccagctaatttttttattatttgtagacatggggtctccctgcattactcaggttgatctctaactcaggctcaagagatctgcctgccatggcctcctaaattgctgagattacaggagtgagccatcacacatggccgagaatttatttaataaactgcaaggggaagaaaattaaaatgccacttcccaggcctaagcaatatgaacataytggtttatattctttctttcctttataatctaagtgaaaaacagaaaactaaataaaaatattagaagaaaatgtatgtagttttattaatctaagtctgacataggacccagaagccataaaacagaaattgacaaatttaaaactttgtagaagtcaaaagataaacaataatctgggaaaatatttgcaacatatgtattagtttaaaataattgaatgaataggcagttcagaaagaaaaaatgtgtaatcagtaaataataagatggttaaagtcataatggaagaaatgaccat

SEQ ID NO: 39846 - DNA, 601 bp, Human
acttttgccatcaaacaacataagactaataaggggagaaaccctgcgggcagcacccacccatcatatagctcattgtcaaccactttttctctggttgtaatgacctctgggattaggacagaggaaccaaaccccttctttgaattgtaccctttaactctttttttttttttcttttttgagatggattcttgctctgtcacccaggctggagtgcagtggtgtgatcttagcttactgcaacatctgcctcccaggttcaagcaattctcgtgtctcagcctcctgagtagctggsattacagggacacgccgccatgcctggctaattttttgtattttagtagagacagggtttcaccatgttgcccaggctggtcttgaactcctgagctcaggcaatccacctccctcggcctcccaaagtgctgggattacaggcatgagccactgcgcccagcactctttttttttttttttttgagacggagtctagctttgtcgcccaggctggagtgcaatggcgccatctcggttcactgcatcctctgcctcccaggttcaagtgattctcctgcctcagcctcccaaaatagct

SEQ ID NO: 39847 - DNA, 601 bp, Human
ctgggattacaggcatgagccactgcgcccagcactctttttttttttttttttgagacggagtctagctttgtcgcccaggctggagtgcaatggcgccatctcggttcactgcatcctctgcctcccaggttcaagtgattctcctgcctcagcctcccaaaatagctaggattacaggtgcccgccaccacgcctggctaatttttgtatttttagtagagacagggtttcaccatgttggtcaggtgggtctcgaactcctaacctcaagtgatctgcccgccttggcctcccaaartgttgggattacaggcatgagccactgcacccagctccccttaactcttgaactcataattaatcaaaagtcttactaacataatgggccttttttctccccaactttgtcttgtccagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggtatgtacatgcttgctttctttgccaggtcagggg

SEQ ID NO: 39848 - DNA, 601 bp, Human
gcgccatctcggttcactgcatcctctgcctcccaggttcaagtgattctcctgcctcagcctcccaaaatagctaggattacaggtgcccgccaccacgcctggctaatttttgtatttttagtagagacagggtttcaccatgttggtcaggtgggtctcgaactcctaacctcaagtgatctgcccgccttggcctcccaaagtgttgggattacaggcatgagccactgcacccagctccccttaactcttgaactcataattaatcaaaagtcttactaacataatgggccttttytctccccaactttgtcttgtccagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggtatgtacatgcttgctttctttgccaggtcaggggcgagggatctgcctcagctgtgccttcatgagggtttcatgctgaattactgtagggagggcagtagagtcctggagttccttggtagttgtttt

SEQ ID NO: 39849 - DNA, 601 bp, Human
tggatcctgttagacgtgcctgccaagactgagccaagccaaccttgatggctgacttcaggactcagctgacaaagtttctgaagtggttgtaacatgattctggacccattggtggcctagttcctgttttctttgtgactgggaaagtaagtatgttgaaaaaaacatattccaacaccaaatgtaaatgactttcagcttgtccacattactgctcccctccagaaacacaatgagacttcactagtatgttcggtgcagaggaggagggtggggcagggccagacagggtagggcyaaagactggtgaggtgaggaaggcagctgtgcccaaggagatttgtttgctgcagaggttgggagcagctaatccatgaggcctgcagacctgcaggatgggcattgcctaattgctagtagaaatgcagtttgtcgggccccaccccaaagctgcagaatcagaactgccagaggatttctgtccactttgaaagttagagaagctctgctctagagcggatgcagttcttagaagcttggtcacaatagaagcaagctgaggaggtgcatccccacgggtgagggagagcagagcact

SEQ ID NO: 39850 - DNA, 601 bp, Human
agcttgtccacattactgctcccctccagaaacacaatgagacttcactagtatgttcggtgcagaggaggagggtggggcagggccagacagggtagggccaaagactggtgaggtgaggaaggcagctgtgcccaaggagatttgtttgctgcagaggttgggagcagctaatccatgaggcctgcagacctgcaggatgggcattgcctaattgctagtagaaatgcagtttgtcgggccccaccccaaagctgcagaatcagaactgccagaggatttctgtccactttgaaagttwgagaagctctgctctagagcggatgcagttcttagaagcttggtcacaatagaagcaagctgaggaggtgcatccccacgggtgagggagagcagagcactgcccaggtggacaagaggggtgctgattcccccatcaccgtgtgtgtttggctgccctcatcggccaggtcccaggcccactggctaagccctccagcaaggctttgggccacagggtagggtcccagtgaccagtttctcgctgaggagcaggaaagatgcagagagccacacatctcacctctgaatgaaatccctg

SEQ ID NO: 39851 - DNA, 601 bp, Human
gctttgggccacagggtagggtcccagtgaccagtttctcgctgaggagcaggaaagatgcagagagccacacatctcacctctgaatgaaatccctgatgaggtgttgtgtggtggctgccatgtatcttggctctgttttcagatggcattttggagttttggtttgattttatttttcctgaggaatttgcaaatgagtaaccttgctacattcttcacagatagtggcacttgggaaagaggcagattgaggctgggcgcagtggctcacgcctgtaatcccagcactttgggaggycgaggcaggcggatgacctgaggtcaggagttcgagaccagcctggccaacatggtaaaacctcgtctctactaaaaatacaaaaactagctgggctggtggcatgggcctgtgatcccagctacttgagagtctgaggtgggagaatcacttgaacctaggagacagaggttgcagtaagctgagatcgcaccactgcactccagcctgggcagcagagcaagaatgcatctcaaaaatgaatttaaaaaaaaaaaaaaagaggcagcttgggattaatttgcttctgttcctcttcag

SEQ ID NO: 39852 - DNA, 601 bp, Human
aggagttcgagaccagcctggccaacatggtaaaacctcgtctctactaaaaatacaaaaactagctgggctggtggcatgggcctgtgatcccagctacttgagagtctgaggtgggagaatcacttgaacctaggagacagaggttgcagtaagctgagatcgcaccactgcactccagcctgggcagcagagcaagaatgcatctcaaaaatgaatttaaaaaaaaaaaaaaagaggcagcttgggattaatttgcttctgttcctcttcagcccagcatactttgttttcctttcayctgtaaatgtagaaagtgcttcagtttagttctcagaaagctcaagagaaaaccacacagttgctcatacgggccctgacactttgaggaaggaggaacaaggtctggttttatttcttctggctttgccttctgtgcagtgtgtggtgtcggactccatggaagagcagtcaccctgagcatctgactagtctgcctttgaggtccagggtcagtcaagccccagttagattcctttgtttgtgtcagcctgtaaaaagtgccaccttggcaggcgtgttagcctgcatggctgaggcg

SEQ ID NO: 39853 - DNA, 601 bp, Human
aggcagcttgggattaatttgcttctgttcctcttcagcccagcatactttgttttcctttcacctgtaaatgtagaaagtgcttcagtttagttctcagaaagctcaagagaaaaccacacagttgctcatacgggccctgacactttgaggaaggaggaacaaggtctggttttatttcttctggctttgccttctgtgcagtgtgtggtgtcggactccatggaagagcagtcaccctgagcatctgactagtctgcctttgaggtccagggtcagtcaagccccagttagattcctktgtttgtgtcagcctgtaaaaagtgccaccttggcaggcgtgttagcctgcatggctgaggcgtcaccctagttctgagttttctcaggggtggtggtacctacagcttcttgccctaatttttttttcacttaattggaggactaatgattataaatctcgtgcatatcagctgcactgtgtttttacagtactctccaccttcttgggagagttttaattagatggtattccactaaagaaacctacaagtctctctgatttatttatttatttatgagacagagtctcactctgtcg

SEQ ID NO: 39854 - DNA, 601 bp, Human
ctttgaggtccagggtcagtcaagccccagttagattcctttgtttgtgtcagcctgtaaaaagtgccaccttggcaggcgtgttagcctgcatggctgaggcgtcaccctagttctgagttttctcaggggtggtggtacctacagcttcttgccctaatttttttttcacttaattggaggactaatgattataaatctcgtgcatatcagctgcactgtgtttttacagtactctccaccttcttgggagagttttaattagatggtattccactaaagaaacctacaagtctctctkatttatttatttatttatgagacagagtctcactctgtcgcccaggctggagtgcagtggcgttttctcggctcactgcaacctctgcctcccaggttcaagcagttctctgcctcagcctcccgagtagttgggattacaggtgcccaccaccacgcccggctaatttttgtatttttagtagagacagggtttcaccatcttggccaggctggtcttgaactcctgacctcgtgatccacgtgccttggcctcccaaagtgctaggattacaggcatgagctaccgcacccggccctc

SEQ ID NO: 39855 - DNA, 601 bp, Human
ataagactagagggtctggccctcagttttgtaggctcaaaaatgtttttttaatatacatagctgtcagttggaagcggattgacttaaattcacaagagctactttatgaataatcaaatggtgggttttggctgggcgccgtggctcatgctataatcccagcattttgggaggccaaggcaggaggatcacttgagtctaggagtttgagaccagcctgggcaacagtgagacctcatctctatgaaaaataaaattagccaggcgtagtggcgcatgcctatagtcccaaccactsgagaggctgagatgggaggatcgtttgggcctaggaggtcgaggctgtagtgaaccaaggttacgccactgcattccagcctgggcaacagagcaagaccccatctcgccggtcatgagtttcctaactagggaagaaaaatatgacctctctcccaagcaaacctgttgggaagcctgattaccaacagagcaggctgcttccctgttgtgtgtccctgcactttccagatcctgacctgcagcacgtggataatgactcatttatttactatttccccagaagatggtatgtctcatg

SEQ ID NO: 39856 - DNA, 601 bp, Human
aagaaaaatatgacctctctcccaagcaaacctgttgggaagcctgattaccaacagagcaggctgcttccctgttgtgtgtccctgcactttccagatcctgacctgcagcacgtggataatgactcatttatttactatttccccagaagatggtatgtctcatgaggacagggacttggtcctttttcctgctgtacactaggggctggcatggtcactgagtcactggtgcacggttggtgctcagtaatgtgtctgatggaagagggtgagatgatcagtgccagcggtggtgtcrtgtgctgcagcctgatgcagccctttccaccacacttgccccacagattatcattctgggaaggtctagagcttcctgttacatgttagaatgaaatgtttggactttgggaggccgaggcgggtggatcacttgaggccaggggtttgaaaccagcctggccaacatggtgaaactccatctctactgaaaaaaaaaaaacaaaacaccaaaattagccagcgtggtggcggacacctgtaattccagccactcgggagtctgaggcaggagaattgcttgaaccagggaggtgaaggt

SEQ ID NO: 39857 - DNA, 601 bp, Human
caacagagcaggctgcttccctgttgtgtgtccctgcactttccagatcctgacctgcagcacgtggataatgactcatttatttactatttccccagaagatggtatgtctcatgaggacagggacttggtcctttttcctgctgtacactaggggctggcatggtcactgagtcactggtgcacggttggtgctcagtaatgtgtctgatggaagagggtgagatgatcagtgccagcggtggtgtcgtgtgctgcagcctgatgcagccctttccaccacacttgccccacagattatcattctgggaaggtctagagcttcctgttacatgttagaatgaaatgtttggactttgggaggccgaggcgggtggatcacttgaggccaggggtttgaaaccagcctggccaacatggtgaaactccatctctactgaaaaaaaaaaaacaaaacaccaaaattagccagcgtggtggcggacacctgtaattccagccactcgggagtctgaggcaggagaattgcttgaaccagggaggtgaaggttgcagtgagccaagatcgcaccactgtactccaacctgggcgacagaatga

SEQ ID NO: 39858 - DNA, 601 bp, Human
gtcactggtgcacggttggtgctcagtaatgtgtctgatggaagagggtgagatgatcagtgccagcggtggtgtcgtgtgctgcagcctgatgcagccctttccaccacacttgccccacagattatcattctgggaaggtctagagcttcctgttacatgttagaatgaaatgtttggactttgggaggccgaggcgggtggatcacttgaggccaggggtttgaaaccagcctggccaacatggtgaaactccatctctactgaaaaaaaaaaaacaaaacaccaaaattagccagcrtggtggcggacacctgtaattccagccactcgggagtctgaggcaggagaattgcttgaaccagggaggtgaaggttgcagtgagccaagatcgcaccactgtactccaacctgggcgacagaatgagactgtctcaaaaaaaaaaaaaagaaaagaaaaaaaaaatatttgggatcaggagtctgaaagtcagtaaaagcatgaattgagtgcctagtctatacagagccctttgctaggaacactgttactgggttggtcccttttgaagactccattttccaaaatgcactaaacat

SEQ ID NO: 39859 - DNA, 601 bp, Human
aggagtctgaaagtcagtaaaagcatgaattgagtgcctagtctatacagagccctttgctaggaacactgttactgggttggtcccttttgaagactccattttccaaaatgcactaaacattgcattcttcccagtgtaaacatgagtgagcccattgtagaaccgaaatcatcccaagggccagaattcagtggtgaatctctcagcatatatgagtccgattgagctctggataggaatgagggctgtgtctttggagcactccccacatgctcccacagaggaggggcctatcctrctcagggaggggatgttgtgtcagggtgacttcccggcagcactgtgtagacttggtgattcagcccaaaggcacttgcaggactctaaacactgagggcctgagttggcagtagcagttaactggctcacgctgctgaaagccaaggctggcagggccacgattgagcctggcgcctagaagccatcatctggttcagaaatgggcccagtacattgttgttgctgttgacacaaaagcagccttgttgtgactccttacaaacccatccagactgatgggcctgggccagggccctga

SEQ ID NO: 39860 - DNA, 601 bp, Human
gaggttttgccatgaattggccctcagttaggggctaagggtagctggaaagatggtttgcagttgccaagcacagaatgttcttcagatagagggctcctagggacaggaggaatttgctctggttgagttttgaactgagccctttactgccccgagggggcaaagggtgaggctcacagctgtgctcttctttcaggcgaagtggtgaacacccatggccccgtggagcctgacaaggacaatatccgccaggagccctacaccctgccccagggcttcacctgggatgctttggacytgggcgatcgtggtgtggtgagtgggccctcagaaggttacacctgcgggtaggagccactttcacagtaagccctgcagtctcacctagactacgtttactcgagccctagagagctgagccaaggaggtctgaacagactcccgtctgtaacttcctggggcatggccaagactccacataaatagctcttagcttttctggcaggttggaagttaacctctgtaggtccccgatgtggatacctgtttttcatttattcttttttgttcattcatttcctcattttctttctagtct

SEQ ID NO: 39861 - DNA, 601 bp, Human
tgagactccacgtcgtttttggtagtttgcttcatccttctgaaaagcctagagccccagggtattggagttggtctactacctggcagaatacctccaagtgagctgcttatttctttacagctaaaagaactgtacaccctcctgaatgagaactatgtggaagatgatgacaacatgttccgatttgattattccccggagtttcttttgtggtaagttgtgggggctttcttgaggttcttgagaggaaggcatagagcagatccaccagagggcaccagagttttcatccctgccaggggccaacctttgaatggcaaattagtgtgtcatttttgagttcctgcatctgaaggacacttgctttcattagcacttagaattgcagccttgtttaagacaattgactgggtgagggagaccttcgtagagctagtacccagggaagaggtattcattgtctggtgactttatataagaaaggaacgggcatgagacctactaagactgaaagaaaagaaggcacattttctatctagttcctgagcatgctcagttgtatagccttgcctggctgagccatccacctgcccaggcc

SEQ ID NO: 39862 - DNA, 601 bp, Human
ttcattagcacttagaattgcagccttgtttaagacaattgactgggtgagggagaccttcgtagagctagtacccagggaagaggtattcattgtctggtgactttatataagaaaggaacgggcatgagacctactaagactgaaagaaaagaaggcacattttctatctagttcctgagcatgctcagttgtatagccttgcctggctgagccatccacctgcccaggccacgtttaatatccaggaagagagaggcatgggccgaaatggagagggactacctgaaagggaaggaaraatttgtaccagaaagagggagacaggacaccagagctccagggttgccacagtcagctctcaaccatgggacccactggcctccgaaccaaagatgccagtaccttggttcaagctgtcaaagtgaacacagaaattggatcaggcatgaaatcctcagtatgataaccttgggttggatgagtaactaggccaaatgggatgagcagccagaaatggtgatggctcgattctgtgtgtccaggagggcttggccctaaagagaatccagctattaaccctcagggaggtggtagcacc

SEQ ID NO: 39863 - DNA, 601 bp, Human
acctctgccttagaaagttgtttaaaacaattgaataatctctccttagagaactttaaaagtaaaaacaccaggtgtgaaagcagaaggggaggagggaggagggtgagtgcctctgccatcatcttctgggcatgactacagtccttttccgttgacttgattctaggagtgaggattggtctccccagacaaccgctgtagcaaaggaatagtttttgaaattgagcaagaaaaatagggagaaagaaaatccaggaggagctttggcagcactcactgtggggagggggaggctggmgagcagggtgacaccactgactccggaggcacctgatgtgtctctcacgccacctgctggccagctggggtctccctgccattgtccttgtaatagggattggccagaaccctgaggacaggacatttgtgtccccacaggtattggcatcggtccctaaacccacggaagctgattgaagtgaagttctcccacctgagcagaaatatgaccatgcagcgcaccatgaagctctaccgactgccagaggccagtgctgccccgggtggtgggcagggggcagagagagggcaaggagag

SEQ ID NO: 39864 - DNA, 601 bp, Human
cgcagtgccactgtgcatgcttgacattgcctctttattgccttcccttcagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatggtgaggagcagacgggggggtctctggagatgtgcagggaaggggcagtggagccatggtgagcacagctcccgggacgcrgcctcccatgggctggaggctctgagccctcctcatctgttctgcttaggcagggttcccgcagtttttaggcagaaactcaaaacttggagggaacaaggagcatccgaagtgaaggcattgaactcctcctgattcatttcagtgagtttcgttctcacaggaggcgccaccaaggagcctgaatagccaggccttccctgggaggacagggcttctcctcacagctttcccagcgtgggaaaggggtgattgctgtctgtcgtggtgagtcattggagcatccaactgccagtagcg

SEQ ID NO: 39865 - DNA, 601 bp, Human
tttcttagcccttcctcccccagtgccacaggggacataggggtgagctggagcgtgggccagttttccctgggaggtctgatggacgtgtgaaccctggtgtggaggttgagtgtggggccggctgggtgtgagtctgctcccacagcacaggcggtggacccgggcccagccactcggaacttcagggatagggggtgtgggagagtctttgggccactgtcaactcagctctgcctctccctgttggctttcctaggttggactggtgctacaataaccagtcaccagtgcgattctrgataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagt

SEQ ID NO: 39866 - DNA, 601 bp, Human
gatggacgtgtgaaccctggtgtggaggttgagtgtggggccggctgggtgtgagtctgctcccacagcacaggcggtggacccgggcccagccactcggaacttcagggatagggggtgtgggagagtctttgggccactgtcaactcagctctgcctctccctgttggctttcctaggttggactggtgctacaataaccagtcaccagtgcgattctggataaagccactgaaaattcgaaccaggaaatggaaccccaccactgttggtccaattttcacacacgtgagaatccctrgcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatga

SEQ ID NO: 39867 - DNA, 601 bp, Human
ttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccargcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcc

SEQ ID NO: 39868 - DNA, 601 bp, Human
atcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaamctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtgcccggctcctcggactctgctttatgttgcggtgagaactctgcccaggtgtgcagggtttggcttgtgggctgcttgctgc

SEQ ID NO: 39869 - DNA, 601 bp, Human
aacagatctcctggcaaaggccccagcatctccctcactgaaaccaggtgcccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcasgctaaccctcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactctggatcgaggcctgtatagggctcgtttccccacacatgcctatttctgaagaggcttctgtcttatttgaaggccagcccacacccagctactttaacaccaggtttatgg

SEQ ID NO: 39870 - DNA, 601 bp, Human
ggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactctggatcgaggcctgtatagggctcgtttccccacacatgcctatttctgaagaggcttctgtcttatttgaaggccagcccacacccagctactttaacaccaggtttatggaaaatgtcaggccttccccacaactccygtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaa

SEQ ID NO: 39871 - DNA, 601 bp, Human
ctgaagaactgtgtgtgattgttctttctttaccaatataaaaactctgcccttagttctccctgtgtgcagagtcttctgctgaacaccaatggaagtttcagaatagatccaatttctgttactatgtgttcccagtttactgtgggagataggacagagaaacagagaatagtaatgttttgcatttatatactcgctaaagcacttctaaactcatcatctcagtcaattcttacactaaaattctgtaagtggggaggatatagtaatgatagccaaaatttactgagttcttacmgtgggccaaaaggtgatgttattctcatttctttggaataacagaacagaggttttgagacaggtgtagtgacaatgccagtatcagtatgttaacacagccagtggcagtgttgcctaactagctaacagtgtgtcggctaaactccagattgcataattctcaagctgtgagctgcaaaggtaagaagcccagttcattgtatgtttcaaacaagctattataaaacattaaaatatattaatatttaggaggatcatttatatatatccctagggttaaaagaataatacattactt

SEQ ID NO: 39872 - DNA, 601 bp, Human
tttactgtgggagataggacagagaaacagagaatagtaatgttttgcatttatatactcgctaaagcacttctaaactcatcatctcagtcaattcttacactaaaattctgtaagtggggaggatatagtaatgatagccaaaatttactgagttcttaccgtgggccaaaaggtgatgttattctcatttctttggaataacagaacagaggttttgagacaggtgtagtgacaatgccagtatcagtatgttaacacagccagtggcagtgttgcctaactagctaacagtgtgtcrgctaaactccagattgcataattctcaagctgtgagctgcaaaggtaagaagcccagttcattgtatgtttcaaacaagctattataaaacattaaaatatattaatatttaggaggatcatttatatatatccctagggttaaaagaataatacattactttattattttgcctatttttttagttaatgatatctcttctggtcccaaagaatttagggctacttgcaaagatgtatatacttctcatgaaatgaggcaatataaatcttacaagatttgactgtactgaggacagat

SEQ ID NO: 39873 - DNA, 601 bp, Human
ttgcataattctcaagctgtgagctgcaaaggtaagaagcccagttcattgtatgtttcaaacaagctattataaaacattaaaatatattaatatttaggaggatcatttatatatatccctagggttaaaagaataatacattactttattattttgcctatttttttagttaatgatatctcttctggtcccaaagaatttagggctacttgcaaagatgtatatacttctcatgaaatgaggcaatataaatcttacaagatttgactgtactgaggacagatacctctatgtctcytctcatgttagttggtctattgtaatagatagggaattaaaataaaacataacattccttatattctgactgatatattacatgaaaagcataattcttttaatgtccagtaggattatcatgaaaatgttatagaatctctttagtaggaagagtagacatttaattttacaggatttaagaactctgcctaaagtcaaggtgatcaattagcttacccttaggaatctctgtcctccatgttgggctctgtgcctgactccagcagcctctgaagtagaagctatcatattgccagga

SEQ ID NO: 39874 - DNA, 601 bp, Human
aaaacaagattgggaaccagtgtgttagctttggagttccttcagtatctgtttctatcggatgctcataaggggtaaatggaactaccagggatgaaatcttcccacataatgcatactttcttgcagaggccgaaggatcataaatagggtaattgaccatgaatacctcctaggaataaaggcaaatggaaagtacccatggggtagaaatgtgaaggggatctttgcccttgtacacattttttcccctctgcagctctgtagtccatctctacaggtgcatttagtatcaacatgrttggcattctcacctctccatttcagagtcctatcattgatcggcctgagtctaatagctttggggacaggaggcatcaaaccctgtgtggcagcttttggtggagaccagtttgaagaaaaacatgtaagaatcctgttattttgtattttcaagaatatagagccagcattaatgggggtatctggcaggtagccatttgccaagattgaagtaatgtactggtcagatcttatctgagcagttgtattcaatgctggatactggccattaatagtgaggaaaactgaaacagtttca

SEQ ID NO: 39875 - DNA, 601 bp, Human
caatgggaggtgataagtagtatagagatgattttagcatcttgttttgagattccatgaaatgggaaagtgacaaattgcaaggaaacgtaatgaatgtctatagatgaatttccctgactgatcattccctctcttcctaaatactttccattaccagtggtgaaaaataaatgggcatttatgagaaagcagtgacaaataggcaaggaaatagtctatttctagatctgtcaacatttctggcttcctcagttttgcttccagttttcagttttgtctgtcttcatgtatccattcyctcttctataactgtttatcttttttccagtttctctttttctcccccactccttctctctttctctctctcccccccacctcccgccactctctctctctctctttcctcttccctcttccaccctgacataatgcctattatctccttctgcctctgctatcctgtcctgtcttccagtgtttttcttacctttcagaccatttgggttattttatactctttatctgtcaaagagtccatagatcataattgcttgctgactttggagaaagaaccaacttttggcaagtgggatcc

SEQ ID NO: 39876 - DNA, 601 bp, Human
atttgaaagttgtttcatttggtaactgctccacaaagatatttcaattagtaagacaaatctgcctccaggtttccactagccacttctaagccagatgatttctttttagactctctggcaaatctccgttaagcactaggtgaactatcctccttcattaacagttgactccactgtcctatgttctggtactattcctaccacacactcctaccacaaaatctattatttaactaaatcaggcattcacttagttaatacagtcaataaacatttatcgagtccctaatatatgtcrgatgctgtgctaggtattggtgattacagaaatgagtaagataaaatttctgctctaaagaaactcacaacatactgaaaaaacagacacttacgggaggcagaggcaggagaatggcttgagcccgggaggcggagtttgcagtaagctgagactgcgccactgcattccagcctgggcggcagagtgagactccatctcaaaaaaaaaaaaaaaaaaccacaaacacacacatgaaataaaaaacccagacatttaatgcaaagacattaatattagaatagctatatacaggatacg

SEQ ID NO: 39877 - DNA, 601 bp, Human
ctggcaaatctccgttaagcactaggtgaactatcctccttcattaacagttgactccactgtcctatgttctggtactattcctaccacacactcctaccacaaaatctattatttaactaaatcaggcattcacttagttaatacagtcaataaacatttatcgagtccctaatatatgtcggatgctgtgctaggtattggtgattacagaaatgagtaagataaaatttctgctctaaagaaactcacaacatactgaaaaaacagacacttacgggaggcagaggcaggagaatgrcttgagcccgggaggcggagtttgcagtaagctgagactgcgccactgcattccagcctgggcggcagagtgagactccatctcaaaaaaaaaaaaaaaaaaccacaaacacacacatgaaataaaaaacccagacatttaatgcaaagacattaatattagaatagctatatacaggatacggtagtggcactgaagacaggaagattatttttaacctatgaaaagggaggaaaagaatgctaaagctgctctggagtttgaaaggtgagtaaatgattggggtcagccagcaatgtt

SEQ ID NO: 39878 - DNA, 601 bp, Human
aaaatctattatttaactaaatcaggcattcacttagttaatacagtcaataaacatttatcgagtccctaatatatgtcggatgctgtgctaggtattggtgattacagaaatgagtaagataaaatttctgctctaaagaaactcacaacatactgaaaaaacagacacttacgggaggcagaggcaggagaatggcttgagcccgggaggcggagtttgcagtaagctgagactgcgccactgcattccagcctgggcggcagagtgagactccatctcaaaaaaaaaaaaaaaaaamcacaaacacacacatgaaataaaaaacccagacatttaatgcaaagacattaatattagaatagctatatacaggatacggtagtggcactgaagacaggaagattatttttaacctatgaaaagggaggaaaagaatgctaaagctgctctggagtttgaaaggtgagtaaatgattggggtcagccagcaatgtttttaaatatctattaataatatgaaattcaggtattgtggaggcaatatctgaatctttctctttgtgtgtaccttcagctctgaatctgaacgtggagtggg

SEQ ID NO: 39879 - DNA, 601 bp, Human
actaaatcaggcattcacttagttaatacagtcaataaacatttatcgagtccctaatatatgtcggatgctgtgctaggtattggtgattacagaaatgagtaagataaaatttctgctctaaagaaactcacaacatactgaaaaaacagacacttacgggaggcagaggcaggagaatggcttgagcccgggaggcggagtttgcagtaagctgagactgcgccactgcattccagcctgggcggcagagtgagactccatctcaaaaaaaaaaaaaaaaaaccacaaacacacacaygaaataaaaaacccagacatttaatgcaaagacattaatattagaatagctatatacaggatacggtagtggcactgaagacaggaagattatttttaacctatgaaaagggaggaaaagaatgctaaagctgctctggagtttgaaaggtgagtaaatgattggggtcagccagcaatgtttttaaatatctattaataatatgaaattcaggtattgtggaggcaatatctgaatctttctctttgtgtgtaccttcagctctgaatctgaacgtggagtggggctggagctagggga

SEQ ID NO: 39880 - DNA, 601 bp, Human
cagaggcaggagaatggcttgagcccgggaggcggagtttgcagtaagctgagactgcgccactgcattccagcctgggcggcagagtgagactccatctcaaaaaaaaaaaaaaaaaaccacaaacacacacatgaaataaaaaacccagacatttaatgcaaagacattaatattagaatagctatatacaggatacggtagtggcactgaagacaggaagattatttttaacctatgaaaagggaggaaaagaatgctaaagctgctctggagtttgaaaggtgagtaaatgattggrgtcagccagcaatgtttttaaatatctattaataatatgaaattcaggtattgtggaggcaatatctgaatctttctctttgtgtgtaccttcagctctgaatctgaacgtggagtggggctggagctaggggacacattgcactgatgatttatcctgtttgtttcaggcagaggaacggactagatacttctcagtcttctacctgtccatcaatgcagggagcttgatttctacatttatcacacccatgctgagaggttaggatttttttgaggggccctgtataaggctttgctc

SEQ ID NO: 39881 - DNA, 601 bp, Human
cactgcattccagcctgggcggcagagtgagactccatctcaaaaaaaaaaaaaaaaaaccacaaacacacacatgaaataaaaaacccagacatttaatgcaaagacattaatattagaatagctatatacaggatacggtagtggcactgaagacaggaagattatttttaacctatgaaaagggaggaaaagaatgctaaagctgctctggagtttgaaaggtgagtaaatgattggggtcagccagcaatgtttttaaatatctattaataatatgaaattcaggtattgtggaggyaatatctgaatctttctctttgtgtgtaccttcagctctgaatctgaacgtggagtggggctggagctaggggacacattgcactgatgatttatcctgtttgtttcaggcagaggaacggactagatacttctcagtcttctacctgtccatcaatgcagggagcttgatttctacatttatcacacccatgctgagaggttaggatttttttgaggggccctgtataaggctttgctctggtcagccaaaaagctgttcaaggctttctcctgtctatcatctccttttataagagct

SEQ ID NO: 39882 - DNA, 601 bp, Human
ctgtccatcaatgcagggagcttgatttctacatttatcacacccatgctgagaggttaggatttttttgaggggccctgtataaggctttgctctggtcagccaaaaagctgttcaaggctttctcctgtctatcatctccttttataagagcttgataatctgtgaaaatttattttagtcttgatttgtctggcccaaaagaagaactatggattaggtgatgggaggaaagagggtggttatgtctattctacaagctcaggtttattcaacaacctgagcttgtagaataaaacawcaaatattcaagactcagagttactttcctcctcccatcccattttctttaggagatgtgcaatgttttggagaagactgctatgcattggcttttggagttccaggactgctcatggtaattgcacttggtaagtgcagtgaagcaaaggaaactaataatcattgatacctgacacatgtaaagcatcatgtaggcactttacacaagctgtttcattcaatcctcacaccaggcctattgggtaactgttattgtaagggtttcccctcaattttggaggtaaattctgaatgaagt

SEQ ID NO: 39883 - DNA, 601 bp, Human
ctttcctcctcccatcccattttctttaggagatgtgcaatgttttggagaagactgctatgcattggcttttggagttccaggactgctcatggtaattgcacttggtaagtgcagtgaagcaaaggaaactaataatcattgatacctgacacatgtaaagcatcatgtaggcactttacacaagctgtttcattcaatcctcacaccaggcctattgggtaactgttattgtaagggtttcccctcaattttggaggtaaattctgaatgaagtcagaaactttaagaaaaaagtgcytaaggttgcataaccagtaagatgctttctggggagccttaaaaagtccaaactctgggccagtcagggacttgggcttttttttagtatctcgggtcattctaatgtatagtcaaggtggagatccactgctctacactacaatatatagggaagcaaggaagataatcctctttcaaattagtttacttcatattatacttatttatctggtaattggaaaagattttaaattctccaagccttttaaaacagcttctaggtttagctatttctgccctgctctgtagtgcccccaaa

SEQ ID NO: 39884 - DNA, 601 bp, Human
acatgtaaagcatcatgtaggcactttacacaagctgtttcattcaatcctcacaccaggcctattgggtaactgttattgtaagggtttcccctcaattttggaggtaaattctgaatgaagtcagaaactttaagaaaaaagtgcctaaggttgcataaccagtaagatgctttctggggagccttaaaaagtccaaactctgggccagtcagggacttgggcttttttttagtatctcgggtcattctaatgtatagtcaaggtggagatccactgctctacactacaatatataggraagcaaggaagataatcctctttcaaattagtttacttcatattatacttatttatctggtaattggaaaagattttaaattctccaagccttttaaaacagcttctaggtttagctatttctgccctgctctgtagtgcccccaaagggtctgcccttgagtaaagagaataagaggagttggataaataggtgaaaattaatgcaacttaaatcaagtggcattctctttatccctgagaacccagtcctggaagagaagagggatgtggtgttccttattttacatagcctaaggga

SEQ ID NO: 39885 - DNA, 601 bp, Human
atagttcagtagggaaaggaagacaaacaaataaaaggaatttacaatatggtatgatcagtatttcccagatcaatatagtgtgatctaggaaagtacagagagagctatgggaatgcgtagaagcaatgtttaattaagaccttgagggaccgggcatagtggctcacacctgtaatcccagcactttgggaggccgaggcaggaggattgcgtgagctcaggagtttgagaccatcctggacaacacagcatgactccatctatacaaacatttaaaaattagccgagtatgatggcrcacacctatgatcccaactatttgggaggctgagatgggaggatcgcttgagcccagaaggtcaaggctgcgatgagccatgattgagccactgcacttcagcctgggcaacagagcaagcccctgtctcaaaaataaataaatgaataaaataataaataaataaataatactttggggattgtaaaaagtttgcctaaaggaatgacatttaaggtgagacctaagggccaaacagcaattaatcaataaagaaattataagtgatgcagaaagaggacacagtagctgtaagacaag

SEQ ID NO: 39886 - DNA, 601 bp, Human
tgagggaccgggcatagtggctcacacctgtaatcccagcactttgggaggccgaggcaggaggattgcgtgagctcaggagtttgagaccatcctggacaacacagcatgactccatctatacaaacatttaaaaattagccgagtatgatggcgcacacctatgatcccaactatttgggaggctgagatgggaggatcgcttgagcccagaaggtcaaggctgcgatgagccatgattgagccactgcacttcagcctgggcaacagagcaagcccctgtctcaaaaataaataaatraataaaataataaataaataaataatactttggggattgtaaaaagtttgcctaaaggaatgacatttaaggtgagacctaagggccaaacagcaattaatcaataaagaaattataagtgatgcagaaagaggacacagtagctgtaagacaagaggctgagaaatagcatgacatgtttaaaggttttaaaggcattcagattacctaaagcataaaaaagaatgataaagaggagaaactgccagaaaccagataatgaagggccttttaaaccaataagaaattagaactttattg

SEQ ID NO: 39887 - DNA, 601 bp, Human
taagaaggaatggccaaagtggtaatagcgttatcttggatatgaagaagatttcaagaaaagattcatttagagtgataaatgttcctgagtgggagattaagataagggtgacagatgtctattaaatacaacaacaaggaggtcactgatacgattagatcagttatggtaaatggtggaggctgaagactgattggaggagactgagaagtaaatgttacaggattccttcagtgctgctttgtcagccagaaatctctgtggccactaccgcctctgtctgggccttgctctggcycactgggctcgctcagcctgcgactggactgggcatgtagcgagcagcttctgtgttgggtgcggcatctagacaaggggaacacggtggcgcccaaaaactcggagatgctagcaattgcagagtcctaagaggtgttatagctcctgctcagggagtcccaaggtctgagcccccagaaatgttacagctgttcactcctgtagttcaacgagcaggagcatgttacaactctctcctgtagtctagcgagcgggagcgtgttacggctcttttattcccgctgcccatagcttggcg

SEQ ID NO: 39888 - DNA, 601 bp, Human
cagttatggtaaatggtggaggctgaagactgattggaggagactgagaagtaaatgttacaggattccttcagtgctgctttgtcagccagaaatctctgtggccactaccgcctctgtctgggccttgctctggcccactgggctcgctcagcctgcgactggactgggcatgtagcgagcagcttctgtgttgggtgcggcatctagacaaggggaacacggtggcgcccaaaaactcggagatgctagcaattgcagagtcctaagaggtgttatagctcctgctcagggagtcccraggtctgagcccccagaaatgttacagctgttcactcctgtagttcaacgagcaggagcatgttacaactctctcctgtagtctagcgagcgggagcgtgttacggctcttttattcccgctgcccatagcttggcgagctgcccaggggtgtcacagccctttcattcccatcacccacagctcagcaagttccgggttcttgtcccatgatgaagaggaatggggtgtgtggacaccagagagtgagtaaagcagagaagaattttattgagtggcagaaggaaagctctgagctcct

SEQ ID NO: 39889 - DNA, 601 bp, Human
acagctgttcactcctgtagttcaacgagcaggagcatgttacaactctctcctgtagtctagcgagcgggagcgtgttacggctcttttattcccgctgcccatagcttggcgagctgcccaggggtgtcacagccctttcattcccatcacccacagctcagcaagttccgggttcttgtcccatgatgaagaggaatggggtgtgtggacaccagagagtgagtaaagcagagaagaattttattgagtggcagaaggaaagctctgagctcctagaggggacccgaagtaggtagcygtctgtgaggcttagtgtgggttttttatgggttttgaatgggggagtacatgctgattggtccatgggtgggtttggaaaaagtaccactagattggttaaaaggcatcatccaaaaggaaccaatggagagagaggataagacggagatagaagttctcactcaggtcatggactctatcaggaaccggcaagtcggttttcaggctttaaactgtctttggcttgaaggtcgggtttcactgggacccgtccgtgtctgcctaggaatttatctgtctcttgtcactatcagtaaga

SEQ ID NO: 39890 - DNA, 601 bp, Human
gtgtatcaactgcagttgtgtttgcaatgggaagcaaaatatacaataaaccaccccctgaaggaaacatagtggctcaagttttcaaatgtatctgggtaagtccataaattgttttcttgcctttttcaatcaaaagaaagagatgctatgctgagaatatgggccttcaaacgtgggcatacatttttctcaatgacctctattctattttcatgttttttaacaagctaagattaaccagtcttcttcttatgcctctacttaaccattaagttaaaaaaagtaatcatctttttargttggcaaaaatcttctgaaatgtaattatatatagacagataacattttttcttttttgttgttattttttgttttgaatggcaagttctttcttaaagtgatagataaaattatatcagaaatattctgaaattcaatgcctgattaggtcaaagagttggaataagtcactagaagtatggtgtttgaaggaaggtataataagttggaaaaggcagaggatgtttttctctttgtctctcccatgatgtctactctctgccctagtttgctatttccaatcgtttcaagaaccgtt

SEQ ID NO: 39891 - DNA, 601 bp, Human
aagcaaaatatacaataaaccaccccctgaaggaaacatagtggctcaagttttcaaatgtatctgggtaagtccataaattgttttcttgcctttttcaatcaaaagaaagagatgctatgctgagaatatgggccttcaaacgtgggcatacatttttctcaatgacctctattctattttcatgttttttaacaagctaagattaaccagtcttcttcttatgcctctacttaaccattaagttaaaaaaagtaatcatctttttaagttggcaaaaatcttctgaaatgtaattatrtatagacagataacattttttcttttttgttgttattttttgttttgaatggcaagttctttcttaaagtgatagataaaattatatcagaaatattctgaaattcaatgcctgattaggtcaaagagttggaataagtcactagaagtatggtgtttgaaggaaggtataataagttggaaaaggcagaggatgtttttctctttgtctctcccatgatgtctactctctgccctagtttgctatttccaatcgtttcaagaaccgttctggagacattccaaagcgacagcactggct

SEQ ID NO: 39892 - DNA, 601 bp, Human
tgggcatacatttttctcaatgacctctattctattttcatgttttttaacaagctaagattaaccagtcttcttcttatgcctctacttaaccattaagttaaaaaaagtaatcatctttttaagttggcaaaaatcttctgaaatgtaattatatatagacagataacattttttcttttttgttgttattttttgttttgaatggcaagttctttcttaaagtgatagataaaattatatcagaaatattctgaaattcaatgcctgattaggtcaaagagttggaataagtcactaraagtatggtgtttgaaggaaggtataataagttggaaaaggcagaggatgtttttctctttgtctctcccatgatgtctactctctgccctagtttgctatttccaatcgtttcaagaaccgttctggagacattccaaagcgacagcactggctagactgggcggctgagaaatatccagtaagttggaaatgcagaaacatcttatggcttgatagagtctttcctaatgttcaaaatgattctatcctactgcattcaacctcctctctactgttttttggacacttctactttaag

SEQ ID NO: 39893 - DNA, 601 bp, Human
ataacattttttcttttttgttgttattttttgttttgaatggcaagttctttcttaaagtgatagataaaattatatcagaaatattctgaaattcaatgcctgattaggtcaaagagttggaataagtcactagaagtatggtgtttgaaggaaggtataataagttggaaaaggcagaggatgtttttctctttgtctctcccatgatgtctactctctgccctagtttgctatttccaatcgtttcaagaaccgttctggagacattccaaagcgacagcactggctagactgggcrgctgagaaatatccagtaagttggaaatgcagaaacatcttatggcttgatagagtctttcctaatgttcaaaatgattctatcctactgcattcaacctcctctctactgttttttggacacttctactttaagcaagaaagccatgtacagaacttctagcatttctgcccattcttcctccttttcgcagaagcagctcattatggatgtaaaggcactgaccagggtactattcctttatatcccattgcccatgttctgggctcttttggatcagcaggtaagaatagttctttt

SEQ ID NO: 39894 - DNA, 601 bp, Human
gtcactagaagtatggtgtttgaaggaaggtataataagttggaaaaggcagaggatgtttttctctttgtctctcccatgatgtctactctctgccctagtttgctatttccaatcgtttcaagaaccgttctggagacattccaaagcgacagcactggctagactgggcggctgagaaatatccagtaagttggaaatgcagaaacatcttatggcttgatagagtctttcctaatgttcaaaatgattctatcctactgcattcaacctcctctctactgttttttggacacttctrctttaagcaagaaagccatgtacagaacttctagcatttctgcccattcttcctccttttcgcagaagcagctcattatggatgtaaaggcactgaccagggtactattcctttatatcccattgcccatgttctgggctcttttggatcagcaggtaagaatagttcttttggacattaccgctccttacagccacttccctctcacaggaaagggatttctcataacaggatctgtttgccctagggttcacgatggactttgcaagccatcaggatgaataggaatttggtgagtag

SEQ ID NO: 39895 - DNA, 601 bp, Human
gtctttcctaatgttcaaaatgattctatcctactgcattcaacctcctctctactgttttttggacacttctactttaagcaagaaagccatgtacagaacttctagcatttctgcccattcttcctccttttcgcagaagcagctcattatggatgtaaaggcactgaccagggtactattcctttatatcccattgcccatgttctgggctcttttggatcagcaggtaagaatagttcttttggacattaccgctccttacagccacttccctctcacaggaaagggatttctcatwacaggatctgtttgccctagggttcacgatggactttgcaagccatcaggatgaataggaatttggtgagtagaagagattttccagagaagtctattattttcttcatcatccatattggggaaaaattaatttctttgtgattttgcctgaaaactaacaagatcttcagagaagtgcttttagcctgaaggtaccgtgtaggcaaagataaagaaagctagtttagaaataaaaaccagaatcttctctttagaaatcaggaacataaggatgagaaagtttcaatgtatacaagga

SEQ ID NO: 39896 - DNA, 601 bp, Human
gcccatgttctgggctcttttggatcagcaggtaagaatagttcttttggacattaccgctccttacagccacttccctctcacaggaaagggatttctcataacaggatctgtttgccctagggttcacgatggactttgcaagccatcaggatgaataggaatttggtgagtagaagagattttccagagaagtctattattttcttcatcatccatattggggaaaaattaatttctttgtgattttgcctgaaaactaacaagatcttcagagaagtgcttttagcctgaaggtacygtgtaggcaaagataaagaaagctagtttagaaataaaaaccagaatcttctctttagaaatcaggaacataaggatgagaaagtttcaatgtatacaaggaagtattgagaggctagcaaatgatgtgatgcgtaacctgggatagtgattttcttctgtctaagcctatcccagagtacagcagggacaggtttgagtggcactactacgcaattggtctatctcttcaacaaggatcacagcaggggacctgtgggaaatggaatattttgtatgtatggatatggaaagaatgaga

SEQ ID NO: 39897 - DNA, 601 bp, Human
gggatttctcataacaggatctgtttgccctagggttcacgatggactttgcaagccatcaggatgaataggaatttggtgagtagaagagattttccagagaagtctattattttcttcatcatccatattggggaaaaattaatttctttgtgattttgcctgaaaactaacaagatcttcagagaagtgcttttagcctgaaggtaccgtgtaggcaaagataaagaaagctagtttagaaataaaaaccagaatcttctctttagaaatcaggaacataaggatgagaaagtttcartgtatacaaggaagtattgagaggctagcaaatgatgtgatgcgtaacctgggatagtgattttcttctgtctaagcctatcccagagtacagcagggacaggtttgagtggcactactacgcaattggtctatctcttcaacaaggatcacagcaggggacctgtgggaaatggaatattttgtatgtatggatatggaaagaatgagaaggttatacgtattattttctctttttccaaactccattctttagcccactcaaataaggtaccatctctactctcaattgttcttttcc

SEQ ID NO: 39898 - DNA, 601 bp, Human
gactttgcaagccatcaggatgaataggaatttggtgagtagaagagattttccagagaagtctattattttcttcatcatccatattggggaaaaattaatttctttgtgattttgcctgaaaactaacaagatcttcagagaagtgcttttagcctgaaggtaccgtgtaggcaaagataaagaaagctagtttagaaataaaaaccagaatcttctctttagaaatcaggaacataaggatgagaaagtttcaatgtatacaaggaagtattgagaggctagcaaatgatgtgatgcrtaacctgggatagtgattttcttctgtctaagcctatcccagagtacagcagggacaggtttgagtggcactactacgcaattggtctatctcttcaacaaggatcacagcaggggacctgtgggaaatggaatattttgtatgtatggatatggaaagaatgagaaggttatacgtattattttctctttttccaaactccattctttagcccactcaaataaggtaccatctctactctcaattgttcttttcctagattagtgtattatttttctatcttctcagtttttgaaaaga

SEQ ID NO: 39899 - DNA, 601 bp, Human
aagataaagaaagctagtttagaaataaaaaccagaatcttctctttagaaatcaggaacataaggatgagaaagtttcaatgtatacaaggaagtattgagaggctagcaaatgatgtgatgcgtaacctgggatagtgattttcttctgtctaagcctatcccagagtacagcagggacaggtttgagtggcactactacgcaattggtctatctcttcaacaaggatcacagcaggggacctgtgggaaatggaatattttgtatgtatggatatggaaagaatgagaaggttatacrtattattttctctttttccaaactccattctttagcccactcaaataaggtaccatctctactctcaattgttcttttcctagattagtgtattatttttctatcttctcagtttttgaaaagacagagtagaatgataccagggtcttattagtcagtctatttggagcctgcaaaatataattttaccttttcccttcctctggctgtctcttatttaccatggtggtcttcttgttgaccctctggagaacaactttggaaacactatgtgtcagggagagtcttcaccctaaccat

SEQ ID NO: 39900 - DNA, 601 bp, Human
taaggatgagaaagtttcaatgtatacaaggaagtattgagaggctagcaaatgatgtgatgcgtaacctgggatagtgattttcttctgtctaagcctatcccagagtacagcagggacaggtttgagtggcactactacgcaattggtctatctcttcaacaaggatcacagcaggggacctgtgggaaatggaatattttgtatgtatggatatggaaagaatgagaaggttatacgtattattttctctttttccaaactccattctttagcccactcaaataaggtaccatctctrctctcaattgttcttttcctagattagtgtattatttttctatcttctcagtttttgaaaagacagagtagaatgataccagggtcttattagtcagtctatttggagcctgcaaaatataattttaccttttcccttcctctggctgtctcttatttaccatggtggtcttcttgttgaccctctggagaacaactttggaaacactatgtgtcagggagagtcttcaccctaaccatgatgtcttgcccttcatattattacaacctagaactgcagttgctgagatcaataaaaatg

SEQ ID NO: 39901 - DNA, 601 bp, Human
aaagtttcaatgtatacaaggaagtattgagaggctagcaaatgatgtgatgcgtaacctgggatagtgattttcttctgtctaagcctatcccagagtacagcagggacaggtttgagtggcactactacgcaattggtctatctcttcaacaaggatcacagcaggggacctgtgggaaatggaatattttgtatgtatggatatggaaagaatgagaaggttatacgtattattttctctttttccaaactccattctttagcccactcaaataaggtaccatctctactctcaattrttcttttcctagattagtgtattatttttctatcttctcagtttttgaaaagacagagtagaatgataccagggtcttattagtcagtctatttggagcctgcaaaatataattttaccttttcccttcctctggctgtctcttatttaccatggtggtcttcttgttgaccctctggagaacaactttggaaacactatgtgtcagggagagtcttcaccctaaccatgatgtcttgcccttcatattattacaacctagaactgcagttgctgagatcaataaaaatgcactgactct

SEQ ID NO: 39902 - DNA, 601 bp, Human
agccagaagctttcccaagtctgttcccatcccccaaataatcttaacagcaaaatagtggccctgaaccaaagacctgatgaattttctctcatatgtttctcacttgctaactagcaaaattattgatctaggccaacatttttttttcttttcttcacacatcaactaaattaatttgttaaaatgtttcaggggttttttgtgcttcagccggaccagatgcaggtatgtgactcttctatagccatggggacttatttgtttccttatctatgcctccacctgcagtattacgatwaacaaccataatttgatgcttttctccttgtacgctgataagggccaagcttcgacatgaaaacattcccattaagccccacccttctccttcacatcccctgttaagtacttaacttgcaacgggttaagtgtaagcattggatttttttccaagtcaagatagtataatcaaaatcttgtaaaagaaattgtaaggcttattttgtgagcaatgaagtcatgagaggaaagagctcacaataaggctggcagaaagacaggctcagagtgaaacttgtcccttgggatatttgaaagc

SEQ ID NO: 39903 - DNA, 601 bp, Human
caaataatcttaacagcaaaatagtggccctgaaccaaagacctgatgaattttctctcatatgtttctcacttgctaactagcaaaattattgatctaggccaacatttttttttcttttcttcacacatcaactaaattaatttgttaaaatgtttcaggggttttttgtgcttcagccggaccagatgcaggtatgtgactcttctatagccatggggacttatttgtttccttatctatgcctccacctgcagtattacgattaacaaccataatttgatgcttttctccttgtacrctgataagggccaagcttcgacatgaaaacattcccattaagccccacccttctccttcacatcccctgttaagtacttaacttgcaacgggttaagtgtaagcattggatttttttccaagtcaagatagtataatcaaaatcttgtaaaagaaattgtaaggcttattttgtgagcaatgaagtcatgagaggaaagagctcacaataaggctggcagaaagacaggctcagagtgaaacttgtcccttgggatatttgaaagctaaaatgctatgcaagggaaatagggtcttgggt

SEQ ID NO: 39904 - DNA, 601 bp, Human
caaagacctgatgaattttctctcatatgtttctcacttgctaactagcaaaattattgatctaggccaacatttttttttcttttcttcacacatcaactaaattaatttgttaaaatgtttcaggggttttttgtgcttcagccggaccagatgcaggtatgtgactcttctatagccatggggacttatttgtttccttatctatgcctccacctgcagtattacgattaacaaccataatttgatgcttttctccttgtacgctgataagggccaagcttcgacatgaaaacattcycattaagccccacccttctccttcacatcccctgttaagtacttaacttgcaacgggttaagtgtaagcattggatttttttccaagtcaagatagtataatcaaaatcttgtaaaagaaattgtaaggcttattttgtgagcaatgaagtcatgagaggaaagagctcacaataaggctggcagaaagacaggctcagagtgaaacttgtcccttgggatatttgaaagctaaaatgctatgcaagggaaatagggtcttgggtgtaaatggactgaggaatgtggagtcattctgtac

SEQ ID NO: 39905 - DNA, 601 bp, Human
attgatctaggccaacatttttttttcttttcttcacacatcaactaaattaatttgttaaaatgtttcaggggttttttgtgcttcagccggaccagatgcaggtatgtgactcttctatagccatggggacttatttgtttccttatctatgcctccacctgcagtattacgattaacaaccataatttgatgcttttctccttgtacgctgataagggccaagcttcgacatgaaaacattcccattaagccccacccttctccttcacatcccctgttaagtacttaacttgcaacrggttaagtgtaagcattggatttttttccaagtcaagatagtataatcaaaatcttgtaaaagaaattgtaaggcttattttgtgagcaatgaagtcatgagaggaaagagctcacaataaggctggcagaaagacaggctcagagtgaaacttgtcccttgggatatttgaaagctaaaatgctatgcaagggaaatagggtcttgggtgtaaatggactgaggaatgtggagtcattctgtacttacaatgacaaaagtgtgtgtagatgtgagacagagtgtaaacaagcaaatgag

SEQ ID NO: 39906 - DNA, 601 bp, Human
ggccaacatttttttttcttttcttcacacatcaactaaattaatttgttaaaatgtttcaggggttttttgtgcttcagccggaccagatgcaggtatgtgactcttctatagccatggggacttatttgtttccttatctatgcctccacctgcagtattacgattaacaaccataatttgatgcttttctccttgtacgctgataagggccaagcttcgacatgaaaacattcccattaagccccacccttctccttcacatcccctgttaagtacttaacttgcaacgggttaagtrtaagcattggatttttttccaagtcaagatagtataatcaaaatcttgtaaaagaaattgtaaggcttattttgtgagcaatgaagtcatgagaggaaagagctcacaataaggctggcagaaagacaggctcagagtgaaacttgtcccttgggatatttgaaagctaaaatgctatgcaagggaaatagggtcttgggtgtaaatggactgaggaatgtggagtcattctgtacttacaatgacaaaagtgtgtgtagatgtgagacagagtgtaaacaagcaaatgagtgcagtgct

SEQ ID NO: 39907 - DNA, 601 bp, Human
ttttcttcacacatcaactaaattaatttgttaaaatgtttcaggggttttttgtgcttcagccggaccagatgcaggtatgtgactcttctatagccatggggacttatttgtttccttatctatgcctccacctgcagtattacgattaacaaccataatttgatgcttttctccttgtacgctgataagggccaagcttcgacatgaaaacattcccattaagccccacccttctccttcacatcccctgttaagtacttaacttgcaacgggttaagtgtaagcattggatttttttccaagtcaagatagtataatcaaaatcttgtaaaagaaattgtaaggcttattttgtgagcaatgaagtcatgagaggaaagagctcacaataaggctggcagaaagacaggctcagagtgaaacttgtcccttgggatatttgaaagctaaaatgctatgcaagggaaatagggtcttgggtgtaaatggactgaggaatgtggagtcattctgtacttacaatgacaaaagtgtgtgtagatgtgagacagagtgtaaacaagcaaatgagtgcagtgctcacactcatgataggaga

SEQ ID NO: 39908 - DNA, 601 bp, Human
atcccctgttaagtacttaacttgcaacgggttaagtgtaagcattggatttttttccaagtcaagatagtataatcaaaatcttgtaaaagaaattgtaaggcttattttgtgagcaatgaagtcatgagaggaaagagctcacaataaggctggcagaaagacaggctcagagtgaaacttgtcccttgggatatttgaaagctaaaatgctatgcaagggaaatagggtcttgggtgtaaatggactgaggaatgtggagtcattctgtacttacaatgacaaaagtgtgtgtagatrtgagacagagtgtaaacaagcaaatgagtgcagtgctcacactcatgataggagaatatttgtagctaatcctttttatcatggtgttacaggttctaaatccccttctggttcttatcttcatcccgttgtttgactttgtcatttatcgtctggtctccaagtgtggaattaacttctcgtaagtgttcactatgtctgtatggattactctaaattgactcagtctttgcccagtttgaaaaagattcaatgtcagtatttttcttagtgaggattggttttagtttatcatctatc

SEQ ID NO: 39909 - DNA, 601 bp, Human
tttccaagtcaagatagtataatcaaaatcttgtaaaagaaattgtaaggcttattttgtgagcaatgaagtcatgagaggaaagagctcacaataaggctggcagaaagacaggctcagagtgaaacttgtcccttgggatatttgaaagctaaaatgctatgcaagggaaatagggtcttgggtgtaaatggactgaggaatgtggagtcattctgtacttacaatgacaaaagtgtgtgtagatgtgagacagagtgtaaacaagcaaatgagtgcagtgctcacactcatgataggrgaatatttgtagctaatcctttttatcatggtgttacaggttctaaatccccttctggttcttatcttcatcccgttgtttgactttgtcatttatcgtctggtctccaagtgtggaattaacttctcgtaagtgttcactatgtctgtatggattactctaaattgactcagtctttgcccagtttgaaaaagattcaatgtcagtatttttcttagtgaggattggttttagtttatcatctatctgcttctatttttccatgttagactaactgcctattgaccctgaaaaatgtga

SEQ ID NO: 39910 - DNA, 601 bp, Human
tattttgtgagcaatgaagtcatgagaggaaagagctcacaataaggctggcagaaagacaggctcagagtgaaacttgtcccttgggatatttgaaagctaaaatgctatgcaagggaaatagggtcttgggtgtaaatggactgaggaatgtggagtcattctgtacttacaatgacaaaagtgtgtgtagatgtgagacagagtgtaaacaagcaaatgagtgcagtgctcacactcatgataggagaatatttgtagctaatcctttttatcatggtgttacaggttctaaatcccyttctggttcttatcttcatcccgttgtttgactttgtcatttatcgtctggtctccaagtgtggaattaacttctcgtaagtgttcactatgtctgtatggattactctaaattgactcagtctttgcccagtttgaaaaagattcaatgtcagtatttttcttagtgaggattggttttagtttatcatctatctgcttctatttttccatgttagactaactgcctattgaccctgaaaaatgtgaattagatataattaatgagagtcaaagccattactgtggacttaactgtgta

SEQ ID NO: 39911 - DNA, 601 bp, Human
tatttgaaagctaaaatgctatgcaagggaaatagggtcttgggtgtaaatggactgaggaatgtggagtcattctgtacttacaatgacaaaagtgtgtgtagatgtgagacagagtgtaaacaagcaaatgagtgcagtgctcacactcatgataggagaatatttgtagctaatcctttttatcatggtgttacaggttctaaatccccttctggttcttatcttcatcccgttgtttgactttgtcatttatcgtctggtctccaagtgtggaattaacttctcgtaagtgttcacyatgtctgtatggattactctaaattgactcagtctttgcccagtttgaaaaagattcaatgtcagtatttttcttagtgaggattggttttagtttatcatctatctgcttctatttttccatgttagactaactgcctattgaccctgaaaaatgtgaattagatataattaatgagagtcaaagccattactgtggacttaactgtgtaatggtggtggaggggcaggtctaggtttcatgccaaaccaaaaatatgtgaaatttagctcctaaaccaactttcttctttgttcttga

SEQ ID NO: 39912 - DNA, 601 bp, Human
gcagtgctcacactcatgataggagaatatttgtagctaatcctttttatcatggtgttacaggttctaaatccccttctggttcttatcttcatcccgttgtttgactttgtcatttatcgtctggtctccaagtgtggaattaacttctcgtaagtgttcactatgtctgtatggattactctaaattgactcagtctttgcccagtttgaaaaagattcaatgtcagtatttttcttagtgaggattggttttagtttatcatctatctgcttctatttttccatgttagactaactkcctattgaccctgaaaaatgtgaattagatataattaatgagagtcaaagccattactgtggacttaactgtgtaatggtggtggaggggcaggtctaggtttcatgccaaaccaaaaatatgtgaaatttagctcctaaaccaactttcttctttgttcttgaatgttgtctcttcaaagaaactcaaggcctttgatgactactaatccctttaaatctcctgttgtccctacaaaacaaatggggaacctagtaggactggggactgaattattcccaattactgcctgaaattttt

SEQ ID NO: 39913 - DNA, 601 bp, Human
cagtgctcacactcatgataggagaatatttgtagctaatcctttttatcatggtgttacaggttctaaatccccttctggttcttatcttcatcccgttgtttgactttgtcatttatcgtctggtctccaagtgtggaattaacttctcgtaagtgttcactatgtctgtatggattactctaaattgactcagtctttgcccagtttgaaaaagattcaatgtcagtatttttcttagtgaggattggttttagtttatcatctatctgcttctatttttccatgttagactaactgyctattgaccctgaaaaatgtgaattagatataattaatgagagtcaaagccattactgtggacttaactgtgtaatggtggtggaggggcaggtctaggtttcatgccaaaccaaaaatatgtgaaatttagctcctaaaccaactttcttctttgttcttgaatgttgtctcttcaaagaaactcaaggcctttgatgactactaatccctttaaatctcctgttgtccctacaaaacaaatggggaacctagtaggactggggactgaattattcccaattactgcctgaaatttttt

SEQ ID NO: 39914 - DNA, 601 bp, Human
ggagaatatttgtagctaatcctttttatcatggtgttacaggttctaaatccccttctggttcttatcttcatcccgttgtttgactttgtcatttatcgtctggtctccaagtgtggaattaacttctcgtaagtgttcactatgtctgtatggattactctaaattgactcagtctttgcccagtttgaaaaagattcaatgtcagtatttttcttagtgaggattggttttagtttatcatctatctgcttctatttttccatgttagactaactgcctattgaccctgaaaaatgkgaattagatataattaatgagagtcaaagccattactgtggacttaactgtgtaatggtggtggaggggcaggtctaggtttcatgccaaaccaaaaatatgtgaaatttagctcctaaaccaactttcttctttgttcttgaatgttgtctcttcaaagaaactcaaggcctttgatgactactaatccctttaaatctcctgttgtccctacaaaacaaatggggaacctagtaggactggggactgaattattcccaattactgcctgaaattttttctaaatagaaggactagtct

SEQ ID NO: 39915 - DNA, 601 bp, Human
catatggtatttgttcaataaacctgattgtattgccattatttttggtgttatgacatagcgaatagaaaaaccatcataagcaaagatggaggtgggtaaatgtggtgtatcacagagaagagcagttcaatgtgactcaagaacaagaagaaagaagcatgtatgaaggggagttctaggaaatcccttgaaaagtaattggtcatggaaacatggatttaaaaaaggaaagtaattgggatcaaatcaggaaaagtctttgatgcagtttgaatatttgtacccactcaaatctcakgttgaaatgtaatccccaatgttggatgttggaggtggggtctggtgggaggtagtcggatcatggggatgaattcctcataaatggtttagtgctatcccgttggtgctgtccttatgatagtgagttctagtgggatctgaccatttaaaagcatgtagtatctccctacccttcacttgctcctgctttcaccatgtgacatgtctgtttctccagagggtacaagccataaaccttggtggcttctacatggtgttaagcctgcaggcatacagagtgcaagaatgaagaatgctt

SEQ ID NO: 39916 - DNA, 601 bp, Human
atggaaacatggatttaaaaaaggaaagtaattgggatcaaatcaggaaaagtctttgatgcagtttgaatatttgtacccactcaaatctcatgttgaaatgtaatccccaatgttggatgttggaggtggggtctggtgggaggtagtcggatcatggggatgaattcctcataaatggtttagtgctatcccgttggtgctgtccttatgatagtgagttctagtgggatctgaccatttaaaagcatgtagtatctccctacccttcacttgctcctgctttcaccatgtgacatgyctgtttctccagagggtacaagccataaaccttggtggcttctacatggtgttaagcctgcaggcatacagagtgcaagaatgaagaatgcttggcacccttcacctagatttcagaggctgtatgagaaagtgtgggtgttcatgcagaaaccggctgcaggggtggagcccccagagagtacctctactagggcagtgtggaggtaaaatgtggggttggagctcccacacagagtccccacaaggacactgcctagtgcagctgtgagaagggggccaccatcctccagaccccaga

SEQ ID NO: 39917 - DNA, 601 bp, Human
atggatttaaaaaaggaaagtaattgggatcaaatcaggaaaagtctttgatgcagtttgaatatttgtacccactcaaatctcatgttgaaatgtaatccccaatgttggatgttggaggtggggtctggtgggaggtagtcggatcatggggatgaattcctcataaatggtttagtgctatcccgttggtgctgtccttatgatagtgagttctagtgggatctgaccatttaaaagcatgtagtatctccctacccttcacttgctcctgctttcaccatgtgacatgtctgtttcyccagagggtacaagccataaaccttggtggcttctacatggtgttaagcctgcaggcatacagagtgcaagaatgaagaatgcttggcacccttcacctagatttcagaggctgtatgagaaagtgtgggtgttcatgcagaaaccggctgcaggggtggagcccccagagagtacctctactagggcagtgtggaggtaaaatgtggggttggagctcccacacagagtccccacaaggacactgcctagtgcagctgtgagaagggggccaccatcctccagaccccagaatgataga

SEQ ID NO: 39918 - DNA, 601 bp, Human
catggggatgaattcctcataaatggtttagtgctatcccgttggtgctgtccttatgatagtgagttctagtgggatctgaccatttaaaagcatgtagtatctccctacccttcacttgctcctgctttcaccatgtgacatgtctgtttctccagagggtacaagccataaaccttggtggcttctacatggtgttaagcctgcaggcatacagagtgcaagaatgaagaatgcttggcacccttcacctagatttcagaggctgtatgagaaagtgtgggtgttcatgcagaaaccrgctgcaggggtggagcccccagagagtacctctactagggcagtgtggaggtaaaatgtggggttggagctcccacacagagtccccacaaggacactgcctagtgcagctgtgagaagggggccaccatcctccagaccccagaatgatagacccactggcagcttgcaccctgggcctggaaaaccacgggcactcaacaacctgtgagagcagccacaggggctgaactctgcaaagccacaagggtggagctatccaagtccttgggagcccaccccttgtattggtgtgccctga

SEQ ID NO: 39919 - DNA, 601 bp, Human
atggtgttaagcctgcaggcatacagagtgcaagaatgaagaatgcttggcacccttcacctagatttcagaggctgtatgagaaagtgtgggtgttcatgcagaaaccggctgcaggggtggagcccccagagagtacctctactagggcagtgtggaggtaaaatgtggggttggagctcccacacagagtccccacaaggacactgcctagtgcagctgtgagaagggggccaccatcctccagaccccagaatgatagacccactggcagcttgcaccctgggcctggaaaaccacrggcactcaacaacctgtgagagcagccacaggggctgaactctgcaaagccacaagggtggagctatccaagtccttgggagcccaccccttgtattggtgtgccctgaatgtgggacatggagtcaaaggagattattctggaactttaagatttaataactgccctgctgtgtttcagacttgcctggggcctgtagcccatttgttttggccagtttctcccttttggaatgggaatgtttacccagtatctatacccccattttatttggggagtcaataagttgttttgatttta

SEQ ID NO: 39920 - DNA, 601 bp, Human
caataagttgttttgattttataggctcatgggtggaagggacttgccttatttcaaatgagactttggacttggaacttttgattgagtttgtgctggaatgagttaaaatttggggaactattgggaagatataattgtattttgcaatgtgagaaggacatgagatttttggggggctagagatggaatgatatggtttgaatatttgtccctgccaaaatctcatgttgaaatgtaattcccagtgataaaggtggggcctggtgggacatgactggatcatgggagtgaattctcrtgaagggtttagcaccattctgtggtgctatcttcatgatagtgaatgagttctcacaagatctggtcatttaaaagtgtgtggcacctcccatctcctcgcttgcttctgctttcaccatgtgacatgcctattccacctttggcttctcccatgattgaaagctcctcgatgcttcaccagaagctggaagatgccagcactgtgcttcctgtaaagctacagaaccataagccaattaaacttcttttctttataaattacccagtctcaggtatttctttacagcaatgcaagaac

SEQ ID NO: 39921 - DNA, 601 bp, Human
ggggggctagagatggaatgatatggtttgaatatttgtccctgccaaaatctcatgttgaaatgtaattcccagtgataaaggtggggcctggtgggacatgactggatcatgggagtgaattctcgtgaagggtttagcaccattctgtggtgctatcttcatgatagtgaatgagttctcacaagatctggtcatttaaaagtgtgtggcacctcccatctcctcgcttgcttctgctttcaccatgtgacatgcctattccacctttggcttctcccatgattgaaagctcctcgakgcttcaccagaagctggaagatgccagcactgtgcttcctgtaaagctacagaaccataagccaattaaacttcttttctttataaattacccagtctcaggtatttctttacagcaatgcaagaacagtctaatgcagtctttaataataggctacagagtttggatttcatcctttagagtctaaagtttagatataattgtttctcctttccaccacagatcacttaggaaaatggctgttggtatgatcctagcatgcctggcatttgcagttgcggcagctgtagagataaaaat

SEQ ID NO: 39922 - DNA, 601 bp, Human
tttctcctttccaccacagatcacttaggaaaatggctgttggtatgatcctagcatgcctggcatttgcagttgcggcagctgtagagataaaaataaatgtgagttcagtaattcttaagctctatgagggcaggatcatatctttcttatttgctcttttgacttgttcagtcatgattccctgggacctagcacagtacctgttttataagaggtgcatcataagtatttgtgataaataagtagatacaggggtaaaacagcaatgcaaaatgaggcccacctcccacctgagtgrctcagaatgtattttcagggaattctcaaacactaatatccaagagagccctctccttagggaacacaggcttatgtgatgcctttctacatactcaagtaaaaaccttttggcagattgaatagccactattacggatgaggccacagctgagtcaaaaagcatcgagtttgtaagctggcattggtacttgctacaatgagctgatgtttccctctccaagctgcctttagagttttctaagccaaatatttttcagagggagaaaactatgtctacttggctagtggactaggctgt

SEQ ID NO: 39923 - DNA, 601 bp, Human
taaaaataaatgtgagttcagtaattcttaagctctatgagggcaggatcatatctttcttatttgctcttttgacttgttcagtcatgattccctgggacctagcacagtacctgttttataagaggtgcatcataagtatttgtgataaataagtagatacaggggtaaaacagcaatgcaaaatgaggcccacctcccacctgagtgactcagaatgtattttcagggaattctcaaacactaatatccaagagagccctctccttagggaacacaggcttatgtgatgcctttctasatactcaagtaaaaaccttttggcagattgaatagccactattacggatgaggccacagctgagtcaaaaagcatcgagtttgtaagctggcattggtacttgctacaatgagctgatgtttccctctccaagctgcctttagagttttctaagccaaatatttttcagagggagaaaactatgtctacttggctagtggactaggctgtcagaaacaactgagatatgtgttgccattgtatctgaaggattatttgttggtgattctgacatgtgttctttgctctaaggaaatggcc

SEQ ID NO: 39924 - DNA, 601 bp, Human
taaaaaccttttggcagattgaatagccactattacggatgaggccacagctgagtcaaaaagcatcgagtttgtaagctggcattggtacttgctacaatgagctgatgtttccctctccaagctgcctttagagttttctaagccaaatatttttcagagggagaaaactatgtctacttggctagtggactaggctgtcagaaacaactgagatatgtgttgccattgtatctgaaggattatttgttggtgattctgacatgtgttctttgctctaaggaaatggccccagcccagycaggtccccaggaggttttcctacaagtcttgaatctggcagatgatgaggtgaaggtgacagtggtgggaaatgaaaacaattctctgttgatagagtccatcaaatcctttcaggtgaggtgtgtacctgaatgaattagaaactctgtatgctatattgatcttgatttttccttaacattaattgtatcataagcatcttcccatgtctttagataatctttgagcacatgattttaatgggcatataatattccattctatagatataccatagtttatttagacatttccacat

SEQ ID NO: 39925 - DNA, 601 bp, Human
tggctagtggactaggctgtcagaaacaactgagatatgtgttgccattgtatctgaaggattatttgttggtgattctgacatgtgttctttgctctaaggaaatggccccagcccagccaggtccccaggaggttttcctacaagtcttgaatctggcagatgatgaggtgaaggtgacagtggtgggaaatgaaaacaattctctgttgatagagtccatcaaatcctttcaggtgaggtgtgtacctgaatgaattagaaactctgtatgctatattgatcttgatttttccttaayattaattgtatcataagcatcttcccatgtctttagataatctttgagcacatgattttaatgggcatataatattccattctatagatataccatagtttatttagacatttccacataggtattccgtttttattattatacataatcctacaatgaacattcttattcataaatatttatgcatggctctgattatttcttagggtaaattccaagaaataaaatggctaggttaaagaaaggaattactaggttgaaagtgtctgatgaggtcacctaccctgagatgctacatcg

SEQ ID NO: 39926 - DNA, 601 bp, Human
gaaagagattaaagattaaaatgaagagctgcagagtcagacttcccgtgttcaaattttggctgcatgacctattgtgtaaccttgagcaagtaaattactatctctgtaatgctgtcgcccaggctggagtgcagtggcgcgatctcagctcactgcattccagcctgagcgacagagcgagactccatctgcctccccggctcaagcgattctcctgcctcagcctcttgagtagctgggattataggcgcacaccaccattcctggctaatttttgtatttttagtagagacagggyttcaccatgttggccaggctgatctctaactcctgaccttggatgatctgcccaccttggcctcccaaagtgctaggattacaggcttgagctactgcgcccagtctgtaatactattttttaaatgtataagaatacgaatagaacttatctcttaggattgtaatgaagattatatgacataatgagtttaaatatattcagttaggagcttcatcttattcttactgtttacattattaacaccctctgaatcaatgtgatagctgaacttaataagagaagttctaacttggaagc

SEQ ID NO: 39927 - DNA, 601 bp, Human
gtgggcattacaactttatgatttatcttatacctaaacattgatgaacttttcctgttattttcttgattatattttattttattggttttcccacagagttttcaatgaattgaaaaagtgcttgtctagtatttcagccagtgctaatgaataacaaatgatgggcttatgaaagcagctctgttctgtattgagggtttgtccttcattgtataccacacggctagtaacagtgtggtcctcttcctggtgctgctgggttctccatggtgcctagcagaaagtcttcctggtgttktccctggcctgatgctttagacaacgcttgggagttgattctgtgtgtactagttggggagtagcatggccatgtatgtatcttttgtttttgtttagtttctcataaagtagcattgttacaagtttttacaaattctcatttataactctaccaccagaacccatggttgtattccgttttcttttttcttgagacagagtcttgctctgttgcccaggctggagtgcagtggtgcgatctcggctcactgcaacctccacctactgggttcaagcgattcttgtgcctcggcctctc

SEQ ID NO: 39928 - DNA, 601 bp, Human
ggaaatgacagtaggactgataattattttcacttctacgctttgcaaacacgaacactagatatgaattcagttagtaggattaattgactggtcatcagtctctccttcccatgtactttatttttttgaaatggagtttcactcttgttgcccaggctggaatgcaatggcgtgatcttggctcactgcaacctccgcctcctgggtacaagcgattctcctgcctcagcctcctgagtagctgagattacaggcgcttgccaccacgcccagctaatttttgtattttagtagggaygggatttcaccatgttggtcaggctggtctcgaactcctgacctcaggtgatccatctgcctcagcctcccaaagtgctgagattacaggcatgagtcaccgcacccggcccttcccatgtactttaaatatttatctctatggttgacttctgctctgaagcatgtactttcctctcttagctgcataatttagccaatagcagaaactagcctggaactgtggtgactggccctttttcagtattttgtagatgaccccactgactttatggaggtggatggagactacgaagtgcca

SEQ ID NO: 39929 - DNA, 601 bp, Human
cttctacgctttgcaaacacgaacactagatatgaattcagttagtaggattaattgactggtcatcagtctctccttcccatgtactttatttttttgaaatggagtttcactcttgttgcccaggctggaatgcaatggcgtgatcttggctcactgcaacctccgcctcctgggtacaagcgattctcctgcctcagcctcctgagtagctgagattacaggcgcttgccaccacgcccagctaatttttgtattttagtagggacgggatttcaccatgttggtcaggctggtctcraactcctgacctcaggtgatccatctgcctcagcctcccaaagtgctgagattacaggcatgagtcaccgcacccggcccttcccatgtactttaaatatttatctctatggttgacttctgctctgaagcatgtactttcctctcttagctgcataatttagccaatagcagaaactagcctggaactgtggtgactggccctttttcagtattttgtagatgaccccactgactttatggaggtggatggagactacgaagtgccagatgccacaatgcctggtgttcctcagcagta

SEQ ID NO: 39930 - DNA, 601 bp, Human
tatagtgtgtgttttttttttttttttaaatcacacttggtaataccttcactttaaagataaaagttgtaagtactaggaagctataaagttcatggtgggagatgagaggttttccaaaatctaatctttgcacaaaagctttattattgacaactaatactatcttttgttgttactgtttgtttttttcctaatagtgtcttttggaaaaaagacctgccaaatgtccaagtctgcattaccatagtttttccatcagttgttcttccaattaagaatgatactcaatgaaaaaaaatggctagttcatctcttaattgaagcatttgcacaagtgctttactttgtgacaccgtaatattgcaccatacatcagaggtgttttacttgtatttcctctgtaaaaaagacttctacttaagggtcaggatttaataaatagaatttataatatttccttgctttatcaaggtcattcttatgaaattggcaccactgtctcaattgtgctaaggtaccagcagttttacctaccaggtttttttgcactattagtatagatgtcaatacagtgaagaaaggcaataataccgtaata

SEQ ID NO: 39931 - DNA, 601 bp, Human
caccttggtctttgtactttcattgtgattatgctagcagatatggcagaaaaaccaaatatgaatgattagaagctttgaaattattttaaggttttggacttttccaggatgaagagactcggcacagccttgagtgcatccaggccaatcagatctttcccaggaagcagctgatccgggaggatgagaatcttcaggtaattataggccacttttaaatgtaaaatatttatttagcattaactgtatagcagagttaatggatttaagtgtaacgtactatattatatatatatawaacatacatgtagtagaaatgcaagctggaaaacatctcattttagcaagacttatttcctgagaatccactgtttaagatgatcttctctgtatcattcctttagtagttcagaatttgaataactagatatatttgaattaggtgggtataaacccatcctctttagcttccttatctacttatgtgctgtgttttcaacttcagtggcagaggatttaccatccattcagccaactgatgtttgaagcttttttttttttaactgcttcagaactctgaagggtttctttcatttcg

SEQ ID NO: 39932 - DNA, 601 bp, Human
ctctaaggtaaatggagaaagtaagtcaaaaaacttaatgctctcaaagagaggagaggcatacagaattgggagagaaagcattatgtgctctgcttttctcacttaatttagcactcaaggaacactggcttggccaggcgcggtggctcacgcctgtaatcccagcactttgggaggccaaggcaggcagatcacgaggtcaggagatcgagaccatcctggctaacacggtgaaaccccatttctactaaaaatacaaaaaattagccgggcgtggtggcaggtgcctgtagtcccrgctactcaggaggctgagtcaggagaatggcatgaacccgggaggtggagctggcagtgagccaagatcacgccactgcactccagcctgggtgaccagagcaagactccatctcaaaaacaaacaaacaacaacaacaaaacacactagatcagcaagcagctcttatgcttgatttaaaatgatgtgtgtagttgtcagctgaggtgtccattgtttagtttaacagtgaatgatttgcattaggtaatgctgtatcattaagctttataaaggtataaaggctgaatgggcttttat

SEQ ID NO: 39933 - DNA, 601 bp, Human
cactttgggaggccaaggcaggcagatcacgaggtcaggagatcgagaccatcctggctaacacggtgaaaccccatttctactaaaaatacaaaaaattagccgggcgtggtggcaggtgcctgtagtcccagctactcaggaggctgagtcaggagaatggcatgaacccgggaggtggagctggcagtgagccaagatcacgccactgcactccagcctgggtgaccagagcaagactccatctcaaaaacaaacaaacaacaacaacaaaacacactagatcagcaagcagctcttrtgcttgatttaaaatgatgtgtgtagttgtcagctgaggtgtccattgtttagtttaacagtgaatgatttgcattaggtaatgctgtatcattaagctttataaaggtataaaggctgaatgggcttttattctgcaatctttagtagttaccaactgcctcagttgagataattcccttggccttaatgtcaaaagatgagatgcactttgagctcactgcagactctcattacagcatgaggttactctaatgactccttggtggtataagtgtagatgttaagtataatgttgatt

SEQ ID NO: 39934 - DNA, 601 bp, Human
actgaagaaaaggaagcctcttgattctcaagagtacatttacccttttcagttatgaatgtcctctcagtgaactggttcttccagtgctctgctatcattagccttaaatgaaacgaataaaggcttgaaaattcatgtacttacagcaaatgccttcttccttctttacttgccagtgttgtggctttctacactccacttccagcacagagaagtgtattatgacacgttaaaacagctcaggactgtaattccatgcagactgtgttttggcttcattttgggattctttgaaattttgttcattcgttttactcagcaattaaaaaaagactcagtggctgtcattttttttttggtagttgacattttttacttcttattatcattcttctttgtagttaagcatttatgtccaggagcagttttggcctgaatcccttctggcttctagatttgggccatgattatagcagttacatcagttttctgtctatcagctaaagatacacaccagattcattaaggaaagaggcaatgctgttctttcatactatgtagcactctgttcagaagggtccacttggatttgagtagt

SEQ ID NO: 39935 - DNA, 601 bp, Human
ttattatcattcttctttgtagttaagcatttatgtccaggagcagttttggcctgaatcccttctggcttctagatttgggccatgattatagcagttacatcagttttctgtctatcagctaaagatacacaccagattcattaaggaaagaggcaatgctgttctttcatactatgtagcactctgttcagaagggtccacttggatttgagtagtcgtgatggggaggggaaaggggggaaacacctataaaatcccagcaactgagaattccccaccagctactgtggaagtaatratagtagtgtttagtagaactgcccaatttaactttgtgttctttcagtgtttgaattgctggaattaaattataattaaattgcatgtgagaatgatagtttcatatcattgcattttctcatatcatcctgtatttatcagtttattggttgatggccaagtgtttcagagactattttagaactatttgggaataaggtctgctggaaagcaagcaggaaagaaagaaagaaagaaactgatcatgtcattcatcagcttaaagcccttcagtgtttcttcactacttctatgatga

SEQ ID NO: 39936 - DNA, 601 bp, Human
ttgcatgtgagaatgatagtttcatatcattgcattttctcatatcatcctgtatttatcagtttattggttgatggccaagtgtttcagagactattttagaactatttgggaataaggtctgctggaaagcaagcaggaaagaaagaaagaaagaaactgatcatgtcattcatcagcttaaagcccttcagtgtttcttcactacttctatgatgaagatcagattgtttagcatgacatgaagctgtctgacaacgtggcagggaccaaggatcacagcttccctcctttccccatkatcacatttttacttgtaaaagcagcctctttgtactattcagccatacctcacacctctgtgttctcttttcggcccaggaacttctgttcatctgtcaaaattcagttcaggtgataacttctcctgtgaagcctttcttagtcccagttccctctgtgacagttaactacactctttctttgctttgtctttatcttgtacattcttttataacatttaccaaataggttgtaatttttggttaattgtttttgtgtcttcaagatccagcatgtctcctggtgccacaatattcag

SEQ ID NO: 39937 - DNA, 601 bp, Human
aaaaaaaaaatttcagattgagagagactagaactcctccataaaaataaattaatttcatcacagctagtgctaagagattcctgaaacctgaaacctggaggtacttaggaaacaaggattcttcctgcatcgggtcctggatggagatcagacagttggtagtggtgttgcccctccctctttccttcccttagcaaataagtatttcaataaaatatgtgtatttcaataaaatgttagatcaggaggctctctttaaatgttattttatctatatcaaacacatttaaaccatcaragcccagacataccagcatatgttgtggcatgccccagttcatcattttgtatgcttaaatcaaaatacttagcacttcagaaaatgatttaccatcaagttttaaatagctacctgatatcatatattctcttttaatttcacagcacattgagtaaaatgtgtctgtaggttttgataccgtaaacatcattactttaattcacacattcactgaatatcaagttccagttcctgtggtaaagaatctctgtagtagagtttatgtgtagcatttaaggtatacattgctcctattct

SEQ ID NO: 39938 - DNA, 601 bp, Human
ctttccttcccttagcaaataagtatttcaataaaatatgtgtatttcaataaaatgttagatcaggaggctctctttaaatgttattttatctatatcaaacacatttaaaccatcaaagcccagacataccagcatatgttgtggcatgccccagttcatcattttgtatgcttaaatcaaaatacttagcacttcagaaaatgatttaccatcaagttttaaatagctacctgatatcatatattctcttttaatttcacagcacattgagtaaaatgtgtctgtaggttttgatacygtaaacatcattactttaattcacacattcactgaatatcaagttccagttcctgtggtaaagaatctctgtagtagagtttatgtgtagcatttaaggtatacattgctcctattctgtgcttttcccaaattattatatatttacagacatagttctttgaagcttagataaattataaacaagtgttcaagtggaattcatgaacgtttaaaagtttgtttgtgtgtgtgtgtgtgtgtgtgtgtgtgtgtgtgtgtgtgtgtatgtgtttgtaatttaatagactgcttctcaatc

SEQ ID NO: 39939 - DNA, 601 bp, Human
attgtcaaaggtgaacaatagagtttgaatcttaaaccagtgacagtcttctgctgattagtgggtttttggtggttgttttttgaaacagggtcttgctctgtcgcccaggctggagtgcactggcgccatcatggcccactgcagcctcaacttcctgcgcttaggtgatcctcccacctcagccttctgagtagctaggtctacagacacatgccaccgcgttcagttaatttaattttattttttgtagagatgatgtctgtgttgcccaggttggtctcaaaactcctgggctcamgcagtgcacccactttggcctcccaaagtgctgggattacagatgtgagccactgcactcaattttttattttattttatttttattttattatatttattttatttttatgttatgttatgttattgtagtgacagggtttcaccatgttgcccaggctggtcttgaactcctgggctcaagcgatcctcctgcctcagcctaccaaagtgctgggtttatagatgtgagtcgtcgtgcccggccctgattagtttttaaatgaaaagatttttgtgcccagatattccactttattac

SEQ ID NO: 39940 - DNA, 601 bp, Human
tttttttccttcttagatgcacaggtctcagaagaattcttagttgcatcagttgcagtttctcacagcaccttggggttaaggacgtaaataaaaacagaaggccaaaagctccttttgttctcagaacacaggcaagatttttcttttttcttttcttttttttttgtttttgagatggagttttgctcttgttgcccaggctggtgtgcaatgacacgatctcagcttaccgcagtctctgcctctgggattcaagcgattctcccgcctcagcctctggagtagctgggattacagrcatgcaccaaaattacaggcatgcaccaaatacaggcatgcaccaaatacaggcatgcaccaaaatacaggcatgcaccaaaattatccgcacctggataattttgtatttttagtagagatggggtttctccatgttggtcaggctggtctcaaactcctgacctcaggtgatccgcccacctcggcctcccaaaatgttggcattacaggcgtgagccaccgtatccggccaagatttcttagtctttttctgacccccagtcctattacatttgtaagggaatttttatagactgta

SEQ ID NO: 39941 - DNA, 601 bp, Human
tcaggtgatccgcccacctcggcctcccaaaatgttggcattacaggcgtgagccaccgtatccggccaagatttcttagtctttttctgacccccagtcctattacatttgtaagggaatttttatagactgtagacttaaaagcaagaagactttagtcctaaggtagaaactcccagtcatttatctgagtaatattattttgctttcttctcttctttaacccctgctccagtttctgtttctttgtccagcactgggcttctttttgatccctgcatcctcattctgagagttctstgctgactggcagctctgtggtggggcagagtttgcaggaagcttgttcctgaaactggctcagctaacacgagggccagcctgtgcagacagtactcttgttcctgtctgcattggaggagactgtcctcctctttgcatactaaacacaagttgttggaatgctatttgcaactcccagagccacattttggctagacttgatacactgtaagaggcaaatggcccactcctttttcaaggagtaaaagtattcactattattttaccaggtttgccttgaaagcctagaaattgctt

SEQ ID NO: 39942 - DNA, 601 bp, Human
ggcgtgagccaccgtatccggccaagatttcttagtctttttctgacccccagtcctattacatttgtaagggaatttttatagactgtagacttaaaagcaagaagactttagtcctaaggtagaaactcccagtcatttatctgagtaatattattttgctttcttctcttctttaacccctgctccagtttctgtttctttgtccagcactgggcttctttttgatccctgcatcctcattctgagagttctctgctgactggcagctctgtggtggggcagagtttgcaggaagctkgttcctgaaactggctcagctaacacgagggccagcctgtgcagacagtactcttgttcctgtctgcattggaggagactgtcctcctctttgcatactaaacacaagttgttggaatgctatttgcaactcccagagccacattttggctagacttgatacactgtaagaggcaaatggcccactcctttttcaaggagtaaaagtattcactattattttaccaggtttgccttgaaagcctagaaattgctttttgaagccaagggttgaattaggatgatttaagggataggagga

SEQ ID NO: 39943 - DNA, 601 bp, Human
cattccagcttgttcaaacctcaagccccatttggcaaacggggcttctaactgattttttgaagcaaatctgacatagttattatagctttagcatccttgatcactgtatggccttctccctcctttttgatacttttgggtctattctacttagtagagagcctggccagcagctattgccccattgtcttttctgtgcaatccacagtcagcttagaactctagtctttttcaggagcctcattggctgacactaagccataagcccactctgtcatttggggcaaacaatagtctyccactggcattctgatctgtagttcttttctataagcaagaaaagattactgttctggctcccttcagcttctatgtcattgcatcattgcaaatcatagtcagttatagcatctaaaagtagtactctgatcttgtgaattcggtgcctgagagatatattctccccttcttccaaaggtggtgccacctctttgttgccttcatgctatgacatgacttgagaccactgatttagagataaagggaagtcctaattcactttgtagtaaatcacttgagtactgttgatccagataag

SEQ ID NO: 39944 - DNA, 601 bp, Human
actgatttagagataaagggaagtcctaattcactttgtagtaaatcacttgagtactgttgatccagataagtttgcagttctatttttgttgctttcccttatagatctttttaattagtcttgttggacacattgaagaactccagggtcaatgcctttttgactaagaggacttcatttttttaaaattgcaggttccattacagcttatagaaagtgttgaatgccgagatatatttcagcttcatttgacttgcaaagactgcaaagttatcaggtatgtggtatggtatgtttrtgttgctgtttagtgtggaaaatattttttaaagaatgggtccattatttggtaacttagtaaaataccttttgatgattagcctcattaggaatattttctgagtagtttgtgcctgaaatattttatctgtaggatgtatactttgctatgttgaaagatgttttttttttttaatttggaaataattttaaatttacaaaagggcaaaaataaaaatactaaaaagaacatcagtacaccattcacccagattcacttgttaacattttaccatttgctttattatttgcagaggcg

SEQ ID NO: 39945 - DNA, 601 bp, Human
gtaggatgtatactttgctatgttgaaagatgttttttttttttaatttggaaataattttaaatttacaaaagggcaaaaataaaaatactaaaaagaacatcagtacaccattcacccagattcacttgttaacattttaccatttgctttattatttgcagaggcgtgtgtgtatgtgtgtgtgtgtttcttttcctgaacagattgagagtaagttacgtaatcatggctcttaaccccaaaatactttagtgtgctttcctaagaatagggatattttcttacataaccataacaytatcaattttcaattttacattgataatacttacatccagtctactatacatgttccaattttgtcagttcacctaatgacctattgatacttttttatagcattctccctcacctccatctcattcagtacaggatccagtctaggtcatatattgcatttagctgccatgactctgtagccttctttaatctggaacattttctttttgtttttgtttgtttgatttttgagacagagtcttgctctgttgcccaggctggagtgcagtagcacgatctcagcgcactgcaacttctg

SEQ ID NO: 39946 - DNA, 601 bp, Human
actgcactcagcctaaacatatctttaataaattagttttcactaattattttaacttcttagttgtatatactgaaaatcgcagttgacaatagaattgttttgttctctacatggtcatagctgaaagtttcagtgcaatctgtcttttggatctgatttgtcctaatagctaaatattgaaattactacctaactggctaaaaataatgctgtttttttttaaacttgatctaatatgttactacaaaacaaagatttttctaaacatattttttatgagggacaaccataaaacttygatggaagaagtagaatgaaactccactcatgaaagagaatagctgccatttttctgtaataattgtcattaatcttagaagagatttcattagtctaaaaaaataggttttccaatggtcagcttcctccttttggacattttgttccattggctaacatttgtttttcttataagtgataatgagcatgcgaatgactgactgcctcagatgctttcttggttgtagttcccacttcactacgagtgggcattcttgaaataatggcttttcttacatttcatttcaactgtcttctg

SEQ ID NO: 39947 - DNA, 601 bp, Human
tgaaagttgaataggagttaattggtgagaggccaggttcctatcaagaacaaatagatagtggggtttgttttttgttttttttgagacggagtttcgctcttgttgcccaggctggagtgcaatggctcaatctcggaccactgcaacctccgcctcttgggttcaagcaattcccctgcctcagcctcctgtgtagctgggattacaggcatgcgccaccatgcccggctaattttttatttttagtagagacggggtttctccatgttggtcaggctggtctcaggtgatacgcccrccttggccacccggagtgcttggatttataggcgtgagccacagctcctggcctagattataggttttaacatgtgaccccctcccccccaaaaaaaccaaaaagagatgctgagcctgttctggaacccaggcttcctgactcctctatagtctttgtccccctcactgtcattctccgtcagaaatggctttgaccatgttatttctctgcatgtagtttcttgtaaactttatgtggtcataaaactttgctggtccaacactgacttttagtgtgtcaggtttcaaagtgaagtct

SEQ ID NO: 39948 - DNA, 601 bp, Human
agagatgctgagcctgttctggaacccaggcttcctgactcctctatagtctttgtccccctcactgtcattctccgtcagaaatggctttgaccatgttatttctctgcatgtagtttcttgtaaactttatgtggtcataaaactttgctggtccaacactgacttttagtgtgtcaggtttcaaagtgaagtcttaaatttctgtgcagtgaaaagttgtaagcctccttcaagtaaagtttactcttgggacttttttctagaaacctgaaattttaatcctgaatcttcaatcttrtaagtctgccctgggtcattttaaacatttgaggctaatcttgctatgcttttgttactttgttctctggccccatgactaattgaagcttttggttcacattcttgttctattaaaatgcttgtagcattagcattatcttatgtttaacaatgctttgataaatacttttgtttgatcctcatgaccttgtcaaacaggcaagataggttggtgtctgttttgggagccaaagaaatggaggctcagaggtaaaaagcctgttgtcaagtcccagtgctagtcactgacgacagaact

SEQ ID NO: 39949 - DNA, 601 bp, Human
ttgtccccctcactgtcattctccgtcagaaatggctttgaccatgttatttctctgcatgtagtttcttgtaaactttatgtggtcataaaactttgctggtccaacactgacttttagtgtgtcaggtttcaaagtgaagtcttaaatttctgtgcagtgaaaagttgtaagcctccttcaagtaaagtttactcttgggacttttttctagaaacctgaaattttaatcctgaatcttcaatcttataagtctgccctgggtcattttaaacatttgaggctaatcttgctatgcttktgttactttgttctctggccccatgactaattgaagcttttggttcacattcttgttctattaaaatgcttgtagcattagcattatcttatgtttaacaatgctttgataaatacttttgtttgatcctcatgaccttgtcaaacaggcaagataggttggtgtctgttttgggagccaaagaaatggaggctcagaggtaaaaagcctgttgtcaagtcccagtgctagtcactgacgacagaactaggacttaaaaccagttctcagttattcagacctgaccatggtggatgctgt

SEQ ID NO: 39950 - DNA, 601 bp, Human
gcctcagggaaagcctcagaatcccagcttctcacaggcgtgtccaggctagcagaatcctgtcacctacgagagaccacaccaaccttggaagtttatgagaatgtgcttaaactgtctctcacttcactccgattgttacatctattttttttctttattgaaatgccatcacattttaaatacattttttcattttttatggctcttttcaaatttgggggtttttcttaaagagaaagtttacaaacagtgatgtgtacaaatcttacatgtacagtttctgagtttttaaccattkcatcttctttattaaatttttagtttctaccatctcctaggataatgaacttaatgagtgcatcctactgcattatgttatataagaactttaatttgtttaagacccctgactccaagacccctgactccaagaggtattccctaattttgggttgccagcatttactcagcaagatttgctttctcctatcctgttctctcacaaccacagactgaaaagtccttatctttttaggagagcttttttagtcccttgataatttgagtttcttttagatttcagcaaactcttaggata

SEQ ID NO: 39951 - DNA, 601 bp, Human
aattttgggttgccagcatttactcagcaagatttgctttctcctatcctgttctctcacaaccacagactgaaaagtccttatctttttaggagagcttttttagtcccttgataatttgagtttcttttagatttcagcaaactcttaggatattcctgagaggtacctcagtctagtcttttaattatgggtggctctgccctgaggtgggatgactttggtccccagacccttccccttcctgatgatatctggtattctttggccatcaggacataaagatatctacagtgttctytgtcttttcgtaggtttgtgatgcaagggcatgtgaggggtaaagtactgacttaggaattaggaaacctgaatttaaatgcgtattctacgatttagttgaaaaaaagaacactgggcaaagaatttatgctctctgtgctttagtttcctttgtgctttaaagtgggacattcatgctcttcctgcccaggctgatccaggtatcctgaagatcaaatctgttaatgctgcagagttcaattcagtaaatgtttaagtgccccctatgtgccatgcttatgaaaacactttggaaatt

SEQ ID NO: 39952 - DNA, 601 bp, Human
gtttaagtgccccctatgtgccatgcttatgaaaacactttggaaattatgcaactacaaggtaatgcaatcataactgtttggctagagattatgagtaagggttgcattttgtttcttcccagtatacacagtccacattgatgttaacctgccaccactcagcatggaatcttgtatttcagtgacttggttgaatgtatgtgtatgtatggcttttgccttttatgtatattcgctgtggagtacaaaggaaaaacttggttttaattaaaaacaaaccaaaaaaaaaaaaaaaaaacacctcgaggacatccagtcaacctgtttcttttgtcattacctcatgttgttgagcagtggcggtgtatatagcattactcatcaaatattagcataccagacaaccacatacttataagtcatctttaggatgagacaacacttgggatatttcaaagtcatgcctttttataatctgccccagtacatgatatcacaagtgtagactctgaggggtggaagttagtttaatcttatagcagttaataaagccttttatggagtcttctctacctagcctgctagaagtagaatgtat

SEQ ID NO: 39953 - DNA, 601 bp, Human
attactcatcaaatattagcataccagacaaccacatacttataagtcatctttaggatgagacaacacttgggatatttcaaagtcatgcctttttataatctgccccagtacatgatatcacaagtgtagactctgaggggtggaagttagtttaatcttatagcagttaataaagccttttatggagtcttctctacctagcctgctagaagtagaatgtatcagagaggagagaaatgagaaaattacataattgtcttagtattcatataaatcttagtttctggctgttgaaccrgtcatagttaagccggctgtactgtggtcacagctctaaggcttaatcagctttggaagaagtttcaacattgctgttggagtttacctgtgaaacctgcagaagcctttgccaaattcttgacccttctcttagcccctcaaactctaaaaaagtggactgaaagctaaaagcttctctcccatgtccttaacttcctgctcctcattgcaattgacttgttggtgatggctctgtactagagtgttaatctggaggcctgacagatgactgggcagcttagctgccagtttagtagca

SEQ ID NO: 39954 - DNA, 601 bp, Human
gtagaatgtatcagagaggagagaaatgagaaaattacataattgtcttagtattcatataaatcttagtttctggctgttgaaccggtcatagttaagccggctgtactgtggtcacagctctaaggcttaatcagctttggaagaagtttcaacattgctgttggagtttacctgtgaaacctgcagaagcctttgccaaattcttgacccttctcttagcccctcaaactctaaaaaagtggactgaaagctaaaagcttctctcccatgtccttaacttcctgctcctcattgcaaytgacttgttggtgatggctctgtactagagtgttaatctggaggcctgacagatgactgggcagcttagctgccagtttagtagcatcaggcctacctctctaacctctctcatgtgaaatgtcccttaagcccatcttgtttatccacgactagcatatgactctgggtcttaacactgctgtgaagctgcctatttatctgtcttccgggtttgaatgcagtccaggaagttgcatctagaggatttactgtgacctttgtacatagaaaagcataattcctttctccatatttgaaa

SEQ ID NO: 39955 - DNA, 601 bp, Human
tcattgcaattgacttgttggtgatggctctgtactagagtgttaatctggaggcctgacagatgactgggcagcttagctgccagtttagtagcatcaggcctacctctctaacctctctcatgtgaaatgtcccttaagcccatcttgtttatccacgactagcatatgactctgggtcttaacactgctgtgaagctgcctatttatctgtcttccgggtttgaatgcagtccaggaagttgcatctagaggatttactgtgacctttgtacatagaaaagcataattcctttctccrtatttgaaaatctgctaagaggtagttcttaccttctctgactctggtattggtctgcttcctcacctgccaggtaaaggcctgtcccttctgtcccaggccttttaagctgtgtgtaattgtgggcttgactactcaggatcagccagggagctagacttttgggggaaaattttttagattgctgattgacactgtgtttgtgatagagggagttagggaacttcattgcttttaaaaagaaagttttcatttccactaaagtgaaaattgctggactgtattatttttattataaga

SEQ ID NO: 39956 - DNA, 601 bp, Human
atgtgttttatcctgagatagaggtgttaatgtaaaagatcattaatgtacagttcaagaaaagcacaaaaaaaataaatcattaatgaaatacttacagcttttgcaaagacttggagctatatcccagagtcgggggaaaaaatctcttaatgaacttggaatttgccacagttttgcagcttttagattgggattatgaattaaagactccttgtctgttttttttgttcgttttgttttgtttttttcccctttttttgagacagggtctcactctgttgcccaggctggagtgcartggtgtgatgatggctcactgcagcctcaacttccctaggttcaggtgatcctcccacctcagcctctcaagtagctgggactataggcatggaccaccacaacttaatttttgcatttttgtggagatggggttgcccatggggttgaccagatgttgcccaggctggtcttgaactcctgggctcaagcaatctgcctgcatcagcctcccaaagtgctgggattacaggtgtgaggcaccgcgtctggcctagtattcttgatggtcaatattccttgcaatttgtagacagatggc

SEQ ID NO: 39957 - DNA, 601 bp, Human
ctctccttcaggaaatgtataatacctagcttgagctcaagaaaagcagtttaaatgggaagtagtttaacagaattgtcttccatccaagtaattgctgtttcctattctgtagctcctctcccagggagaacaaagctttatactctgaacactaaagtgaaatctgttttgtgcttttgttgttgtggtttcttccagccctgctagcacttattttacaacctgtaccactatatattagaggttctgcttaatattttttaaaataacatgctgccctaggactgtgtatgttttsaaggaagaaagttattttagatttactgaatttatgttagcttcgtttctacctctgttttgcttttttaaggaagataaagccagattcattagggcaaatatagccagattataccagcttgggtggctgttcttgcaaataatcagcacttagtagtatggtgtttcctgagattcctggctggcagttatgattccatgacctgttaacctgccatcatctaaaaggctctggaaaccagaatgtttttcataccctatttggtgtcttggctggacctgatctgagctgacatga

SEQ ID NO: 39958 - DNA, 601 bp, Human
atgaggtcaagtgtagaattttccacttgtggcattatgtcagcactcaaagttttggattttggagcatttcagatttttggattaaagatgctcagtctgtattattctgtcctttaatatattgatctaaaaccaacttcactgctatgatcatttaaccattaaatattaatgtaacctttatttggctggacatggtggctcacacctgcaatcccagcactttgggaggccaaggcagatcagctgaggtcaggagttcgagaccagcccagccaacatggcgaaacactgtctytactaaaaatacaaaaattagctgggcgtggtggtgcacgcctgtagtcccagcaacttgggaggctgaggcaggagaattgcttgaacctgggaggtggaggttgtagtgagctgagattgcaccactatattccaacctgggtgatagagtgagactctgtcgcaaaaaaaaaattaatgtaaccatttagccattacccagttccttaaaatgtgtaagtgcgttggtgggggaggacagttaactactatgattttggtgatccaaatttctataaaacaaaattgtccatgatag

SEQ ID NO: 39959 - DNA, 601 bp, Human
cttaaaatgtgtaagtgcgttggtgggggaggacagttaactactatgattttggtgatccaaatttctataaaacaaaattgtccatgatagttaaatatcttaaatctttaactatatccttcttggccaggcgcggtggctcacgcctgtaatcccagcactttgggaggctgaggcaggaggatcatgaggtcaggagatcgagaccatcctggctaacacggtgaaaccccgtctctactaaaaatacaaaaaattacccgggcatggttgcaggtggctgtagtcccagctactkgggaggctgaggcgggagaatggcatgaacctgggaagcggagcttgcagtgagctgagattgtgccactgcactccagcctgggcaaccgagcgagactttgtcttaaaaaataaaaaaaataaaaaaaaaaaatatatatatccttctcctacgtttccctgcatcattaatcattctgcggtcctcttagctgtctcaaattatgacgggcattttcctggtctgtttgtggctagccgtcagagttttcactggaaaagctatagctaattgctatacacagttcttaatgtggac

SEQ ID NO: 39960 - DNA, 601 bp, Human
ggcgcggtggctcacgcctgtaatcccagcactttgggaggctgaggcaggaggatcatgaggtcaggagatcgagaccatcctggctaacacggtgaaaccccgtctctactaaaaatacaaaaaattacccgggcatggttgcaggtggctgtagtcccagctacttgggaggctgaggcgggagaatggcatgaacctgggaagcggagcttgcagtgagctgagattgtgccactgcactccagcctgggcaaccgagcgagactttgtcttaaaaaataaaaaaaataaaaaaaawaaatatatatatccttctcctacgtttccctgcatcattaatcattctgcggtcctcttagctgtctcaaattatgacgggcattttcctggtctgtttgtggctagccgtcagagttttcactggaaaagctatagctaattgctatacacagttcttaatgtggaccttctccagggagttgagaacccagggtgttttgaagagttggagctgcagactttttatacttttgcctgttctcagtgatgagtcaaagcaaagaaggagggtgaatgctggatgagggggcggcctcag

SEQ ID NO: 39961 - DNA, 601 bp, Human
cgcggtggctcacgcctgtaatcccagcactttgggaggctgaggcaggaggatcatgaggtcaggagatcgagaccatcctggctaacacggtgaaaccccgtctctactaaaaatacaaaaaattacccgggcatggttgcaggtggctgtagtcccagctacttgggaggctgaggcgggagaatggcatgaacctgggaagcggagcttgcagtgagctgagattgtgccactgcactccagcctgggcaaccgagcgagactttgtcttaaaaaataaaaaaaataaaaaaaaaawatatatatatccttctcctacgtttccctgcatcattaatcattctgcggtcctcttagctgtctcaaattatgacgggcattttcctggtctgtttgtggctagccgtcagagttttcactggaaaagctatagctaattgctatacacagttcttaatgtggaccttctccagggagttgagaacccagggtgttttgaagagttggagctgcagactttttatacttttgcctgttctcagtgatgagtcaaagcaaagaaggagggtgaatgctggatgagggggcggcctcagag

SEQ ID NO: 39962 - DNA, 601 bp, Human
tggctaacacggtgaaaccccgtctctactaaaaatacaaaaaattacccgggcatggttgcaggtggctgtagtcccagctacttgggaggctgaggcgggagaatggcatgaacctgggaagcggagcttgcagtgagctgagattgtgccactgcactccagcctgggcaaccgagcgagactttgtcttaaaaaataaaaaaaataaaaaaaaaaaatatatatatccttctcctacgtttccctgcatcattaatcattctgcggtcctcttagctgtctcaaattatgacgggcwttttcctggtctgtttgtggctagccgtcagagttttcactggaaaagctatagctaattgctatacacagttcttaatgtggaccttctccagggagttgagaacccagggtgttttgaagagttggagctgcagactttttatacttttgcctgttctcagtgatgagtcaaagcaaagaaggagggtgaatgctggatgagggggcggcctcagagagcctgtggctgcattaggctttcctgagtgtaacctatactggaaattgtttatccacaagtgagtaggtagtgcatact

SEQ ID NO: 39963 - DNA, 601 bp, Human
ggccaagatagaggattgattaagcccaggagtttgagactaggctgggcaacatagtgagacctcatctctacagaaaatttcttaaaaatttggccaggcatggtggctcattcctctaatcccagcactttgggaggccgaggcgggtggatcacgagctcaggagatcgagaccatcctggctaacacagtgaaaccccgtctctactaaaaatacaaaaaaattagccagcgtggtggcgggcgcctgtagtcccagctactcaggagactgaggcaggagaatggcgtgaacccrggaggtggagcttgcaatgaaccgagatcatgccactgcattccagcctgggcgacagagcgagactccatctcaaagaaaaaaaaattagttgggcatggtggtgcatgcctgtagtcccagctactggggaggctgaagtagaagagttgtttgagcccaggaggtcgaggctgctgtgagccatgaccgctccactgctctctagcccgggtaacagaacaactgtctcaaggagtttaccagttatacctcagaaccagtctttaggatgttatcaccaccataaaacaaaatggg

SEQ ID NO: 39964 - DNA, 601 bp, Human
ggggttggtggtgttggtggagtttgtgtgttttaggatttggattaaaggccttattgccttcactattgaaaaaagaagattggattatccagagagagacattgtcctgtaagtaaaaatctatcggaagtattgcttcctaggataccggcttgactgtagctgggatcttccctaattaaaagaaagcttatccccccgcccccagtataatttgttctgaagtatgttttatggaaattatggttaatagcttagtcacattactaacctggttcaatgggactgaggctgtgtrtgcagatagactggcttgtgttggttttgcatacccatggctgcacctgttacctataaggatgacaccctgtttggttcaaatcaaagaatgagttaatcctgtgaagtctctggaaacttgcaattgtgggcttttttccttccctgagggtctggtagaactgacacggactctcagttctgtaattggactgggcgctcatgtagttagaaataacctatgtacttgttacagcagaagagttgtaatggagtataaagagctgaccctcgactcccctttttttcattgatagtt

SEQ ID NO: 39965 - DNA, 601 bp, Human
tcttccctaattaaaagaaagcttatccccccgcccccagtataatttgttctgaagtatgttttatggaaattatggttaatagcttagtcacattactaacctggttcaatgggactgaggctgtgtatgcagatagactggcttgtgttggttttgcatacccatggctgcacctgttacctataaggatgacaccctgtttggttcaaatcaaagaatgagttaatcctgtgaagtctctggaaacttgcaattgtgggcttttttccttccctgagggtctggtagaactgacacrgactctcagttctgtaattggactgggcgctcatgtagttagaaataacctatgtacttgttacagcagaagagttgtaatggagtataaagagctgaccctcgactcccctttttttcattgatagttaagattgccagattcccaaaaggtagcatcaagtggaacaattcaagatagtatcatttgttgtatacacataagtaaacatttaaggcaacaaaacaaaacaaaacacacttatggtaacccattctgttgaggagtccaaaactcgaataaagcgcctcattgccttta

SEQ ID NO: 39966 - DNA, 601 bp, Human
aagtatttgctctggcccagtggaactcattacgtttttaatctcaattctcatcactgttgttttcagacacccctagaaaagtcagtcaccaaatttacctgtcattcaagtggtaaggatgctacaggaactagagagtagtgaaagctgaagggatttatgagtcttatcaatgatcagctcagctggaatggggaaagcagccagttgctgctctggccaacaactgtgttaggtcagcagccctggcatctgtggggcttgctgactttgaccaaaagggggaaggtactcttayttgcaaaataagaggctttaggtgaattctccctttgggaagagaagcttaagagggctggttgaagaaaaacttcctttttttctaaattttattctagagggcatgcaccttctaaaattaattctagagggcatgcaccctaggttttccccccctttttctagagatacaagaggatatataaatgaaaaattttatttgcagtttttcagagaaagtctttcaaaagatcacaaagttcttggtgtagtcatccatgcaaaatcaggcaggtttcctggaactgggctctgtctc

SEQ ID NO: 39967 - DNA, 601 bp, Human
tactataatgcagtgtcccctaaaacccaagatccaggctgaagagcgccatctactgctcctcttgggcactgctgggaagcattgaagaagaggaggatgttcaggaaaggcccaaccagcctcttgtgcagggtttggagtcattcagctcagtggttgcctgttatttgctaggagacattttataaagaatcattgaggttttatttctattttggccccattcagcacgtgagccagttgagcatgttggcaatacacaagtacttacagctacttgtctcccagggagggaggmtttaaaaactacaagcaaactggtgatttcagtggaatttgattagtgccaaatttaacttatttgtgagttttaggagtaaaaacaaattacagtacattttcatcgtcccaaaaaacccattcacagggcacccagccaccctagccctgaataattaagatgtccaatggatgaagcccctgctagtaaaacatagagtgcttcagttttatatagaaacatactcgttttaagtaaccccaacttagaattaggcaagctcccttaagtaactacgagtttataatagtcactaca

SEQ ID NO: 39968 - DNA, 601 bp, Human
gaaaggcccaaccagcctcttgtgcagggtttggagtcattcagctcagtggttgcctgttatttgctaggagacattttataaagaatcattgaggttttatttctattttggccccattcagcacgtgagccagttgagcatgttggcaatacacaagtacttacagctacttgtctcccagggagggaggctttaaaaactacaagcaaactggtgatttcagtggaatttgattagtgccaaatttaacttatttgtgagttttaggagtaaaaacaaattacagtacattttcatygtcccaaaaaacccattcacagggcacccagccaccctagccctgaataattaagatgtccaatggatgaagcccctgctagtaaaacatagagtgcttcagttttatatagaaacatactcgttttaagtaaccccaacttagaattaggcaagctcccttaagtaactacgagtttataatagtcactacatgcagaaatctacttccatctttatagattcgcctattctggatacttcatgttaattgtcgtacaataagttgccttttgtgactgacttctttcacttgtcataa

SEQ ID NO: 39969 - DNA, 601 bp, Human
ccttccttgtgccaacttgtaggtgataaggaaagcagatcttccccataataagacctgttcatgtttggaagctgctgctttagtgggctcaatttctcagccgtctaaaagctttttgttgcctttgacagagggtatgctcaccactggccttgtagcaaactcctcaagggcctctccttagaaaacctggggtgaaaattgaagcagtaaatacagaaccctagtaaggtatctctgtcctgagctgtaacaccattactgttggaatgctagctttccccaaggagggaccccsctcagtgcctatggcacaggcagaggcaccaggctctttgttcagatgtggtctaagctggaaattgaaagcagctgtaccaaggtgaaatttgaatgtgtgaacgcattgttctgcggagttcttttcaaagagatttcaaagccacaagttagataaggcccaagaagtaaagccagagtgagatcgaagtaggcctttcttttaaaaaataatagcttttattttatgtcagtatcttctttacaaatctaaccttcccttttcacgctttttgaaaagatagctaaaattcagtgt

SEQ ID NO: 39970 - DNA, 601 bp, Human
ccaacttgtaggtgataaggaaagcagatcttccccataataagacctgttcatgtttggaagctgctgctttagtgggctcaatttctcagccgtctaaaagctttttgttgcctttgacagagggtatgctcaccactggccttgtagcaaactcctcaagggcctctccttagaaaacctggggtgaaaattgaagcagtaaatacagaaccctagtaaggtatctctgtcctgagctgtaacaccattactgttggaatgctagctttccccaaggagggacccccctcagtgcctmtggcacaggcagaggcaccaggctctttgttcagatgtggtctaagctggaaattgaaagcagctgtaccaaggtgaaatttgaatgtgtgaacgcattgttctgcggagttcttttcaaagagatttcaaagccacaagttagataaggcccaagaagtaaagccagagtgagatcgaagtaggcctttcttttaaaaaataatagcttttattttatgtcagtatcttctttacaaatctaaccttcccttttcacgctttttgaaaagatagctaaaattcagtgtgttcctcttat

SEQ ID NO: 39971 - DNA, 601 bp, Human
aggaaggtgaactaataccccctccaagggtactgattgaatacaagataaattaggaagaatgctctgtaaaacaaatatggacagataagtatttaaaaatcctgttttactatttcaggaagccagagataggtgccagagaagacagaattttcttttttctggtatttgtgctggagcccatagttgtttctctgggtcctattcagtagatctgatgatcacatcaagttttactgcgttctttatttgatttattaaatcagatgctgcctaaaccacttatattgactgccartagcaaatgattaaattcaccgtagttgtcatcagccaagaggatgaagcagtgcctttggggaaagcctgaccggagaattgagcttgctgcctcctttggggattagccatttgcatttgctacacagttccaggtcccagctagcagcgctttcttccctagggtggtatgtagaaggagccttactaaggacccaggagatcggccgcgaactgtgtaaccttggccaaggggtttaactactgtagatctcagttttcctgtctataaaatgaaagacatgtaatcaacactaca

SEQ ID NO: 39972 - DNA, 601 bp, Human
aaatttcatacttattccacagggtttagtaggcctttacagccttcccacagtcccctgacagaaatgtttatttcttcctctgactcagtgtttgaaagacttgacttgtgatcttaactacaaatctgatcacatttgggaaaaatcaactcctttttagggattgggaggggtgagggaaagcacaagaaacaaaatgcaacagagtttaaaaagcaagtgtgattagcttgtgattactcccaaggggcagctactgctatctgatactccaaaagtgagatggagtctctctctstcatccatgctggagtgcggtggcctgatctcagctcactgcaacctccacctcccgggttcaagtgattctcctgcctcagcctcctgagtagctgggattacaggcgtgtgccactatgcccagctaatttttgaatttttagtagagatggggtttcaccatgttggccaggctggtctggaactcctgacctcaagtgatccacccacctcagcctccgaaagtgctgggattacaggcatgagccactgcgcccggcccctaaaagtctttcaaaaaaaggttcttcctagatcg

SEQ ID NO: 39973 - DNA, 601 bp, Human
agatacccacatgcctgctctttcaagtccactgggtcccagccagtgaggccatcctgcactgcctcatatgtgtcctgtccatctcagtctgccttgttctccatagcactggtcactcttcagctatgactagagcaagctccatcagggcagaagaatttgctggtcattgctacatgcccagcaccttagtcatgtttgggccatgtgaaatgctcaataatttgtagaatgaacaagtagttttacaaacatactgtcagctcagacttgagttgtacactgacgtgctcctgcrcccagttcatatgctgtggcgcttgtgagagtggctgttaattcacaatctcagactatttatcacggaagctaagaggaataggggcaccaacaacctgtctgactcaggttgttgggtcctggaattggtggtgtgaggaggaggaggctactgcatggcttactgggttccccgtcctgacagagtaaattgaagtgttctcagggatgttaggataaggtggctcagctgagctgacttatcagagtgtgcatgcctgattgcttaatttgtgcttcattggacttccataggtga

SEQ ID NO: 39974 - DNA, 601 bp, Human
ataagtcttcagaagggcttgaacccatgggcagaatgacatctgtagggcaatgccaagttattcctgtcagattttagtgcctgttctgccttagtaactacaaagtattagtccttccagacgtgggctatggctttgaaggttcagttctttttaaacaaatatttatacccatcctgtggcagatgctgccagtagaaatggagagaagggactggtttctagcactgttgaggagttagctctgatgggggtttgtggctggaaatgggggttccagagggggaggttctcaaggaggtgctttcctctctgggtggacttgactcaggcagctcaagtacaagtgtgagcctggctctcaagtggtcagcgtacattaaaggcgggcacatccagtgactttcagttcagagtgacttggcttttccttcatgctaatgatagtttctcatgttcccagagagtccttctaagaaaaggagggcatcccgaaagcactcagctttaacttagtggcaggcagggttggattgacaggcccactggagcagctgacatacagaattctcattccattttggtcacttccctctca

SEQ ID NO: 39975 - DNA, 601 bp, Human
aactcttatcatttccccctctctgcacttactagggtgaagcctggggccttgggtgcacaggcagataggtgggcttgaggggattcaaagcagctgaggagaggccatcgagggtgggtcaggctgcagccatgtgctcccctcctgatcacagaggtcagccaggccgtcttgcttgtgacgagaagtagtgcttcttgtcttctggtcttgtaggggaaccagttgggttttcagagctatttattttgggtcagtgattcattgagatgccagaataatgctagtaatttccagstcaaacagcatcactgcttcttttttccctttttttttttttttaagagaccaggactgaacagaggtgatctttccagagaattgttttagcttggaagacttcaaggaaagattccacttagtgtctttcagggtcctctgaaagaagtcagatagaaaagcatcagccaggtgcggtggcttacgcctataatcctagcactttgggaggccgaggatggcagatcacctgaggtcaggagttcaagaccagcccgaccaacattgtgtaactccatctttactaaaaatacaaaat

SEQ ID NO: 39976 - DNA, 601 bp, Human
gccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctctyctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccct

SEQ ID NO: 39977 - DNA, 601 bp, Human
ctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaaygtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatt

SEQ ID NO: 39978 - DNA, 601 bp, Human; identical to SEQ ID NO: 31793

SEQ ID NO: 39979 - DNA, 601 bp, Human; identical to SEQ ID NO: 31794

SEQ ID NO: 39980 - DNA, 601 bp, Human; identical to SEQ ID NO: 31795

SEQ ID NO: 39981 - DNA, 601 bp, Human; identical to SEQ ID NO: 31796

SEQ ID NO: 39982 - DNA, 601 bp, Human; identical to SEQ ID NO: 31797

SEQ ID NO: 39983 - DNA, 601 bp, Human; identical to SEQ ID NO: 31798

SEQ ID NO: 39984 - DNA, 601 bp, Human; identical to SEQ ID NO: 31799

SEQ ID NO: 39985 - DNA, 601 bp, Human; identical to SEQ ID NO: 31800

SEQ ID NO: 39986 - DNA, 601 bp, Human; identical to SEQ ID NO: 31801

SEQ ID NO: 39987 - DNA, 601 bp, Human; identical to SEQ ID NO: 31802

SEQ ID NO: 39988 - DNA, 601 bp, Human; identical to SEQ ID NO: 31803

SEQ ID NO: 39989 - DNA, 601 bp, Human; identical to SEQ ID NO: 31804

SEQ ID NO: 39990 - DNA, 601 bp, Human; identical to SEQ ID NO: 31805

SEQ ID NO: 39991 - DNA, 601 bp, Human; identical to SEQ ID NO: 31806

SEQ ID NO: 39992 - DNA, 601 bp, Human; identical to SEQ ID NO: 31807

SEQ ID NO: 39993 - DNA, 601 bp, Human; identical to SEQ ID NO: 31808

SEQ ID NO: 39994 - DNA, 601 bp, Human; identical to SEQ ID NO: 31809

SEQ ID NO: 39995 - DNA, 601 bp, Human; identical to SEQ ID NO: 31810

SEQ ID NO: 39996 - DNA, 601 bp, Human; identical to SEQ ID NO: 31811

SEQ ID NO: 39997 - DNA, 601 bp, Human; identical to SEQ ID NO: 31812

SEQ ID NO: 39998 - DNA, 601 bp, Human; identical to SEQ ID NO: 31813

SEQ ID NO: 39999 - DNA, 601 bp, Human; identical to SEQ ID NO: 31814

SEQ ID NO: 40000 - DNA, 601 bp, Human; identical to SEQ ID NO: 31815

SEQ ID NO: 40001 - DNA, 601 bp, Human; identical to SEQ ID NO: 31816

SEQ ID NO: 40002 - DNA, 601 bp, Human; identical to SEQ ID NO: 31817

SEQ ID NO: 40003 - DNA, 601 bp, Human; identical to SEQ ID NO: 31818

SEQ ID NO: 40004 - DNA, 601 bp, Human; identical to SEQ ID NO: 31819

SEQ ID NO: 40005 - DNA, 601 bp, Human; identical to SEQ ID NO: 31820

SEQ ID NO: 40006 - DNA, 601 bp, Human; identical to SEQ ID NO: 31821

SEQ ID NO: 40007 - DNA, 601 bp, Human; identical to SEQ ID NO: 31822

SEQ ID NO: 40008 - DNA, 601 bp, Human; identical to SEQ ID NO: 31823

SEQ ID NO: 40009 - DNA, 601 bp, Human; identical to SEQ ID NO: 31824

SEQ ID NO: 40010 - DNA, 601 bp, Human; identical to SEQ ID NO: 31825

SEQ ID NO: 40011 - DNA, 601 bp, Human; identical to SEQ ID NO: 31826

SEQ ID NO: 40012 - DNA, 601 bp, Human; identical to SEQ ID NO: 31827

SEQ ID NO: 40013 - DNA, 601 bp, Human; identical to SEQ ID NO: 31828

SEQ ID NO: 40014 - DNA, 601 bp, Human; identical to SEQ ID NO: 31829

SEQ ID NO: 40015 - DNA, 601 bp, Human; identical to SEQ ID NO: 31830

SEQ ID NO: 40016 - DNA, 601 bp, Human; identical to SEQ ID NO: 31831

SEQ ID NO: 40017 - DNA, 601 bp, Human; identical to SEQ ID NO: 31832

SEQ ID NO: 40018 - DNA, 601 bp, Human; identical to SEQ ID NO: 31833

SEQ ID NO: 40019 - DNA, 601 bp, Human; identical to SEQ ID NO: 31834

SEQ ID NO: 40020 - DNA, 601 bp, Human; identical to SEQ ID NO: 31835

SEQ ID NO: 40021 - DNA, 601 bp, Human; identical to SEQ ID NO: 31836

SEQ ID NO: 40022 - DNA, 601 bp, Human; identical to SEQ ID NO: 31837

SEQ ID NO: 40023 - DNA, 601 bp, Human; identical to SEQ ID NO: 31838

SEQ ID NO: 40024 - DNA, 601 bp, Human; identical to SEQ ID NO: 31839

SEQ ID NO: 40025 - DNA, 601 bp, Human; identical to SEQ ID NO: 31840

SEQ ID NO: 40026 - DNA, 601 bp, Human; identical to SEQ ID NO: 31841

SEQ ID NO: 40027 - DNA, 601 bp, Human
gtgctttataaacattagtaataatacataatgaagctaacattttcaaaacagcatgtctcagattaagacacgaatactctccagttaacacaagaaaactgagagattaaataacttgctcaaggttatgcagcatgatacaaaacaagagagagagaaacagtgctgtctgcagctatgacaggtgttcagcaagggccctgtcctcactattcccagaaccaggacaggagcagagtgttgcagtcagtcattcacaggacatagtttagatttcaactaatcaagagacagactracataaactatgtcttctgcttttgcccactaggagaaagattaggctgtctttccgctctcccacagtgtgttcttgggcagacactggctggctggcaagatatggcctcatgcagactaaacctgaactctgaacctcttggggccaataaagagggaaaatcagacctggcaactcttggatcacatgttctacaagattcccaacaggcttaaactctggtttaacctaaacatgccctgggcctttgcacattgcaacaccctgagttttctcattcgtctttggcaagttttt

SEQ ID NO: 40028 - DNA, 601 bp, Human
agttaacatttgctgaacacctgctatgtaacccagcagtgtgtgaggtgctttataaacattagtaataatacataatgaagctaacattttcaaaacagcatgtctcagattaagacacgaatactctccagttaacacaagaaaactgagagattaaataacttgctcaaggttatgcagcatgatacaaaacaagagagagagaaacagtgctgtctgcagctatgacaggtgttcagcaagggccctgtcctcactattcccagaaccaggacaggagcagagtgttgcagtcagkcattcacaggacatagtttagatttcaactaatcaagagacagactgacataaactatgtcttctgcttttgcccactaggagaaagattaggctgtctttccgctctcccacagtgtgttcttgggcagacactggctggctggcaagatatggcctcatgcagactaaacctgaactctgaacctcttggggccaataaagagggaaaatcagacctggcaactcttggatcacatgttctacaagattcccaacaggcttaaactctggtttaacctaaacatgccctgggcctttg

SEQ ID NO: 40029 - DNA, 601 bp, Human
ggggaaagaggggctgaggtgctcacccctacactcatatcctcactgtgtctgtgatctgcagccagttgctgctccagggctctggggtagggcaggggcggatgtgtggctacaatctggcttccagccacagtctcacagtcttcctccacggagtgatactgtccagggtgagctgcaaaggaattagctcttagtgaggcctatctggccttggtagccattcacccttgggccttgtacatcgcatgccatcagaagtggaccagccagcatagtggtagcccttcaaggtctrgaggccctggtatgggtttggtaggggacataagtgagggagaagcatcagagtgcgacagccaggagacaatataacttggccaggacctttgagtatgcacagctgtgaaattcaacaaccttcttaggtctccacccgagtaccaaaagaaaaataaactctagcctaagtttcttagcagaatttcccagccccacttgaaggcacagacccagtcactacaatacactaagccagcagagcccagcctggcgccacagcccagcaggaaacacagcatggagactaatggcagca

SEQ ID NO: 40030 - DNA, 601 bp, Human
ctatcctcattctgcttaccatctgaaagatgaaggtcacagttccacacactcgcacagttttattgaatcgaagctccaggtactgggtatacagaaaaaaagatttttctcctgacttcaccccgacaactcacagacaaattccctcaagatgctcaggaacatgagggaatatccaacccatacccactctgagtcctactcggcatagcaccctcctctccaatcctgcccctatacctaacatcactgagaaagaattataaacacacaatgagttttctgtccctctcattargtggaggaggtctagggtcccaggtccttcctatgtgcctgtccctcctctccaccccaacccgtgtcccacgcacttctcccttctgtccctgctcacctcataggcactggtgagatgcaggcggtagaaaacggggatgaagatgtgtgcaggtatcagcagccccagaaagtagcagcagcccaggaaccaatattgggtcccaaatcggtagatctctgacggcacacccaggatggccacggctgactggaaggtggccagcagggacagtgccaccggaaggcagcccatttt

SEQ ID NO: 40031 - DNA, 601 bp, Human
gtctctggtgatatgtataaaagagggatgacgaaggggctttactgacccaaccagaaacagaaactaagaacccatgactatattctctcccttggacactcctgaaaccatccaccctaagaacatactaccagtgaggggactctcctgccattaggcatgtaattgctgtgaccctgttgacctcattcccatcccatcctctaccttcatataccatccccactgctaaatcctatcataaatcttaccaccccagaatttcacctattctcctcatctatattctcagcttatstcttcttttccttctcttcccatgtcccctccttacttcatcccttcccctccccacaccagggcttactgcacttaccagagctgtatagacggtacagacaatgcccagggccagcacggacagccacagatcaaagccagtcactgtaagcatagaagccacattcttatccctggaaaagggttccccaggggagaagccctggtagggcaatcacgtcatgccacagagataaagcattggtcattaacaatgaaataaatcattcaccacaacggagaaaaatgtttgcagagc

SEQ ID NO: 40032 - DNA, 601 bp, Human
agaggccttctaaacccagcttgtccaacctgccttattttgttgttgctccattttgttttgttttgttttgttttaggctttttgcagcctgaagccagtttttagtttctgtctctggtgatatgtataaaagagggatgacgaaggggctttactgacccaaccagaaacagaaactaagaacccatgactatattctctcccttggacactcctgaaaccatccaccctaagaacatactaccagtgaggggactctcctgccattaggcatgtaattgctgtgaccctgttgacmtcattcccatcccatcctctaccttcatataccatccccactgctaaatcctatcataaatcttaccaccccagaatttcacctattctcctcatctatattctcagcttatgtcttcttttccttctcttcccatgtcccctccttacttcatcccttcccctccccacaccagggcttactgcacttaccagagctgtatagacggtacagacaatgcccagggccagcacggacagccacagatcaaagccagtcactgtaagcatagaagccacattcttatccctggaaaagggt

SEQ ID NO: 40033 - DNA, 601 bp, Human
aaagacccagactgaagagatgaggaagcataaccccaccaaggcctctggaaagcatgatggcccgggcttcagagaactcagggaaccaaggtcgaatcaggtcttccatcgtaacagttgccaatgaattaaaagcagaggatatagtgctgaaaaagaggaagaggatgaggagttgagcgaggcaaaattgtcagctctatgggactctatggaggaaatggtgtcctaaagcggggagatgacaggtaccaccaagaaacctcctcatagttggacttgatgccacctcagagcrggcctggaaggcaaggacacagtccttttttgaatgtggatatgggtttcattcgagtagatcaatttctggtaccataaaagaactcttaaccaaaacaggggtatctctgttgtgctgtggcctacaaagatgagctatcccttgtcatccacacagatggggcaggcacagtgagaaacttagagggattccccacccactatcaccccgctccacccatcaccttgtaccaaataggggtcaggtgcaccaggcctgagggaaatcgttaaagtgggtacctgagagagccgctga

SEQ ID NO: 40034 - DNA, 601 bp, Human
ggtgagaacaattagcaattcgttggcagggcattccttgggcaccaatctctacttgcccgcatggtcccagggtcttgggacccaatacccaacatttccctggggcctctggtggcccatcccttagcaagacccctgtgaaagccctcaaaggaggactttgagaaaacaagaagatagcaagccctgccttacttggagaaggtagtcaagggcatcagtgtggtcacagtggcaacggttagattggtgggcagggagaagctggacccattagagggagagggtggcatgctgragcccatgctggtcacgatgctcccgatgccaatccagaaggccatgacgagcccagccaacaggcccacaacagcaccctgccgagacacagtgcaggcctgtcacaaggccagtcctgccagccctcacggcagtcctcagctctcctggtgacagccctgccaacccccaggtccatcctgctacacatgactgtggatccagatgcatcactcacaggagggttagcacatggaaagaacattccaaggcagaagagtcccagcagcggtcccccaaccatgccaaagatgctgat

SEQ ID NO: 40035 - DNA, 601 bp, Human
catgaagaattgaaagaattcatccttggtaaattaggctaggtcttgtggcaaaggcacccaaagctaatgaagaagagtaaatgatatttgactgttacatatgtatatatagacgaaaaagaaaatataccaataaacatcttcatcaatatggaattaaatacatttacctattttagagatattttaagtatgctagtatcaacataatgagaatagtattttactgtctatttttaatagaaaaacatgtatatatacatatctatatatatttaaggagcaccccttcccccakttgagtatgattactcaatgggaagcagtaatacaaatggaaaaatcttccctcctatattgaggaaagaagataaaataagattaagccatgtttagcactgagtattttaacacatgggttttttgtttgtttgtttgttttgtaataccatacttcagattacaatacccaaaattctaaggtcctaatgttaatgatagtatctcaatgtccattttcggtttgtttcaacatgattttctccttttgcctctgtgtcacacgtagtctttcccgctggaaggtgcaggttttgga

SEQ ID NO: 40036 - DNA, 601 bp, Human
ttaaatacatttacctattttagagatattttaagtatgctagtatcaacataatgagaatagtattttactgtctatttttaatagaaaaacatgtatatatacatatctatatatatttaaggagcaccccttcccccagttgagtatgattactcaatgggaagcagtaatacaaatggaaaaatcttccctcctatattgaggaaagaagataaaataagattaagccatgtttagcactgagtattttaacacatgggttttttgtttgtttgtttgttttgtaataccatacttyagattacaatacccaaaattctaaggtcctaatgttaatgatagtatctcaatgtccattttcggtttgtttcaacatgattttctccttttgcctctgtgtcacacgtagtctttcccgctggaaggtgcaggttttggatagggccttggtgttgggtaagaggttgtttttcggggacaggaacagcaaagtagggcacctcccagaaggcagagagaagcagcagcccagccagtgaagagagcctgaccaaattcgtacctaaaaggaaaaacccatgtgcttgttaatcagtga

SEQ ID NO: 40037 - DNA, 601 bp, Human
cgctggaaggtgcaggttttggatagggccttggtgttgggtaagaggttgtttttcggggacaggaacagcaaagtagggcacctcccagaaggcagagagaagcagcagcccagccagtgaagagagcctgaccaaattcgtacctaaaaggaaaaacccatgtgcttgttaatcagtgaattattggcaacttttctaatataataaaaggaaaaaaaatcaatactcattgtatttttttcattgaaaataacccctgaatatcccttgggaagtactttaagatttctgaacatayacgccaaagaatgtttatattgcaattggtgacaatttgcaatagtagatcaggaaataacacatgtaataccaggttaattacacaaataattccaaggacttttccatatataggatacttgtaaagcatgtttatatgttttagaagtagggtttggatcatggttcctaggctgaaacttagcaaaggaagctttatcactaagtagtaatcatattctataaagaaactgatagagcataatggagataatcagagctttgaacagatgatccattggtcccaggcacctataca

SEQ ID NO: 40038 - DNA, 601 bp, Human
cccaatctcaatttcccatggcattttatattcaatgatagcagagaaatcatttagtcaaaatcattcacttaatcatttataagatgtataaaatacttcatttttttatcaaaaaagttaaataacttttttgtagtaattctaagtattcatcaatatagatagattagatgtttctatgctactgtctctccccagccaaaaacatggtccaatgtaattgcctctagacatgacagaaaacactattgcttttggcttctcaaatagaccatgcgaatggtcttgaacttgtgaygcttactcctaagagaagtccctgaaactggaataggagtgatgcagtcacatgtgggagttacaagaaggcaagcgaaggaagaatgcaatgcatttcatcctcatcgtcttccaagcacttcatacacttcatgccacgatggccacaaagattactattcgcagcctttgatataagagtaaattattgggaataagacactatccatgccttttcagagaggagtcaatttgtatttgggtaaactgagagactggtcattttaaactaaccacatctttagcaaagccacagata

SEQ ID NO: 40039 - DNA, 601 bp, Human
aggagtgatgcagtcacatgtgggagttacaagaaggcaagcgaaggaagaatgcaatgcatttcatcctcatcgtcttccaagcacttcatacacttcatgccacgatggccacaaagattactattcgcagcctttgatataagagtaaattattgggaataagacactatccatgccttttcagagaggagtcaatttgtatttgggtaaactgagagactggtcattttaaactaaccacatctttagcaaagccacagatactcttcctcaattactggttaaactgacatattayactgaagcaaaagcccctacaagtcttctgtcaaaaagaaaataagaaaataaagtctattctagtttttttctattagtagatttgtatcattaattatatctgttatttttttaaaataatatactataatatactacatatataatatatgcatctaatacctaatatagagaacatatagtagtctattattatagctgtataatttatatggagattatcaacatatataacacagtgtatagatataaagatatatatatacacacagagagattgcatatgtatgtacatata

SEQ ID NO: 40040 - DNA, 601 bp, Human
tacactataattttttaaataggcattattataaagctttgaaataatgctgtccatgttttctgactttgattttctcaaatgacacataatgtaacttatcaatcaacacttgaattaaaaaacagatatttcttttcttttcttttttcttttttttttagacagtcttctgttgcttaggctggagtgcagtggtgcgatctcggctcccgagttgaggtgattctcatgcctcagcctctggagtatatgggattacaggcgtgcaccaccacacccagctaatttttgtgttttyagtagagatggggtttcaccatgttggccaggctggtcttgaactcacgacctcaggtgatccgccctcctcagcctccaaaagtgctgggattacaggcgtgaaccaccacacctggcctaaaaaacacgtatttattttaaatggaaaatataatattattttatcaaaaaaatttaaaggtatttctgtattttttttttcctaactgctttaaactgaccattccaacaggccacctctactccagttggcctttcttttcattgatctacaggcacatcctgtttattctcgaat

SEQ ID NO: 40041 - DNA, 601 bp, Human
aaacacgtatttattttaaatggaaaatataatattattttatcaaaaaaatttaaaggtatttctgtattttttttttcctaactgctttaaactgaccattccaacaggccacctctactccagttggcctttcttttcattgatctacaggcacatcctgtttattctcgaattagatctgcccagctggaatgctatccttatttttctccaataatcccaatccttccatccctcacagacctgaagggttcacatattcttgtgttttctctcactactccccatcttttccacrtagtatctgtggagacaccataggaattatctgaattacatgaacttcctccttagcgtttgctaaatagtgaacaactttcttcactggaagagactggttctaacaaaccagttgccacttgaaacttcaaccaatagacctgtcagatgtgagcagagctctcacattttcatttagtttgtgtttgagaacatgaaagtcaactggacttcaggtctatgtttgcagtttgccttagagactgaaatcaagtataatgaatccaacgtaatagatttcaaatcataccaggaacag

SEQ ID NO: 40042 - DNA, 601 bp, Human
gcgtttgctaaatagtgaacaactttcttcactggaagagactggttctaacaaaccagttgccacttgaaacttcaaccaatagacctgtcagatgtgagcagagctctcacattttcatttagtttgtgtttgagaacatgaaagtcaactggacttcaggtctatgtttgcagtttgccttagagactgaaatcaagtataatgaatccaacgtaatagatttcaaatcataccaggaacaggttagtaaggtgaaaggggggcacagcctctattacctgcaagaagaaatatcgcrcccccaatgacagccatcctcatcttctgcacctcatcgtcttccaagcacttcatacacttcatgccaacggtggccacaaagattgctatcactcccaggaggatgccaaccaccatcaaggcacgggttgcttgcaatgtgcctggcagaaaacattttaaaacatgtaaaaatatgcttggaccaacaagagaaaaatggaagaagaccaagtatatgtcactgttgtatggaagagagaaaactggactaggaatctagagaccccagtcatactgatgtttccgctggtaaccc

SEQ ID NO: 40043 - DNA, 601 bp, Human
gacagccatcctcatcttctgcacctcatcgtcttccaagcacttcatacacttcatgccaacggtggccacaaagattgctatcactcccaggaggatgccaaccaccatcaaggcacgggttgcttgcaatgtgcctggcagaaaacattttaaaacatgtaaaaatatgcttggaccaacaagagaaaaatggaagaagaccaagtatatgtcactgttgtatggaagagagaaaactggactaggaatctagagaccccagtcatactgatgtttccgctggtaacccaatatacartatcttctccagaaaaacaaatgccaggctggatgatgaaaaagagatccctccactccaatattttatgtttccaacattaaattcaaaatcaactggaaaattaattaatgatctaattgaatagggttagctgaactaatacatatttattttttactaagggattttcatccttgctaagataattttaattttaagtaacaatcatatatactatcctggatgttaactatttgtaatcaaaatggtttacagtatatctttgatattagtcaccagctttacaccccaatcaat

SEQ ID NO: 40044 - DNA, 601 bp, Human
ttcatacacttcatgccaacggtggccacaaagattgctatcactcccaggaggatgccaaccaccatcaaggcacgggttgcttgcaatgtgcctggcagaaaacattttaaaacatgtaaaaatatgcttggaccaacaagagaaaaatggaagaagaccaagtatatgtcactgttgtatggaagagagaaaactggactaggaatctagagaccccagtcatactgatgtttccgctggtaacccaatatacagtatcttctccagaaaaacaaatgccaggctggatgatgaaaargagatccctccactccaatattttatgtttccaacattaaattcaaaatcaactggaaaattaattaatgatctaattgaatagggttagctgaactaatacatatttattttttactaagggattttcatccttgctaagataattttaattttaagtaacaatcatatatactatcctggatgttaactatttgtaatcaaaatggtttacagtatatctttgatattagtcaccagctttacaccccaatcaataagcttcagaaaaactggatgaattggaagataaaaaataaat

SEQ ID NO: 40045 - DNA, 601 bp, Human
tctaatcaggcctaggcttagtgttaatattgtcaagattgagaacttaggtcaccaatcataattgaagctaaatatttctaaaacttcattaaatcttgatttactgattttctgtctttgctataaccaggcaatctatgataaaattatagtaatctctttatttttctttttttgagatagagtcttgctctgttgcccaggctggagtgcagtggtgcgatatgggctcactgcaacctctgcctctggggctcaagcgattctcatcccacagcctcctgagtagctgggactrcaggcacgaaccaccatgcctggctaaatttttttttttttttggtatttagtagagatgggtttcaccatgttgcccaggatggtctcaaattcctgagttcaggtggtctgcccacctcggcctcccaaagttctgggattacagacgtgagccactacgcctggccataatctctttctaaaaagtatcaaaggtattgtttacagtatttgagagatatttttgaagccaaggttaagttttacttgatttcatttaaaaataaaaaagagacttcctgattcccctcacacactg

SEQ ID NO: 40046 - DNA, 601 bp, Human
aggaaagtaccaagggctccatggttaaggtatgtcctctttctgatggatggtttttgcaaaggctatcattattgggaaataacaaataaaataactaaacccatacataacacagatttcagatgtggtcctaagattacacttggcaggaaaatatttcaggcagagatatgcctgaagaggagatgctgaaagtaacaaagatgatccatgtctggaggatagggaaaccacatatctcagtttgcctggaacagtcctagctttaaagtttaaagtcctacatccttagaaggcyctcaatcctgaacaaattgggagagctggtcatcctaacgcaggatgataggatgtgcaaagtaaaacgaagtttagcaaggtgggcagaaggcatatgtcatgcagaacttcgcaaattagggtaagaagatggattctattctaagtataatcagaagtcatatgattatcttgagaaaggggcgacatgatttttactgtcagcatagagatcacacaatcaataaatatttctatgacagcacttcaagcatctatagcatcttacatttcacagcctcctccattttattttttc

SEQ ID NO: 40047 - DNA, 601 bp, Human
gctctcaatcctgaacaaattgggagagctggtcatcctaacgcaggatgataggatgtgcaaagtaaaacgaagtttagcaaggtgggcagaaggcatatgtcatgcagaacttcgcaaattagggtaagaagatggattctattctaagtataatcagaagtcatatgattatcttgagaaaggggcgacatgatttttactgtcagcatagagatcacacaatcaataaatatttctatgacagcacttcaagcatctatagcatcttacatttcacagcctcctccattttattttytcataaatactctttttcaaccttttattaatcattttagatgttttctctgatcttgctccaagtttttctctttgttcaagttgtggggccccaaactggaccagtttatagaataatcacactgatcttttcttcaagtaaaaacagaaggtcacttgcccagcaggtctgagcacttagatcgcagagtagtcttcaagagaagtctaactgggcatcaatctcatgagtcggactgtgtaaaacccctgatctcccaggcaaggaacacatgtgcataaactactccagggccct

SEQ ID NO: 40048 - DNA, 601 bp, Human
ggccccaaactggaccagtttatagaataatcacactgatcttttcttcaagtaaaaacagaaggtcacttgcccagcaggtctgagcacttagatcgcagagtagtcttcaagagaagtctaactgggcatcaatctcatgagtcggactgtgtaaaacccctgatctcccaggcaaggaacacatgtgcataaactactccagggcccttactgcacccacctggaatgacctaatattcacatttttaatctctaagtttttgcccattaagttctcaaagaaaacacatttgattcrtgtcaaatctatcttgccacttcatctacaaagtgttctttccaaggggctggggactgatattctgttctatgattgctaagaaacctatcaggtttcatttctctatagaataatatattatttgcataatacacaaaaagtaatggagaaaatggaaaacacaatatttaaaaattgcataaaccatagaaatgagatcctgctttgttttttaaaatgtcgttttgcaaagtaatattttcacttacatcctggcaactattgacttatacaatttatttgtatgttccaatatta

SEQ ID NO: 40049 - DNA, 601 bp, Human
gaataatatattatttgcataatacacaaaaagtaatggagaaaatggaaaacacaatatttaaaaattgcataaaccatagaaatgagatcctgctttgttttttaaaatgtcgttttgcaaagtaatattttcacttacatcctggcaactattgacttatacaatttatttgtatgttccaatattagatttgcatcaaacccaaaatcttgctttgcttcattggagatatttggataaattcttaagtatagttatatgtgaggaaaatgcaaaaataatatacacatgtagtcaygcacaaaaagctgagaattaaaacagcacgaaaactcacaagcaaggcgtaggtaatgataggttaccagtcaaagtaagcaactattgtgttacaagttacaagtgttttatgtgcagatcaaatctaaattgcacagttttaagccggaaacagatgaataccttcacatcatagaagtgttttaaatcagatttgtaaagtatgtaatcatgaactcctggatgatttgagtcagatatttattcctatttccatctaaagcaccaagcacagtacttgaaaagtcacatggattta

SEQ ID NO: 40050 - DNA, 601 bp, Human
tgtgttacaagttacaagtgttttatgtgcagatcaaatctaaattgcacagttttaagccggaaacagatgaataccttcacatcatagaagtgttttaaatcagatttgtaaagtatgtaatcatgaactcctggatgatttgagtcagatatttattcctatttccatctaaagcaccaagcacagtacttgaaaagtcacatggatttatcaaatttcaataaatttaaattagaacatgtctttatcctttaaaaatctgtaccaatatgataggtaaaaatacttattctcttgkgtttagcttaatttttgaaataatactgagaaatacctcccttgagagcctggtatgctaaaatcttgctactaaaagccagacttagcttaggtcactgataactagaaactcatgcagataatacaaattgtactttttgcttattttgatctattttttaaagtatgtatctaatgagcttcaaagcttaagttttgtttctttttgccctaatggaatgatgagtggcagagcagagaagttaaaaaggatgtttgaaagctataaaacaacaatttggatgagatagatgttgta

SEQ ID NO: 40051 - DNA, 601 bp, Human
aacaaaatatagtcatctcttggtatataagggtgattggttccaggaccacccacaggtaactaaatctgcacatgctcaagtcctacagttgatcctgtggaagccttgtatacagaaagtcaaccctccctacatgcaggctttggactctcagatactgtattcttgatcggtattggttgaaagaaatccacctataagtggacacttgctgttcaaacctgtgttgttcaaatgttgactgcagattccaattctccctttgcatctgtagttgcttaataagtattaagtgaawaaatgaactgatgattgggtgactagaacaaaaatattgtgcttccttctcccctgcaattaaatgagctcaacacagacagtcacagaagtgtactcccctggcttttctccatattaaatcttttacttttacggaagttcaaagtttcataaaagtcctaatcattagcatttccctcttattggtgcatgaggtgatggtcaccagatgtgaactcagaacataagcaaaatcaggagtgaaaatgatcctggatgaggcaggatgtaccacttttcaggatgtcctcagaagttt

SEQ ID NO: 40052 - DNA, 601 bp, Human
attattctaagagtcagaactaatttatgaagtatatctgaacaccaatggcccttcgagtaccctcggttcagcaggcacaacgcatctggagaagcataaataggtgccctcctctccacttaggcttcaaagactgtccacgtcagtgattttgtctctctgattgagcctgacatcatggtgagagtgctggggaagctcacagccaccaatactcattaagcacacctacacacatgtggattcatgcaaagcaagttaaacaggctagaggagcttataaacaaattacagaatytcagggttcggtgagattgagagagagtctagcctaacctcccatttgtctggtgcttggatcttccctacaacattccttcaaaatgcttatttattctctgcttgcacacctcccaccatgcagcctcctacagcaactcaatctttggacagctctagctattaaagtcaagtaagaagaagcatttaagcaagcacataaaattggcgcgagcttcctaaaagtttgagaattagatgaaaacaaggcgagaggtacaggtgaatcaagaaaagtctactacaactgtatctggca

SEQ ID NO: 40053 - DNA, 601 bp, Human
accgcttggcaagaactacctaaaagaagaagccttgctctatctcattttgtatttactgtatacactattagcacactgtattccttcagatactttatgaaggtcatatgctttttatgacctaccctacataaagcagggaaacaacagattttaatacttcccgtgctaaagccctgcatctggccgggaagacaagtgtgctctactgggaaagacggcaaggtacaatttcgggaaacccacagctaagcttttcacctaaacacacttaatgaaatgcagcttttttctgagkgatactgcttaaatatacacacataacccttttcatctctacatgtaacaaaactgtaccaaaaccagccaatgaatcaccatcccagatctctacagctggtgggcgtaaacaccactgctcaggcagagaaatgaagtaaggtttcctgggttctatccaaaagcatcccgtgagtcacggcaggtgagaggagaacacctgtgagtcaagggtccctcttctgagaatgggttttgagagaaaggcctaagccacaccttggataaactatggctttaagtaaaataaaagtggatt

SEQ ID NO: 40054 - DNA, 601 bp, Human
acaaaactgtaccaaaaccagccaatgaatcaccatcccagatctctacagctggtgggcgtaaacaccactgctcaggcagagaaatgaagtaaggtttcctgggttctatccaaaagcatcccgtgagtcacggcaggtgagaggagaacacctgtgagtcaagggtccctcttctgagaatgggttttgagagaaaggcctaagccacaccttggataaactatggctttaagtaaaataaaagtggattctgatctggagttttaaaaaaataggaagacatctctaaagtgtgtgggggggggtaggtatttagtcctttcaccctagttttaaaaactgtaataactacattaaccaaaaaatgaaagtaaaacattttaacacattatcatgtgtaaggatgatccatttgagtatttacaacatagatcaatctgatttcatttggtcatttcaggaagttaaaagaaaacctatttaaagatgttgaaaaggaactattttgatcagaggaataaaactgacagtgagacctctctggaattgtccttagaaacctccacctgccaattccttaacgtggtacctaaaatgc

SEQ ID NO: 40055 - DNA, 601 bp, Human
atacactattaaaagttgtcccttgataggaggtagacaaaacaagttaagtaaacttgaacaatgccaacacttttcacccttagcatgcaatgggggccagtgggcagtcacgttcatctaggcaaagactaagggatcttttcttcaagtgagttaaagggcataacagacacatgatataagacaattaatgtgatttctcaaggaagatactccagccgtgaatcattattatctaagtaaatgggaatttaatgacttttcggacaaggaactcgaaacctttaatttaaaaaamaaagtaaaacaattatcctattatccttcttcccaccatccttagaaatatgtctctctatacaatcctttccagttttacagggggtcactgaacatccattacacagaaatttctttgtggaagatggaaacctaaggaagacccacctcttctttctctctcactgccttccactcccagctgacctctgatttcatcagctatgactattttgctgcatttcccttcagtgcctttacttttttctttgtattatgttgcgcaggttatttagaacctttcttgtcagcctttccc

SEQ ID NO: 40056 - DNA, 601 bp, Human
taaaggttaaaaagttatatctaatacttgaggattatttatttaagcgtgcacacttgagaagttaccaggcttcaaactttttcagtcatcccattttcttgtctgaactctaccaatcctcaatttaccccaaatctcggaatgcctaggagaggtctaagagctcaagttcaagtttggccttcactccctcaactcgaaccaccagcataggaatttaggatgaagccacacctagagtggcagaagtgtcacccagggagttagaggcaaaactagagcttatgcctgggcgtcsctttcctcaaaccaggattctcttcatttccttatgacagagcacatgatcagaagacttgatcaactgaagactgataaccatggaatcacacaacagaatgagcccataagggagctgcagggggactggggcctctggacggccgctgtgaggtgggggtgcactcactgctcagattcagcaaggagtcaaagactttgcactggatctgcccggtgctctgcgacacgcaggacatccacagcccctcgtacatggcctgggcggtcacgatgttgtcgccggcataggagtaaa

SEQ ID NO: 40057 - DNA, 601 bp, Human
gtggtacaatgtcactgacggatcctgccagctgtttgtgtatgggggctgtgacggaaacagcaataattacctgaccaaggaggagtgcctcaagaaatgtgccactgtcacaggtgagatggcagtagttggagcttttgtttttttccttttttttttttttttttttttttttgagacggagtcttgctctgtcgcccaggctggagtgcagtggcgcgatcttggctcactgcaagctccgcctcccgggttcacgccattctcctgcttcagcctcctgagtagctgggactaygggcacccaccatcacgcccaactaattttttgtgtttttagtagagacatggtttcaccttgttagccaggatggtctcgatctcctgatcttgtgatctgcctgcctcagcctcccaaagtgctgggattacaggcatgagccactgcgcccagcccctgctttttttttagacagggtctcactgcagcctccacctcctgggctcaagcagaacctcccacctcagcctcctgagtagttgggactacaggcacatgccaccacaccttgctcattttgaaattttttatagaggc

SEQ ID NO: 40058 - DNA, 601 bp, Human
ggcaagtgagaatgagactgccagtgtattaattcatcatgagaaccaggaccgccccggggagcaggcactcgtgtccccgggcccacgcctttagtccgcataggcaagtctctagtccagttgccagaagactgcttgatgaagagagaggcagaacgcggggagctggtttgcaaggtgaccgtttaatagcatcaggctaggccaggcccgaggatgcggaggagccagggttccctccatcttggacgaggtgtgggagataagcgctgtgtaaaatgtatcatgtgggccgggygcggcggctcacgcctgtaatccagcactttgggaggccgaggtgggcagaccaagaggtcaggagatcgagaccatcctggctaacacggtgaaactccgtctctactcaaaatacaaaaaaaaattagccgggcctggtggcgggcgcctgtggtcccagctactccagaggctgaggcaggagaatggtgtgaacccgggaggtggagcttgcagtgagctgagatcgcgccagagcactccagcctgggcgacagagcgagactccgtttcaaaacgaaaaatttgtcatgttaac

SEQ ID NO: 40059 - DNA, 601 bp, Human
gtgggccgggtgcggcggctcacgcctgtaatccagcactttgggaggccgaggtgggcagaccaagaggtcaggagatcgagaccatcctggctaacacggtgaaactccgtctctactcaaaatacaaaaaaaaattagccgggcctggtggcgggcgcctgtggtcccagctactccagaggctgaggcaggagaatggtgtgaacccgggaggtggagcttgcagtgagctgagatcgcgccagagcactccagcctgggcgacagagcgagactccgtttcaaaacgaaaaatttrtcatgttaacctttaaaaaaagtgtcgtgttttgttttgtttttctccccccaaagagattaggtctttttatgttgcccaagctggtctcaaactcctggcctcaagtgatgccccccacccttcacccagtgtaagcactggtattacagttgaattagttagatgagttgatacagttaagcaattatttggccctggaagtcactgtgttttgattgtttgtttctttctttgagacggagtttcactcttgttgcccaggttggagtgcaatggtcaatggtgtgatctcggctc

SEQ ID NO: 40060 - DNA, 601 bp, Human
acgaaaaatttgtcatgttaacctttaaaaaaagtgtcgtgttttgttttgtttttctccccccaaagagattaggtctttttatgttgcccaagctggtctcaaactcctggcctcaagtgatgccccccacccttcacccagtgtaagcactggtattacagttgaattagttagatgagttgatacagttaagcaattatttggccctggaagtcactgtgttttgattgtttgtttctttctttgagacggagtttcactcttgttgcccaggttggagtgcaatggtcaatggtgygatctcggctcactacaacctctgcctcccaggttcaggcgattctcctgcctcagccacccgagtagctgggattacaggcatctgccatcacgcctggctaactttttgggtttttttgtttgttttttgagacggagtctcactctgttgcccaggctgagtgcagtggtgcgatttcggctcactgcaacctccgcctcccgagttcaagcaattctcctgcctcagcctccggagtagctgggactacaggcgcgtgccaccacacccggctaattttttgtatttttagtagag

SEQ ID NO: 40061 - DNA, 601 bp, Human
gcaagttaatcttaagtttcctcttcgggaggcaatcttggttccttatttccaagttgtggtctggcatgcacattgaaggtcccatgtaaaggagaagtggatgctgtggtgagaggcgcacagggccagctcattctttgtccctggcagtctctcgaaagctctttcactgtgctgtttctttgtccccttgcagagaatgccacgggtgacctggccaccagcaggaatgcagcggattcctctgtcccaagtggtaggttcttaaagagacccgcgatggagtgaggccaccggrtgggtcattgtgaaaggacacttgtcatttgggaactgtcacaggcttccctctcatggttctgtttactcaaaattggcaaaccgggggctctgcctgggctgccggcttctggctccagcatccttatgggggagtttatactgtccagctgacacaggggccggggatcctgcagcacttcctggctggcccccatctcctcctggaggatgggatggaggtggctgctgcccatgaggctcaggcccctccttgctgtgcgggcctccagctgctctgctgaccccactccccgcc

SEQ ID NO: 40062 - DNA, 601 bp, Human
ggatgggtcattgtgaaaggacacttgtcatttgggaactgtcacaggcttccctctcatggttctgtttactcaaaattggcaaaccgggggctctgcctgggctgccggcttctggctccagcatccttatgggggagtttatactgtccagctgacacaggggccggggatcctgcagcacttcctggctggcccccatctcctcctggaggatgggatggaggtggctgctgcccatgaggctcaggcccctccttgctgtgcgggcctccagctgctctgctgaccccactccccrcccaccctcctgtctgcctgttctgtctcctctgcttcctttgctccctgttgccatcgctgtcccctgccccgtgggcatcctctgtcctctgccacccccgcctccccgccactgcagcttgtgatctcaagatgtgtgttagcttgctttgtagtgctggcggctgctgccccattcctcctttatggtttaaggactctgcatcgggcgcctggggtgagtggtcccgatgcactaccaggtagcaaatgcaccctcggggcagacctcaggccatggactctgggaggctgctgt

SEQ ID NO: 40063 - DNA, 601 bp, Human
cccattagggctggggtgacgtggcagagccggccatggaaggggctacacaccccttcttaaaggcgtgtccacactcctcagtgggcccttccagacccagacccagctaggcctgtgtcctgtgtccggcccagcctccctaacacagatgtttgtgtttcagctcccagaaggcaggattctgaagaccactccagcgatatgttcaactatgaaggtaaaactccaaagaggccaggtgcggtggctcacacctgtaatcccagcgctttgggaggctgaggtgggcggatcacgrggtcaggatatcaagaccatcctaacatggtgaaaccctgtctctactaaaaatacgaaaaattagctggacgtagtggcatgcacctgtagtcccagctactcaggagactgaggcaggagaattgctcaaagcctgggaggcggagggtgcaatgagccaagattgcgccactgcactccagcctgggcaacagagtgagactctgtctcaaaaaaaaaaaaaaaaaaaaaaaaaaaaactccgaagaaacttatatatggggcaaaacatgtattcttagttgggtattgagagaca

SEQ ID NO: 40064 - DNA, 601 bp, Human
gagagttgggtttttagttcaaaaagaaggaacacagatgactactctgctggcgacacggccactctgctggcacgcacatagcatggcgcctccttttttgggggactctccttggtggcatctctggcaggctgtgtcctctccagctgcagttctggaccctgtctgggttggggaggggcatttggtcctcaggctgagcccacctggattccccaggcccttggtgagcgccactctggctgcaactccccttgcctggcccgtcctgaggcccctctctcgtcctcagtggtgsttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctgg

SEQ ID NO: 40065 - DNA, 601 bp, Human
gacattcttagagatgaagatggagaagtacataagggtctgctcacacacatctgatgtctctccacctgtatgtactctaagctcctttacagatctaaaggcagtttgatctataaaccagctattttacatgccacttttctatccaattgcataaatccactctttccctttatatgtctttttcatttccccgcattttctcattgttcaaagccctactattgttgtaaacagggtggcattaagacaaaggtttgctcttagaaaaagttcaagaagggagcccccaaactgyctgacacgtttaagtgtcacttgtagtaaccatgtatctcaatgtgataagccagaaaaaacaacgactgcctgttcctggaactgggaagtggccatgccaagacttccaggaataacagtgcatgaatgaaaccacctgggaaccagagaatcagcttggagaagcaggaactttgtcaaatatttaaaataataagagctaactttcactgagtactttctgtagcgccaggcactgctctaagaattttacattaatactctgtagctcatttaatagttacacaatttcagagat

SEQ ID NO: 40066 - DNA, 601 bp, Human
aaataaaattaatgttgctataagaaagggttatggggcactaacttagatggtggtagggggtttaagaaaagtcagactaggagatgaaggaagtctcaaatcaactagtctatggaggtatggtgggtggggtgttggagggcatcatagatagagggaactccataggtagaattcctgagctggaggaacgtccctcattcaagtaaaggaagacgagtgaggttacagagcaaaagagggagacattcttagagatgaagatggagaagtacataagggtctgctcacacacatytgatgtctctccacctgtatgtactctaagctcctttacagatctaaaggcagtttgatctataaaccagctattttacatgccacttttctatccaattgcataaatccactctttccctttatatgtctttttcatttccccgcattttctcattgttcaaagccctactattgttgtaaacagggtggcattaagacaaaggtttgctcttagaaaaagttcaagaagggagcccccaaactgcctgacacgtttaagtgtcacttgtagtaaccatgtatctcaatgtgataagcc

SEQ ID NO: 40067 - DNA, 601 bp, Human
atatatacacatagaaattcttcctatataaatattcactaaatataaagcttgtgtggttttaaaggaattaattgaaggcatagagcatgcaaggcactataccaggcactagagcacaatacctagacactaggggagacagacaattaagaattaaatatattattaaaaatactctaagtgctataaataaaattaatgttgctataagaaagggttatggggcactaacttagatggtggtagggggtttaagaaaagtcagactaggagatgaaggaagtctcaaatcaactartctatggaggtatggtgggtggggtgttggagggcatcatagatagagggaactccataggtagaattcctgagctggaggaacgtccctcattcaagtaaaggaagacgagtgaggttacagagcaaaagagggagacattcttagagatgaagatggagaagtacataagggtctgctcacacacatctgatgtctctccacctgtatgtactctaagctcctttacagatctaaaggcagtttgatctataaaccagctattttacatgccacttttctatccaattgcataaatcc

SEQ ID NO: 40068 - DNA, 601 bp, Human
agaacatatggaaaattgaagagtgcaactattaagttctgattaaaaagtgttttggttttttaatttagcactattcagggcagtgcaatacagtgtgtatatacacagatacacatatatacacatagaaattcttcctatataaatattcactaaatataaagcttgtgtggttttaaaggaattaattgaaggcatagagcatgcaaggcactataccaggcactagagcacaatacctagacactaggggagacagacaattaagaattaaatatattattaaaaatactctaastgctataaataaaattaatgttgctataagaaagggttatggggcactaacttagatggtggtagggggtttaagaaaagtcagactaggagatgaaggaagtctcaaatcaactagtctatggaggtatggtgggtggggtgttggagggcatcatagatagagggaactccataggtagaattcctgagctggaggaacgtccctcattcaagtaaaggaagacgagtgaggttacagagcaaaagagggagacattcttagagatgaagatggagaagtacataagggtctgctcac

SEQ ID NO: 40069 - DNA, 601 bp, Human
ctagcctccagaactgtaagaaataaatttctgtcctttataaattaccaagtctcaggtattcttttacagcagcagacaacatatggagacatcatttttttctaatcacttcttaaaagaacatatggaaaattgaagagtgcaactattaagttctgattaaaaagtgttttggttttttaatttagcactattcagggcagtgcaatacagtgtgtatatacacagatacacatatatacacatagaaattcttcctatataaatattcactaaatataaagcttgtgtggttttwaaggaattaattgaaggcatagagcatgcaaggcactataccaggcactagagcacaatacctagacactaggggagacagacaattaagaattaaatatattattaaaaatactctaagtgctataaataaaattaatgttgctataagaaagggttatggggcactaacttagatggtggtagggggtttaagaaaagtcagactaggagatgaaggaagtctcaaatcaactagtctatggaggtatggtgggtggggtgttggagggcatcatagatagagggaactccataggta

SEQ ID NO: 40070 - DNA, 601 bp, Human
cagcctaaatagtaggctggctatagtatccaggattgtgtaagtaaattctatgacgttctcacaaccacaaaattgcctcatgatgcatttctcagaatgtattcctgtatttaagcaacacatgattatgttggacttcctagcctccagaactgtaagaaataaatttctgtcctttataaattaccaagtctcaggtattcttttacagcagcagacaacatatggagacatcatttttttctaatcacttcttaaaagaacatatggaaaattgaagagtgcaactattaagttstgattaaaaagtgttttggttttttaatttagcactattcagggcagtgcaatacagtgtgtatatacacagatacacatatatacacatagaaattcttcctatataaatattcactaaatataaagcttgtgtggttttaaaggaattaattgaaggcatagagcatgcaaggcactataccaggcactagagcacaatacctagacactaggggagacagacaattaagaattaaatatattattaaaaatactctaagtgctataaataaaattaatgttgctataagaaagggtt

SEQ ID NO: 40071 - DNA, 601 bp, Human
caggacttctacctgtgaggttccctctgtctataatgccctccaccaacccactcacccacacgtctatagactagttgatttgagacttccctcagctctcaatctgactctcctcaacacccccaaccccaccaccccagcctaaatagtaggctggctatagtatccaggattgtgtaagtaaattctatgacgttctcacaaccacaaaattgcctcatgatgcatttctcagaatgtattcctgtatttaagcaacacatgattatgttggacttcctagcctccagaactgtargaaataaatttctgtcctttataaattaccaagtctcaggtattcttttacagcagcagacaacatatggagacatcatttttttctaatcacttcttaaaagaacatatggaaaattgaagagtgcaactattaagttctgattaaaaagtgttttggttttttaatttagcactattcagggcagtgcaatacagtgtgtatatacacagatacacatatatacacatagaaattcttcctatataaatattcactaaatataaagcttgtgtggttttaaaggaattaattgaaggc

SEQ ID NO: 40072 - DNA, 601 bp, Human
aaataaaagtgattttaataaatgtgatacagcttgctaactagctgaattaagatgattaataattcatattctttgcaccgatgtctctaattcactgaaaaaaggaagactgacatccttcagtgaaatttgttaaaagactcttttaaggttatctttcttatgtaagacagaaaaggcttgaatttcaatttactcttgtgccacttagctttaactaggccaggtgctatggttagaatgtgtgagctaagttcatgtgttggaaacttaatttccaatgcaacagtgttgggargtggagcctaataaaatatgattagtttataagcactctaccttcatgaatagattaatgtcgttatcttgggagtgggtttgttattgccagagtaggcttgtaaggaaatcaagttccactctctcttgctgtcttgcccttccactttccaccatgggatgatgcagtaagaagaccctcacaagatgctggtgcctccatacagtcatgcaccacaacaacagatcacatatatgatggtggtcccataagattatttttactgtaccctttctatgtttagatacataaatactt

SEQ ID NO: 40073 - DNA, 601 bp, Human
ttgggttatgtttgtacataaattttgtacctttaaaaatgtttagttaacatctaagaaggaaaaatattcatctgttgaactccagttttggtaaaagttaagcttagaaaaaattgatacatttaagcaaatgggtggggcaagcaggtggtgaggctttgagtatacagcacatcatacttgtaagatacgggatgaaactgaggtgactgtggctgattataaatgcaaagtaccttgtaacaaggagccattccataaaaatcctcttgtgtattttatgctgaacaaacaaaayaaatatgcttaaaaccagtttaggatagccttttatagcattttatattaaaccttgaataaaaatgtagatgatacatcaactaggaccaagtgagatggtagtgatcaagtgttctacaaaactaaaaagtaaaccaaagagacaaaggaaacaaatactgaatcagttattctcatttgattgctttactactctgaaaagcctttcctgacaacccagagctccctcacaaatttgcttcctttcctcctaataaatggtgaaactaaacccatagaaataaaagtgattttaata

SEQ ID NO: 40074 - DNA, 601 bp, Human
gggaacattacagaggtaagtcacaaatcaagtaacttccatgtcatttgggttatgtttgtacataaattttgtacctttaaaaatgtttagttaacatctaagaaggaaaaatattcatctgttgaactccagttttggtaaaagttaagcttagaaaaaattgatacatttaagcaaatgggtggggcaagcaggtggtgaggctttgagtatacagcacatcatacttgtaagatacgggatgaaactgaggtgactgtggctgattataaatgcaaagtaccttgtaacaaggagycattccataaaaatcctcttgtgtattttatgctgaacaaacaaaacaaatatgcttaaaaccagtttaggatagccttttatagcattttatattaaaccttgaataaaaatgtagatgatacatcaactaggaccaagtgagatggtagtgatcaagtgttctacaaaactaaaaagtaaaccaaagagacaaaggaaacaaatactgaatcagttattctcatttgattgctttactactctgaaaagcctttcctgacaacccagagctccctcacaaatttgcttcctttcctcc

SEQ ID NO: 40075 - DNA, 601 bp, Human
aattctaggtccctaacttcctccgaataactgagaataagatactagactagaggaaaggtaggaatttcaagtaggccaggggaacattacagaggtaagtcacaaatcaagtaacttccatgtcatttgggttatgtttgtacataaattttgtacctttaaaaatgtttagttaacatctaagaaggaaaaatattcatctgttgaactccagttttggtaaaagttaagcttagaaaaaattgatacatttaagcaaatgggtggggcaagcaggtggtgaggctttgagtatacrgcacatcatacttgtaagatacgggatgaaactgaggtgactgtggctgattataaatgcaaagtaccttgtaacaaggagccattccataaaaatcctcttgtgtattttatgctgaacaaacaaaacaaatatgcttaaaaccagtttaggatagccttttatagcattttatattaaaccttgaataaaaatgtagatgatacatcaactaggaccaagtgagatggtagtgatcaagtgttctacaaaactaaaaagtaaaccaaagagacaaaggaaacaaatactgaatcagtt

SEQ ID NO: 40076 - DNA, 601 bp, Human
tttatttaaatttacttgttaattgcctaagaacaagctccttccctcattccctcaaaacagaagataaagcatttcacattctcttcaagccccaagatagggataaatgttttgaattatgttagcaaaattctactgctctgaaaacaagaattctaggtccctaacttcctccgaataactgagaataagatactagactagaggaaaggtaggaatttcaagtaggccaggggaacattacagaggtaagtcacaaatcaagtaacttccatgtcatttgggttatgtttgtacrtaaattttgtacctttaaaaatgtttagttaacatctaagaaggaaaaatattcatctgttgaactccagttttggtaaaagttaagcttagaaaaaattgatacatttaagcaaatgggtggggcaagcaggtggtgaggctttgagtatacagcacatcatacttgtaagatacgggatgaaactgaggtgactgtggctgattataaatgcaaagtaccttgtaacaaggagccattccataaaaatcctcttgtgtattttatgctgaacaaacaaaacaaatatgcttaaaacca

SEQ ID NO: 40077 - DNA, 601 bp, Human
atttgtttacccacaccagatttggattatttatttaaatttacttgttaattgcctaagaacaagctccttccctcattccctcaaaacagaagataaagcatttcacattctcttcaagccccaagatagggataaatgttttgaattatgttagcaaaattctactgctctgaaaacaagaattctaggtccctaacttcctccgaataactgagaataagatactagactagaggaaaggtaggaatttcaagtaggccaggggaacattacagaggtaagtcacaaatcaagtaamttccatgtcatttgggttatgtttgtacataaattttgtacctttaaaaatgtttagttaacatctaagaaggaaaaatattcatctgttgaactccagttttggtaaaagttaagcttagaaaaaattgatacatttaagcaaatgggtggggcaagcaggtggtgaggctttgagtatacagcacatcatacttgtaagatacgggatgaaactgaggtgactgtggctgattataaatgcaaagtaccttgtaacaaggagccattccataaaaatcctcttgtgtattttatgctg

SEQ ID NO: 40078 - DNA, 601 bp, Human
actgtaaaatctggaacccaaaggggaagcatacttaattttgaaagttcctaaaactaaaatttgtttacccacaccagatttggattatttatttaaatttacttgttaattgcctaagaacaagctccttccctcattccctcaaaacagaagataaagcatttcacattctcttcaagccccaagatagggataaatgttttgaattatgttagcaaaattctactgctctgaaaacaagaattctaggtccctaacttcctccgaataactgagaataagatactagactagaggraaggtaggaatttcaagtaggccaggggaacattacagaggtaagtcacaaatcaagtaacttccatgtcatttgggttatgtttgtacataaattttgtacctttaaaaatgtttagttaacatctaagaaggaaaaatattcatctgttgaactccagttttggtaaaagttaagcttagaaaaaattgatacatttaagcaaatgggtggggcaagcaggtggtgaggctttgagtatacagcacatcatacttgtaagatacgggatgaaactgaggtgactgtggctgattataa

SEQ ID NO: 40079 - DNA, 601 bp, Human
tttcaaaaagtattactgtaaaatctggaacccaaaggggaagcatacttaattttgaaagttcctaaaactaaaatttgtttacccacaccagatttggattatttatttaaatttacttgttaattgcctaagaacaagctccttccctcattccctcaaaacagaagataaagcatttcacattctcttcaagccccaagatagggataaatgttttgaattatgttagcaaaattctactgctctgaaaacaagaattctaggtccctaacttcctccgaataactgagaataagayactagactagaggaaaggtaggaatttcaagtaggccaggggaacattacagaggtaagtcacaaatcaagtaacttccatgtcatttgggttatgtttgtacataaattttgtacctttaaaaatgtttagttaacatctaagaaggaaaaatattcatctgttgaactccagttttggtaaaagttaagcttagaaaaaattgatacatttaagcaaatgggtggggcaagcaggtggtgaggctttgagtatacagcacatcatacttgtaagatacgggatgaaactgaggtgact

SEQ ID NO: 40080 - DNA, 601 bp, Human
ataactgtaacctctactaccacgaagaggaagacacagcacaggggatttccagttctggcttcaaaattcatattacagtgaaactcttttgacccatctcttgaggtcctgaaatttttatcttactgctttcaaaaagtattactgtaaaatctggaacccaaaggggaagcatacttaattttgaaagttcctaaaactaaaatttgtttacccacaccagatttggattatttatttaaatttacttgttaattgcctaagaacaagctccttccctcattccctcaaaacagargataaagcatttcacattctcttcaagccccaagatagggataaatgttttgaattatgttagcaaaattctactgctctgaaaacaagaattctaggtccctaacttcctccgaataactgagaataagatactagactagaggaaaggtaggaatttcaagtaggccaggggaacattacagaggtaagtcacaaatcaagtaacttccatgtcatttgggttatgtttgtacataaattttgtacctttaaaaatgtttagttaacatctaagaaggaaaaatattcatctgttgaa

SEQ ID NO: 40081 - DNA, 601 bp, Human
ctcttaattatacatactcaagaagttcagcaatggttgaataattcaaaatgggtttatgtggtcctgaaataaatcaaaagatgtgtttgtgttactaacttcccagattttcttaggacaataggaatctcagtttgcattaactggtcagaaattaatgctgtagacctcaagccagaaaggtagaaatattaaaatttatacttttctgctgttaatctataaggtgagcaataataaacacatgtaaccaaagtagactaaaagttttcaagactacatttgttttagattccawcatatgaagaactgtgtaagactaaattcatacataagaggacatgatttttgtcaatctcacatttctaccatcaaagactatactttaaaatgccaattttttaaaaatatgcgaagagtactttaacagatatatcagaaaagattaatacataccgaattagaagtaggtagtatcctttaattaacacactggactatacatctctaaagtctttacctgccccttgcttcttataggatacctctctataacatgcttagcttaaaaaaaaaattctatggcctttaaccaatt

SEQ ID NO: 40082 - DNA, 601 bp, Human
cagagcaagactgtgttttaaaataaagggttttttttgtttgtttgttttgttttgattattgccaactttaagcacaaaattttataatcaacttaaagtcttaagaacattccaattatagtcaactcttaattatacatactcaagaagttcagcaatggttgaataattcaaaatgggtttatgtggtcctgaaataaatcaaaagatgtgtttgtgttactaacttcccagattttcttaggacaataggaatctcagtttgcattaactggtcagaaattaatgctgtagaccacaagccagaaaggtagaaatattaaaatttatacttttctgctgttaatctataaggtgagcaataataaacacatgtaaccaaagtagactaaaagttttcaagactacatttgttttagattccatcatatgaagaactgtgtaagactaaattcatacataagaggacatgatttttgtcaatctcacatttctaccatcaaagactatactttaaaatgccaattttttaaaaatatgcgaagagtactttaacagatatatcagaaaagattaatacataccgaattagaagtag

SEQ ID NO: 40083 - DNA, 601 bp, Human
ttgctgtttcagaattattttttggccagggatggtggcttatgcctataatgccagtattttgggaagctgaggcaggaggatcacttgagtccagaagtttgagatcagcctgggcaacatggacagacactgtctctactaaaaaaaaattagccaagcatggtggcatgcgcttgtagtcccaactactcgggaggttgaggtgggaggattgcttgagcctggaatattgacggtctaatgaagtatgatgtcatcactgcattccagcctgggtgacagagcaagactgtgtttyaaaataaagggttttttttgtttgtttgttttgttttgattattgccaactttaagcacaaaattttataatcaacttaaagtcttaagaacattccaattatagtcaactcttaattatacatactcaagaagttcagcaatggttgaataattcaaaatgggtttatgtggtcctgaaataaatcaaaagatgtgtttgtgttactaacttcccagattttcttaggacaataggaatctcagtttgcattaactggtcagaaattaatgctgtagacctcaagccagaaaggtagaa

SEQ ID NO: 40084 - DNA, 601 bp, Human
aagtgatccctctacatgctcaactaaaatcaagacttcccaagaagaaaccgccttcctccttgctgtttcagaattattttttggccagggatggtggcttatgcctataatgccagtattttgggaagctgaggcaggaggatcacttgagtccagaagtttgagatcagcctgggcaacatggacagacactgtctctactaaaaaaaaattagccaagcatggtggcatgcgcttgtagtcccaactactcgggaggttgaggtgggaggattgcttgagcctggaatattgacgstctaatgaagtatgatgtcatcactgcattccagcctgggtgacagagcaagactgtgttttaaaataaagggttttttttgtttgtttgttttgttttgattattgccaactttaagcacaaaattttataatcaacttaaagtcttaagaacattccaattatagtcaactcttaattatacatactcaagaagttcagcaatggttgaataattcaaaatgggtttatgtggtcctgaaataaatcaaaagatgtgtttgtgttactaacttcccagattttcttaggacaatagga

SEQ ID NO: 40085 - DNA, 601 bp, Human
tctgctacccaacatttttatcttggacccacacacactaacacaaactgcccatccccttcccaggcccactccagtgctggctaccctttaaattatcttactgtgcaatcctaagtggttaataagtcaagtgatccctctacatgctcaactaaaatcaagacttcccaagaagaaaccgccttcctccttgctgtttcagaattattttttggccagggatggtggcttatgcctataatgccagtattttgggaagctgaggcaggaggatcacttgagtccagaagtttgagaycagcctgggcaacatggacagacactgtctctactaaaaaaaaattagccaagcatggtggcatgcgcttgtagtcccaactactcgggaggttgaggtgggaggattgcttgagcctggaatattgacggtctaatgaagtatgatgtcatcactgcattccagcctgggtgacagagcaagactgtgttttaaaataaagggttttttttgtttgtttgttttgttttgattattgccaactttaagcacaaaattttataatcaacttaaagtcttaagaacattccaattatagtc

SEQ ID NO: 40086 - DNA, 601 bp, Human
gggtccagtgaggcagaaagccataaagacacactatgagctaagactccaagtagtaaccaagctaataacatcaaccttcacaacttgaacaatctaaaggaaatgcttggttcagttcccagtctttggactggaaatgcttggcccagtctctgggccccaggaatgttccagcaggaaagcaaaaaatgttaattatcaggtcacactactgcaattatcttgggaaatgtaggtcttgtggacctgttctttgcaaatttgagaaggcctgagacgactccgtgcattcagagatttttttttttttttaaccagaaaacccactctcaggagttgtcacagccatagcaccttgaccacccaagtgaaactttgtactcggtatttatacagaaacataaattgcagcaaacattctactcaatatttctgccttccagtgccttgatccgatcctagtttttcccactactatcctgtcactactttttccatctcctgtagatcccgatgcccttcatcccttttagcgacaatgcattaggcaaaactctgctacccaacatttttatcttggacccacacacactaacac

SEQ ID NO: 40087 - DNA, 601 bp, Human
aggcaaaaaaaccgctctcctactcgttcaagactagcctggccaacaaaatgaaaccccatctctactaaaaatacaaaaattagccaggcatggtggcacgcgcctgtagtcccagcaactcaggaggctgaggcaggagaatcacttaaacccgggaggcggaggttgcagtgagccgagatcgtgccactgcactccagcctgggcgacagagcgagactccatctcaaataaataaataaataaataaataacacaaaacaacaacaaaaaacaaatgaggacttttccctggacraacattgcaacataccttgtgatttgtgaatcatcacaaatctctgaaactccccatcattctttcccatccattctcttctatttctcagcatcaagtgactgacctaactccctagttctctagctaataaggccctgcctgcagcccctactcccaaattaagttggaaacacagcatcagactcagaatagatttcaagaaaatattttgcaagtctgaagtaaagatctacccttgacaggtatgtcacattgtgatacctcttaataagcaacattgtttgaatactataacat

SEQ ID NO: 40088 - DNA, 601 bp, Human
tatgaattactaactgtaaattcaaagtcttttgttttagaatcatggagacatggcatcaatatagaagaacatataggtcaaactttcactgtaacacatttttctgtatgtgtctctattatgaactttcaaagaccactcaacttgtgaatcgtgtggttttatcaggaagattggattgtttcccccaccccctgccccggcctttctccttcataaatagcttcatgatgacttcagcggaatccagtccatggtgattgtgtaaaatcaggcaaaaaaaccgctctcctactcsttcaagactagcctggccaacaaaatgaaaccccatctctactaaaaatacaaaaattagccaggcatggtggcacgcgcctgtagtcccagcaactcaggaggctgaggcaggagaatcacttaaacccgggaggcggaggttgcagtgagccgagatcgtgccactgcactccagcctgggcgacagagcgagactccatctcaaataaataaataaataaataaataacacaaaacaacaacaaaaaacaaatgaggacttttccctggacaaacattgcaacataccttgtgattt

SEQ ID NO: 40089 - DNA, 601 bp, Human
tagggaaagtaaaattttcacttaacgtaagctgtgcctgttctcagagctaatttgcaactagcaaatttgtttcaaacaaattctcctttagataaaatgagacagttaagttactggggctgaattaccagtttttgaaacatccctgatgaatgttcagttccatgttttgttgataataaaacaaagatagctttaaaattacatacagactacgaagaaagagataaatgaaattaatgggatgtgaagatggtagaattatggatgattttaaagatatctatcatcattgctrtaagtattattttaaatatttaaaataatgaatatacttcagtatttatatatgttatgcttactctggaactacaccaatgaagttgaaccatatgaaattccccaaatatgactgtttttgacccacaaaagccatgtttaattacaatacactagcatattaaactttgttatttgctaataaggcttgagtaaacttaatatatgcacaaatggttcaacctcctaaatattaatattcatgtctatctagtcattcggttacctaccgcagccagtctctaaatatttactgagc

SEQ ID NO: 40090 - DNA, 601 bp, Human
tctttcagcaactgctttaccttggaatgctgtcggtggatactgaggaggatacccaactggcaagtttgtttccgggtgagaagcattcatctgtgagtctgcaattcaaggagaggtaaatagatgtctgattaaataaaatatatattagaaagaaacaatgtattgtacttagataattgtaacttgtatgttcttatgctgtattgaaatagggaaagtaaaattttcacttaacgtaagctgtgcctgttctcagagctaatttgcaactagcaaatttgtttcaaacaaattytcctttagataaaatgagacagttaagttactggggctgaattaccagtttttgaaacatccctgatgaatgttcagttccatgttttgttgataataaaacaaagatagctttaaaattacatacagactacgaagaaagagataaatgaaattaatgggatgtgaagatggtagaattatggatgattttaaagatatctatcatcattgctgtaagtattattttaaatatttaaaataatgaatatacttcagtatttatatatgttatgcttactctggaactacaccaatgaag

SEQ ID NO: 40091 - DNA, 601 bp, Human
agaactactaaaataaaaacaaatgcacaattctctctctctcttactctctctctcccactctcactctctctctctgtctctcaattaattttactttttcttctttcagcaactgctttaccttggaatgctgtcggtggatactgaggaggatacccaactggcaagtttgtttccgggtgagaagcattcatctgtgagtctgcaattcaaggagaggtaaatagatgtctgattaaataaaatatatattagaaagaaacaatgtattgtacttagataattgtaacttgtatgktcttatgctgtattgaaatagggaaagtaaaattttcacttaacgtaagctgtgcctgttctcagagctaatttgcaactagcaaatttgtttcaaacaaattctcctttagataaaatgagacagttaagttactggggctgaattaccagtttttgaaacatccctgatgaatgttcagttccatgttttgttgataataaaacaaagatagctttaaaattacatacagactacgaagaaagagataaatgaaattaatgggatgtgaagatggtagaattatggatgattttaaag

SEQ ID NO: 40092 - DNA, 601 bp, Human
aaaagaactactaaaataaaaacaaatgcacaattctctctctctcttactctctctctcccactctcactctctctctctgtctctcaattaattttactttttcttctttcagcaactgctttaccttggaatgctgtcggtggatactgaggaggatacccaactggcaagtttgtttccgggtgagaagcattcatctgtgagtctgcaattcaaggagaggtaaatagatgtctgattaaataaaatatatattagaaagaaacaatgtattgtacttagataattgtaacttgtrtgttcttatgctgtattgaaatagggaaagtaaaattttcacttaacgtaagctgtgcctgttctcagagctaatttgcaactagcaaatttgtttcaaacaaattctcctttagataaaatgagacagttaagttactggggctgaattaccagtttttgaaacatccctgatgaatgttcagttccatgttttgttgataataaaacaaagatagctttaaaattacatacagactacgaagaaagagataaatgaaattaatgggatgtgaagatggtagaattatggatgatttta

SEQ ID NO: 40093 - DNA, 601 bp, Human
tttttttgagacagagtcttgctctgtcgcccaggctggagtgcggtggcatcatctctgctcactgcaagctccacctcctgggttcacaccattctcctgcctcagcctcctaagtagctggaactacaggcgcccaccaccacgcccagctaattttttgtattttttagtagagacggggtttcagtgtgttagccaggatggtctcgatctcctgacctcgtgatctgcccacctcagcttcccaaagtgctgggattacaggcgtgagccaccgcgcccattcgtttagtacacrtcatttcttttagtacattccagatgcctgcttgggttaatcctttgccttatgttttaatccataatgtattgctttcctaagtccttcttcattaaaataaaattctattataatatttaggttagaaatttaaatttcacaatttaacatcctttggtctctggaaaatataatttgagaaacaaggatggcaaaaaattgtaagaggcagaaatttaataacagtaaatgtacttcatattctctgcgaatgtgtgattacaatgaagatttatatacctgtttgtatggtccaca

SEQ ID NO: 40094 - DNA, 601 bp, Human
agggctgctgctacacatcttaaaagagccagaacagctccctaaaaatgaagaattgtccagcccaaaatattatagtgccactgttgaaggtgaaagcacgtcatttctttctttccattttttttttttttgagacagagtcttgctctgtcgcccaggctggagtgcggtggcatcatctctgctcactgcaagctccacctcctgggttcacaccattctcctgcctcagcctcctaagtagctggaactacaggcgcccaccaccacgcccagctaattttttgtattttttagyagagacggggtttcagtgtgttagccaggatggtctcgatctcctgacctcgtgatctgcccacctcagcttcccaaagtgctgggattacaggcgtgagccaccgcgcccattcgtttagtacacgtcatttcttttagtacattccagatgcctgcttgggttaatcctttgccttatgttttaatccataatgtattgctttcctaagtccttcttcattaaaataaaattctattataatatttaggttagaaatttaaatttcacaatttaacatcctttggtctctggaaaata

SEQ ID NO: 40095 - DNA, 601 bp, Human
aaaacagtcttgactctttaggttctcaccccagagtgagctatataacctctctggacctcagtttcttcttttgaaaaatgtagcacctatacatcacagactttcaataaggattaaatgagttaatacatgtatcaggcatacaacaaaggcaggaaacagtgctaattaaatgtttgctattggccattatcatagattgtatttaagataacagaaaatacaattttctaaggcatttgtattttgctttaaaattgaaccagacctagaagaattagagtaatctgttagcagraaatacagttttgctatttcagactttggtgaattattcatttgctaatctggttaagcaagctggaagcacagttctgttttttatgagtattttgtgtctttgaaattacctgacttaaatattctaatccaggtggacagtttaatggaggctgtggcgctggcatccatggtacccctgcagctccaactggctgattatatactggctgattatacactggctgatttgggacaggaaagccagctgggccaggacctgaatggccggctggtgggggtgggtagctgacctggg

SEQ ID NO: 40096 - DNA, 601 bp, Human
tttctccccatgtgatagtctgaaatatggcctcctgggaagggaaagacctgaccgtccaccagtccgacacccgtaaagggtctgcactgagggggattagtaaaagaggaaggaacgcgtctttgcagttgagataagaggaaggtatctgtctcctgctcgtccctgggcaatggaacgtctaggtgtaaagcccaattgtatattccatctactgagataggggaaaactgccttagggctggaggtgggacgtgctggcagcaatactgctctttaaggcattgagatgtttatktatatgcacatcaaaagcacagcacctttttctttacctttttatgatgcagagacatttgttcacgtgtttacatgctgaccttctccccactattatcctattgtcctgccacatccccctctccgggaaacgcccgataatgatcaataaatactaagggaactcagaggccggtgctggcgcgggtcctccgtatgctgaatgccagtcccctgggcccatttttctttctctatactttgtctctgtgtcttttcttttccaagtctctcgttccgcctaacaagaaacacccac

SEQ ID NO: 40097 - DNA, 601 bp, Human
aatctagttgagagggcaggaaaaaaaatctgtgggctatagttgaccatataaaatttatcactactcaggatcagtttctatattttgagattcctgaaacacaacagtggcaggaattcagatttcaagctcatagacagagctgacttggtatgtcagtttcatgtggccatattttttccccctaccaagagtccttgaaggagacagactctcttatcacctatattggataaaaggtctactaggctctctcttactcaccattaagataaccttcttagagattcaattaccrtctgtttgctgaaaactctccattcttttcctatacataactaaaatccaacatgaccttaattcaagtcattaacttcccatatatattttatataatcaactacagctcattgattatattttgctgatccctgacctagatgtgtattagtatttgataccttactttttaaaaagcagactatcataatggtcaagaggacacaaatcaagtgtttttcctccaagattcttaacttggccaatgtaatatcagaataataacacatcaagtttatctccaaaatttttttcatcc

SEQ ID NO: 40098 - DNA, 601 bp, Human
aaatctagttgagagggcaggaaaaaaaatctgtgggctatagttgaccatataaaatttatcactactcaggatcagtttctatattttgagattcctgaaacacaacagtggcaggaattcagatttcaagctcatagacagagctgacttggtatgtcagtttcatgtggccatattttttccccctaccaagagtccttgaaggagacagactctcttatcacctatattggataaaaggtctactaggctctctcttactcaccattaagataaccttcttagagattcaattacyatctgtttgctgaaaactctccattcttttcctatacataactaaaatccaacatgaccttaattcaagtcattaacttcccatatatattttatataatcaactacagctcattgattatattttgctgatccctgacctagatgtgtattagtatttgataccttactttttaaaaagcagactatcataatggtcaagaggacacaaatcaagtgtttttcctccaagattcttaacttggccaatgtaatatcagaataataacacatcaagtttatctccaaaatttttttcatc

SEQ ID NO: 40099 - DNA, 601 bp, Human
agcataatactgttcatcaaatattcatttcattccctctccttctgtagggccagtatacttcctgttccttcataattaggcttggccatgttacttgtttgaacaacgggtgttagcagatatgacatgagtagtgtccttaaacttggctaagtgctttggcctggcttatgatcttcagtgacaagccactagaaaagcatgactcaggtagctgctgctgctacagccatagaacaaatctacctggagcagattgaggttaacatgcgcctaagtcagtgcttaaatacatccrctgaaacacagttgacctacacacccataagcatgagtataaacacttattgcaagctgctgagttttagggattatgtgtaatgaaatactactgtggtgaaataaactaatacaaatcctttcttgtacatgttagtatttttctgctaatagctgtcattgaagcatttgaagctagtaatgaaaactcttatgttttattttttaattctgaaatttaaaaaaatgaaaaatgcagctgacaacttactagccaccgtaaactcaacactatacagataaagatattaacatttgc

SEQ ID NO: 40100 - DNA, 601 bp, Human
gaatgtagctgaaattcacaaaactatgtacacatatagttgtattaacagaggagtgtccttttcagctaaataaatgtggggaatctaaaaatacttgactcattttatttgagtacaagtggatagtttgtaaaatactagaaataaacatctaatatgaagctgatagcataatactgttcatcaaatattcatttcattccctctccttctgtagggccagtatacttcctgttccttcataattaggcttggccatgttacttgtttgaacaacgggtgttagcagatatgacaygagtagtgtccttaaacttggctaagtgctttggcctggcttatgatcttcagtgacaagccactagaaaagcatgactcaggtagctgctgctgctacagccatagaacaaatctacctggagcagattgaggttaacatgcgcctaagtcagtgcttaaatacatccactgaaacacagttgacctacacacccataagcatgagtataaacacttattgcaagctgctgagttttagggattatgtgtaatgaaatactactgtggtgaaataaactaatacaaatcctttcttgta

SEQ ID NO: 40101 - DNA, 601 bp, Human
actagtcacctgtgaccccagagtgtcaggatcaaatagaatttcagagctaggattaaatgggaatcctgatttaaaatctataaattttaaaatgtcattttgaaatatacactttactgaatcatttcagaatgaacctagagaaagcatctataatcaagattaataagaacagacttacaatgaggaaacaggcaccaatcattacagctttcattttaacatcaaggtctaaagggaactggattccaaagttatcagcgtctgtaaatgcctctctcaaaattccagtccagtrcttggaaattttgccaaccacacactgttcatcaagagatttaatctaaattgaaaaaaaaaagtattaaatacttttaggaaacttatagcaaaagtactttcaaatttgaagtaagatgaaacaaatatggtattaaaattatgcaccatatgtaaccctcattagataactggaggctcctgtatctatttatagatatatgaaaaaaactgtttcattgtacggagaaattatatttcagaaagttttcctgaaatatttaacaatttctattttatattaatatagacattaata

SEQ ID NO: 40102 - DNA, 601 bp, Human
tgtccgaggtgctccagttggaggctgaggttcccgggctctgtagctgagtgggcggcggcaccggcggagatgcctgggaagaaggcgcgcaagaacgctcaaccgagccccgcgcgggctccagcaggtaccgacccgctggggccagcgaagacccaggccgggcggggtcggggccggggtcgaggtctcggctggggcgggctcagctcgccggggctcaagcacagactgcacgggggtcaaggtcgggccaggtctgtgccctggcgcgagccttaggggcgcctccagaaasttcttcggggtttttccccaggaccggcgggtacggcgggtacggcgagggaccaagccggatttgcgattgggatgcagctgcgtttcaccaggggcaaaaagctcctttcctcctctctttcctcctcgccacttgcccttccccggggccacgaggaacaagtgcaagtgtaggcggctgtctctaggagaaagtcattgtcgcggcagaaggggcaggagagagccccggggaccgcctggactcccagcgcttccagagacggccccacaagggcccctgtgttcaggagcctag

SEQ ID NO: 40103 - DNA, 601 bp, Human
tttctggtccgacttaattcccaagaacaggaagcagcacaaagtccctcttaaacttgatttgattgatactaatacatttataggtgtgtaatgcaatttttaaaaaattaaggaaatgaccgggaagtattttctgccttgttttctacatttttggtgaaagggataacttttccacttagaattcagggcttccagtgtcggacgctgaatggtatttggtttttcttttagaactgtatattaatatatctcaatctctgtagacaacatgtctatgtaaatacttcccaacatrtttgatcttgtagcccataaagaataacaccttaagggatttattaggtctcttggtgtaggagttaggaaagatttcactcacttcttgtagagagaaattggttgaaatataggtttaagattttgctttactatatattgacagctttgatttattttgagcctaaatacggtattttcagggtcgatttataaaatagaccagattttaatttgtaatcatgattttttaatgtttgtaatcatgaagtgtacccgaaagacctcaagctgctctttgaaatattcaagaaaattg

SEQ ID NO: 40104 - DNA, 601 bp, Human
aggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaaggkagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaac

SEQ ID NO: 40105 - DNA, 601 bp, Human
gggaagctgccagggaggggggcgaaagtgattccggaggctgccgtctttattagtcgctgcttaggggatggggtggtgctccgtgggcctgcgcccgcctcgcctccagtttcggcctccgcgtcctgctcacccctcatcctcctactctctggttccagtgcctgagaatttattgagggaaactgcccgtggtgtctaaatccctaattttaaaaggctggttgtgcaaggaggttagtctctccggcatctccttcggtaactcttatttaccttgtagcctctttttagttcwtcttaaataactgggatggaggtgctacggaaggatcttagagaccctttttgtgcagaaggagaaggctgtttgccgacctaccttgaactaagaaggactggccatagataacttttacattcccgacagaggcaaataggttggccgaccaaacacagctaatgttttgaaagcatttgatattcttgctatcctgtctccaatgttggggtccctgggaaggtctcaggagggagaaatgttgaaaatcagaaaaggcatcccctccatgccccacaaaagaggtgaacaaagagc

SEQ ID NO: 40106 - DNA, 601 bp, Human
gcctgcgcccgcctcgcctccagtttcggcctccgcgtcctgctcacccctcatcctcctactctctggttccagtgcctgagaatttattgagggaaactgcccgtggtgtctaaatccctaattttaaaaggctggttgtgcaaggaggttagtctctccggcatctccttcggtaactcttatttaccttgtagcctctttttagttcatcttaaataactgggatggaggtgctacggaaggatcttagagaccctttttgtgcagaaggagaaggctgtttgccgacctaccttgractaagaaggactggccatagataacttttacattcccgacagaggcaaataggttggccgaccaaacacagctaatgttttgaaagcatttgatattcttgctatcctgtctccaatgttggggtccctgggaaggtctcaggagggagaaatgttgaaaatcagaaaaggcatcccctccatgccccacaaaagaggtgaacaaagagctgggttccgtttcttaggacattcaaaaccagacatttattttgtacaaaacctctgggtgtgtgcccttagaacaaggatgtccaggc

SEQ ID NO: 40107 - DNA, 601 bp, Human
actcttatttaccttgtagcctctttttagttcatcttaaataactgggatggaggtgctacggaaggatcttagagaccctttttgtgcagaaggagaaggctgtttgccgacctaccttgaactaagaaggactggccatagataacttttacattcccgacagaggcaaataggttggccgaccaaacacagctaatgttttgaaagcatttgatattcttgctatcctgtctccaatgttggggtccctgggaaggtctcaggagggagaaatgttgaaaatcagaaaaggcatccyctccatgccccacaaaagaggtgaacaaagagctgggttccgtttcttaggacattcaaaaccagacatttattttgtacaaaacctctgggtgtgtgcccttagaacaaggatgtccaggccaggcgcggtggctcatgcccgtaatcccagcactttgggaggccgaggcgggctgatcacctgaggtcgggagttcgagaccagcctgaccaacatggagaaactccgtctcttctaaaaatacaaaattagccgggcgtggtgacacacgcccgtaatcccaactactagggagga

SEQ ID NO: 40108 - DNA, 601 bp, Human
aggcggaggttgcagtgagccgagattgctccactgcactccagccactgcaccccagcctgggcgagagagctagactccatctcaaaaaagaaaaagttctggtaaggacatcaggagataggagatataaggcaaccactgttatcagtgagatgaatgtgtccctgaagatgagtgggggtggggagtgggaggagagagaacctgtgccctgaaagagagctgtgctcagggaggttatccgtggctggaaacagccaggtccctggttgtggtccttttttgaaatttgaaacaraacttttgggaacagctggaaagaacttcttctttttagtttttttttgagacagagtttcactttgtctcccaggccagggtgcagtggtgcaatctcagctcactgcaacctccgcctcctgagttcatgcgattctcgtgcctcagcctcccgagttgctgaggcgcccaccactgtgccgggctaattttttgtatttttagtagagatgggatttcgccgtgtgggccaggctggtctcgaactcctggcctcaagtaattcacccgccttggccacccagagtgctgggattac

SEQ ID NO: 40109 - DNA, 601 bp, Human
tcttaatgtaatgatgaaaactttggattttggagtcatacatatctggctctgcctggcaagtcacagctctgtgagcctcagttacttctctcttttttaaaatttctttttttttccctaagaaaaagcctcagttatttcttaaaataactataggctactatactttcttcatagaattgtagtatgtgttttataagatgtgtgcaaagcatgggacatagtaggcgatcagtaaatgctgattgcccttatctttttcaaagtttcaaagttgtacaggttgaacatgtagacragtttcaaatggccaatgataatgctatatattatagtctttgttggggggcttaggaaggaacatttctaaaattctgaatgttgattttatactgtgaggttgttgggaatccactgtcccttggaacctatgtctctataacctgaggctggagagactgtgggcgtgacctcatttatcaccatcctgcctttgaaggcttgtttctttgatttgggattgtgtgttctggcaacttgtgtgtgtttcatcagtaatttgttatagtgcttcctggtaaggtagccttttcccaaa

SEQ ID NO: 40110 - DNA, 601 bp, Human
tatagtgcttcctggtaaggtagccttttcccaaacatggactggcctgaaggctctcttcctgtgaaatatcccggttaaataatgtcaggagtgccatccctttttttatttttattttttgagacagagtctcactctgtcacccaggctggagtgcagtagcatgatcttggctcagtgcaacctccgaggagagctgtccctttgcagagaatggtgatctcacacgtataaaagggctgtatgttcccaaagattatttccaagttgattatttggaatgtgggacacattttcycataaaagcaatgtggttgggttactagtctgacctacaaagctttttatttggcatcttagttgaagtgccaatttactaatagcagttttgggttctgggaacagagcttgcaggacaggtgggaggaggaagagagcttctgatctctttctggggccttggtttgagttaggcagagatttgtctttctctaaactcaggttctctatccttctccttaggtctccaagtcccctggcacttttcttttcttcagttcctctccagacaggctctatttctccaaatgttatatgt

SEQ ID NO: 40111 - DNA, 601 bp, Human
acctcaggtgatccaccagcctccgtctcccaaagtgctgcgattacaggcctgagccaccgcgcctggccaactgcctcctgggttcaagtgattcttctgcctcagcttcgcgagtagctgggactacaggtgtgcgctaccatgcccggctaattttttttttttgagacgagtctcgctctgtcgcctggtctggagtgcagtggcgcgacctcggctcactgcaacctctgcctcctgggttcaagcgattctgcctgcctcagcctcctgagtagctgggattacaggcactcgycaccacgcctgactaatttattttttatttgaggcggagtctcgctctgttgcccaggctggagtgcagtggcgcgatctcggctcactgcaagctctgcctcctgggttcacgccattctctcacctcagcctcccaagtagctgggattacaggcatgcgtcacctcgcccagctaattttttttgtatttttagtagagacagggtttctttttttttttttttttttttgagacggagtctcgctctgttgaccaggctggagtgcagtggcacgatcttggctcactgcaagctc

SEQ ID NO: 40112 - DNA, 601 bp, Human
cagcccccgaatagctaggactacaggtgtgcaccactacacctggctaatttttgtattttttgtagagatggggtttggccatgtggtccaggctggtttcaaactcctggactcaagcaatctgcctgcctcggcctcccgaagttttgggattataggcgggaggcactgtgcctggcctagattttattcattttataagctatgaaaatttttattatgtgggcctatcttttttttctcttttttaaatttgagacggagtcttgctgtgttgcccaggctggagtgcagtggygtgatcttggctcactgcaacctctgcctcctgggttcaagcggttcttctgcctcagcctcccgagtagctgggattacaggtgtgcgccaccatgcctggctaattttttgtatttttagtagaggtggaatttcgctatgttggccaggctggtcttgaactcctggcctcaagtgatccacccgcctcggattcccaaagtgttgggattacaggtgtgagccaccacacccagcctctttttttttttaagacagtctcactctgtcacccaggctggagtgcagtggaacggtc

SEQ ID NO: 40113 - DNA, 601 bp, Human
aatttgagacggagtcttgctgtgttgcccaggctggagtgcagtggcgtgatcttggctcactgcaacctctgcctcctgggttcaagcggttcttctgcctcagcctcccgagtagctgggattacaggtgtgcgccaccatgcctggctaattttttgtatttttagtagaggtggaatttcgctatgttggccaggctggtcttgaactcctggcctcaagtgatccacccgcctcggattcccaaagtgttgggattacaggtgtgagccaccacacccagcctctttttttttttaagacagtctcactctgtcacccaggctggagtgcagtggaacggtccagctcactgcaagctctgcctccccagttcaagcgattctcctgcttcagcctcccaagtagctgggattacaggtgtgtgccgtcatgtcaggctaatttttgtattttttagtagagatggggtttcaatatgtttcccaggcctggtctggaactcctgacctcaaatgatccacctacctcagcctcccaaagttctgggattacaggtgtgagtcaccatgccggacctgggcatatcattatttac

SEQ ID NO: 40114 - DNA, 601 bp, Human
cagctcactgcaagctctgcctccccagttcaagcgattctcctgcttcagcctcccaagtagctgggattacaggtgtgtgccgtcatgtcaggctaatttttgtattttttagtagagatggggtttcaatatgtttcccaggcctggtctggaactcctgacctcaaatgatccacctacctcagcctcccaaagttctgggattacaggtgtgagtcaccatgccggacctgggcatatcattatttacccattgtcttatcaactgatatttgagttgtttcttttttttttttttcccccgagatggagtcttgctctgtcaaccagagctggagcgcaatggcacgatctcagctcactgtaacctctgcctcctgggttcaggcaattctcctgcctcagcctcctgagtagctaggattacaggtgtgcgccaccacacttggctaatttttgtatttttagtagagatggggtttcaccttgttggccaggctggtttcgaactcctgatctcgtgatctgcctgtcttggcctcccaaagtgctgggattacaggtgtgagccaccacgcccagcctatttgggttgttt

SEQ ID NO: 40115 - DNA, 601 bp, Human
cttttttttttttttcccccgagatggagtcttgctctgtcaaccagagctggagcgcaatggcacgatctcagctcactgtaacctctgcctcctgggttcaggcaattctcctgcctcagcctcctgagtagctaggattacaggtgtgcgccaccacacttggctaatttttgtatttttagtagagatggggtttcaccttgttggccaggctggtttcgaactcctgatctcgtgatctgcctgtcttggcctcccaaagtgctgggattacaggtgtgagccaccacgcccagcstatttgggttgtttctaattaataaaaaatttttttatttgagtcagagtttcactcttgttgcctaggctggagtgcgatggcacgatcttggctcactgcaacctctgcctcctggttcaagcaattctccttcctcagcctcccaagtagctgggattataggcatgcgccaccacacctgaataattttatatttttagtagaaatggggtttcactatgttggtcaggcgcatctccaactcctgacctcaggtgtgatccacccactttggcctcccaaagtgctgggattgta

SEQ ID NO: 40116 - DNA, 601 bp, Human
taattaataaaaaatttttttatttgagtcagagtttcactcttgttgcctaggctggagtgcgatggcacgatcttggctcactgcaacctctgcctcctggttcaagcaattctccttcctcagcctcccaagtagctgggattataggcatgcgccaccacacctgaataattttatatttttagtagaaatggggtttcactatgttggtcaggcgcatctccaactcctgacctcaggtgtgatccacccactttggcctcccaaagtgctgggattgtaggcatgagccaccgcrccccgcctaaaatttttttttttttaaagtagagatggggtctcgctgtgttgcccaggttggtgtcaaactcctggactcaagtgatcctcccacctggggctcccaaagtgctgagattacaggtgtgagccactatgcccagcttttttttttttttttgatgcattaaacacctttgtgtttccgtgagcacatctgaaagatagattcctgtaagtagacctgttgactcattgtgtatatgcagttttttattccaaaagattgtccccttaggaggtccttcccacccacaga

SEQ ID NO: 40117 - DNA, 601 bp, Human
tgcagttttttattccaaaagattgtccccttaggaggtccttcccacccacagagcgggagaattcttgtttcctcttcctggaatcttgttttgtttttattgagacagagtctcgttctgttgtccaggctggagtgcagtggtatgatctcagctcactgcaacccccacctcctggactcaggtgatcctcctgcttcagcctcccaagtagctgggactacaggtatgcaaccacacccagctaatttttaaattttttttgtaaagatggcgttttgccaagttggccagcctsgtcttgaacccctggcctcaagtgatctgcctgccttggcctcccaaattgctgggattaggtatgagccaccacacctagccagatgtttttaatttgccaaccttatccagaaagagaaatcacatataatttacgtgtccgtgcttattcaggaggttggcaatttattccaaatgtttactgcaattaggttttttttttttttttgagacgaagtctcgctctgttgcctgggttggagtgcagtggtgcaatctcggctcaccacaagctccgcctcccaggttcacgccattc

SEQ ID NO: 40118 - DNA, 601 bp, Human
aagttggccagcctggtcttgaacccctggcctcaagtgatctgcctgccttggcctcccaaattgctgggattaggtatgagccaccacacctagccagatgtttttaatttgccaaccttatccagaaagagaaatcacatataatttacgtgtccgtgcttattcaggaggttggcaatttattccaaatgtttactgcaattaggttttttttttttttttgagacgaagtctcgctctgttgcctgggttggagtgcagtggtgcaatctcggctcaccacaagctccgcctcccrggttcacgccattcttctgcctcagcctcccaagtagctgggaccgcaggcgcccgccaccacgcctggctaatttttttgtacttttttagtagagatgggatttcaccatgttagccaggatggtctcgatctccttaccttgtgatctgcctgccttggcctcccaaagtgctgggattacaggcgtgagccaccgcacctgacctgtttttttttcttctgtgaattgcctgtgtatgtctgaaacatcaacttggttttatttttctaacggttctgctctggtggggagaggga

SEQ ID NO: 40119 - DNA, 601 bp, Human
atctgcctgccttggcctcccaaattgctgggattaggtatgagccaccacacctagccagatgtttttaatttgccaaccttatccagaaagagaaatcacatataatttacgtgtccgtgcttattcaggaggttggcaatttattccaaatgtttactgcaattaggttttttttttttttttgagacgaagtctcgctctgttgcctgggttggagtgcagtggtgcaatctcggctcaccacaagctccgcctcccaggttcacgccattcttctgcctcagcctcccaagtagcygggaccgcaggcgcccgccaccacgcctggctaatttttttgtacttttttagtagagatgggatttcaccatgttagccaggatggtctcgatctccttaccttgtgatctgcctgccttggcctcccaaagtgctgggattacaggcgtgagccaccgcacctgacctgtttttttttcttctgtgaattgcctgtgtatgtctgaaacatcaacttggttttatttttctaacggttctgctctggtggggagagggaagggagggcatggttattgaagggattgtcagtattgcc

SEQ ID NO: 40120 - DNA, 601 bp, Human
tcactggactccagcctgggcaacaagagcaaaactccgtctcaaaaaaaaaaaaaaaggtgaaagggagtgtgtgtgttgtaggggaggattctatttacctgtttgttttttcatttttttttgtcaagattcttcagaggaggcccctccagccactcagaacttcatcattccaaaaaaggagatccacacagttccagacatgggcaaatggaagcgttctcaggtaccatttggaactgtggtgagaaacttgggcttttcaaagacagtggttttcctagcatgacgggcggtragttcctggcccttcttgctcttggagcctgacttttcagaagctagggagaaaggtgacaggggagctggctgtctcttcccttcagaggcagtactcagagatgctttatcaggaaggttgcctactttttcaggctgctgccagggtagcccgggagagttccgctcctggttctcttaagccattgccccttgagtgttgctgtattggctgaacatgagtgtttgaaatgatggagcgagtcactttgattcttggctgcaagtaacagcaagtgtggcagccagtgcctcaagg

SEQ ID NO: 40121 - DNA, 601 bp, Human
aatcaggagtcacttgttcccagcaactgcctctctaggggcctgcacctcaatgctatttttttttttgagacagggtctcaccctggcccccaggctggagttcagtgatatgatcatggctctctgcagcctccacctcttgggctcaagcagtcctcccacctcagccacctgagtagctgggaccacaggcacgtaccaccacacctggcaaactttttaattttttgtagagatggggtctcactatgttgcccaggctggtctcaagctcctgggttcaagtgatcctcctgcmtcagcctcccaaagtgctaggattacagacttgagccacaatacctgaccctcagtgctttcttatccctgtgttgggtgtaactgcagcccagcagggaagaagagtgtctagttgaaagctgggaatggttgtgtggggagacctgtctgtggcaggcatctgcactccaactagacagcctggcccgcctttggtcgctgattgctgggggtgagacacttggtggtactccttgaattcctggtggtagagcatcatggacaagcatgtgcccactcagctttgaagttaggctac

SEQ ID NO: 40122 - DNA, 601 bp, Human
cacctgagtagctgggaccacaggcacgtaccaccacacctggcaaactttttaattttttgtagagatggggtctcactatgttgcccaggctggtctcaagctcctgggttcaagtgatcctcctgcatcagcctcccaaagtgctaggattacagacttgagccacaatacctgaccctcagtgctttcttatccctgtgttgggtgtaactgcagcccagcagggaagaagagtgtctagttgaaagctgggaatggttgtgtggggagacctgtctgtggcaggcatctgcactcyaactagacagcctggcccgcctttggtcgctgattgctgggggtgagacacttggtggtactccttgaattcctggtggtagagcatcatggacaagcatgtgcccactcagctttgaagttaggctactgggtcctagctccatgtctaatgatatcttggtcttgggagaccttgggcggatcacttctcttgaaatcttggtttcctcatctgtaagatggcgccagcagtgtctaccttatagggctattgtgtaaaaaaactgctggcagcaatagtgagtacttggttcactct

SEQ ID NO: 40123 - DNA, 601 bp, Human
gctgattgctgggggtgagacacttggtggtactccttgaattcctggtggtagagcatcatggacaagcatgtgcccactcagctttgaagttaggctactgggtcctagctccatgtctaatgatatcttggtcttgggagaccttgggcggatcacttctcttgaaatcttggtttcctcatctgtaagatggcgccagcagtgtctaccttatagggctattgtgtaaaaaaactgctggcagcaatagtgagtacttggttcactctggctggagatcagcgtgttgctgtggtcrctgtcttgccagcttttctggagggtaggggtcggtatttggcattacgtttctgcttctcctgctattgggttgggagtcagggtcaggagaagtagaaagctcggagctctttggtaacctggtggagctcggggcaggtggggcgggggggtctgccacccctctccccatccccattctcctctctgtttggtaggcatacgctgactacatcggattcatccttaccctcaacgaaggtgtgaaggggaagaagctgaccttcgagtacagagtctccgaggtaggcccaaggag

SEQ ID NO: 40124 - DNA, 601 bp, Human
tctaggcatatacaaatctcagtttgttaaaatgtcaatttcacttagcaaaattacaaatgagtttatactctgcttggtcatcttctgggaaacacgactgtgcacatacggccctctgcactacaaggctgtttattaagtcactgtattacagcaaactggaaatgttccaagtatccatctgtaggggattatttaaataaattagtccatcaatatcatggagtactgtgcagctataaaaaggaattttttttattttttattttatctttttttttttttagacggagtctckctgtgttgcccaggctggagtgcagtggcgcagtcttggctcactgcaagctccacctcctgggttcacgccattctcctgcctcagccttccgagtagctgggactacaggcacccaccaccacgcccggctaattttttgtatttttcgtagagacggggtttcaccgtgttagccaggatggtcttgatctcctgaccttgtgatccgcccatctcggcctcccaaagtgctgggattacaggtgtgagccaccacgctcggccccaaaaaggaatttttttcatagctgggcacgg

SEQ ID NO: 40125 - DNA, 601 bp, Human
ttacctattcaaagcaaacaaaaataaaaatgcaggatctcagaccctgtctagaaaagcagagtctacaggtctgggtagggactgggaacctggatttttactagctttccaggagatggctcatgccagttgtctacaactgagcttaaggaaatttgggtcctaattgctctggcccaatattttcacatagagcagaggggaggactcaggacccagtgaagtgctgttcccaagagacgcccgggcctgcctctggactcttaagatggtacatgatctttttttttttttttttcctgttgttcaggctggagtgcagtggcatgatctcagctccctgcagccttgacctcctgggctcaagcaatcgtcctgcctcagcctcccaagttgctgggactacagcatgcgccaccatgcttggctaatttttgtgtttttagtagagacggggtttcatcatgttggccaggctgatctcgaaatcctggcctcaggtgatccgcccaccttggcctcctaaagtgttggaattacaggtgtgagccactgctcccagccttaagttatatcttaaagctgacaaatcatagct

SEQ ID NO: 40126 - DNA, 601 bp, Human
ctcagcctcccaagttgctgggactacagcatgcgccaccatgcttggctaatttttgtgtttttagtagagacggggtttcatcatgttggccaggctgatctcgaaatcctggcctcaggtgatccgcccaccttggcctcctaaagtgttggaattacaggtgtgagccactgctcccagccttaagttatatcttaaagctgacaaatcatagctttacagcttgatggatttttacatgtttttactcatggactcaccactcatgccaagttttttacccatggattcaccactyatgtcaagcaatagaacattctagctggagtgctccccttcccaattgatatcgcccagattattctgatttctattccataaattgatttttttccatgtttctgaacttcgtataactctctggcttcttttgctcaatgtcatgtctgagattcatccatgttttcatgtctagctataggtctttttctttgctgtgtagtattctattgtatgaatataccacaatttattcatttcactgttgatggacatttccattgcatttccaccttttggctactctaaacagtgctgt

SEQ ID NO: 40127 - DNA, 601 bp, Human
gcagtgtgggcccccagtcaggtgctgcccctgggcacctgcccactgggatgctgcttaatatgctgccaccactttgtgtctcttgtgttaccaggaagcagaaaacttggtggccacagtggtccctacccatctggcagctgctgtgcctgaggtggctgtttacctaaaggagtcagtggggaactccacgcgcattgactacggcacaggtatctgctgcttgtggggctctgtacttatctagcttcactgctttctgttttgggcttcaggtggtctctgggccctctgagcragtgagagcaatcaagaattcgccaagcacctgcaacctattggggccagctggggttagggtggcttcaccggcagggagggcgtaggcatgcagggaggcccggatgctgcagctctgctgtggtccaccagggggagctgatgccccgtgcatggtgcttgcgcagcgctgctttctgttcttgtgaaaatggtctctgagctcctcatcatcaccaaaataattattaattgagcacttactgtgtgtcaaggcagcagcttactgaagctttgagaaatgggaacgcttcttggt

SEQ ID NO: 40128 - DNA, 601 bp, Human
ctgagggggaggattgcctgagctcaggagtttaagaccagcctaggcaacgtagcaagactccatctcttttttaaaaatttattttaagttatttttatttatatatttatttttttgagacagggtcttgctttgtcacccgggctgcagtgcagtgatgtgatcttggcccactgcagccttgacctcccgggcccaagtgatcctctcacctctgcatctccccactccccagtacctgggactacaggtgtgcaccaccagcctggcaatttatttatttatttgagacagagtstcactctgttgcccaggctggagtgcagtggcatgatcttggctcactgcaacctccacctcctgggttcaagcgattattctgctgggactataggcacacaccaccatacctggctaattttagtgtttttggtagagacagggtttcaccatgttggccaggctggtctcgaactcctgacctctggtgaggtcacttctccacccaccttggcctcccaaagtgctgggactgggattacaggcgtgagccactgcgcccagctgattgttttgtattttttgtagagatggggtt

SEQ ID NO: 40129 - DNA, 601 bp, Human
agggtcttgctttgtcacccgggctgcagtgcagtgatgtgatcttggcccactgcagccttgacctcccgggcccaagtgatcctctcacctctgcatctccccactccccagtacctgggactacaggtgtgcaccaccagcctggcaatttatttatttatttgagacagagtctcactctgttgcccaggctggagtgcagtggcatgatcttggctcactgcaacctccacctcctgggttcaagcgattattctgctgggactataggcacacaccaccatacctggctaattttagtgtttttggtagagacagggtttcaccatgttggccaggctggtctcgaactcctgacctctggtgaggtcacttctccacccaccttggcctcccaaagtgctgggactgggattacaggcgtgagccactgcgcccagctgattgttttgtattttttgtagagatggggttttgccatgttgcctgggctggtcttgaactcctgagctcaagctgttctcccacctcagcctcccaaagtgctcagattacaggtgcaagccaccatgctgagaccccatctctcaaaaatata

SEQ ID NO: 40130 - DNA, 601 bp, Human
ggtcttgctttgtcacccgggctgcagtgcagtgatgtgatcttggcccactgcagccttgacctcccgggcccaagtgatcctctcacctctgcatctccccactccccagtacctgggactacaggtgtgcaccaccagcctggcaatttatttatttatttgagacagagtctcactctgttgcccaggctggagtgcagtggcatgatcttggctcactgcaacctccacctcctgggttcaagcgattattctgctgggactataggcacacaccaccatacctggctaattttartgtttttggtagagacagggtttcaccatgttggccaggctggtctcgaactcctgacctctggtgaggtcacttctccacccaccttggcctcccaaagtgctgggactgggattacaggcgtgagccactgcgcccagctgattgttttgtattttttgtagagatggggttttgccatgttgcctgggctggtcttgaactcctgagctcaagctgttctcccacctcagcctcccaaagtgctcagattacaggtgcaagccaccatgctgagaccccatctctcaaaaatataaa

SEQ ID NO: 40131 - DNA, 601 bp, Human
ctggcaatttatttatttatttgagacagagtctcactctgttgcccaggctggagtgcagtggcatgatcttggctcactgcaacctccacctcctgggttcaagcgattattctgctgggactataggcacacaccaccatacctggctaattttagtgtttttggtagagacagggtttcaccatgttggccaggctggtctcgaactcctgacctctggtgaggtcacttctccacccaccttggcctcccaaagtgctgggactgggattacaggcgtgagccactgcgcccagcygattgttttgtattttttgtagagatggggttttgccatgttgcctgggctggtcttgaactcctgagctcaagctgttctcccacctcagcctcccaaagtgctcagattacaggtgcaagccaccatgctgagaccccatctctcaaaaatataaaagggaggtgttctctaggtcagggcatggcctgtggagccaccatgctgagaccccatctctcaaaaatatagaagggaggcgttctctgtgtcagggcacggcctgtcgagccaccatgctgagaccccatctctcaaaaa

SEQ ID NO: 40132 - DNA, 601 bp, Human
cctcttggaccgggtggggctttgactaagaccagcaggaaaagatcaaagagggaagactggccaggtcagcaggggttggtgccccagctgcatgtgaacccctgaacaatgggagcctgggccctgtctggtcataattggaaactgtggcaggggaaggaaactgagctcacaagcttccaggccctggaggggtcttcgtcctccagagacaggacagaagtattctctgacacattctcttctcacctccctccagataggttttgtgtgacattgtgaacaatgggattcaatsacagtccagtgagttgttcctacagtgcagaccattcctgtttgatatgactgggaaaggaaggaggatactttttcaccctgtaatctgatcatgtgttccctgcttagaagcctgcagtggctccctattgctcttagggtaaagtctgagctctttcctatggccaaaaggcccatgtgacctgtagcctcctgtcattacacgttctcccttgctctcactgccttcgacatactggcctccttagtgttcctcaaacagatcaaactttttcttgcctcaaggcctgtgcacatg

SEQ ID NO: 40133 - DNA, 601 bp, Human
ctatggccaaaaggcccatgtgacctgtagcctcctgtcattacacgttctcccttgctctcactgccttcgacatactggcctccttagtgttcctcaaacagatcaaactttttcttgcctcaaggcctgtgcacatgctattccttctggctagaatgcatttcttgcttccctcactccctttgccttgccagctcacatctttcagatttcagattagatgttacttccttaggggaaaccttgaacccttacgtcagggtccttctgtgatatcctccagttagtaccctgtctktctccttcagagctggaatcatagtagtgactgtatatttataatgtctgttgtccctgatagatcataaactttctgagggcaaggacttacttgtcactgtctcctagtgcgtaacatggacagtgactgcttacatagtaggtgctcagtaaatatggtggaattgctgagtgagttaaacctacgtaatgaaatgtaaatgtccagcccgggtcttttacgagtggaattatagtactggtagttcttttttttttttttttttttttttttttgagacagtctcactttgtcacc

SEQ ID NO: 40134 - DNA, 601 bp, Human
atcctccagttagtaccctgtctttctccttcagagctggaatcatagtagtgactgtatatttataatgtctgttgtccctgatagatcataaactttctgagggcaaggacttacttgtcactgtctcctagtgcgtaacatggacagtgactgcttacatagtaggtgctcagtaaatatggtggaattgctgagtgagttaaacctacgtaatgaaatgtaaatgtccagcccgggtcttttacgagtggaattatagtactggtagttcttttttttttttttttttttttttttttgagacagtctcactttgtcacccaggctggagtgcagtggccttatcatggctcactgcagcctcaacctcctgggctcaggagatcctccatctcagcctcctgagtagttgggaccacaggcacatgccaccatgtctggctaatttttgtattttttgtagagacagggttttgccatgttggccaggctgatctcaaactcctgagctcaagcaagctgcctgcctcagcctcctgaagtgctgggattacaggcatgagccaccatgcacggccagtactggtattatagttct

SEQ ID NO: 40135 - DNA, 601 bp, Human
tcctccagttagtaccctgtctttctccttcagagctggaatcatagtagtgactgtatatttataatgtctgttgtccctgatagatcataaactttctgagggcaaggacttacttgtcactgtctcctagtgcgtaacatggacagtgactgcttacatagtaggtgctcagtaaatatggtggaattgctgagtgagttaaacctacgtaatgaaatgtaaatgtccagcccgggtcttttacgagtggaattatagtactggtagttctttttttttttttttttttttttttttkgagacagtctcactttgtcacccaggctggagtgcagtggccttatcatggctcactgcagcctcaacctcctgggctcaggagatcctccatctcagcctcctgagtagttgggaccacaggcacatgccaccatgtctggctaatttttgtattttttgtagagacagggttttgccatgttggccaggctgatctcaaactcctgagctcaagcaagctgcctgcctcagcctcctgaagtgctgggattacaggcatgagccaccatgcacggccagtactggtattatagttctt

SEQ ID NO: 40136 - DNA, 601 bp, Human
caagtctttctgaatggggaagaggtctcattgtctccatgttgaccaccctcctcagaggggcacttatcaatgattcggattctgggagactaaaacaatcccagtcctttacctggactactgtcaacgctggttgtttttctcctccagggcatgaggcagccttcgctgctttcctctgctgtctctgcaagattggggtgctccgggtggatgaccaaatagctattgtcttcaaggtgttcaatcggtgagagaaaggacaggagggttggaggagggggcgtgaggggccatytgtttcctcctcaaactgggaaatggggtgctctagggttctcctgagtagctcatggttctcttgtcctgtcctaatcaagctctggctgtggatggagtgtccaagccttttttccaacaggttcaaattaacctccaagtaaaagcaagtgaaagaattgtcacataggccgggcgcggtggctcacgcctgtaatcccaggactttgggaggcccaggcaggcggatcacaaggtcaggtgttcgacaccagcctggccaacatgatgaaaccccgtctctactaaaaatacaaga

SEQ ID NO: 40137 - DNA, 601 bp, Human
aaagcagggcattagaccagctattgagggaggctgtttactgtcgaccttctgctgtgagagcccgtgtggtgggctggaggaggcggaggccaagcgccaccaagataatgggaagtgacatgggctggagcaagggcgcacgcctggtgcataatggactggtgtgaaatgcgccccagctcctggcagcagctgtggggttttatgttgaaaatgagggacccttttgatttggtgaccagtgtcatccactgttattatcgagctgtgtgcaaaggggcccgttagggagcagccrccaagtgctgggtggtgggcctgcttcctgtggggctcagagaggcctgctctggtgactccccaactcttgaagctagttttcaggatgggcgtaggtgatcatctctattttgatgaagaatgaactgcctacagactgatattcataaatgaccattagttgtggcctcgggtgcattgcctccccgaatcttctcagtgacactgcgaagggtctgccagcatgaagccggctctgctgactggcacctgcaccaggcaccatactgagtgctgtaggtgtggtaattgttgtcat

SEQ ID NO: 40138 - DNA, 601 bp, Human
agaccagctattgagggaggctgtttactgtcgaccttctgctgtgagagcccgtgtggtgggctggaggaggcggaggccaagcgccaccaagataatgggaagtgacatgggctggagcaagggcgcacgcctggtgcataatggactggtgtgaaatgcgccccagctcctggcagcagctgtggggttttatgttgaaaatgagggacccttttgatttggtgaccagtgtcatccactgttattatcgagctgtgtgcaaaggggcccgttagggagcagccgccaagtgctgggyggtgggcctgcttcctgtggggctcagagaggcctgctctggtgactccccaactcttgaagctagttttcaggatgggcgtaggtgatcatctctattttgatgaagaatgaactgcctacagactgatattcataaatgaccattagttgtggcctcgggtgcattgcctccccgaatcttctcagtgacactgcgaagggtctgccagcatgaagccggctctgctgactggcacctgcaccaggcaccatactgagtgctgtaggtgtggtaattgttgtcatggcccctaggagg

SEQ ID NO: 40139 - DNA, 601 bp, Human
gcgccaccaagataatgggaagtgacatgggctggagcaagggcgcacgcctggtgcataatggactggtgtgaaatgcgccccagctcctggcagcagctgtggggttttatgttgaaaatgagggacccttttgatttggtgaccagtgtcatccactgttattatcgagctgtgtgcaaaggggcccgttagggagcagccgccaagtgctgggtggtgggcctgcttcctgtggggctcagagaggcctgctctggtgactccccaactcttgaagctagttttcaggatgggcgtrggtgatcatctctattttgatgaagaatgaactgcctacagactgatattcataaatgaccattagttgtggcctcgggtgcattgcctccccgaatcttctcagtgacactgcgaagggtctgccagcatgaagccggctctgctgactggcacctgcaccaggcaccatactgagtgctgtaggtgtggtaattgttgtcatggcccctaggaggaggtgctcttcttgtccccagtgtccaggtgaggaaactgaaccttggcaggctgaagtcatgcgtccaacgccatgtagcta

SEQ ID NO: 40140 - DNA, 601 bp, Human
ggcgtaggtgatcatctctattttgatgaagaatgaactgcctacagactgatattcataaatgaccattagttgtggcctcgggtgcattgcctccccgaatcttctcagtgacactgcgaagggtctgccagcatgaagccggctctgctgactggcacctgcaccaggcaccatactgagtgctgtaggtgtggtaattgttgtcatggcccctaggaggaggtgctcttcttgtccccagtgtccaggtgaggaaactgaaccttggcaggctgaagtcatgcgtccaacgccatgyagctagagcttagcacattagaatacacaaacccagagttacttattgctccttcaaggtgaggtgttgagggcaccacgggcaggactgaggcccctgggggggtgtgactgctgggccgggttgcccaggtagtcgtggggcctggttctgaacgctggggcccattccttttcccagaccacccatacctggagcccagacactttgtggatgagaaggccgtgaatgagaaccacaaggactacatgttcctggagtgtatcctgtttattaccgaggtgaggaggaggggtgaga

SEQ ID NO: 40141 - DNA, 601 bp, Human
gagtgggagtgcgcaggcctggcctgtggtggcagtcactggatagccagccccacggctgggttctggaactggaagttattgtctcaccaaggcaggattccttgcagtgggccctggaccacttgtgcgagatctcctagtgtgtttgttaaaacgcacattcctgggccctccatcccagcttattgcatcagaatcttaggggacaagagccaggaacctgcatctaaacacacgtgccaggcgactgcacaggaaagctggggaccctctgctctctggacctctcttgagggasgtgttaggacttctcatcctctctgccatccccatgccccagtttccaaagggcgccctcgctcagctatctggagagggtttgagagttctatccctcctcagtccctttcccgacaccagcacggatgtctgctgcctcagtgaggttcctagcaggcctgtggatgctggccacgggggctgctctccgtccgggctgtgtattctgagcccccgacgaggtggagaaagctgggttataaccagcagccttggctccaggctcttcctggtcaacattcggctcaggcttctgcca

SEQ ID NO: 40142 - DNA, 601 bp, Human
gttaaaacgcacattcctgggccctccatcccagcttattgcatcagaatcttaggggacaagagccaggaacctgcatctaaacacacgtgccaggcgactgcacaggaaagctggggaccctctgctctctggacctctcttgagggaggtgttaggacttctcatcctctctgccatccccatgccccagtttccaaagggcgccctcgctcagctatctggagagggtttgagagttctatccctcctcagtccctttcccgacaccagcacggatgtctgctgcctcagtgaggtycctagcaggcctgtggatgctggccacgggggctgctctccgtccgggctgtgtattctgagcccccgacgaggtggagaaagctgggttataaccagcagccttggctccaggctcttcctggtcaacattcggctcaggcttctgccaaactccagaggccagaggggaatgacacattttttccaagtcagcaaatggagccgggactgacggctgggcggccaccacttcattcccggagatctgctgccctcagcagtgtggcaggcccaaggtcgggaggacttgggggcagcc

SEQ ID NO: 40143 - DNA, 601 bp, Human
cccggagatctgctgccctcagcagtgtggcaggcccaaggtcgggaggacttgggggcagcctggctcactgccttgaaagccagtcacgcgctgctctctgtggagtggaatgtgggggtctgcggagccctgggggacctcaggataagctggaggagcagggtgggaagaagggtgcagatgccacactgagttcttgggtgtggctgaaaggctgagctgtttgggctcccccggcggctggccaggcctctgggtccctgtcggtattctaactaggaggcatgccaggcctggyctccaggattttgggaattgattccatggtaaaattttgtctttagttggttggttgattttgttggtataaacaccccaaaagcttttccaaagtttgggacccagttcctccagtagaggaaatctcaaagtagccactaggtggcaggagaggcacactgaacttggagagggtttggtgacatttatttgaggcagcagaaggaacagggaggggagggcgtgcctagagttgttggctgttccgcaccttctccacaggtccgggttttcactttgggtctaggctcttgggcat

SEQ ID NO: 40144 - DNA, 601 bp, Human
cggtattctaactaggaggcatgccaggcctggcctccaggattttgggaattgattccatggtaaaattttgtctttagttggttggttgattttgttggtataaacaccccaaaagcttttccaaagtttgggacccagttcctccagtagaggaaatctcaaagtagccactaggtggcaggagaggcacactgaacttggagagggtttggtgacatttatttgaggcagcagaaggaacagggaggggagggcgtgcctagagttgttggctgttccgcaccttctccacaggtcygggttttcactttgggtctaggctcttgggcatggtgttcaacagtagaccctaggaggagtgtgcccaggagccggggtggctgcagcaagggcccatcttgccacgtggccgctggttgcagcacacgttgtgttggttctccagagcgcccaccctcttccacctcggagcagtgagcagcattttgcagtccctagttggtgagtggcctggcctagctcactggggacctggaggcttgcatggagttctgtacgccttgcttgggaaggaggcagtgtttcctctggagaccct

SEQ ID NO: 40145 - DNA, 601 bp, Human
tctgttttcctttgccagagttacaggcaaaggactgtaacctccctgaaggacttagggagaccctggggtactgaaggcctgggggcagcctgcagcccctccaaagaaactacctctctggcctttctgtgtgtaggggcccagggccactggagctccaggacatgggcctagccctggctctgccagaggccttttgaggatctgttctttggccctggtaggcgaggctggccaggaggcaggggctcttgtcttccagtgcccatctgcctgcctttgcctcggagcccttgcygggcaggcccctggcagacaaagccgacaaagccgacagggtgcctcctggttgcttgctcagagggccctgtccagagagtgaaactggttacacagctccatgctccctgagctttcctgggcctggaagtgtgcacagggctggagcctgcagactggggaaggggtggggtagggtggggaggtgggggaggggctgggggtggagtgtggttgagcagggcagttgaaacaaagctccccagaggtgaggcccctgtaggctcggggtgcctggctgccctcctggaggagagag

SEQ ID NO: 40146 - DNA, 601 bp, Human
agagcgtttctggcttatcttttctccttcaaaaaataacccagtctcccctgacacccgcatgtttctagaaccttccaagtctctgtttctttgccagattcagcctctttgcagagtcttccttctgcagcatgggtctggggtacagagccctgttcccctgtaaatgctgcctatgagctggggggctgtgtcgaggggaattatgaactgcttggttaataaatacaaatgtgctggacttgcggtgtcagggggatatgctcaggcacacaggcgtccctctgtggtttctgaygtcatgggaacttcatgctggctgcagaatctttctcttccgtcctggagggtcagactctttggcaagagggaggaccaggaatggagccgtccttgtgcctgcctctttcagctgctgtggcggccaccccttccccacctcctggccaggccaggctggctgctgcttcaggcacccctgcctcccatcggccctctcttccctgcctgcatggcaggcagagggctgtcggatacctgggtttggtcatacccaccttggtcctcttgcaaattgaccctttcctcatctcttcta

SEQ ID NO: 40147 - DNA, 601 bp, Human
agtctcccctgacacccgcatgtttctagaaccttccaagtctctgtttctttgccagattcagcctctttgcagagtcttccttctgcagcatgggtctggggtacagagccctgttcccctgtaaatgctgcctatgagctggggggctgtgtcgaggggaattatgaactgcttggttaataaatacaaatgtgctggacttgcggtgtcagggggatatgctcaggcacacaggcgtccctctgtggtttctgacgtcatgggaacttcatgctggctgcagaatctttctcttccktcctggagggtcagactctttggcaagagggaggaccaggaatggagccgtccttgtgcctgcctctttcagctgctgtggcggccaccccttccccacctcctggccaggccaggctggctgctgcttcaggcacccctgcctcccatcggccctctcttccctgcctgcatggcaggcagagggctgtcggatacctgggtttggtcatacccaccttggtcctcttgcaaattgaccctttcctcatctcttctagctctgctggtggcaggtgcagaccacgtgtcctgtgggggg

SEQ ID NO: 40148 - DNA, 601 bp, Human
agctgctgtggcggccaccccttccccacctcctggccaggccaggctggctgctgcttcaggcacccctgcctcccatcggccctctcttccctgcctgcatggcaggcagagggctgtcggatacctgggtttggtcatacccaccttggtcctcttgcaaattgaccctttcctcatctcttctagctctgctggtggcaggtgcagaccacgtgtcctgtgggggggcctgggggagagggggtgggcctggaggggtggggcctagctgctgctgctatttatctgaacccaagtraatccctgtgctggagaggcgctctgaggctcctggggagtcggtgggaacgacaccagaagctcaggtggagatcttatcttcctgaggctgctggatttggtgggcgataggaatcaggccccctttttttggctgtgggagaaagaggggtgactgcgggtaggtgggcaaggaatgttatattttcctagcaggccttgagggccaaaggggaaccttgtctctggcacttgcatgtgcctgtttgtatgtttgcccctcaggcagatgctatagcttggtccccaagtgtctgcg

SEQ ID NO: 40149 - DNA, 601 bp, Human
tgaatccctgtgctggagaggcgctctgaggctcctggggagtcggtgggaacgacaccagaagctcaggtggagatcttatcttcctgaggctgctggatttggtgggcgataggaatcaggccccctttttttggctgtgggagaaagaggggtgactgcgggtaggtgggcaaggaatgttatattttcctagcaggccttgagggccaaaggggaaccttgtctctggcacttgcatgtgcctgtttgtatgtttgcccctcaggcagatgctatagcttggtccccaagtgtctgygcgtgcattgtgtgtgtgtgcgtttgtgtgtgtgtgtgtgtgcatgcatgggtgtgactttgctgcaggggaggagggatgagctcccagccagaacctgtctcttcagcttgtggcttctctttttcagatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggaca

SEQ ID NO: 40150 - DNA, 601 bp, Human
gagaggcgctctgaggctcctggggagtcggtgggaacgacaccagaagctcaggtggagatcttatcttcctgaggctgctggatttggtgggcgataggaatcaggccccctttttttggctgtgggagaaagaggggtgactgcgggtaggtgggcaaggaatgttatattttcctagcaggccttgagggccaaaggggaaccttgtctctggcacttgcatgtgcctgtttgtatgtttgcccctcaggcagatgctatagcttggtccccaagtgtctgcgcgtgcattgtgtgygtgtgcgtttgtgtgtgtgtgtgtgtgcatgcatgggtgtgactttgctgcaggggaggagggatgagctcccagccagaacctgtctcttcagcttgtggcttctctttttcagatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggacaaagcaaaagatgtgg

SEQ ID NO: 40151 - DNA, 601 bp, Human
tcggtgggaacgacaccagaagctcaggtggagatcttatcttcctgaggctgctggatttggtgggcgataggaatcaggccccctttttttggctgtgggagaaagaggggtgactgcgggtaggtgggcaaggaatgttatattttcctagcaggccttgagggccaaaggggaaccttgtctctggcacttgcatgtgcctgtttgtatgtttgcccctcaggcagatgctatagcttggtccccaagtgtctgcgcgtgcattgtgtgtgtgtgcgtttgtgtgtgtgtgtgtgttcatgcatgggtgtgactttgctgcaggggaggagggatgagctcccagccagaacctgtctcttcagcttgtggcttctctttttcagatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggacaaagcaaaagatgtggaacctggggctcctgcttcctcctacc

SEQ ID NO: 40152 - DNA, 601 bp, Human
gtcctgggctggggacaaagcaaaagatgtggaacctggggctcctgcttcctcctaccccactgttttgctctgaatcttaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtckgagtctggctctcccatggcatacctgggaagggtcttaccctttggaggcatctccaaagtgctgccttcaaatgttagtgtgtatgatcactgagtggtgggaggtctgagggtaggccgagaattggcatttttatggaccgcttcagggattttgatgcaaatggttttccctgctctcaaatcagatgctgaggagaggagagctgaggcttcctggagctccccctgctggcaggcagccgagggtgtctcctgccctcttggcactgttctcccagccaaggaggtggccttt

SEQ ID NO: 40153 - DNA, 601 bp, Human
gagtgatgggtccttaaagtcccttctttctgttctcaggctggcccttgtgactagttcatggcctcagacactgtactgtgggcaccatctcttgactcctggccggccttctcttctgggaaggggctgctccaggtcttcattggacccagagcttcctggatcccatcagcagaggcgggacaacggggaagggcgccagaggccagcggggtgggggagcacagatgcttccagttggcttggctccctgcacttggtcctgaaggggttaatgaggcttgaactgaacagaccsggccctcactcccttccgccccctccccctttggtccccttcctctggacctcacatcctgtgtttaggttccagcccacatacctctctaatctgagaggcctgagagcccgttggctggagctgcctaggttccttccggctgcagctggccacccccggctctccactccgactctgccctgggtcactgccctctggtgtcctgatgttcctgaccccacccccgcctgtcccacagtgggggctgctggggaactctcactctgctgtgccccgcctccagggtgtctgagcatg

SEQ ID NO: 40154 - DNA, 601 bp, Human
gctgagacgggagaatcgcttgaacctggtaggcggaggttgcagtgaattgagatcacaccactgcactccagcctgggcaacagtgtgagactccgtctcaaagaaaaaaatcactggttgggtgcggtggctcatgcctataatcccagcactttgggaggccaaggcaggtagatcacctgaggtcaggagttcatgaccagcctggccaacacggtgaaacactgtgtctactaaaaatacaaaaattagcctggcatcgtggtgcgcacctgtaattccagctactcaggaggcygaggcaggacagtcacttgaatttgggaggtggaggttgcagtgagccgagatcatgccactgcactccagcctgggcaacagcgagactccatctcaggaaaaaaaaaaaaaaagatcaccaagtctttgcagtgttcaacactcattgacaacttactagcaactagcccttagtccttggtcccgaagggcccatgggctggcatgttgcctacacagaggtccaaggagagggcttgttttctcaggccagttcttagcccctaaggaggccctccaaggcctgccagtcttgcag

SEQ ID NO: 40155 - DNA, 601 bp, Human
actggttgggtgcggtggctcatgcctataatcccagcactttgggaggccaaggcaggtagatcacctgaggtcaggagttcatgaccagcctggccaacacggtgaaacactgtgtctactaaaaatacaaaaattagcctggcatcgtggtgcgcacctgtaattccagctactcaggaggctgaggcaggacagtcacttgaatttgggaggtggaggttgcagtgagccgagatcatgccactgcactccagcctgggcaacagcgagactccatctcaggaaaaaaaaaaaaaaagatcaccaagtctttgcagtgttcaacactcattgacaacttactagcaactagcccttagtccttggtcccgaagggcccatgggctggcatgttgcctacacagaggtccaaggagagggcttgttttctcaggccagttcttagcccctaaggaggccctccaaggcctgccagtcttgcagtccaggggtgggtaggaaggctgggtctccagtcagaactggttgattgaggggagtcagcctcctgggctgccacagaagtctgaccagcctggcagtaggtggcctcaggatt

SEQ ID NO: 40156 - DNA, 601 bp, Human
cccttagtccttggtcccgaagggcccatgggctggcatgttgcctacacagaggtccaaggagagggcttgttttctcaggccagttcttagcccctaaggaggccctccaaggcctgccagtcttgcagtccaggggtgggtaggaaggctgggtctccagtcagaactggttgattgaggggagtcagcctcctgggctgccacagaagtctgaccagcctggcagtaggtggcctcaggatttgggtctaactctgctctgtcccagcctttctgaccgaagaaccaagtgctctcrggggccttgtgtggttgcggggcggcgggggggagggtctgtctttcctctgggccatggctgtgtgggtgctgccttcagaaggaccttgtcaggacccagggagtcccttccccagcttgaatcacctctggctggaaggtcagggggcagtctgaagccgctgctccgcccaggtacatgggagggccttgctgggagaaaggctgggctggaggctcctcctgccctggagccttaggcttccttggcccagctcctgtggctctgagggggctggctctggggtcctgtgggcag

SEQ ID NO: 40157 - DNA, 601 bp, Human
cgttgtggagtgggtgtctttggatagaaggagtgaggaactgggggaggaaggcctgggggatcccctggcggggctacttcctgggcccgggatggacacctgggagctgctgcggttgttggggtcctggcaggggtgtggtgtggccctcaccactctgctcacctgctccttcctcacagtgcctggagaagttccctgtgatccagcacttcaagttcgggagcctgctgcccatccatcctgtcacgtcgggctaggaggggccaagccgaagagccacccaggccacagttcytgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgt

SEQ ID NO: 40158 - DNA, 601 bp, Human
gctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggcyactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctg

SEQ ID NO: 40159 - DNA, 601 bp, Human
tccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacckcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctctt

SEQ ID NO: 40160 - DNA, 601 bp, Human
ctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccrgccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcc

SEQ ID NO: 40161 - DNA, 601 bp, Human
ctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagwgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggccc

SEQ ID NO: 40162 - DNA, 601 bp, Human
tgtcagtaagtttcatggttactgccaccttgtctgaaggaactcacctctaggattctcagatttctggagctactttgatccatgacatgccttcatctgtttattttgccaatggcaatctaaggctagcctggtattctgttggcatctaccaaccttcatgtagactaacagaacccagttataattggtagcaggagacactgcactgtaattatgaatttgttgtaataatgatccacaaattgaatcatccacatttactctaggcctttcctctctgcaatgaaaaactttycctatcataaacaaagatcccacaatttctaagagagaattggggattggggactcacctattaagatgttttgtggttgcagatcctggtgggtgtatccacaggacaagtgtagttcttgaacagccttaaatatagatgacaggacatttcgggcaaattcatcttcctcattttccacatcttcccctctgtgcacatccaaacacgcttccagagtctgctcacagagggtgacacacacaaacaagtggcccctgtggctctcactcccatagaatgtcaccaagtgactgttc

SEQ ID NO: 40163 - DNA, 601 bp, Human
aaatcatcatctctgtggaaggcaataataaaccttatatctgtatttgccattcacccctcaaaacactgccatgtgcactgtttcatttgatctgttaggtatctgccaagagcagcacttacattttattttttccaggccagggggtaggaagggatgaggacaaatttaaccagctcctcgttcatgcaattccaggggccgaaagcacagatttgtaaaggagctgttcccttacactgagcttaaatctcagtgcatgtctatggataaggtatgtactctgcttagacctttyaggcaagaacagcctttcctgagcacctatgatgtaccaaatgacttactatttcatcattgcacttagacctcataacaaacttacgaaggaggcattatcagcctcaagtgaggaactgaggctcacagtatcaagtgacttgtctgaggttacaaaactacaaactagtgagactaggcttcaagccaccctaatcatcgctgaagccctggcttgctcccccgcaccatattgcttcctgggactttacggtcagccttgcttttcttttaacatttaaaagaaaatgctattttc

SEQ ID NO: 40164 - DNA, 601 bp, Human
ttgtcatcttgaaagctctgctgcgggagaagcccaaggaaatgccatggcctacaggggagtcaggacagtgagcaagatggggaaagccttgaacattctttttttcctggttaaaatagaatgccctccaattgcccataggaaataaggtaatgaactgtgacggttaatattgagtgtcaacttgattgagttgaaggatacaaagtattgtgactgggtgtgtctgtgagggtgttgccgaaggagagcaacatttgagtcagtggactgggagaggcagacccacattcagtcwcggtgggcaccatctaatcagctgccagcatggctaaaataaagcaggcagaaaatgaaagagcagacaacttgctaagacttctggccttcatctttctcccgtgctggatgcttcctgccctcaaacatcagtatccaagttcttcagcttatggagttttggacttacaccagtggtttgccaggggctttcaggcctttggccacagactgaaggctgcactgtcggcttccctacttttgaggttttggtactcagactgacccatcactggcttccttgttcctcaacttgcag

SEQ ID NO: 40165 - DNA, 601 bp, Human
gaccagccgtccaaggtcctgcacaaaagccataaatcaagccaaagatgcttactaattatttgggtaaccctggaaggagtggtgcacgctattagcaaacaagatgatgggaggaatctcaaggaatttgtaggcttgttagggagggaaggcacagatgtgtgcatacagacctcttcaaggcagtatatcgcccataccacttagttttatgaagagtaaaagatacatataagtcacagttgttagggcagactgcttggaggaagagagatttgagctgggcctcaaatgtatggacagaatatagataaattgaggaaagggagaatgctttaaacacagggagaactgacagcctggctggaaactgggactttgggtctgaggctatgtcacgcagcaaataaaaaagtcagtccaggccaggagaggcaaagtgatgaccccagggattaggccgtggccaggaggaaaggccaagaagaaggtcgcctaaggaactctttgcactagccaccagtcaaggagggagctgaaatctgatgccaccaaaccaggaggccagacatatgggtggagagtctcacccactggg

SEQ ID NO: 40166 - DNA, 601 bp, Human
ggttaagtcatctctccaaggacacacagccagtaaatcccaagctaagaaaaaagcctgggtctcctgatttgcagcccagacttctgtctgcaccaccttaccctttccatcctggaggcctgtggcatctgcacaaagttttacttacctctcccaagtccaaaagaagggatgacccagcaggtcactcagacagtccctcacatgttccccaggatggaagagacgatgaatgaggtccttagtttcctcatctggagaaagttgaaccacctcttcattactttgagctttcagmtcctcaaatgagatgcttcccttctttaccacatagaggaccagccgtccaaggtcctgcacaaaagccataaatcaagccaaagatgcttactaattatttgggtaaccctggaaggagtggtgcacgctattagcaaacaagatgatgggaggaatctcaaggaatttgtaggcttgttagggagggaaggcacagatgtgtgcatacagacctcttcaaggcagtatatcgcccataccacttagttttatgaagagtaaaagatacatataagtcacagttgttagggcagactgc

SEQ ID NO: 40167 - DNA, 601 bp, Human
tctttcataaaatggaaatagtgcaatgccacaatcctctacctacaattccaaaatccagaagagccctgaactgcaaggcttttttgtgagtttgcaactaacatctttgtcagcaaaagctgatctaactaatgtgggctatttttagacgtatataactctaccttcactttatctagctgtccagtctcctgtgttacttcacagaagggagtcactagctcctgttcaatttgttttaccatttatccaacaaaaaaatgacaaggaagatgaaagcctgctggacatgtccctyattaattgtaaggcaacagtgatagcccttttacacacagagggaaggaattacttttctttcatcaaaataaattttcttttttccatcgtagatataaacttagaattggattttttaaattgttctcatttcacatataatttgtaggaatgaaaacaatacttactttttatgcttttcttcatcaatgtgttctcccaaattccggatgaactttagcagatcacccacagtgttctggtagaaattgcctcttttttcataaaacttattcatttttttcataacacattcatt

SEQ ID NO: 40168 - DNA, 601 bp, Human
ggggtcggcgctcaaggcagaaagcgcgaggcaggtgcccaggagagccgcgcagaaggggactgactggggggccctggtccccgacgccatttgaggggcagcggcgcccgccttacctgtggatgcagtttccatggcaacgggcgactgccgggcggggcccgagccggcttcccgcgacgccgcttcccgggccctggcgcccaaccccgggctgggctccccagcctgcggcgccggcgtggcccctttcggcgtcaccgcttcgttctccccctccccccggtgcctgagccamtgggacccggggccggccagcggcagcagctcgtcctgcggatcccccggcgcggccatggctggcggtcccccggcgcggcgacggcggcttggctgggcagaggctcggtggctgcgcgggcgctccctgctgctgtccccggagggactcggcgctcagggaagctgcggtgtctcagcgtcgccgccgcctctgctgcaactccgccgagccgctgcctgccgctcttcccgcttcagctcctccttctcccccctcctcttcctccggccccgccgcggccgctgcctgcgctcc

SEQ ID NO: 40169 - DNA, 601 bp, Human
ctggccttgagcatgtcatgtcacttctcagaacctcagtgttcccacctgtaaatagggacaaaaatgcctgctgtgcctttctgatattgctgagaggattaagtaattgttggattatgattactgttaatagtaaatacatatgaaaactcaacaaagcaataagtattggaataagaataatcgagtttgtttcagaaattcaccagaaatgttagatattcaaagacagggtgttaggggagactctaagaggtctgttgggtctcagagaaacatgactcaagtgcatctgtgrgctgaaatacaggtgagggtaaaagcccctggtcagtgggtgagggctcctcagctgaggcactcacttgaaagggtggccttcgtcggttttctgcactgcttgtaaaacagacttgtagatgcggaaactgatggtggctgagagtgcggccagggccaggtaggccacgacgctcaccacgctgaactgggtcagggagaagagcagcagcaggaaactcccaaacacgatgcccgtctgcttgatgtcccgccaatacaacaggtcaatagctgcaggagacaccaaacacaccca

SEQ ID NO: 40170 - DNA, 601 bp, Human
aggaatccaccaggtcctggacaaggaagagcctcctcagttccttaagtgtgctgttcacgtagaactgcaggcagtccgtgtacttctgaatctgctcctgagaaagggtgatctcaagctccaagtaggccctgtcaacaaaccattcccacagaaaattccgtcagagggaatcatgagacaggctgccgaaccccagtaacagctaagcgttcctactctcactctgagggtgagagcaggagtcatctctggggggttatgccagccagtgagggccacagggcaccgtacacayctgcttccatgcactgagaacacagaaagcatggttctcagtggagcattgtgactgtttctggctacctaagacacagcatgggtgggctgaaaattcagagaaaccagctgggaccagagaaaaaaaattagtgccaaatcagctcatttgctgaattctccacacatgacttcatggagataaattatctttttttaagtagttgagatagctcaaaatcctagctgccaactgttcctcatcagatctctaagaattcatgtttaaattctagaatttacttccaggtttatagaa

SEQ ID NO: 40171 - DNA, 601 bp, Human
ttttctaatatatgaaatgatattgaatcaaatttttagtgttcagaagtcttatgggcacacagtcaagcccttcctttttgtactgtctttttctgcttttgtgctacaatggcaaagttgaaaaggtgccacagatggtgtggcttgcaaagcctaaagtatctaccatctgtctctttacggacaaggtttgctgacccctgttctggcccacaatttttacattacaaatacaaccatggccttaaaagcactaaggtaagtaattataattgccctggtatctctcttcagtcaktatatggcaagtcattattccagtaaagcattttgagggtcaagaccacatttttcacttttccttctgcccttctttgaacagttaccagacagctcccagtacaagcccctgccagggtgtgtataaagtgctgtgagagcacagaaacttcacaactaccttgtctgggcttccccagctctgcttatgaccatgccgaatcacgattgactaactttgattccacgtgtaagtcaccaggaggccaaagcaacttattcaaaggaacccagcaaattcagtgagagccccaggtgc

SEQ ID NO: 40172 - DNA, 601 bp, Human
atggtgtgatgtatttagttggcaaacattttatgtattttaaagttctaaaaataattcaaagttttaaaagtaatttaaatgatttttaaaaaattagtgctattcattgtttaaaagattaaaaatgttaacttgtttttatttgaattaaactgttaattttacttttttgaatcaagtttccttctttcctccaatgcatcttgttcttgtacatgggccagtccttagagcttaatatcatgcattcattaaaacttattatgaaacctgaataaaccactgggtttaatttaaytgagagtttaaaaacttatgcttattttctaaaataacataattgagaagagaatgaatatatgattccagtaagtgaatgaccataaatcaatctatcattttactatcttctcattacccctatcctaatccactcaaatgctgatgtaagagagtctctccttttatgcattgcactatgtgacttactttgccacaacagcatttatgtgagtcctcacaagtcccagatattggtcaatctgtgcctacataaagaaaaaaaaaataatgagcatatccaaagatgatgaggtca

SEQ ID NO: 40173 - DNA, 601 bp, Human
ctcctcaggttcgggtaccaccaagtctcatactgtgctatgataccatttcttaatacaaaataaaatgattattttatgcttaatgtgttgattttcattaggtattggttacatctgggtccaagctgatacgttcaggcattttgaaatgtgttgtagatctctcaaagatccaaattcaacatagaaccctatgagttcctaatgactttaagaggacaaatgtaaataatacacagtaaaaaacaaaagtttataaacttcagagggaactgaagcacatcacatataatctaakagcagaggaactttaatgtgattggcctttcttattttgttattacacatctttaactacctaaaatgcctctctctaaatctgaccctcacctaggtccagccacattattatcagataattagatagagtttttgtgaaaaagtctagtcctttggtgaaatatatttatagttaaagattaggctagctttttaataaaacaaaatattgaataataatgcaatataagagctatcactttagatgactatatacctaaaaatagtaatgtaagaattagggaaaactcctaagttt

SEQ ID NO: 40174 - DNA, 601 bp, Human
tgttattatgcattattaacccctattttaagctggaaaactgagacaaacaaaggtgaaacgacctagacagggtcactcagtatggaggagagactggccctggtgtctactggcccaatctgggactgtcctctacctccaagccccatgaaccgatctctaagcagtaatcggatgatgatgatgatgatgacaatgatatataatattgagggtttcctacatccaagtaagaatactttacagacattacctcatttaatcaccaagaaccctgtgtggtattaacatttccaayttacagataaggaaataggctcatagagtcaaataacatttatgatgagctcatacagctaaaaatgccagaaatggactcagtctgtctgattctaacaatcatgttcttaactgtaccactaaagtggtgtaagttcttttgctggaattatttattctaaggtggaattacaatttcagaggttgaagaggacttagagttaagatcccaccaagaaatttccttcaaaatgtagtgccaggcaaaacaggttatttggaagaattgttgtttcctcctctctgatagatagtgaga

SEQ ID NO: 40175 - DNA, 601 bp, Human
tgtgtcacataccttgccccagacacatattggatggattaatgaacatctttagggtctattatttcaatcttctagaattctaccacctgtgctatcatctggatcatacatctccatttttttccacaaggacaccaagaagacttgctgactacccccactaaaatcagaatactcactggctagggaagtccatctcatctcagggtttagtgaagatacactgatctattctgagtatctacagttttactaattcattctggatttttgcttgaaattaggccttcagtttatyaaatataacatctagaatctttctttcttctcatttgaagatcgtgacagctcctttccaatttgagttttcaggatgtcctttattccatgagatttatcaaaggtcaccaagagagcttctaggtaaaattacaagctactttgtcattctaaaacataactcacctagacatagggaattgtattcacttaaagcagatttcttattatggtctcacttactcgaagctttaatttcctctacagtgtttattttgccttttgaaatttgaggcttttttcctcattttcaaaactc

SEQ ID NO: 40176 - DNA, 601 bp, Human
ctcatctatccctcgccgcattctatatctgtaaagttgactttttagaaacctaaatgtaggacttcactttccttattaatttcattttattgatttcaattcggcattctcgcttactcaagatcccttgattcattttgaatcttgagcttgccatcttctgaatttgcttttgcttcaaactgtacatcatctggaactttgacaaagatatttgatttgtcttcacatagtcatgagaagtaatggggttgaaagtaatgggatcaaaggcagagccctgtgtcacataccttgscccagacacatattggatggattaatgaacatctttagggtctattatttcaatcttctagaattctaccacctgtgctatcatctggatcatacatctccatttttttccacaaggacaccaagaagacttgctgactacccccactaaaatcagaatactcactggctagggaagtccatctcatctcagggtttagtgaagatacactgatctattctgagtatctacagttttactaattcattctggatttttgcttgaaattaggccttcagtttatcaaatataacatctaga

SEQ ID NO: 40177 - DNA, 601 bp, Human
aatgagagtagaagcaatgaacagagggagagaaacccacagcagtccaagtacctgaaggcaatgcctggattgtatggtagacatggaaatgaagagaggggaacagtctcagggttagtttagagatgaggctgcaggacccacttgatctgttgataaactgaatgcataggctaggattagaggaagagtaatcaaggaagattctttggtttttagcctgaggaaccaggtgaaaatgccatttaccaagattgtgataactgaaggaaatacaagttctggggtgagattgcaygatgtgtggctaagtgaatctgaaaggtctatcagacactttagagaaaccttacataaataagtggatagacctggtgcttagttgaagaggtctgggctggagacacaagtttgcagccctagacatgagataacctttagggtcacaggaccagaagggagttggacaagaggaagaggtgccagcagaggacatgtgcaatggtgaccatctaacttctatttgaatacttgaatgaatgtcagggtactcactccttcatggggcagatggttctattattgagcaactctaatc

SEQ ID NO: 40178 - DNA, 601 bp, Human
tcacagagaggacaagctggcggcaaggagatgagaagcccgtttgcttggggtgtggacaggggaggtctgaaaggcaggcagggaccagatggtgggtgttggagtttgtaggatgtggtgaggagtttagattctaccctgtgtgatgggaaaccattgatgaatttaggcaggggagtgacgtgatctgattaatgttgtaagaagatcatgatggtggctgtgtaaaaaaaaaattgggaaatgagagtagaagcaatgaacagagggagagaaacccacagcagtccaagtaccygaaggcaatgcctggattgtatggtagacatggaaatgaagagaggggaacagtctcagggttagtttagagatgaggctgcaggacccacttgatctgttgataaactgaatgcataggctaggattagaggaagagtaatcaaggaagattctttggtttttagcctgaggaaccaggtgaaaatgccatttaccaagattgtgataactgaaggaaatacaagttctggggtgagattgcacgatgtgtggctaagtgaatctgaaaggtctatcagacactttagagaaaccttac

SEQ ID NO: 40179 - DNA, 601 bp, Human
aactgctataaagaaaaacaaggtggtatggcaggcagtgaggggcacagtggtaaggtgtgtaccacctcttttaaatccactcatctgagaaactgatcctcagaggacaggaagggaccatcaggcaaagatctggatgtgaagtgtttcaggcagagggagtaatgagtgcagaggcatcacagagaggacaagctggcggcaaggagatgagaagcccgtttgcttggggtgtggacaggggaggtctgaaaggcaggcagggaccagatggtgggtgttggagtttgtaggatgyggtgaggagtttagattctaccctgtgtgatgggaaaccattgatgaatttaggcaggggagtgacgtgatctgattaatgttgtaagaagatcatgatggtggctgtgtaaaaaaaaaattgggaaatgagagtagaagcaatgaacagagggagagaaacccacagcagtccaagtacctgaaggcaatgcctggattgtatggtagacatggaaatgaagagaggggaacagtctcagggttagtttagagatgaggctgcaggacccacttgatctgttgataaactgaatgcata

SEQ ID NO: 40180 - DNA, 601 bp, Human
ggtgataactgctataaagaaaaacaaggtggtatggcaggcagtgaggggcacagtggtaaggtgtgtaccacctcttttaaatccactcatctgagaaactgatcctcagaggacaggaagggaccatcaggcaaagatctggatgtgaagtgtttcaggcagagggagtaatgagtgcagaggcatcacagagaggacaagctggcggcaaggagatgagaagcccgtttgcttggggtgtggacaggggaggtctgaaaggcaggcagggaccagatggtgggtgttggagtttgtrggatgtggtgaggagtttagattctaccctgtgtgatgggaaaccattgatgaatttaggcaggggagtgacgtgatctgattaatgttgtaagaagatcatgatggtggctgtgtaaaaaaaaaattgggaaatgagagtagaagcaatgaacagagggagagaaacccacagcagtccaagtacctgaaggcaatgcctggattgtatggtagacatggaaatgaagagaggggaacagtctcagggttagtttagagatgaggctgcaggacccacttgatctgttgataaactgaa

SEQ ID NO: 40181 - DNA, 601 bp, Human
tcattcctgtaggaattgaggagacagaaataaactagaagacaagagaagtttagatggtgataactgctataaagaaaaacaaggtggtatggcaggcagtgaggggcacagtggtaaggtgtgtaccacctcttttaaatccactcatctgagaaactgatcctcagaggacaggaagggaccatcaggcaaagatctggatgtgaagtgtttcaggcagagggagtaatgagtgcagaggcatcacagagaggacaagctggcggcaaggagatgagaagcccgtttgcttggggtrtggacaggggaggtctgaaaggcaggcagggaccagatggtgggtgttggagtttgtaggatgtggtgaggagtttagattctaccctgtgtgatgggaaaccattgatgaatttaggcaggggagtgacgtgatctgattaatgttgtaagaagatcatgatggtggctgtgtaaaaaaaaaattgggaaatgagagtagaagcaatgaacagagggagagaaacccacagcagtccaagtacctgaaggcaatgcctggattgtatggtagacatggaaatgaagagaggggaacagt

SEQ ID NO: 40182 - DNA, 601 bp, Human
agagagaaagtgctattactgactatgccaggaagatgagcataagtagggatggttatataactagggatataatctgttcctatgttggacataggaaaaggaacctatgttcaccctcagagtagtctaattacccacaactggaatttaaaaagctgggtcctagtctcagctattctattaattagctgtgtggcatccggcaagctaagggacttttctggtcctaaatactcattaaaatgtgggcatagactagatatctccagggtcctgaaattctgtgatgctcacaatrtagcagcatgattttcggacaggtttacactggaagtgttttgttaatttgaagatttatgagcttatcgtgcagattttgattgagacctccctctgtgccatgaggtacccttccatgtactggaattcagtggtcaacaaaagggaggagatgcttgctctcatggagttttcattcctgtaggaattgaggagacagaaataaactagaagacaagagaagtttagatggtgataactgctataaagaaaaacaaggtggtatggcaggcagtgaggggcacagtggtaaggtgtg

SEQ ID NO: 40183 - DNA, 601 bp, Human
gaaaggatcaggaaaaataactaaaaggtactagtcttactacctgtaagatgaaacagtccatacaacaaaccccaagacataagtttacctgtgtaacaaacctccacatttacccttgaaattaaaagttaaaaaataaaacttaattttaaaaagataaaaaattttaataattatatgcattaaaaattttaggtagtcataattctagtgtgaaaaagcaacaacaatttactaatgacctatatgcttttttaatgtattttatgagttttcatctaccaaatttaatattaatttattcatttttttgagtaatatgggaagtagttcacttatatctacttatctataagtcattttaacagagtttgatgtcctttgattgacaaaaatgcaagtctataaaataagctacttggaagaagtcaattaatgctgcaaaggtagcatgtataacttcttggaaattacaaattatcaagaactacttccaagaaaaatttcaagtgacaatttttgacacaaattcagagtattctcagtattgctaattttggatattttgtcaatgtagaaataaggaacctgttggtac

SEQ ID NO: 40184 - DNA, 601 bp, Human
attatctttttagtttataatcaatagacatttgagtgccaacaatttctggacactattaataattctgtcataaacattcttgtatatagcaataggcttacaaatttatacatatattttcctatataattgagagtggaattgttgaaataaaagtgtgtgcataattatgatttacttttttactttaaaatattctaaagtgtatttaatattcaaaatttaaagattttttagttatcatttttataatttctcacattcactatggctggatcttatactctttatgatattraatcttttcatacatactgaatcttgatttatgaccctccccatgtaacttcaaataactattacctactcaacatgctctagaaaactatgccttccagttgatatatagaatacatatgtatgagttatatatgtgtgtgtgtgttatgttacattacaacattacaattgttaattgtgttcttcaattgttttatgtccttactcattatttggtcttatttttcaggtcagtttagatttaatggaagtatctgtatattcacatttaaatctactaccttattttatatttctt

SEQ ID NO: 40185 - DNA, 601 bp, Human
gtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaarctaataaataattaaattgtatagaaagtctcttcctcttgatattttgagatgattagtgctgcttggcttttattgtgcatcgtgcttcaacgtcattttttttcctaaaaggtatgataaaaatgcttaccattttagagcttaagtcatttcccagtgaaaagtatgtggaattagaaatatagcaactcctacctggtttctactacaaaatgaactaattttacaatgcgtttggttttttgagccaattctatttttctgttcatttgaaaatattcatctttttttattctt

SEQ ID NO: 40186 - DNA, 601 bp, Human
gatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccataygaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaagctaataaataattaaattgtatagaaagtctcttcctcttgatattttgagatgattagtgctgcttggcttttatt

SEQ ID NO: 40187 - DNA, 601 bp, Human
atcaggggagtatcacaatctgacttttatttcaaaaataatcattctggctactgcgtgggaaacagtaggacacaaagagtagaatagaagcagagcatgtggctatgaggcatttcacccacatgacacaattcctctttagaaacttaaagatgataattctcaaattgtattttaaggtgtatatcttttaccacttaaaacggctcatgatgctgaccatgattttatacgcctgctggagaactaaaggagtgtaactggatatttcataacacaaagataaatgcttaagcartgggtagcctttcttcatgatgtgattatttcacactgcagcctgtatcaaaacatctcatgcacctcatagaaaaatacccctactatgtaaccacaaaaactaaaaattaaaagaaaataaaattgctcatatgttctctgcctcaaataattaactttctcacctgaccctccatttttactttaaaaatatttgtcaattatgaaattccaatttaaaagccaaactttctatgatgactcaaattaaaatacacacattctatgtcaattctatgacatttactttgaatgatct

SEQ ID NO: 40188 - DNA, 601 bp, Human
atcatgccactgcactccagactaggtgacagagtgagactccatctcaaaaaaaggaaaaaaaaaggagtatatattacataattaatttaattacataagcaagtaaagctgaagtatgacctttgaagtcaggttaatacttaattggaggacaaaagcagtgactaaaatggtccaggaaaagagagttcttctaagaagattctgataccctctatcatgatctgagagatagtggtatcttcacttcgaaataatgtttaagatgatcttaccttattgggctgtttcacttagygtatgtacacttatgttatgtgttttatgcttaaatgtgtattttagaagacgtacaatgtattttaagattataggaatcaaataagttcaaaataagcacaaaaagtagaggaaatcctaggggttctatcatagtgtggccaggaaaagcctctcttattggtaacatttagagggttgcctcaaaaagagatagaagcatgccttgagttgttgcaagaaagaatactccaagtgtgggtagaggggacgcaatgtgtaagatgctaggacaggagcttaaagaaaaatataaggc

SEQ ID NO: 40189 - DNA, 601 bp, Human
tgcacacacttttatttcaacaattccactctcaattatataggaaaatatatgtataaatttgtaagcctattgctatatacaagaatgtttatgacagaattattaatagtgtccagaaattgttggcactcaaatgtctattgattataaactaaaaagataatctgtggtattctcaatcaatgaaatactacacagcaacagaattaaaccaacaactgctacattaaaaaaaaaagacactttgggaggctgaggcaggtggatcacgatgtcaggagttcgagacaagcctgaygaacatggtgaaaaccttgtctctgctaaaaatactaaaattagccaagcatggtggtgcgcacctgtaatcccagctactcaggaggctgaggcaggaatattacttgaacctgggaggtggaggttgcagtgagccgagatcatgccactgcactccagactaggtgacagagtgagactccatctcaaaaaaaggaaaaaaaaaggagtatatattacataattaatttaattacataagcaagtaaagctgaagtatgacctttgaagtcaggttaatacttaattggaggacaaa

SEQ ID NO: 40190 - DNA, 601 bp, Human
tttaatgaataatcaattattgaaataattttctacacaaaaataattttaaagtgatatagataagaagacattttaaaataaatttgacgtaatcaatccacagtagaaaggaaagataaacttgacgtaatataataaaatattttaattcaatatctaaaatgtctcaaagtatatctgttttctcactgaaaaatttatttttattatcattattgtaacagacttgataattaaatttaatttccatagcataaaaccgacctatttaagtataaaatccaaatatatttagtakgcttacagtcatgaagccatcaccatcatataattttagaacatttgtatcaacgtaaaagaagccataatggtatagaagtcactttgcatgaccccttagccctaggctaacaccaatttgctttccttctctatagattattctctctacatatttcatataaactgaatcatataatttatgatgtgtaaatgacttcttttaccaagtacagtttttgttgtttttttatggtttttagctttatttatattgtgtgtattaatagttcatttatttttgcagcaatatatttta

SEQ ID NO: 40191 - DNA, 601 bp, Human
aaattttatttgaaccacatacatttaatgaataatcaattattgaaataattttctacacaaaaataattttaaagtgatatagataagaagacattttaaaataaatttgacgtaatcaatccacagtagaaaggaaagataaacttgacgtaatataataaaatattttaattcaatatctaaaatgtctcaaagtatatctgttttctcactgaaaaatttatttttattatcattattgtaacagacttgataattaaatttaatttccatagcataaaaccgacctatttaagtrtaaaatccaaatatatttagtatgcttacagtcatgaagccatcaccatcatataattttagaacatttgtatcaacgtaaaagaagccataatggtatagaagtcactttgcatgaccccttagccctaggctaacaccaatttgctttccttctctatagattattctctctacatatttcatataaactgaatcatataatttatgatgtgtaaatgacttcttttaccaagtacagtttttgttgtttttttatggtttttagctttatttatattgtgtgtattaatagttcatt

SEQ ID NO: 40192 - DNA, 601 bp, Human
ttgctttttcacactagaattatgactacctaaaatttttaatgcatataattattaaaattttttatctttttaaaattaagttttattttttaacttttaatttcaagggtaaatgtggaggtttgttacacaggtaaacttatgtcttggggtttgttgtatggactgtttcatcttacaggtagtaagactagtaccttttagttatttttcctgatcctttctctcctcccaacccccaccctccaataagccccagtgtatgttattcctctctatatgttcatgtgttctcatsttttagcttccacttataagtgagggcatgtggtatttggatttctgttcctgtgtttgtttgctagggataatggactgcagctcacttatgttcctgaaaaatacatgatcttgttcttttttatggctacataatatttcatggtgaacatgtaccacattttctttattgaatccatcattgatgggcatttagattgatttcatgtctttgctatggtgaatagttttatatagagtaaaatgtatatttgtctgtagtaaacatacatgtgcatgttctaatttgcagtccttt

SEQ ID NO: 40193 - DNA, 601 bp, Human
aacccaattgtagaaacttcctgcctatatattcagctgttgggaaagcactaattatctcagatattaattcaaaatcaaaaatatgtatggaagatgataaactcatacagaaggtgtttttcattggtaattaatttggcattaatattgtgatcaggaataaatacaattaagagttgcaggtaaagttttggtattatcatgatactggggtcaggtaagagctatcaccaaattctgcccctgtgatttgatccttttgtttaagaactcctgagggcgatgtacatcctacagrtgttagaaaacgttacattttaatgagtaacttcactagcacaataacaatagcaggtatttcaaaaaggctgacatgcatcatgcagtttagtgttgccatgttacccagcctcgtgtacttcctgtacattttggaataggcctattcaagtgatattcagggtactattcagagaaaggaaggcctaggctgtcagacaactagtgtaaggatccgcagagctaggcagatttggagaaagagaaaaagcagcctgctttgctggactggacccagccaatgtctgaagtaggcaga

SEQ ID NO: 40194 - DNA, 601 bp, Human
tgttaaagtttgtaaagaacccaattgtagaaacttcctgcctatatattcagctgttgggaaagcactaattatctcagatattaattcaaaatcaaaaatatgtatggaagatgataaactcatacagaaggtgtttttcattggtaattaatttggcattaatattgtgatcaggaataaatacaattaagagttgcaggtaaagttttggtattatcatgatactggggtcaggtaagagctatcaccaaattctgcccctgtgatttgatccttttgtttaagaactcctgagggygatgtacatcctacaggtgttagaaaacgttacattttaatgagtaacttcactagcacaataacaatagcaggtatttcaaaaaggctgacatgcatcatgcagtttagtgttgccatgttacccagcctcgtgtacttcctgtacattttggaataggcctattcaagtgatattcagggtactattcagagaaaggaaggcctaggctgtcagacaactagtgtaaggatccgcagagctaggcagatttggagaaagagaaaaagcagcctgctttgctggactggacccagccaa

SEQ ID NO: 40195 - DNA, 601 bp, Human
aaaattggcgtacattggggaacacaggtcagaatgattcccagtaaattccagccaagtacatcttcactaagatttttatgtagtgtgggtgatctactcaagagggtgaccaaatctctgcagaaagttctggcagtctctcgcattctggtgcaagtgctgctgcctctgagacacagcaaaatgatgatgagaattcctcacatgcagttataaatagcacatcaatttaacagtgtgatttcagggaaaaattgttccacttaaacaatcacctgaaaaatataatcattcgacyatgtaactacatactgtacgattctgtattacaaatgagaatacagaattatttatagaaatttatagaaattccaaaccacaacagcagactccataatgtcagtgattcttaaccaccaccttttacagctacttttttttctcttttgaaaaaagactggaaaactctgacaaactttaagtgaagtgtaaaggattatagaataagataaatgtaggtttacgtaatcccagctgtgagtaacttttcctcagtgctcagagtcagggaagtcaaccactaatgacttcaaactaa

SEQ ID NO: 40196 - DNA, 601 bp, Human
caagactcaaagtttagtttgcaaggaagatactgagtaagaatcagatgatgctgataggcaagataagagccagatactcctcaggagttgaaatatttattaagcacatttagggactactaaaaagagttaagaaaagaaaatatgggataagattatactttttaaaaaaagattccaagatgttcgatggattaaattgtggaagggccaaactagaaagagctgaccattgaggaaattttgtatgaattcaggtagcagatgatggaaaaatggactagaaagtggatagaawtacctatgcctacttttacagtaatatgactaacttcatattgtgttgtgtggaaaaaagttaatacaaataaaccacttaaaatgtctctggcatatagttagtgattcagaaatattattttgcaattatggttatttttgttattactaatactatgaattacttaacatgtgtaagtcacttgagatattattcctcatttaatagaaactaattattcagcatttcaagattatattctctaacaaagtcctatggtcttctatatgacagataccctgtagacttgtttaaaat

SEQ ID NO: 40197 - DNA, 601 bp, Human
acgaatggttctatattcattcaaagtgtttgacttacactggaagaaaggtggaagtgggaagagtaaagcagataccaattagaaactgacgtacatgttgatactatcacaagtttatgaatttcatcattattaccaataaagagggatactaaagagactttgaaaatagggttggtaaattaaagctttgattatgcaacatgtaagaaggtactggccattcattcaaagaatatttataaagagattagcacacaccacaggtacgtgtatgggacacagtttctatcccaayacaccttacattctattttgaaagatagaatatatgcaagtaataaaaactgtgtaaaaactgttatctccagagaaaaaccaatgctaaggaagcatccagtgtagataatagagagtatcctggagtcactgatattaataatttagatgagagctgaactatatgcaggaataggtaaaagaatgaagaagagaaaaaaacacaaaaagaaaagcaggtaaagtgttcaggacagttctcaagactcaaagtttagtttgcaaggaagatactgagtaagaatcagatgatgctgat

SEQ ID NO: 40198 - DNA, 601 bp, Human
ttgagttcgttggaggactccactgcaaacctgccaaacccctaccgaaggtaaactattactgtttgttttgtctgctttgaagtttcagtacgaatggttctatattcattcaaagtgtttgacttacactggaagaaaggtggaagtgggaagagtaaagcagataccaattagaaactgacgtacatgttgatactatcacaagtttatgaatttcatcattattaccaataaagagggatactaaagagactttgaaaatagggttggtaaattaaagctttgattatgcaacatrtaagaaggtactggccattcattcaaagaatatttataaagagattagcacacaccacaggtacgtgtatgggacacagtttctatcccaacacaccttacattctattttgaaagatagaatatatgcaagtaataaaaactgtgtaaaaactgttatctccagagaaaaaccaatgctaaggaagcatccagtgtagataatagagagtatcctggagtcactgatattaataatttagatgagagctgaactatatgcaggaataggtaaaagaatgaagaagagaaaaaaacacaa

SEQ ID NO: 40199 - DNA, 601 bp, Human
ctgaagggtcactagagggagatgtggttccagggattaatgaatttattcaatacagataaacaagatacgagtttgagcaactgatccctagttccctcaactcctcattgagaaatgttgattaaaacgatcatgaacttttaataatgccactcacctccttttttcgtcctctttcagctgctgaaaactttgtagctctagtggaggagctgtttgttgcagatgaactggaagtaaaattctaacagcctgtattgcttcggtatagaaatgaagagttgctatgctacccggkttctctttctcagttttcttactgctgccagataggaactcagaaatatagaccattctgcttccagacaataagttccatatttgaaaccctttgatggcacttactggatacctaattcatgacaaaagtgctttagtcctctagagttttctggtttaaaagtagcttttgtgggtgtgtatcaaataagtgcagcagcatattttgtgactcttaagtttttttaggttatcatgccccaggcattgaaactgggatgtgcattttactgttctcagaggaattttgtggtttatt

SEQ ID NO: 40200 - DNA, 601 bp, Human
aggaaatccacattcaggaagccttttctgccccttcaccgctctggtatcccctccaccagtcttgagtggatgctcctcctgtgtctctcagtgcccagtgcatacttctatcatggaacattgttctggtattatttgttatctgtctgtgtcctctactagaatagatttggtgtctttattttagatcatcagtttacaaactgactcaaattgtcagggtatacctcttagcatatatatagattctagcagtcacttcttgtgacaaaaatgcttcataacaaattatgccccraatcagtgacttacagtgaaagcatctgttctcatgtttgtaggtctgcaggtcagctgcagtttgtctgatgtatattgggcataaatgggtttaactctggcctgcaggttggcatcatatgtactcatcatgggtttattctggggcttaggccaaagaagtggcagctatctggagcatgttcctctcctggtagaaacttctgtagcttttagaaagtatcaggactatttaagggttttccatagtgaaaatttatatgtcttacacacattcttatgtagaacacatcccttt

SEQ ID NO: 40201 - DNA, 601 bp, Human
agtttgtctgatgtatattgggcataaatgggtttaactctggcctgcaggttggcatcatatgtactcatcatgggtttattctggggcttaggccaaagaagtggcagctatctggagcatgttcctctcctggtagaaacttctgtagcttttagaaagtatcaggactatttaagggttttccatagtgaaaatttatatgtcttacacacattcttatgtagaacacatccctttttcacacctttcctaaatactgatacaggttcatgaatacaataagcaagggacattcttmcagtcttttcttacgacttattttctcaaacactctttggaactttgtttccaggcagctgttgtgctgtgtatggacgtgggctttaccatgagtaactccattcctggtatagaatccccatttgaacaagcaaagaaggtgataaccatgtttgtacagcgacaggtaagtttcagattgacactgagcttgtaacccatgtttgaactgcttgttgcctctacctactaatgcaagataccagcctccttatagtgtccagcccctctgtttggggggattctggggagtttcctt

SEQ ID NO: 40202 - DNA, 601 bp, Human
ccccaaagctgtcaggttatcatcgaggggaagacaggcgggcataaaactatcactgtaaggtaataagtggccatgattggtgtcaggaattacaggaatcttaacagacagaaaacacctggagttagcaagctataatccttaaggtttcgagcatgcgcagtaaaagagcaagatggtgaactttaactggtataaaagctgcctctgggggcgctcgaccaataatgccgagttgccgctactgagcatgcgcatgactagtaaccacactacgcatgcggccccctcttaagcmgtagcagggctagtgcgcatgcgttgattaattcgggctgctcaagggaggaacaaaggagactggaagcccgggaaaagatggcgccggtggttggggggcggggcggtctaaaaactaaacaaagaagggcgcagggcacttgatttttcacgtggccctcttggttctcttccaagtgtactctgctttctccagtaaactctcactttgcttaaaataaatttttcctcctgctttaaaccttgcttatgtctgtcgtttcaattgtttacttcgagaagaccaagaaccgagatt

SEQ ID NO: 40203 - DNA, 601 bp, Human
gggaagacaggcgggcataaaactatcactgtaaggtaataagtggccatgattggtgtcaggaattacaggaatcttaacagacagaaaacacctggagttagcaagctataatccttaaggtttcgagcatgcgcagtaaaagagcaagatggtgaactttaactggtataaaagctgcctctgggggcgctcgaccaataatgccgagttgccgctactgagcatgcgcatgactagtaaccacactacgcatgcggccccctcttaagcagtagcagggctagtgcgcatgcgttgrttaattcgggctgctcaagggaggaacaaaggagactggaagcccgggaaaagatggcgccggtggttggggggcggggcggtctaaaaactaaacaaagaagggcgcagggcacttgatttttcacgtggccctcttggttctcttccaagtgtactctgctttctccagtaaactctcactttgcttaaaataaatttttcctcctgctttaaaccttgcttatgtctgtcgtttcaattgtttacttcgagaagaccaagaaccgagattactgcggagtcgccactccggagtttc

SEQ ID NO: 40204 - DNA, 601 bp, Human
gttagcaagctataatccttaaggtttcgagcatgcgcagtaaaagagcaagatggtgaactttaactggtataaaagctgcctctgggggcgctcgaccaataatgccgagttgccgctactgagcatgcgcatgactagtaaccacactacgcatgcggccccctcttaagcagtagcagggctagtgcgcatgcgttgattaattcgggctgctcaagggaggaacaaaggagactggaagcccgggaaaagatggcgccggtggttggggggcggggcggtctaaaaactaaacaaagaagggcgcagggcacttgatttttcacgtggccctcttggttctcttccaagtgtactctgctttctccagtaaactctcactttgcttaaaataaatttttcctcctgctttaaaccttgcttatgtctgtcgtttcaattgtttacttcgagaagaccaagaaccgagattactgcggagtcgccactccggagtttctctggataactgccgacttacaccccagtaacaagagtataggtgtttttttgtttgtttgtttttgttgtagagagaaagagtcagaatcaggaagtc

SEQ ID NO: 40205 - DNA, 601 bp, Human
cctatcataaacagtgctgaagtgtaaacttcctatctgtacataatttttctagggtatactgtatatgcctgcccctgaaattgctgggatataggctatcctgcacttttttttttaacctctggaaaatttaaaccttagacattccataaagacatactaaaatcttttcacattacccatttttggttctctcattgagaattagagtttgatttcgctggaaatcatcaagaacacttactaccctcctatttccacacctcaacttctgctgaaatgaagggtgagacttatrgtcaatgaaaaacatctgttcagaacctaagaattgtcattgtctgtaagtctcatgtttcatcccgcccaatactatatggccccagggacctgccatagggaggtctggttgtcctgctccctgaaggttaggtattttattgcttccagattgttctaatatggttttcagccatctgacatttttttctaggtgtttgctgagaacaaggatgagattgctttagtcctgtttggtacagatggcactgacaatcccctttctggtggggatcagtatcagaacatcacagtgcac

SEQ ID NO: 40206 - DNA, 601 bp, Human
cctccgggatttactttctctgtgttatatccctaacaaaaatttcttttcactacactaacccttcttgctgcatttgaaacatattttttcttgtcctatttttggtgaaagttgagtgatggtatagaatgttgaattattaatcttctgggaatactcgtttttcaaattgagagctatgccaagaagcctctaggttagagtggtaagcctttggcttcataaaatgcctgcctgggggtattaagaacttgttttgcatgtgtgagtagtcttctcttaagactacagagcgacatctcctttctgtacgactgtggaaaaagagttcagaataacccatcaaaccaatacttgttaagatggtacttcagagaaattaagtgcttttaagtgacacttcttactgagttgaggtttttctcagtacttcagaagcccagcacagcttctggtcctttttcataatctcaggatgcctttacatgttagaagcagactgcatttcagtgaatgtcattcgaaagagctactctttttttccatgagcaatacagaaaagtgcagaagaggaagcatagcctttgcttctatttgc

SEQ ID NO: 40207 - DNA, 601 bp, Human
ttggttggaattggacatacatgcattttgagcaaagaacctaagaagaatcggtggcatctagaatagtgtgtgtcctatggggttcaatttggtaaaagtggcaatagagtactttacatagcagtatggcttgggtggttcaaattctcaggggtaatactgcttgatattcttgaattatttccagcttatcagtctgtacacaaaatactggctgtttaagcacattgaagtagtgattgaacaactagaatttttttaagtagctacagtgtatatctccttaatattttttctmaacgaccatttttaatatttctgatgagctataattgacaaaaattatgttctgattttctaaatacagacagccttgaaaaatgataggtaaatttaggaaacagaattgcccacgggattgccctaggaatcagtgaggaatcctgtgaggtgaagtttcttggcgtaatgtgttcttgtcacaatatttacagatatgtgttcctaagttgtttctctttcaaattttggaataaatgccttaagctaaacatattacccatgatatcacaaagaaaaattaggctggacacggtgg

SEQ ID NO: 40208 - DNA, 601 bp, Human
tatgattccttcctttctcctgatggattatatgtagaatataattaataccctacaatttctaccagttcttgaattcaattctgtagcatagaacatgaattttggaatcaaacctgggttagaatcatggttccatcattggttaatcatttgatcctagtataatgactggctcatagtaggaagaatagcatgattaaagccacaagacctggaaagtagggggacttctcagagatactaagtagtccacttgggttggtgtattgagcatatacaggttagtacttgagggtarcatctaatggacagcctgcattttctcttttaatcatcagcgaccatcttataaagcaggcactctttgttatttccattttatagataagggaactgaggctgaaagacactcgttcacatattcaaagccacacagttctcaactagcaggacttggatctaggcctgtactgcttcagagtctgtgcctgcattctattctgaatttggactgagtaatgaagggctttggataataggctaagagtttatgcataaccttgaaaacaacgtggagccacttacagttttgaggaag

SEQ ID NO: 40209 - DNA, 601 bp, Human
gtgtgagccactgtgcctggcctaaaagtgtgtttctttttaataaaataaatgtcatcaacagactaacaggaacaaataaacactagatcacagaatctgtccctggatatgaaagttttattgtgtcttggggtaaagatgcatgtgcttttcctttgcatttgtccaaggccagaatccttggattttgatgctccttcttcccacaaaacatagaagatactgtgtattgaaagggtgtgatttttcatagaatataggctacagaacagggctggacttttttttttttttttttaagaagccgagagcctatgtttatataaatatcctatgtaattaaaaagaaaaatacagttaaatcccagaaataaaagaaatttaaatatagaaaaatatataacttatcaattgaatgtttccaaacagaagagttttagcttctgtcaggcattgcatatctccagcatacgtttttgagaacattttgttctgaaaatttcctgttggcatttttctctgtgggtctctaggtttctgaataatgtgttcttatgtttacaaatcatgctgtactttagtcaaccatggtttatct

SEQ ID NO: 40210 - DNA, 601 bp, Human
tgtgtaattcaaatctggccttatacaacactaatttctgtatatcataggatcactttgagataactcaagaaaaacagatttatctcctaatggcaaagggatactctctagtgtcagtttttgaggtagtcaaaaaatgataatatctaattggagcttctgagataagcaagggagtaaggaaacaatgtcatatgaggacttccagtaaaacaaaacaaaagaatgcctggagaagacttgtgtaggtaggcaggggtgtaggagggatggcagacataatagcactcttcatgcrtttggagaattatcttgtagaatagaaattaaactctgcttcgtatcagaggggtgaactggaaacagcaggtggtgctttttgttcaagatgaagaattattttgtcaacaaggattactgtccccactggattgttttcttgtaagatgatcagatccccatttctgtaagtttacaataaaagtctttatcaccactagtcagatgtacatgtggattgttaaactagatgaatactgttgttttttagctcaaatattctgattctttggataattccctctttaaaaagttttct

SEQ ID NO: 40211 - DNA, 601 bp, Human
agtttttgaggtagtcaaaaaatgataatatctaattggagcttctgagataagcaagggagtaaggaaacaatgtcatatgaggacttccagtaaaacaaaacaaaagaatgcctggagaagacttgtgtaggtaggcaggggtgtaggagggatggcagacataatagcactcttcatgcatttggagaattatcttgtagaatagaaattaaactctgcttcgtatcagaggggtgaactggaaacagcaggtggtgctttttgttcaagatgaagaattattttgtcaacaaggatwactgtccccactggattgttttcttgtaagatgatcagatccccatttctgtaagtttacaataaaagtctttatcaccactagtcagatgtacatgtggattgttaaactagatgaatactgttgttttttagctcaaatattctgattctttggataattccctctttaaaaagttttctctggtcattagcatataattttttgtattgagaatctatactttcatgtgctgatttgcactgtgtgtagaaaacaaggagggaaaagaaaggaaggaaatggagctttagttaagtt

SEQ ID NO: 40212 - DNA, 601 bp, Human
ggttcaagtgattctcctgtctcagcctcccgagtagctgggattacagatgcctgccacaacgcccggctaatttttgtattttttgtagagatgggggtttcacgatgttggctaggctggtcttgaactcctgacctcaggtgatccacccccccccctcctcggcctcccaaagtgttgggattacagttgtgagccaccgtgcccagccccttccttcttttaaacatcctaattggtcctgtcaaagacatataaataaaaacttcaaacaaattggaagtaatctcttcctcakattctcattgtgcttatctagccctttcttatgggacttaactattagaacatacatgtttcatatttgctacatatctcatttctgctaataaagaatgtattaggtaagtgaggtcaaggacttggctttgttttttcacagggctcaagacagtgcctggcaaagaacaggcactgagtaaagtagcctttgaattgaactgaaaaagtaatgattctgttatgaaatctgtacaggattctaatggccaggtcttggggtcataggttttttgtttgtttgtttgttttgttttta

SEQ ID NO: 40213 - DNA, 601 bp, Human
tcaaacaaattggaagtaatctcttcctcagattctcattgtgcttatctagccctttcttatgggacttaactattagaacatacatgtttcatatttgctacatatctcatttctgctaataaagaatgtattaggtaagtgaggtcaaggacttggctttgttttttcacagggctcaagacagtgcctggcaaagaacaggcactgagtaaagtagcctttgaattgaactgaaaaagtaatgattctgttatgaaatctgtacaggattctaatggccaggtcttggggtcatagkttttttgtttgtttgtttgttttgtttttacaacagcatggctgggaggtcataggtttttaactttgataaggttaaccgtgatagtgagagaagtacatagtgtttggggagtttctgcagagagagagagagagctgactaaggtaaatctggaatggagagggtatcaatttactaagcctagagaaaaggttagaagctggagagccagagattagtaaaggggcattctagctaggaggtaatggtatgagcaaaggccaagtatgagacctgcccccagtcagtgatcagctc

SEQ ID NO: 40214 - DNA, 601 bp, Human
tctcttcctcagattctcattgtgcttatctagccctttcttatgggacttaactattagaacatacatgtttcatatttgctacatatctcatttctgctaataaagaatgtattaggtaagtgaggtcaaggacttggctttgttttttcacagggctcaagacagtgcctggcaaagaacaggcactgagtaaagtagcctttgaattgaactgaaaaagtaatgattctgttatgaaatctgtacaggattctaatggccaggtcttggggtcataggttttttgtttgtttgttttttttgtttttacaacagcatggctgggaggtcataggtttttaactttgataaggttaaccgtgatagtgagagaagtacatagtgtttggggagtttctgcagagagagagagagagctgactaaggtaaatctggaatggagagggtatcaatttactaagcctagagaaaaggttagaagctggagagccagagattagtaaaggggcattctagctaggaggtaatggtatgagcaaaggccaagtatgagacctgcccccagtcagtgatcagctcagtgatgccagaatagagg

SEQ ID NO: 40215 - DNA, 601 bp, Human
tagtttcgtgaacacttaaaaggtgagggatgaggcccagcactttgagaggccaaggtaggtggatcacttgaggtcaggagttcgagaccagtctgggcaacatggcaaaaccccatctctactaaaaatacaaaaagttagctgggcatggtggcgcgtgcctataattccagctactcgggaggctgaggcacaaacattgcttgaacgggggacacagaagctgcagtgagccgagattgtgccactgcactccagcctgggggacagagtgagactctgtctcaaaaaaaaaaaagtgaaggatgagaatggtgcggtggcattatcaaagaccggggtttccagtgtggttgattaggcaatgatgttaatggaaatagggaatccaggaggagaatgagggggaaagatagtaagtttaggttttagtcttgtcgtggtgaatgtgaacagttcatactgaacagtttgagataactgaagatgccatgtcagatatccaccagctagcaggcagtctaagtctagatcttaggagagttttaaaaatgaatgtacaggcctggtgcggtggctcacgcctgtaatcccagca

SEQ ID NO: 40216 - DNA, 601 bp, Human
tgtttttgaagccatgaaggagaaagtatatagagacagtggaatggtgagatgctactgtcaaacaaaaaaatcgagaaccaaggagttggcaattagaaggtgatgggtgacttcagaggataatttcattaaggaagtgggggcagtagctggactagactgaagaataataatgcactaagcagtggaaacagcatgcctattattttaagaaattcagaggtaaagacaggaaagatactgatagcaatttgtggagagggaaggacaaacaaaagatttgtttaggagggctgayatgagtttatttttagggtaaagataaaaatttagagaaggaaggttgaagcagtaagacggatttagttaatgaggttaagtcccagaagagctacagtaaatgtaatcaaaagcaaatgtgtgcacttcgtccttcaagtcagggggcaccctaaaaaatgtaaaatagaaagaaagtgataacagtcttaaagtattgagttctgttgtgaaaactctcacatgttgaatatgtgttaatacatccatctttcttaccaggcagctgcagttgcactttcctccctgattcatgctt

SEQ ID NO: 40217 - DNA, 601 bp, Human
gctggctcatttttaaaattgtttgtagagatggaatctcactatgttgttgtggctggtcttaaactcctgggttcaaacaatcctcacatctcagcctcccaaactgttggaattatgggtgtaagccatcacgtccagcccagaatatttttaaaaacccagtttattgataatttattttgtcgacataaatcactcaggatctgaaacattaaatatcttctgttatctattttctgtgagttaacatttgtttacattttctccattggaaaaatggaacattaaagttatttcrtgtatttcccagtagatgtctatgtaggaatgcaatgccaggatgatctggcctcctgctaccttgtagtagtaggtgaaaatcactgaatgttcacatgtacaagtactgccccctacctgttgctgggagggccttgaattagcaagttcaagatggtgttggctgtgccattgcctgaaacctccatggtttcaccatgaaaagtccataaatgggtaaaaaagaaatatctgatgataaatatctgtatgctcttttattttgttgtagctgtacaaaagggatatttgaaaaggt

SEQ ID NO: 40218 - DNA, 601 bp, Human
tatatagagctctttatagaacgtggaacatctcagtgttgagattttgctgttggcattattttgcagcttttcaactagtcaaaatgataggataagtgggggttagtgatacgagccttaatcttcaagtacacacaatttaagttagtataactttcctattttctaacatgcaactttagaacaggattcacaagtttaggatttccccaagaatgtatcctttgatacatgagatttttattgaatgagaaattttttggaacttgaaaatactaccttaattaattaattaatatattaattaatttttatatcttggtcagccaggaggaagaatattttatttaattttagagataggttgtcactgtcacccacgccggagtacagtagtgtgattttagctcactgcagccttgaaatcctgagctcaagtggtcctcctgcctcagcctcctgtgtagctaggactaagggtacatgccaccatacccggctatttttcatagaggtggggtctcagtatgttactcctgggctcaagcaatcctcccgcttcagcctcccgaagcactgggattatagtcatgagtca

SEQ ID NO: 40219 - DNA, 601 bp, Human
tatagagctctttatagaacgtggaacatctcagtgttgagattttgctgttggcattattttgcagcttttcaactagtcaaaatgataggataagtgggggttagtgatacgagccttaatcttcaagtacacacaatttaagttagtataactttcctattttctaacatgcaactttagaacaggattcacaagtttaggatttccccaagaatgtatcctttgatacatgagatttttattgaatgagaaattttttggaacttgaaaatactaccttaattaattaattaatttattaattaatttttatatcttggtcagccaggaggaagaatattttatttaattttagagataggttgtcactgtcacccacgccggagtacagtagtgtgattttagctcactgcagccttgaaatcctgagctcaagtggtcctcctgcctcagcctcctgtgtagctaggactaagggtacatgccaccatacccggctatttttcatagaggtggggtctcagtatgttactcctgggctcaagcaatcctcccgcttcagcctcccgaagcactgggattatagtcatgagtcact

SEQ ID NO: 40220 - DNA, 601 bp, Human
agagctctttatagaacgtggaacatctcagtgttgagattttgctgttggcattattttgcagcttttcaactagtcaaaatgataggataagtgggggttagtgatacgagccttaatcttcaagtacacacaatttaagttagtataactttcctattttctaacatgcaactttagaacaggattcacaagtttaggatttccccaagaatgtatcctttgatacatgagatttttattgaatgagaaattttttggaacttgaaaatactaccttaattaattaattaatttattwattaatttttatatcttggtcagccaggaggaagaatattttatttaattttagagataggttgtcactgtcacccacgccggagtacagtagtgtgattttagctcactgcagccttgaaatcctgagctcaagtggtcctcctgcctcagcctcctgtgtagctaggactaagggtacatgccaccatacccggctatttttcatagaggtggggtctcagtatgttactcctgggctcaagcaatcctcccgcttcagcctcccgaagcactgggattatagtcatgagtcactgca

SEQ ID NO: 40221 - DNA, 601 bp, Human
ctctttatagaacgtggaacatctcagtgttgagattttgctgttggcattattttgcagcttttcaactagtcaaaatgataggataagtgggggttagtgatacgagccttaatcttcaagtacacacaatttaagttagtataactttcctattttctaacatgcaactttagaacaggattcacaagtttaggatttccccaagaatgtatcctttgatacatgagatttttattgaatgagaaattttttggaacttgaaaatactaccttaattaattaattaatttattaattwatttttatatcttggtcagccaggaggaagaatattttatttaattttagagataggttgtcactgtcacccacgccggagtacagtagtgtgattttagctcactgcagccttgaaatcctgagctcaagtggtcctcctgcctcagcctcctgtgtagctaggactaagggtacatgccaccatacccggctatttttcatagaggtggggtctcagtatgttactcctgggctcaagcaatcctcccgcttcagcctcccgaagcactgggattatagtcatgagtcactgcaccca

SEQ ID NO: 40222 - DNA, 601 bp, Human
taaactgtattgtataatgagttatgtgggaaacatgatgactttctacatggctttgggaaatgctcagtgttcggtgaactcaaactctcccttaataagcataaatacagagtgataaataataaataaacatgtaagttccatcttagactctttacgcagcatgacctatttcatggctgtgcctttctgtttgttgaatggagcagctgtgtgggcgaacattgtcccctttctcagatccttaggccatttcagtcctgctggttccacagccctttggttgacctcacccagrttttatctccctgctacttttcatttaccatgttcttggactttccgtttcaacagaccagcatcttcatgtaccaaaaccattcagttcttcacttgcacagcaaccaatgcaagttaaacccagaaagaagacagcacacattctttcagtgttaggcttgatctttgctttttttcatgccctttgccccaccttttttaaaacatgacctgattttcttttagaacccaagtataagatattacttgtttaaaatacatattatgaaaatgattatgtttatgagataaacttttc

SEQ ID NO: 40223 - DNA, 601 bp, Human
ctcatcagtgttataatgaaacaatattatttaagtacctacttttgtttcacttaaagtcacagtttccaacaacctattgatgatagttaagtaaggacatactgtacattgaggggaatataaagacttataagacttagtgtctgcccttgagaaaatatattcttaggagagagaacatgtgtacaaatagttacataaaatacgacaagagccatttcaaaggaataaacaaagtgatctgagatttctaaagaaggggagacttatctagagttgatcaaggaaggcttcatgraacacgtggcatttgacatgcggcctttattgcttattacacaggcaaaaactggagaaaagataatttaagatggtcattgttaattggttgcctttatagttttatattttttgtagaacagagcacctttatagttttaaaaatctccagctcaggctgggcacagtggcacatgcttgtaatcccagcactttgggaggccgagacgggaggatcacttgagcccaggagtctgagaccagcctgggcaacatagtgggaccctgtctctatttaaaaaaaagaaatcttcagctc

SEQ ID NO: 40224 - DNA, 601 bp, Human
catgacctaaaaaagcttgtgtttcctgccagcagcacatcttaaccaaagatgttccagctaagttaacccagaatattagacaggaaagaaatctgaaaacagatgatgcacttgcaaattgtgcaaggcttgttctgtaatgcaaataggatgtcttctttgaaatgtaaaggcactgagcctaagcatgaggaattttaatgtctaatgatgaagctatagagagaaatttcagttaatgaccaggtaggtataagatggtgtccttagataattctgatatcagaactgatgttarttgtagtttaagacaactctcctgagacaggagaaccgcttgaacccgggaggcagaggttggggtgagccgagatcgcgccattgcactccagcctggacaacgaaagcgaaactctgtcccaggaaaaaaaaaaaaaaaaaaaagacaactctcaaaacttcaccatctttgaatagagagaacatcataaaaaacaagtggagagaatctcttctacttcagccacgggttgcctggctctgactggcatcttcttccttttagagcatagtgtttccatagtcaaggcacagagag

SEQ ID NO: 40225 - DNA, 601 bp, Human
ttcagatgtttggaagataccagtcatttgtggccctacagagatttatggcaggatgcagctctactgtttattctcttgccccaactggataagtcttatcctgtagccatatagtcctgatatcacgaaaatcatgcaggggttaatgacaatgagtaggagaggagaggtacaacataaaaagtatgataataacccggaaaaccccaaataaaaacccatttgagaatctaggatagagtagtttatttaacctttacagataaatcatatgctagtaaatgtatagattttttawtcatttatctgtatttggctgtcagatatctttattcataatcacccagaataaacagaatgaatgaaacagaagcttcatcacaattctgttacagactgtctgcctccattgctgggatttcctctctcttataccattgattctcagtcttgcacatggcccagtttagggtcaacaaagagctatggaaagatccataaatgtccttaaaagaagataaattccttattcgctcagtcataaaagaagttaatgaatagtgaggtggtcttaactgagggaaaaaaagtccaagag

SEQ ID NO: 40226 - DNA, 601 bp, Human
accagtcatttgtggccctacagagatttatggcaggatgcagctctactgtttattctcttgccccaactggataagtcttatcctgtagccatatagtcctgatatcacgaaaatcatgcaggggttaatgacaatgagtaggagaggagaggtacaacataaaaagtatgataataacccggaaaaccccaaataaaaacccatttgagaatctaggatagagtagtttatttaacctttacagataaatcatatgctagtaaatgtatagattttttaatcatttatctgtatttgkctgtcagatatctttattcataatcacccagaataaacagaatgaatgaaacagaagcttcatcacaattctgttacagactgtctgcctccattgctgggatttcctctctcttataccattgattctcagtcttgcacatggcccagtttagggtcaacaaagagctatggaaagatccataaatgtccttaaaagaagataaattccttattcgctcagtcataaaagaagttaatgaatagtgaggtggtcttaactgagggaaaaaaagtccaagagagtggttgagtcaacaaa

SEQ ID NO: 40227 - DNA, 601 bp, Human
atgcactctcagcctgaagaatgccagaatgcctctaggggccagtcagttgtggtaccataactgattctctatttactgtttctggcccccaaaggaaaagtagaagtgccccactttccactgccctctctaaaacactcactcctacaggcaggcatgctaccagaaaatcaccttctcgtgttaggatagataggcattgctagatagatatgcattgctagaacccagctcttagaggcagctgccacatgccttgaaggaaaaggctccccactgctatcccttggagggacasgatggaaaaagagtgttcagataattttcaagggcactcacctcactacccttttaaaatctgagtgtcattcctagatcctcacagacttcacttcctggactttgctgtattactatgtatctgcctttcagaagctccagatctagaacagtgatgctgaatggttttctcatccatttctcatctgcctgttttcaaacaatttctaacacaaattgaaagatttccataaaaggaatcaaacaaccttccaagctcactcatttttgcatttcacgtttcttatgagaagtcccc

SEQ ID NO: 40228 - DNA, 601 bp, Human
ttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcgrtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtgaattgctgctaattattgtctgcaaaagacttcttcagtgctctgctgagaa

SEQ ID NO: 40229 - DNA, 601 bp, Human
aggaaagaaagaagtctgtgtagagaaaaaacatccaagaaagatgccgcgccaagcggttctgtctccctctgtgccgccgcaacttccatggctattgcttcaggcgggttaagtctggtggaaagagactgcctagcgttcctgcggcaggaaaacaaaacatcgtggcgcaaagtctccctgcactcgccggcccccagcaggagacccgggctggcggccactgcgtcctgggtgcactcggtggcaaagcgctgctaccgggcacgggtctctgcagctcaaaacctgcccggcyggagcgcaccaatagttgccccaccactttaatgaatgccgtgtggcccggcatgggaaggctgggaaagcccgaaaaccccagtcatctctggcaacgaagtttccccgagttggctggctcccttaccccctccccacgctccagcccggggtagctgtgagaccggaggagacgatgcctgccgcgtggggagtctcagggtggctggcaatgaacagctcagccagagaagagtcgaacacggattccggggcgagtcaggagaatttcctgggacagcgaatggcagggagtgat

SEQ ID NO: 40230 - DNA, 601 bp, Human
aaaacgtgtctgaaatcaaacacaactcctcctcaactgcgtatttggagtggactgcatggagtggggatggagggagacctccctcccaagaaaacttagccctttgggctactgcaatccccctccatccccttcggttctaccctttggttatttacaagctggacttcacttacccaaggaaagaaagaagtctgtgtagagaaaaaacatccaagaaagatgccgcgccaagcggttctgtctccctctgtgccgccgcaacttccatggctattgcttcaggcgggttaagtcyggtggaaagagactgcctagcgttcctgcggcaggaaaacaaaacatcgtggcgcaaagtctccctgcactcgccggcccccagcaggagacccgggctggcggccactgcgtcctgggtgcactcggtggcaaagcgctgctaccgggcacgggtctctgcagctcaaaacctgcccggctggagcgcaccaatagttgccccaccactttaatgaatgccgtgtggcccggcatgggaaggctgggaaagcccgaaaaccccagtcatctctggcaacgaagtttccccgagttggct

SEQ ID NO: 40231 - DNA, 601 bp, Human
ctagatgaaattgatgatttttttttcacttccttaaacatagctcatccacatttatttttacaaggaaggctattgcttgtatatacactcctgcataatccatgagcttatattccctctgggcagttctcagctccccatagtcaccaaagtcctcagctttgtatctgggcatgtgcaggacaacgtttgcagagacaatggctctcacctgggagtcaggaagctgaacctgcaggtcactgcagaccaaattctatgctaatctcatctgagtttcctatgtgccacttcctarcacagcctttatcattggattagagaggtttaattcaattcagaagttcaagatttaatgagaaattcactttagtcttgcataatttgtgtgacgataagggaaataagcatcctgagaaggaaagggttggctttcttttcatagcagaaaaaaacctatggtatttatattacataggactagggatttgaaatgagcctcttcacagcagtagtgacactgagtcatcttcatttgcttctcccgcaacatcttttatcgattgcgaaaagcacagccaacagattatttttcccg

SEQ ID NO: 40232 - DNA, 601 bp, Human
atcaaagtgttcacttcttgtagtagaaactgatcacttgtctgaacatctagaactatcctattagaaaaagagaaggatggcctcttccttctatccgtacctttctaccacacttttgggaaactggtgcacatatgaaactaaatctcatttcatttgcaatttccctggccctagatgaaattgatgatttttttttcacttccttaaacatagctcatccacatttatttttacaaggaaggctattgcttgtatatacactcctgcataatccatgagcttatattccctctgrgcagttctcagctccccatagtcaccaaagtcctcagctttgtatctgggcatgtgcaggacaacgtttgcagagacaatggctctcacctgggagtcaggaagctgaacctgcaggtcactgcagaccaaattctatgctaatctcatctgagtttcctatgtgccacttcctaacacagcctttatcattggattagagaggtttaattcaattcagaagttcaagatttaatgagaaattcactttagtcttgcataatttgtgtgacgataagggaaataagcatcctgagaagga

SEQ ID NO: 40233 - DNA, 601 bp, Human
tctgtgccaagcccccttcggtttggtgcagctgcttttggtttttcctttcagacaactctctcctgcatcattagagctgtaggatacgatctgagttcccgcaccagtaagtggtttttgaggttcatttcgtttctgtgctacgccagagaaatctgtagctttctcctgtgggctatctgggagtaaatatttacctttgcaagtcactattacccagcaaagatggtcactagggtgcgctagtgaacaaggaacaatgaagcaggcagtcaacacccttctaagtatccctttwtgagctgcttatctggattcggagttctgtgtgtgctcccagacagagttgcgaaatattgtaaggctgtcctaaagtgagtcagctgcaaaataaatcagcaatcaatcctgcaggatcaatgatctgattacatttctagtagagttcatactatgtcgaatcacagcaaccatcaactcttgttaatgtatcgttttccaatgattgggcaaccttccctatcactcgcagactgttaccaaaagatagagataaacttccagtcttttcaggcatgcattctccagattggtctgt

SEQ ID NO: 40234 - DNA, 601 bp, Human
tgtttaacactcagctgttaggtttgctgtgtacaaggtggaccggggttagagggcaaggggggtacccatcccttacccaaaaaagcctaacttaaggctttacttccctcgattcttgaccactaaccttaataccagaaataaaaaacgccagtggccaacttgacctactaatgcttgacctgagcgttaaggatgaataactctgaactacaggacaacagatcaggcctggttgtcattgttttttcttaaacttctctaaatttattttaataaaaatcaaatataatcataycaccccctatggtttggaattcttggaaccatttccatcttaagcacccatacatttactaagagacaagtggatgtgtgaaagtaaaattagctttaatggcattactgggattttgatgcaagcaatagtgatttaatgctaactgaggaatggtgtttacatagtgctactccaaagggtcagttaggctgagtaattagagtcaccataaactagaactaaaagggacctttgaggccaatccctttattttataaataaggattacagtaaaaatccatcaaaccaaattggcca

SEQ ID NO: 40235 - DNA, 601 bp, Human
gggatgggtggccaccctatctgggccatgctatggtcatgtgctgtggggctttccctggtttaagaagatgctccagggcacctggtaacccacttcccccagtcagggtgcaggaagacggcctattctgccaaagcccacagaacaggcctccttagagtggagttttgcctgaggatcagcaccaaatttcttggctcttaatgaacagggcagacagtataagtcccatgcttccctctgcaaatgaggaactcaaatttgtgcatccaggaaagtcaatattcatgttgttccsttctcttttgttatagctgattttcagcaggtcagttagctgtctggggaaccggtctggaaattgcattgcttactttcctggcttacttatataaaccaggaaaattagcatatgggcccaggaaactgatgtgggaaatctctccattcagcaactttctcctggggccttttatacagaatgaagcaaacagaggctggccctctatttctttggtttttcttatctcccttcctttcttttagctcttttttttctccttccttggccttcctcctttcttttcctctcttccta

SEQ ID NO: 40236 - DNA, 601 bp, Human
cttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttctatgcgcccgaagcggccgctgggccagaggagcgcggtcgtacccggccgtccttcgcccccgagtctagcctrgctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggtaaacggtgcccatgctccccgggccggtttgggccgggatgggaggtggggttcaagggagagtgtaaggggaggtgaaccgcctgggggcgggcaata

SEQ ID NO: 40237 - DNA, 601 bp, Human
ccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacrctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggtaaacggtgcccatgctccccgggccggtttgggccgggatgggaggtggggttcaagggagagtgtaaggggaggtgaaccgcctgggggcgggcaatagacagagtacgggctgggttgacgtgggttggggctgtgttgc

SEQ ID NO: 40238 - DNA, 601 bp, Human
ccttgggaggagaccgccccagcctgcaaggaagtgctcattatggagagtggagagtgacaggccactcccggccacgtctccaagcaagccggtgccccctcctcctgctgccaccgcccactgagctgcctgggctgcagacgccctggtcggagcgtctggggccagatgttatagggcaagctaaaaataaccgggcaggccagccaccatcgaggaaggggcatgtgctggacgcggacacatgatccgagggaccctgctgggtggaactaagaaagtccagcagactgtgcaygctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgtaagtgcctgggatggggaggctggggcatcctctgtgggtgggagtcagccttgaggagaggcgatcccta

SEQ ID NO: 40239 - DNA, 601 bp, Human
ctgagggaggaggacaggtgaacagagctgtcccgggggaggggaagaaaggagctgggcttaaagctgggccacctgggcgggtctcgggcgcctccactgcgcacctgtgaactgggacgggcgctccttgagcaggcgtggcgctgctgtgcagctgctgtgtgtcccactgcccctggggacttgcgttgtaggagatgcccttccagagaaaatgccacttcctatgaaaatgggatgggggcagggaccctagatgcctccagggagccacagtccagcagacacccattcccgrgaaaatgcccgctgataggatgcgggtgcagtgggatttctcatttaaaagatcacgattcgaggcttttctttaaaataccggaccatgttccctgggctgccaccagctggaacctcaggtgcccctggatgaggaggtgtcctctagcttcccactcaccccatcaacccaccaggcccgccacacttctcatgcctggccctggggtatttgaggtggagaccaggagcttagcaatccagatggggcgtgccccagagaggagcgggtgcgtggcttcagatccaccggccagct

SEQ ID NO: 40240 - DNA, 601 bp, Human
cactgcccctggggacttgcgttgtaggagatgcccttccagagaaaatgccacttcctatgaaaatgggatgggggcagggaccctagatgcctccagggagccacagtccagcagacacccattcccgggaaaatgcccgctgataggatgcgggtgcagtgggatttctcatttaaaagatcacgattcgaggcttttctttaaaataccggaccatgttccctgggctgccaccagctggaacctcaggtgcccctggatgaggaggtgtcctctagcttcccactcaccccatcamcccaccaggcccgccacacttctcatgcctggccctggggtatttgaggtggagaccaggagcttagcaatccagatggggcgtgccccagagaggagcgggtgcgtggcttcagatccaccggccagctgtcactttcttgagtctcctctcctgtgaaatgggtggatcacctgaggtcaggagttcaagaccagtctgggcaacatgctgaaaccccgtctctactaaaaatacaaaaattagccaggcgtggtggcaggagcctcaaatcccagctacttgggagactgaggcagg

SEQ ID NO: 40241 - DNA, 601 bp, Human
ggtggagcttgcagtgagccaaggttgtgccattgcactccagcctgggtgacaaagtgagactctgtctcaaaaaaaaaaagaaagaaaaagaaaagaaaagacaacgtgcagctcacggtggacctgccactccaaagtgctcagcactgcgcggggctgggagcagataatgagatgtgtgttgaatcacgatgccaacctctcggggagaaacaatgttcagggattcatcattggcaggacggagtttcagatcccttttgaagagaaggtttgggaagggaaggaggtgaccccrtcggggacagtaagtgcggagtagggtagacaagtagctatttcctggggaaaatgtgcccttgggtggggaaaatgtgcccctaagcgggtaggatttgcggcaaggaagtcttctccaccctcggctctgctcagggtgataacaacagctgtttggactgtaccttccacgagaggctgtgggttcccatgggccttaattagggaaggcggctcgagaaggtggcccagcccctcctcccaaggctgagaggagagtcagagatggcaaggatgacctcactttgttttctttggg

SEQ ID NO: 40242 - DNA, 601 bp, Human
gccaaggttgtgccattgcactccagcctgggtgacaaagtgagactctgtctcaaaaaaaaaaagaaagaaaaagaaaagaaaagacaacgtgcagctcacggtggacctgccactccaaagtgctcagcactgcgcggggctgggagcagataatgagatgtgtgttgaatcacgatgccaacctctcggggagaaacaatgttcagggattcatcattggcaggacggagtttcagatcccttttgaagagaaggtttgggaagggaaggaggtgaccccgtcggggacagtaagtgsggagtagggtagacaagtagctatttcctggggaaaatgtgcccttgggtggggaaaatgtgcccctaagcgggtaggatttgcggcaaggaagtcttctccaccctcggctctgctcagggtgataacaacagctgtttggactgtaccttccacgagaggctgtgggttcccatgggccttaattagggaaggcggctcgagaaggtggcccagcccctcctcccaaggctgagaggagagtcagagatggcaaggatgacctcactttgttttctttggggtgaggtcacagcgatg

SEQ ID NO: 40243 - DNA, 601 bp, Human
gcgcggggctgggagcagataatgagatgtgtgttgaatcacgatgccaacctctcggggagaaacaatgttcagggattcatcattggcaggacggagtttcagatcccttttgaagagaaggtttgggaagggaaggaggtgaccccgtcggggacagtaagtgcggagtagggtagacaagtagctatttcctggggaaaatgtgcccttgggtggggaaaatgtgcccctaagcgggtaggatttgcggcaaggaagtcttctccaccctcggctctgctcagggtgataacaacarctgtttggactgtaccttccacgagaggctgtgggttcccatgggccttaattagggaaggcggctcgagaaggtggcccagcccctcctcccaaggctgagaggagagtcagagatggcaaggatgacctcactttgttttctttggggtgaggtcacagcgatgacaggggactcagcacacttaatcatgctcataattacagtcttataatgctcatcaagacagacagggactatttcagtactgcctctgggcaggaactggccgctgctccaggccaggcagcctcctactca

SEQ ID NO: 40244 - DNA, 601 bp, Human
agtgcggagtagggtagacaagtagctatttcctggggaaaatgtgcccttgggtggggaaaatgtgcccctaagcgggtaggatttgcggcaaggaagtcttctccaccctcggctctgctcagggtgataacaacagctgtttggactgtaccttccacgagaggctgtgggttcccatgggccttaattagggaaggcggctcgagaaggtggcccagcccctcctcccaaggctgagaggagagtcagagatggcaaggatgacctcactttgttttctttggggtgaggtcacagygatgacaggggactcagcacacttaatcatgctcataattacagtcttataatgctcatcaagacagacagggactatttcagtactgcctctgggcaggaactggccgctgctccaggccaggcagcctcctactcagccttcataagaaaacctaaatgttgcccctcatggtggacaagcacataaaggcactcccctctgggtggacttatcaaaaatggtgccccttcctctggaatgtgacctgacatagggattctagccttgcctcctgcctatagcaggtgcttttgagca

SEQ ID NO: 40245 - DNA, 601 bp, Human
cccaaggtcacacagcaggcagacctgcagtttccatccagttgtctgactgtagagaagtgttcattgccttaggccgtgagtgtgggaatgtggagcccctgccctggcacctgtacccacgtgtggggtccttcattgccaggaatatcctcccccagacatcccatggctcacttccttgcctcctttagacctatttccaaaggccacttttcaggaaagatttccctctctcaatgacagcccctccttggccatttttaaaccctccatccctgtttaatttttctctgtagcrtaatctggaagactgtgttttacttgtttgttcattgactgttctctccccacttgaaggtcagccccacagggcagggagtttgtctttcattcactgctgtaaccccagcatctaaaacggtctctgggcatataatactcaataaatattcactcattcattcattcactagccagcaggaagagcaatcatactactagtgagtaataacaacaatgctgtctaacaccagatttcacaatcttggcatattgacatttgggattggttgattctacttgctgggcaggggggcgc

SEQ ID NO: 40246 - DNA, 601 bp, Human
cctgctgctcagaagcctttgatcaaggcaaaagagaatacaaacagcacatattactacgtttcccacctgaaaatgtttcctaacacgtggtctgatgtggtggtggaaaggagggaagaaccgaaaggttgcgtatagaggctgaagaaccatcgcgtcattcctgttttggaggtcacagactgctggctcctttctctgctgttccaacttccatgtcattataatcagtataatcagcgagtgctcctttacagaaaaagctaaccagcatttttaccagtacccatcaatatamtttaaaagatgctaattatttttctattctctttataaagataaatattagtaatttttatttttgtcttattttggagtcaaacgaatgcagaggtcacaagcaaatgtgatcccagaacagttttgatctccaacatgcttaaagttttctgcccaggcacggtggctcacacctgtaatcccagcactttgggaggccaaagcaggaggatcacgcgaggccaggagtttgggaccagcctgggcaacatagggagaccgcctatctctgtagaataatcatcatcatcatcattag

SEQ ID NO: 40247 - DNA, 601 bp, Human
gtctgatgtggtggtggaaaggagggaagaaccgaaaggttgcgtatagaggctgaagaaccatcgcgtcattcctgttttggaggtcacagactgctggctcctttctctgctgttccaacttccatgtcattataatcagtataatcagcgagtgctcctttacagaaaaagctaaccagcatttttaccagtacccatcaatatactttaaaagatgctaattatttttctattctctttataaagataaatattagtaatttttatttttgtcttattttggagtcaaacgaatgcagaggtcacaagcaaatgtgatcccagaacagttttgatctccaacatgcttaaagttttctgcccaggcacggtggctcacacctgtaatcccagcactttgggaggccaaagcaggaggatcacgcgaggccaggagtttgggaccagcctgggcaacatagggagaccgcctatctctgtagaataatcatcatcatcatcattagtaaaaaagttttaaaattacttgtcaacacttaaaaaccagaagatttctatttttaaaaatacagacttggccgggtgtggtggctcatgc

SEQ ID NO: 40248 - DNA, 601 bp, Human
ggtcacagactgctggctcctttctctgctgttccaacttccatgtcattataatcagtataatcagcgagtgctcctttacagaaaaagctaaccagcatttttaccagtacccatcaatatactttaaaagatgctaattatttttctattctctttataaagataaatattagtaatttttatttttgtcttattttggagtcaaacgaatgcagaggtcacaagcaaatgtgatcccagaacagttttgatctccaacatgcttaaagttttctgcccaggcacggtggctcacacstgtaatcccagcactttgggaggccaaagcaggaggatcacgcgaggccaggagtttgggaccagcctgggcaacatagggagaccgcctatctctgtagaataatcatcatcatcatcattagtaaaaaagttttaaaattacttgtcaacacttaaaaaccagaagatttctatttttaaaaatacagacttggccgggtgtggtggctcatgcctgtgataccagcactttgggagggcaaggcgggtagatcacctgaggtcaggagttctagaccaccctggccaacatggcaaa

SEQ ID NO: 40249 - DNA, 601 bp, Human
gcatttttaccagtacccatcaatatactttaaaagatgctaattatttttctattctctttataaagataaatattagtaatttttatttttgtcttattttggagtcaaacgaatgcagaggtcacaagcaaatgtgatcccagaacagttttgatctccaacatgcttaaagttttctgcccaggcacggtggctcacacctgtaatcccagcactttgggaggccaaagcaggaggatcacgcgaggccaggagtttgggaccagcctgggcaacatagggagaccgcctatctctrtagaataatcatcatcatcatcattagtaaaaaagttttaaaattacttgtcaacacttaaaaaccagaagatttctatttttaaaaatacagacttggccgggtgtggtggctcatgcctgtgataccagcactttgggagggcaaggcgggtagatcacctgaggtcaggagttctagaccaccctggccaacatggcaaaaacccgtctctactaaaaatacaaaaattagccaggcatggtgatgcgtgcctgtaatcccagctacttgggagactgaggcaggagactagcttga

SEQ ID NO: 40250 - DNA, 601 bp, Human
catttttaccagtacccatcaatatactttaaaagatgctaattatttttctattctctttataaagataaatattagtaatttttatttttgtcttattttggagtcaaacgaatgcagaggtcacaagcaaatgtgatcccagaacagttttgatctccaacatgcttaaagttttctgcccaggcacggtggctcacacctgtaatcccagcactttgggaggccaaagcaggaggatcacgcgaggccaggagtttgggaccagcctgggcaacatagggagaccgcctatctctgyagaataatcatcatcatcatcattagtaaaaaagttttaaaattacttgtcaacacttaaaaaccagaagatttctatttttaaaaatacagacttggccgggtgtggtggctcatgcctgtgataccagcactttgggagggcaaggcgggtagatcacctgaggtcaggagttctagaccaccctggccaacatggcaaaaacccgtctctactaaaaatacaaaaattagccaggcatggtgatgcgtgcctgtaatcccagctacttgggagactgaggcaggagactagcttgaa

SEQ ID NO: 40251 - DNA, 601 bp, Human
atctctgtagaataatcatcatcatcatcattagtaaaaaagttttaaaattacttgtcaacacttaaaaaccagaagatttctatttttaaaaatacagacttggccgggtgtggtggctcatgcctgtgataccagcactttgggagggcaaggcgggtagatcacctgaggtcaggagttctagaccaccctggccaacatggcaaaaacccgtctctactaaaaatacaaaaattagccaggcatggtgatgcgtgcctgtaatcccagctacttgggagactgaggcaggagactmgcttgaacccggaaggcagaggttgcaatgagccaagattgcgccattgcgctccagcctgggcgacaagagtgaaactttgtctcaaaaaaaaaaaagaaaaaaatacagacttacagtccgggtgcagtggctcactcctgtaatcccagcactttgggaggccgaagggggtggatcacttgaggccaggagttcaagaccagcctgggcaacatggcaaaaccccatctctactaaaaatacaaaaattagccaggcgtggtggcacatgcctgtaatcccagctactcgggagac

SEQ ID NO: 40252 - DNA, 601 bp, Human
tctagaccaccctggccaacatggcaaaaacccgtctctactaaaaatacaaaaattagccaggcatggtgatgcgtgcctgtaatcccagctacttgggagactgaggcaggagactagcttgaacccggaaggcagaggttgcaatgagccaagattgcgccattgcgctccagcctgggcgacaagagtgaaactttgtctcaaaaaaaaaaaagaaaaaaatacagacttacagtccgggtgcagtggctcactcctgtaatcccagcactttgggaggccgaagggggtggatcasttgaggccaggagttcaagaccagcctgggcaacatggcaaaaccccatctctactaaaaatacaaaaattagccaggcgtggtggcacatgcctgtaatcccagctactcgggagactgagagaggagaactgcctgaacctgggaggcagaggttgcaatgagctgagatcgtgccactacccttcagcctgggtgacagaacaagactctgtctcaaaataaataaataaataaataaataaataaataaataagaagtaaataaataaatagaataagaacttacagtaagaaaaa

SEQ ID NO: 40253 - DNA, 601 bp, Human
cctgtaatcccagcactttgggaggccgaagggggtggatcacttgaggccaggagttcaagaccagcctgggcaacatggcaaaaccccatctctactaaaaatacaaaaattagccaggcgtggtggcacatgcctgtaatcccagctactcgggagactgagagaggagaactgcctgaacctgggaggcagaggttgcaatgagctgagatcgtgccactacccttcagcctgggtgacagaacaagactctgtctcaaaataaataaataaataaataaataaataaataaataagaagtaaataaataaatagaataagaacttacagtaagaaaaaaaataaaacagtctgggagcattggaaatgactggtcagggctaaccagcagctgattcatccaggcaggaggcactctctgctttgctgtggccctgcctggtctgttttcctgtcccctagaggcatttgagttttcgacccctgccttttgaaggccttcccataaactgtgtgggtgactctttctgttaaaaccaggtatattggttatacctgggtgatgggatcacctgtacaccaaacttcacccataca

SEQ ID NO: 40254 - DNA, 601 bp, Human
gagttcaagaccagcctgggcaacatggcaaaaccccatctctactaaaaatacaaaaattagccaggcgtggtggcacatgcctgtaatcccagctactcgggagactgagagaggagaactgcctgaacctgggaggcagaggttgcaatgagctgagatcgtgccactacccttcagcctgggtgacagaacaagactctgtctcaaaataaataaataaataaataaataaataaataaataagaagtaaataaataaatagaataagaacttacagtaagaaaaaaaataaaacastctgggagcattggaaatgactggtcagggctaaccagcagctgattcatccaggcaggaggcactctctgctttgctgtggccctgcctggtctgttttcctgtcccctagaggcatttgagttttcgacccctgccttttgaaggccttcccataaactgtgtgggtgactctttctgttaaaaccaggtatattggttatacctgggtgatgggatcacctgtacaccaaacttcacccatacaccaaacttcagtgacatacaatttacctgtgcaacaaacctgcatgtgtaccc

SEQ ID NO: 40255 - DNA, 601 bp, Human
cctgtcccctagaggcatttgagttttcgacccctgccttttgaaggccttcccataaactgtgtgggtgactctttctgttaaaaccaggtatattggttatacctgggtgatgggatcacctgtacaccaaacttcacccatacaccaaacttcagtgacatacaatttacctgtgcaacaaacctgcatgtgtacccccgaacctaaaaattaaaaaaataaagtattagttagagaacaggctatgctgctgcaacaaaaagacccataaatacagggacccaacctgtgaggcatkttcttctctctcagctattagtgcagagacagacatttgtggtaggcaggtagctctgctcgcaaagccatctagggacccagcttccttccttcttgccactctgcagtctgactgatgtccttgtccacatggtcagaatggcccccagcctgcaggaaggaaaagagggagggagaggagcagagagccccgattggagggtgagacaggaagttgcatggtcactgctgctcacatctttgtagctgcaagggaggcagggaaggctagtccccagctttgtggcccagtgcccag

SEQ ID NO: 40256 - DNA, 601 bp, Human
ttccttcttgccactctgcagtctgactgatgtccttgtccacatggtcagaatggcccccagcctgcaggaaggaaaagagggagggagaggagcagagagccccgattggagggtgagacaggaagttgcatggtcactgctgctcacatctttgtagctgcaagggaggcagggaaggctagtccccagctttgtggcccagtgcccagcccacagtgaaaggttctatcactaaaagcaaagggtgaaggtgtgccaggaaccatagttatttctcccatggggagcctctgtgctrtcatgaagttggggtgcccccagcccccaagcctgggcgtttctcagctgcttgaggagggccctgatctgaccccgtattgtgttagtcttagactggctggtgcagccgaaacctcgatggcttggtggcaatggctggctcctggatggccctgaggaggtgttacaaggtacctgccgggtaaagcccagaccctacatccaagcctcgatccctccttctcagctgcttccagaaagctggcagcaccaggccggctgtcccccatgcacgggcccttcagccaaacactcagcc

SEQ ID NO: 40257 - DNA, 601 bp, Human
caagggaggcagggaaggctagtccccagctttgtggcccagtgcccagcccacagtgaaaggttctatcactaaaagcaaagggtgaaggtgtgccaggaaccatagttatttctcccatggggagcctctgtgctgtcatgaagttggggtgcccccagcccccaagcctgggcgtttctcagctgcttgaggagggccctgatctgaccccgtattgtgttagtcttagactggctggtgcagccgaaacctcgatggcttggtggcaatggctggctcctggatggccctgaggagrtgttacaaggtacctgccgggtaaagcccagaccctacatccaagcctcgatccctccttctcagctgcttccagaaagctggcagcaccaggccggctgtcccccatgcacgggcccttcagccaaacactcagccctctttgatcctccccaccccagcgcagaagggctgatggctgggggcttggccagaatcaaagcccagtacagaataagggcttcgactctccccaagaatggagcctcctcctggatggagaattgaaggggagggggcttagggttggttttcaaattcc

SEQ ID NO: 40258 - DNA, 601 bp, Human
tagtcttagactggctggtgcagccgaaacctcgatggcttggtggcaatggctggctcctggatggccctgaggaggtgttacaaggtacctgccgggtaaagcccagaccctacatccaagcctcgatccctccttctcagctgcttccagaaagctggcagcaccaggccggctgtcccccatgcacgggcccttcagccaaacactcagccctctttgatcctccccaccccagcgcagaagggctgatggctgggggcttggccagaatcaaagcccagtacagaataagggcttygactctccccaagaatggagcctcctcctggatggagaattgaaggggagggggcttagggttggttttcaaattcctagaattctagggggttcaccgctctctaatgatgaagcctccccgggggtgggggaggtaccaggaggcagagggcagtttctggaaggaacagcatgcaggtcgggggcctggaggcctaggaggtgcgagcgggcacccttgcacacctgtggctgtgcttctgactccacgtccatctgtgtgttgtgtgactgtgtccgctagagtgtgcggccgtat

SEQ ID NO: 40259 - DNA, 601 bp, Human
accccagcgcagaagggctgatggctgggggcttggccagaatcaaagcccagtacagaataagggcttcgactctccccaagaatggagcctcctcctggatggagaattgaaggggagggggcttagggttggttttcaaattcctagaattctagggggttcaccgctctctaatgatgaagcctccccgggggtgggggaggtaccaggaggcagagggcagtttctggaaggaacagcatgcaggtcgggggcctggaggcctaggaggtgcgagcgggcacccttgcacacctgyggctgtgcttctgactccacgtccatctgtgtgttgtgtgactgtgtccgctagagtgtgcggccgtatatgcaactgtgtggctgtccttgtgcctgtggctgaatatttgtgtgtgtgtgtgtgtgtgtgtgtgcatgcaaaagtgtgtgactgtattgtgagtgtacatgtgtgggtaagcgtgtgtgtatgtgggtgtggatatgtgtgtgcaggatttgtgtgtggggatgcgtgcgtatatgtctgtgtatatttgtgcgtctgacttgcttgtgtaaatgtctgtgtccccat

SEQ ID NO: 40260 - DNA, 601 bp, Human
cccaaccgtgggcagtgcgtcaagcagcgccggcaagcaggtgagtgtggcaccccagccctgatcctggctcctgccccagtccccttctccctgtaagcgcctctcacccgcatggacgacctgccccaggaagcagccccagcacctgggcctgactgagagctcctcacatcttccccctgcccggctccttctttcatggcccctaccctttccctgtcacactagcatgtgaccgaagctcttgagccagcagactggctgcaaaccccagctctgcacctcccagctgggcgayactggggttaatttcttcctatctctgagcctcagtttcctcatctgtaaaatggggctactacatgctgttgtggggcgtgactgaaatcataagtgcagagcagtcggagcagccctaaggaatagtaggtggtcagtaagcactggatgttttatatccacgtatgtgtagatggaccccgacttacgatggtcaacttaagattgttagactttacgctggtgcagaagcaacatgcattctgtagaaactgtacttcaagttcccatccaaccattctgtttttcactttcagta

SEQ ID NO: 40261 - DNA, 601 bp, Human
cacctgggcctgactgagagctcctcacatcttccccctgcccggctccttctttcatggcccctaccctttccctgtcacactagcatgtgaccgaagctcttgagccagcagactggctgcaaaccccagctctgcacctcccagctgggcgacactggggttaatttcttcctatctctgagcctcagtttcctcatctgtaaaatggggctactacatgctgttgtggggcgtgactgaaatcataagtgcagagcagtcggagcagccctaaggaatagtaggtggtcagtaagcrctggatgttttatatccacgtatgtgtagatggaccccgacttacgatggtcaacttaagattgttagactttacgctggtgcagaagcaacatgcattctgtagaaactgtacttcaagttcccatccaaccattctgtttttcactttcagtatggtaatcaaattacacgacacattcaatattttattataaaataggctttgtgttagatgactttgcccaactctaggctaatgtaagtgttctgagcacagttaaggtaggctcggctaaggtatggtgttcagtaggttaac

SEQ ID NO: 40262 - DNA, 601 bp, Human
ccccgacttacgatggtcaacttaagattgttagactttacgctggtgcagaagcaacatgcattctgtagaaactgtacttcaagttcccatccaaccattctgtttttcactttcagtatggtaatcaaattacacgacacattcaatattttattataaaataggctttgtgttagatgactttgcccaactctaggctaatgtaagtgttctgagcacagttaaggtaggctcggctaaggtatggtgttcagtaggttaactgtgttcagtgcattttgacttaagatattctcarcttgtagggggtatatcagtacataactccattgtaagtcaagaagcatctgtatctgttttcaaaatgcattgaattagaattgtctgagaatccttaacttccagaacttctgccaggactgttcagtttgacttaatttgtgttcgtctttggacacaaaggcaataaatagatgagtgaattgtgttgctctcattggcataattttcccaagaaaagaaagaacaatggcacagcgattcctggtggtatctaaaaccatctcgaaccccactcaaggcaatgaagttgaaagac

SEQ ID NO: 40263 - DNA, 601 bp, Human
aaattacacgacacattcaatattttattataaaataggctttgtgttagatgactttgcccaactctaggctaatgtaagtgttctgagcacagttaaggtaggctcggctaaggtatggtgttcagtaggttaactgtgttcagtgcattttgacttaagatattctcagcttgtagggggtatatcagtacataactccattgtaagtcaagaagcatctgtatctgttttcaaaatgcattgaattagaattgtctgagaatccttaacttccagaacttctgccaggactgttcastttgacttaatttgtgttcgtctttggacacaaaggcaataaatagatgagtgaattgtgttgctctcattggcataattttcccaagaaaagaaagaacaatggcacagcgattcctggtggtatctaaaaccatctcgaaccccactcaaggcaatgaagttgaaagacttcaatgtgctttttggcatggagtttggatgaactgtgtggtgagccaggaatctgggacttcagggtggccaggttcaccttgtcaaagtcagtgtcagtcagactgagaccacacccaggggcccc

SEQ ID NO: 40264 - DNA, 601 bp, Human
aagatattctcagcttgtagggggtatatcagtacataactccattgtaagtcaagaagcatctgtatctgttttcaaaatgcattgaattagaattgtctgagaatccttaacttccagaacttctgccaggactgttcagtttgacttaatttgtgttcgtctttggacacaaaggcaataaatagatgagtgaattgtgttgctctcattggcataattttcccaagaaaagaaagaacaatggcacagcgattcctggtggtatctaaaaccatctcgaaccccactcaaggcaatsaagttgaaagacttcaatgtgctttttggcatggagtttggatgaactgtgtggtgagccaggaatctgggacttcagggtggccaggttcaccttgtcaaagtcagtgtcagtcagactgagaccacacccaggggcccctgtccccgcttcggcatctcatagccctaatagctaaggacaggaccctcagacaagattggtgataattacagtgaccctatttgccgaaagtatactggggagtgcatgatctgccaaaacctctttttttttctgatttgagaatgtttttctctg

SEQ ID NO: 40265 - DNA, 601 bp, Human
atctcgaaccccactcaaggcaatgaagttgaaagacttcaatgtgctttttggcatggagtttggatgaactgtgtggtgagccaggaatctgggacttcagggtggccaggttcaccttgtcaaagtcagtgtcagtcagactgagaccacacccaggggcccctgtccccgcttcggcatctcatagccctaatagctaaggacaggaccctcagacaagattggtgataattacagtgaccctatttgccgaaagtatactggggagtgcatgatctgccaaaacctctttttttttctgatttgagaatgtttttctctgaagtgtttcaagaaaggcatagacgtaaaatcagtcatgcatttaatgtcattatcattgcagataaagtgatgcaaatcccggaatcctgaactttgaagaaattatctacaaaaggctttgaaacaaagagatgcctttttggtttcctctacattccacttgctatttgcagggctttgtttggggttatagggtggcttctccagccagatagcctgggctgccacagctactcagccccttactgctgtgggcagcaaataacataacctt

SEQ ID NO: 40266 - DNA, 601 bp, Human
gggtgtatggtcctttggaggtaaaaccgcaagggcctgccagccactgtgaggctgctggagtgtggaagggatagccttttccaaaagagagctgtggggcgagttgcgagttcgttgggctatgccaccatttataataatgacggcataataggaatgccttgggcacttgtctttttcatcccctgatcttttcattcagccctatgatgtctaagaccaaggtcaaaccaagtcaaactagttcttaagggttcaaaccagttaaaaaaattcccatttcaagacagagctaagsaaagagggtcagtcattcagtggtgaccacaccagtgatgcctactgttaacatgcacctttggagtgctctctttaaattaagctttgctgcaagcctgcaaaaggagaagtagaaccaggaggcagtgctgcataggtttcagagtgcaggctcagaaccacagaaagaagtccaaagcctgtaactttcttcctccgtggccttgagcaggtcacccaacctctcttagcctcagttccttgatctgtaaaatagagatggcgatggtaaccatagtgactacttcatggggtagtt

SEQ ID NO: 40267 - DNA, 601 bp, Human
tggtcctttggaggtaaaaccgcaagggcctgccagccactgtgaggctgctggagtgtggaagggatagccttttccaaaagagagctgtggggcgagttgcgagttcgttgggctatgccaccatttataataatgacggcataataggaatgccttgggcacttgtctttttcatcccctgatcttttcattcagccctatgatgtctaagaccaaggtcaaaccaagtcaaactagttcttaagggttcaaaccagttaaaaaaattcccatttcaagacagagctaaggaaagagrgtcagtcattcagtggtgaccacaccagtgatgcctactgttaacatgcacctttggagtgctctctttaaattaagctttgctgcaagcctgcaaaaggagaagtagaaccaggaggcagtgctgcataggtttcagagtgcaggctcagaaccacagaaagaagtccaaagcctgtaactttcttcctccgtggccttgagcaggtcacccaacctctcttagcctcagttccttgatctgtaaaatagagatggcgatggtaaccatagtgactacttcatggggtagttatggggc

SEQ ID NO: 40268 - DNA, 601 bp, Human
ccttgagcaggtcacccaacctctcttagcctcagttccttgatctgtaaaatagagatggcgatggtaaccatagtgactacttcatggggtagttatggggcttgagtgagagaaacacgtatgaagtgcttagaatagcacctggcccactgtaggtcctcagtgaatgtgtgccaccatcatccctgtcttcgtaaagggaggatatgagttcaggaatttacccaaaagatgcagagctggaagagctggaattccaagactgtccaccagcctcagagcctgtgtgtgtgtgtgygtgtgtgtgtgtgtgtgtgtgtgtgtgtgtgtgagcttcccctcccaaatgaacgatttgaggcttccaaatggaactgtaagtggaattccccctagccttgttctcagggggctgacacttagcaataattactggtaatttactggtaattatatataggtttgaaaacattttgaattccagcaacttcccttggagcaaaaatctcaggggaagggtggcccccttgtcccagccttaccaaggaagaagctttttatttaagtttttaaaaactgcatatttgaaataatttca

SEQ ID NO: 40269 - DNA, 601 bp, Human
gctgacacttagcaataattactggtaatttactggtaattatatataggtttgaaaacattttgaattccagcaacttcccttggagcaaaaatctcaggggaagggtggcccccttgtcccagccttaccaaggaagaagctttttatttaagtttttaaaaactgcatatttgaaataatttcagacttataaaaatgttgcaaaagtagtaccttgaatcccccacccagattcaccagttgttaaaaaactaccgttacattttcctttatgctctctccccacttataaatctaygtgtgtatttttctggaccatttgagagtaagcgacaggccctgtgccgacacctaagatgccatcctcccgtaagagaggcttctagcgggtaccaatagtccttcaagtttgaccatccagcacctggaaccaggcatttgaggggttcacattttatgcaagaggaaaatgaacactgacatgtatagtaaatctggtttttcagagagtgggttcagggaaaatcggtgcatttttctgagtaggtttgaggtcacacagaagctgagctgcgggggctggcccctccttgtcctg

SEQ ID NO: 40270 - DNA, 601 bp, Human
ttatagcagaaaaggcagcgctgatcaccaggatggagaagtgagctaaatttgagagagattgccacattcaagcatccacatgtcctggtcacattcctgtcagcaaatgctttcctgctaccatggggtgggtagcacggctagtcatgggacatgcatgaaattgccagcagttgaccactttttacacacaaagatagaattttcatacggctcatcctaatactgcatagatatgttttaaatgaaattgtttcttttaatcctcacaataactttaagaggtactaattttatrcctatttttaggagaggaaactgaggctcaaagaggacgagtgaggattcatactcaagttactttgtcatttgcagtaatgacatcagagtgtctcttgggcagactcaaaagagtgtcatctcttccccctgtgaacatattttgtaatgacatttactcaacagtgtgttgaaatttggcttccagttcatctgttaagacaatggttttggccgggcatggcggctcacgcctgtaatcccagcactttggcaggctgaggtgggtgaatcacctgaggtcaggagttcgaggcca

SEQ ID NO: 40271 - DNA, 601 bp, Human
ttatgacaacagttttggccttctaaactcctaaaagaagttttttcctctcacttgttttccagatgggcgaatcctacgacacaaactttacaaagaatatccaggtaaaagaagaaactgttctttctttccagagggcacaaaaaaaaggcagtgaacgtttcttatgtgaagaaaaaaataaaagcccagggctgagatatagggaacaaaatgggacctgggattaagaaacaaaatagaagacctgtggtctgatggtgggcagggagttgtgagtcacagaggagctcatggyaaacatgacctcatgctgaagagcagagcctggaactgctcatatttaagcctctgctactttcattcagagaattggaaaacatgcctgataccactcttccattcatccatctaatcatccatcgatccatccatctctccatctattatttcatccatccattcatccctccatccatctacccacccatccatctacccaccatccatccatccatccaccgattcatccatccatcctctcattcatccattcatatatccatctattctttcatccatcttcctgttttttcat

SEQ ID NO: 40272 - DNA, 601 bp, Human
aaactttacaaagaatatccaggtaaaagaagaaactgttctttctttccagagggcacaaaaaaaaggcagtgaacgtttcttatgtgaagaaaaaaataaaagcccagggctgagatatagggaacaaaatgggacctgggattaagaaacaaaatagaagacctgtggtctgatggtgggcagggagttgtgagtcacagaggagctcatggtaaacatgacctcatgctgaagagcagagcctggaactgctcatatttaagcctctgctactttcattcagagaattggaaaacaygcctgataccactcttccattcatccatctaatcatccatcgatccatccatctctccatctattatttcatccatccattcatccctccatccatctacccacccatccatctacccaccatccatccatccatccaccgattcatccatccatcctctcattcatccattcatatatccatctattctttcatccatcttcctgttttttcatccattcattcctctatcaatctattcatccatctattcattcttccatccatccacccattcatccatccatccacatattcatc

SEQ ID NO: 40273 - DNA, 601 bp, Human
tttctttccagagggcacaaaaaaaaggcagtgaacgtttcttatgtgaagaaaaaaataaaagcccagggctgagatatagggaacaaaatgggacctgggattaagaaacaaaatagaagacctgtggtctgatggtgggcagggagttgtgagtcacagaggagctcatggtaaacatgacctcatgctgaagagcagagcctggaactgctcatatttaagcctctgctactttcattcagagaattggaaaacatgcctgataccactcttccattcatccatctaatcatccatygatccatccatctctccatctattatttcatccatccattcatccctccatccatctacccacccatccatctacccaccatccatccatccatccaccgattcatccatccatcctctcattcatccattcatatatccatctattctttcatccatcttcctgttttttcatccattcattcctctatcaatctattcatccatctattcattcttccatccatccacccattcatccatccatccacatattcatctatcttttcacccacccatctatccttttatccaccccttt

SEQ ID NO: 40274 - DNA, 601 bp, Human
attatttcatccatccattcatccctccatccatctacccacccatccatctacccaccatccatccatccatccaccgattcatccatccatcctctcattcatccattcatatatccatctattctttcatccatcttcctgttttttcatccattcattcctctatcaatctattcatccatctattcattcttccatccatccacccattcatccatccatccacatattcatctatcttttcacccacccatctatccttttatccacccctttattccttcatccctccatccayccgtcctttcattcacttacctattcaccaatcatccattcatctatccatccatccattcatacatacatcctttcacttatccatctatccacccatctacctttttttttttttgagatggagtctcactctgttgcctaggctggggtgcactggagtaatcttggctcactgcaaactctgcctcctgggttcaagcagttctcctgcgtcagcctcccaaatagctgggattacaggtgtccgccatcatacctggataatttttgtatttttagtagagacgaggtttcacct

SEQ ID NO: 40275 - DNA, 601 bp, Human
atttcatccatccattcatccctccatccatctacccacccatccatctacccaccatccatccatccatccaccgattcatccatccatcctctcattcatccattcatatatccatctattctttcatccatcttcctgttttttcatccattcattcctctatcaatctattcatccatctattcattcttccatccatccacccattcatccatccatccacatattcatctatcttttcacccacccatctatccttttatccacccctttattccttcatccctccatccatccrtcctttcattcacttacctattcaccaatcatccattcatctatccatccatccattcatacatacatcctttcacttatccatctatccacccatctacctttttttttttttgagatggagtctcactctgttgcctaggctggggtgcactggagtaatcttggctcactgcaaactctgcctcctgggttcaagcagttctcctgcgtcagcctcccaaatagctgggattacaggtgtccgccatcatacctggataatttttgtatttttagtagagacgaggtttcaccttgt

SEQ ID NO: 40276 - DNA, 601 bp, Human
ccatctatccacccacccatatatccatgcatccatccatccatcatttatccattcacccattcacccatccatccatccatcatttatccattcacccatccatccatccattctcccatccatccgatatgtctttatcaataatttacagcacatattttctaagtattactcatcagtctgtgctgggggttggagctacatttgtgaacatgacagacccagtcgctgctgtcatgcagctaatatcaagcagaaaattcagacatgaatatagcccaagtggttattttatgakaatagtgacaagccttcctgacatcacatgctggatactatgaggacaccttagtccaggttgtgagaaaaggcttcctaaggaggagacatgaaagctcagcctaaagaataagaaatagtgggcagcagaatggcatgtgtgaagctcttgaggtcggaagcaatttggccatccccaaagctggagtgtgtggtgagctgtggaggtggtgggaggtaagaccagaaacatagacagagctggtgacaccagctggggggcctggggagggagaggaggcactgcaggtggggactg

SEQ ID NO: 40277 - DNA, 601 bp, Human
caaagctggagtgtgtggtgagctgtggaggtggtgggaggtaagaccagaaacatagacagagctggtgacaccagctggggggcctggggagggagaggaggcactgcaggtggggactgagtgaactcagctgggggagggaggagagggccaggtcaccaggcttcatttggcagttcctggtgagccacgggggggcattagagcaggaatagatacatctaccctaacagagctgtgttcttttcacagaaggtgactcaaagaatgtggcagaacctggaaggggacaacagargcactttcagtaaagcaacggcaagcaggtgagtgggcagagagcaagagtcatggccagggtaaatgtgggcagccagtgtcctggcagctttcaccaccaggttgaggagcaggagggtgagagtagcgctttccctactggtagaatttgaaattcccttctgcagtaagtcctcacctaacgtcatcaataggttcttggaaactgactttaaatgcaacgacatactatatgcactgtatgccatagaagcttaactcatttgtttgtttttttaagagatggggtctcactctg

SEQ ID NO: 40278 - DNA, 601 bp, Human
tcagctgggggagggaggagagggccaggtcaccaggcttcatttggcagttcctggtgagccacgggggggcattagagcaggaatagatacatctaccctaacagagctgtgttcttttcacagaaggtgactcaaagaatgtggcagaacctggaaggggacaacagaggcactttcagtaaagcaacggcaagcaggtgagtgggcagagagcaagagtcatggccagggtaaatgtgggcagccagtgtcctggcagctttcaccaccaggttgaggagcaggagggtgagagtarcgctttccctactggtagaatttgaaattcccttctgcagtaagtcctcacctaacgtcatcaataggttcttggaaactgactttaaatgcaacgacatactatatgcactgtatgccatagaagcttaactcatttgtttgtttttttaagagatggggtctcactctgtcacccaggctggagtgcactggcacaatcattgttcactgcagcctcagactcctaggctcaagccatcctcctgcctcagctttagtctcagtagctgggactacagacatacaccacctcacctgg

SEQ ID NO: 40279 - DNA, 601 bp, Human
ccagggtaaatgtgggcagccagtgtcctggcagctttcaccaccaggttgaggagcaggagggtgagagtagcgctttccctactggtagaatttgaaattcccttctgcagtaagtcctcacctaacgtcatcaataggttcttggaaactgactttaaatgcaacgacatactatatgcactgtatgccatagaagcttaactcatttgtttgtttttttaagagatggggtctcactctgtcacccaggctggagtgcactggcacaatcattgttcactgcagcctcagactcctrggctcaagccatcctcctgcctcagctttagtctcagtagctgggactacagacatacaccacctcacctggctaattttttttttgtattttttgtagagatgagttctcactatgttactcaggctggtcttgaactcctggcctcaagcagtcctcccactttggcctcccaaagtgctgggattgcaggcatgagtcactgtgcctggccttaactcttgtttatatccattagcctatggtaaaattgtttttgttatatagtaggtcattttgcttaaagttgcagtttccaat

SEQ ID NO: 40280 - DNA, 601 bp, Human
cttgatgtctccaggaagtcttgtctatctcttctcatttctgtcaaacaattctgttgggtgccaactatctgatagtcatggttccagcctcttggttgctcagcggtagttcatgccagggtggtatagtgaacaaatcccacagagccgctgccctcagggaggccacatcctggtaggggacggctacacaagccaacagatcaatcaatacaaagacaggtgtggtgaagaagtgaacaggcaatgtggggcagagtccctgggcaggagcagagcctggggcaggggctgcttygtttggggtcagggaaggccctgtgggggttgaagtctgagccaagatccaaggtgagaaggtgctgcttggggagggtctggaggataggcgcccaggtggagggagttggaagagtgaaagtactgaggcaggagggacgctggctttggggagccaaagaaggcccctggggtagacgcaggaaggtggcagggaggctgactccagaggaggccgcaggtgaggcacaggcttgccctcacgtgccctcaaaggtgaggcataggtgcatgcaaagggctgtggagttgcagccct

SEQ ID NO: 40281 - DNA, 601 bp, Human
ccaggaagtcttgtctatctcttctcatttctgtcaaacaattctgttgggtgccaactatctgatagtcatggttccagcctcttggttgctcagcggtagttcatgccagggtggtatagtgaacaaatcccacagagccgctgccctcagggaggccacatcctggtaggggacggctacacaagccaacagatcaatcaatacaaagacaggtgtggtgaagaagtgaacaggcaatgtggggcagagtccctgggcaggagcagagcctggggcaggggctgcttcgtttggggtyagggaaggccctgtgggggttgaagtctgagccaagatccaaggtgagaaggtgctgcttggggagggtctggaggataggcgcccaggtggagggagttggaagagtgaaagtactgaggcaggagggacgctggctttggggagccaaagaaggcccctggggtagacgcaggaaggtggcagggaggctgactccagaggaggccgcaggtgaggcacaggcttgccctcacgtgccctcaaaggtgaggcataggtgcatgcaaagggctgtggagttgcagccctaaacctgaaa

SEQ ID NO: 40282 - DNA, 601 bp, Human
ctgggcaggagcagagcctggggcaggggctgcttcgtttggggtcagggaaggccctgtgggggttgaagtctgagccaagatccaaggtgagaaggtgctgcttggggagggtctggaggataggcgcccaggtggagggagttggaagagtgaaagtactgaggcaggagggacgctggctttggggagccaaagaaggcccctggggtagacgcaggaaggtggcagggaggctgactccagaggaggccgcaggtgaggcacaggcttgccctcacgtgccctcaaaggtgaggcrtaggtgcatgcaaagggctgtggagttgcagccctaaacctgaaaatctacccagcccctgtgaatgctggatagccacagagggcaaaaaggagcccctaaaagcaggtgacagcctcccaggacgtcgctgaaacgcaaatgtcagattgcaggttccagaatcctcccggaaaatctggagcccgtagggactgatgccagcacgtctgttacctgctgatgacaggagccgtccctggagtaggtcagatgcagctgaggactgagcttctaacagggaagaaggaggccagtgga

SEQ ID NO: 40283 - DNA, 601 bp, Human
tgtgggggttgaagtctgagccaagatccaaggtgagaaggtgctgcttggggagggtctggaggataggcgcccaggtggagggagttggaagagtgaaagtactgaggcaggagggacgctggctttggggagccaaagaaggcccctggggtagacgcaggaaggtggcagggaggctgactccagaggaggccgcaggtgaggcacaggcttgccctcacgtgccctcaaaggtgaggcataggtgcatgcaaagggctgtggagttgcagccctaaacctgaaaatctacccagcycctgtgaatgctggatagccacagagggcaaaaaggagcccctaaaagcaggtgacagcctcccaggacgtcgctgaaacgcaaatgtcagattgcaggttccagaatcctcccggaaaatctggagcccgtagggactgatgccagcacgtctgttacctgctgatgacaggagccgtccctggagtaggtcagatgcagctgaggactgagcttctaacagggaagaaggaggccagtggatgaggacgagaccttgggaggcagttgaggatggcagtttggaagttgaggcttttg

SEQ ID NO: 40284 - DNA, 601 bp, Human
aaaatctggagcccgtagggactgatgccagcacgtctgttacctgctgatgacaggagccgtccctggagtaggtcagatgcagctgaggactgagcttctaacagggaagaaggaggccagtggatgaggacgagaccttgggaggcagttgaggatggcagtttggaagttgaggcttttgggtgggcgcagcagctcccgcctgtaatttcaacattttgggagaccgaagcaggcatatggtataatcccaggagttcaagcccagcctggcctggccaacatggtgaaaccctaactctacaaaaaaaaatacaaaactacccaggcatggtggtgtgcacctgtggtcccagctacttgggaggctgtggtgggaggatcacctgagcctagggaggttaaggctgcagtgagccatgtttgcaccattgcactccagcctgggtgacagagtgagaccctgtttcaagaaaaaaaaaaaaaagtacagcctttggagcaagctaggtctgggtttaaattcttgttccagcactgtggatttagtaaataatttcggctctccaagcctcagcctcctcatctataaaatgga

SEQ ID NO: 40285 - DNA, 601 bp, Human
aaatctggagcccgtagggactgatgccagcacgtctgttacctgctgatgacaggagccgtccctggagtaggtcagatgcagctgaggactgagcttctaacagggaagaaggaggccagtggatgaggacgagaccttgggaggcagttgaggatggcagtttggaagttgaggcttttgggtgggcgcagcagctcccgcctgtaatttcaacattttgggagaccgaagcaggcatatggtataatcccaggagttcaagcccagcctggcctggccaacatggtgaaaccctatatctacaaaaaaaaatacaaaactacccaggcatggtggtgtgcacctgtggtcccagctacttgggaggctgtggtgggaggatcacctgagcctagggaggttaaggctgcagtgagccatgtttgcaccattgcactccagcctgggtgacagagtgagaccctgtttcaagaaaaaaaaaaaaaagtacagcctttggagcaagctaggtctgggtttaaattcttgttccagcactgtggatttagtaaataatttcggctctccaagcctcagcctcctcatctataaaatggaa

SEQ ID NO: 40286 - DNA, 601 bp, Human
ctggagcccgtagggactgatgccagcacgtctgttacctgctgatgacaggagccgtccctggagtaggtcagatgcagctgaggactgagcttctaacagggaagaaggaggccagtggatgaggacgagaccttgggaggcagttgaggatggcagtttggaagttgaggcttttgggtgggcgcagcagctcccgcctgtaatttcaacattttgggagaccgaagcaggcatatggtataatcccaggagttcaagcccagcctggcctggccaacatggtgaaaccctatctcttcaaaaaaaaatacaaaactacccaggcatggtggtgtgcacctgtggtcccagctacttgggaggctgtggtgggaggatcacctgagcctagggaggttaaggctgcagtgagccatgtttgcaccattgcactccagcctgggtgacagagtgagaccctgtttcaagaaaaaaaaaaaaaagtacagcctttggagcaagctaggtctgggtttaaattcttgttccagcactgtggatttagtaaataatttcggctctccaagcctcagcctcctcatctataaaatggaactga

SEQ ID NO: 40287 - DNA, 601 bp, Human
gctgatgacaggagccgtccctggagtaggtcagatgcagctgaggactgagcttctaacagggaagaaggaggccagtggatgaggacgagaccttgggaggcagttgaggatggcagtttggaagttgaggcttttgggtgggcgcagcagctcccgcctgtaatttcaacattttgggagaccgaagcaggcatatggtataatcccaggagttcaagcccagcctggcctggccaacatggtgaaaccctatctctacaaaaaaaaatacaaaactacccaggcatggtggtgtgcrcctgtggtcccagctacttgggaggctgtggtgggaggatcacctgagcctagggaggttaaggctgcagtgagccatgtttgcaccattgcactccagcctgggtgacagagtgagaccctgtttcaagaaaaaaaaaaaaaagtacagcctttggagcaagctaggtctgggtttaaattcttgttccagcactgtggatttagtaaataatttcggctctccaagcctcagcctcctcatctataaaatggaactgatggtaggggaggagttaggaactaaataagatgatgccgt

SEQ ID NO: 40288 - DNA, 601 bp, Human
ccaacatggtgaaaccctatctctacaaaaaaaaatacaaaactacccaggcatggtggtgtgcacctgtggtcccagctacttgggaggctgtggtgggaggatcacctgagcctagggaggttaaggctgcagtgagccatgtttgcaccattgcactccagcctgggtgacagagtgagaccctgtttcaagaaaaaaaaaaaaaagtacagcctttggagcaagctaggtctgggtttaaattcttgttccagcactgtggatttagtaaataatttcggctctccaagcctcagcytcctcatctataaaatggaactgatggtaggggaggagttaggaactaaataagatgatgccgtgaagacgtcacagtgagttcagaattgggtcttctcagaaaggggcatcttcctggtgtttctgatggtggcggtggcggcggggagacgaaagatttgtgactctgtggtctgccctgcagtggttcaccctgacccttctttgtctctggtctgccctgcagcggttcaccctgatccttctttgcttgctttccagctaggttgcaagaacattcctctactttctgctaagc

SEQ ID NO: 40289 - DNA, 601 bp, Human
gttcaccctgatccttctttgcttgctttccagctaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccrcccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataagatgccgagtctctggtgttttgtgatactttgtcactgtttaattc

SEQ ID NO: 40290 - DNA, 601 bp, Human
gtgaaaattttctcccattttgtaggttgcctgttcactctgatggtagtttcttttgctgtgcagaagctctttagtttaattatgtggaatgcagctttctctcaacttgggaaccaatagacatttctacctgttctgtttttatagaagactggactttatgagtataaagtctttggtgttctggaggactgctcaccaactctactggcagacatctatatggactcagattacagaaaacaatgggaccagtatgttaaaggtgagtgatgcttgcttttctttttttttagaygtactttcacttttgtagcccagggtgaagtgcaaaggtaggatctcagctcaccgcaatctccgcctcctgggttcaagcgattctcctgcctcagcctcctgagtagctgggactacaggcgcccgccaccacacctggctaatttttgtatctttagtagagacagggtttctccatgttagtcaggctggtcttgaacttctgacctcaggtgatccgcttgccttggcctcccaaagtgctaggattacaggcatgagccgctgcacccagtgcttttttttttttttttttttt

SEQ ID NO: 40291 - DNA, 601 bp, Human
tgctgtgcagaagctctttagtttaattatgtggaatgcagctttctctcaacttgggaaccaatagacatttctacctgttctgtttttatagaagactggactttatgagtataaagtctttggtgttctggaggactgctcaccaactctactggcagacatctatatggactcagattacagaaaacaatgggaccagtatgttaaaggtgagtgatgcttgcttttctttttttttagacgtactttcacttttgtagcccagggtgaagtgcaaaggtaggatctcagctcaccrcaatctccgcctcctgggttcaagcgattctcctgcctcagcctcctgagtagctgggactacaggcgcccgccaccacacctggctaatttttgtatctttagtagagacagggtttctccatgttagtcaggctggtcttgaacttctgacctcaggtgatccgcttgccttggcctcccaaagtgctaggattacaggcatgagccgctgcacccagtgcttttttttttttttttttttttggatcattaaaaagtagatctattctgaccagatgcagtgactcacgcctgtaat

SEQ ID NO: 40292 - DNA, 601 bp, Human
tctactactaggcgaactagggcagctgttgggtccagatcctccagggcctagcatggcgaccaggctatcggtcttagatttttccctgtaagttatgtgttatgaaagacatcacacagggacttctcctgccacttagagctggagtagcctctgccaacccagtcatagtggaatggaactatgaaactagccaaaggcacataaagcctttagtcaagactcttggttgcaagtaacagaaagccaactaaagacagtgtaagaagagaaaaaggagtttattagttcatggcaytgaaaaaagtccaggggtttctaactttgaggacagctgcaacagggaacttaaataatttcatcaggattgtttctttctccatctgtagactctgttttcttctgtgttgacctaattcctaggcagattcttatgtcatggccaagatgtctgccagaagatccagatttatattctaaccatatgaataaccccagaggaaggagaattctacttttctagggatgacagccagatgccaggattggctcttgtcagctcagcttggagtttgtgcttattttctgtggacattca

SEQ ID NO: 40293 - DNA, 601 bp, Human
aggcagcatggaagatccatttttcagtgaccagtgatggcatctgactttagggaaaacaactgctgagtctctgatgtttgctccccaacatcaacagctttcactctgggttctcatccagtggaagcagcagttaggctttgctggaacaatcttgaggttggaaatctcactctggtccatccgagagctttactaaatcactttttgctctcaacttgctagagtgactaactacgactctggacagatctgccatccctgaattcgtcaccatggccgtgtcttgctcattttyccagccctgaaattactgcagagtcagtcttgcgaaaccatgcagctgagaagtaggggaagggtgatgccctgaaggaaaattgagatgctcaaggggcgatcaatgctgagcatgtaaaagcaacagatgtccacctctccctttcttttaaggactctcatcagcctcctgtgaccttaatgggctggcacactccttaatctacagtgtgcttctaatagattttctttcaaaacctaaattatccctccttaccatctcctccagggactttgggctcctttaactggaggtaga

SEQ ID NO: 40294 - DNA, 601 bp, Human
gctttcactctgggttctcatccagtggaagcagcagttaggctttgctggaacaatcttgaggttggaaatctcactctggtccatccgagagctttactaaatcactttttgctctcaacttgctagagtgactaactacgactctggacagatctgccatccctgaattcgtcaccatggccgtgtcttgctcattttcccagccctgaaattactgcagagtcagtcttgcgaaaccatgcagctgagaagtaggggaagggtgatgccctgaaggaaaattgagatgctcaagggkcgatcaatgctgagcatgtaaaagcaacagatgtccacctctccctttcttttaaggactctcatcagcctcctgtgaccttaatgggctggcacactccttaatctacagtgtgcttctaatagattttctttcaaaacctaaattatccctccttaccatctcctccagggactttgggctcctttaactggaggtagaaagaagtttactgcacagcacagtctggggacagagggtgtgcatgccattaaatttctttgctatctccctccaagagttggctgctgtttgcacata

SEQ ID NO: 40295 - DNA, 601 bp, Human
gtcagtcttgcgaaaccatgcagctgagaagtaggggaagggtgatgccctgaaggaaaattgagatgctcaaggggcgatcaatgctgagcatgtaaaagcaacagatgtccacctctccctttcttttaaggactctcatcagcctcctgtgaccttaatgggctggcacactccttaatctacagtgtgcttctaatagattttctttcaaaacctaaattatccctccttaccatctcctccagggactttgggctcctttaactggaggtagaaagaagtttactgcacagcacartctggggacagagggtgtgcatgccattaaatttctttgctatctccctccaagagttggctgctgtttgcacataatagtaagacggaaggattattagggaaatttggtcaccctagctgtggcatagtgcaaagaaacatgggagagaagaaagaaacttggggtaagccatagttctgctgatctctaactattcaagaaggacgttgctcattctggaaccttcatatccgacctatgaatgtgctagactgggtgactccgttccaggttagctgtaatggatcaaggaatcct

SEQ ID NO: 40296 - DNA, 601 bp, Human
tctatccactagactctgtccctgggcaataagctttcagtggaaattaatcggtttgacttttttctagaattttataccttatgagttagtggtttatcataacctaagaggtcatctttttttttttttttcttgagacatggtgtcattctgtcacccaggctggagtgcagtggtgcaatcatggcttggctcactgcagccttgacctgctaggcttggatgatcctcctacctcagcctccagagtagctgggactacagacatgcaccaccatacctggctgatttttttgcttttttttttttttatatatagagatggggtttcaccatatttcccaggctggtcttgaactcctggacttgagcaattgactcaccttggcctcaaaaagtgctgggattacaggcatgagccaccatgcttggcctaagaggtcatacccttattagttgtagctaaaaaggcttccagatgcattaacttcttttgctttcctttagaactctatgaacaagaatgcaacggagagactgtggtctactgggaagtgaagtacccttttcccatgtccaacagagacgtatcctttcc

SEQ ID NO: 40297 - DNA, 601 bp, Human
gcaacagggggcgctgtcaagacactgaggtgggactgaacgcgggtggctcacgcctgtaatcccaacactttgggagtccaaagtgggcagatcacttgatgtcagagttcgagatcagcctggccaacatggagaaaccctgtctctattaaaaatacaaaaaaatttagctgggtgtggtgggcgcctgcaatcccagctactccggaggctgaggtgggaggatcacttgaacccaggaggtggaggttgcagtgagccgagatcgtgacactctactccagtctgggtgagactstgtctcaaaaaaaaaaaaaaaaaagacactgaggtgggtggaggctgagacggctgccatgttatagtaagtgtaattgtgttgtgcgtagtgactttttgattattttaggtttttgattcctttgagtgggaaacccaaaattctgttttatgaaagtgtaactaacaaactaaatatctgagctccatccaactatgaaattctaagtaggttttggagccagatctgggataaaaattcaggtttcatcacttcagctgggatgtgggatttttggcaaggttcttttcctctctg

SEQ ID NO: 40298 - DNA, 601 bp, Human
ggggcgctgtcaagacactgaggtgggactgaacgcgggtggctcacgcctgtaatcccaacactttgggagtccaaagtgggcagatcacttgatgtcagagttcgagatcagcctggccaacatggagaaaccctgtctctattaaaaatacaaaaaaatttagctgggtgtggtgggcgcctgcaatcccagctactccggaggctgaggtgggaggatcacttgaacccaggaggtggaggttgcagtgagccgagatcgtgacactctactccagtctgggtgagactctgtctcaaaaaaaaaaaaaaaaaagacactgaggtgggtggaggctgagacggctgccatgttatagtaagtgtaattgtgttgtgcgtagtgactttttgattattttaggtttttgattcctttgagtgggaaacccaaaattctgttttatgaaagtgtaactaacaaactaaatatctgagctccatccaactatgaaattctaagtaggttttggagccagatctgggataaaaattcaggtttcatcacttcagctgggatgtgggatttttggcaaggttcttttcctctctgagcctca

SEQ ID NO: 40299 - DNA, 601 bp, Human
taagtgaccattcctctgtcatctcccagtgccttcttggagaaaggaaatgtggtttcctcacataattaaaagcatgaagggatcactcacaggtaagtaatacatgctctttggtgagaatactaggtggtgtgaggcacagtcttgcagtgcaggtatggagacagggcacgtcagtgaactagtggtagaaaggagcaaatgccaagtgggaggcacagaatcacctccctttgcttccagcttgtggcgctttccttctgtctgtctacaatgctggcgttggtgtcttgccttractggccatgcagtatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaaggtaaaacccatggtgcctgtcagtgcacccagccaggggtcccccacgggagggccaggctgatggggggacatgtcgagtacatgaagcgtatccctgaaggtcagaggacagg

SEQ ID NO: 40300 - DNA, 601 bp, Human
ccattcctctgtcatctcccagtgccttcttggagaaaggaaatgtggtttcctcacataattaaaagcatgaagggatcactcacaggtaagtaatacatgctctttggtgagaatactaggtggtgtgaggcacagtcttgcagtgcaggtatggagacagggcacgtcagtgaactagtggtagaaaggagcaaatgccaagtgggaggcacagaatcacctccctttgcttccagcttgtggcgctttccttctgtctgtctacaatgctggcgttggtgtcttgccttgactggcyatgcagtatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaaggtaaaacccatggtgcctgtcagtgcacccagccaggggtcccccacgggagggccaggctgatggggggacatgtcgagtacatgaagcgtatccctgaaggtcagaggacaggcaaagct

SEQ ID NO: 40301 - DNA, 601 bp, Human
ggtatggagacagggcacgtcagtgaactagtggtagaaaggagcaaatgccaagtgggaggcacagaatcacctccctttgcttccagcttgtggcgctttccttctgtctgtctacaatgctggcgttggtgtcttgccttgactggccatgcagtatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatygagagtgacggcaagaaggggagcaaaggtaaaacccatggtgcctgtcagtgcacccagccaggggtcccccacgggagggccaggctgatggggggacatgtcgagtacatgaagcgtatccctgaaggtcagaggacaggcaaagctgcagagcaaaccaggatcagcacctagagagagcctcattccaccccaacaaacttgagtagagtatgaggttgatgtttaactctgacccagtctattttctccagactcatggattgtccagatgaaaccagaccattataagtaagc

SEQ ID NO: 40302 - DNA, 601 bp, Human
gtgcctttggagcctatattcctctgcttactggggaataagacagactgacctggcttggagacaaccagatgtgtccaagcctgaggaaagcttccacttttgttgttgttgcccttttttttttttctttttctctataagggagggaactgcagtggtagtttgtatcactagagactgcccaggagcctggcattatggggaccatcagcctgctttgcacaagatctactactagagagctcaacagattccttggaagagtgaaaaagcacatcaactttggagtcaaacagaygcaatttcaaatcctggctctgctgctgactgtcttgttttatttaaggaagccatgcatttcttcctttttaaaaatgaagatagttgtcttctactgcatagagggggagtaaataagacaatatttaggaaaagtcttgcccagtgctcaacattaactaaataataatatatcctgctccttgatccccaatccttaccattttctaattcaataaagcaagtgctttcatttctttggaagaatgtaacaatccagcccaagcccatttcttgtgttttcttttttccagaaaca

SEQ ID NO: 40303 - DNA, 601 bp, Human
gcttactggggaataagacagactgacctggcttggagacaaccagatgtgtccaagcctgaggaaagcttccacttttgttgttgttgcccttttttttttttctttttctctataagggagggaactgcagtggtagtttgtatcactagagactgcccaggagcctggcattatggggaccatcagcctgctttgcacaagatctactactagagagctcaacagattccttggaagagtgaaaaagcacatcaactttggagtcaaacagacgcaatttcaaatcctggctctgctrctgactgtcttgttttatttaaggaagccatgcatttcttcctttttaaaaatgaagatagttgtcttctactgcatagagggggagtaaataagacaatatttaggaaaagtcttgcccagtgctcaacattaactaaataataatatatcctgctccttgatccccaatccttaccattttctaattcaataaagcaagtgctttcatttctttggaagaatgtaacaatccagcccaagcccatttcttgtgttttcttttttccagaaacactgtttcagaaacatcttcgctttt

SEQ ID NO: 40304 - DNA, 601 bp, Human
ggaaagcttccacttttgttgttgttgcccttttttttttttctttttctctataagggagggaactgcagtggtagtttgtatcactagagactgcccaggagcctggcattatggggaccatcagcctgctttgcacaagatctactactagagagctcaacagattccttggaagagtgaaaaagcacatcaactttggagtcaaacagacgcaatttcaaatcctggctctgctgctgactgtcttgttttatttaaggaagccatgcatttcttcctttttaaaaatgaagatagwtgtcttctactgcatagagggggagtaaataagacaatatttaggaaaagtcttgcccagtgctcaacattaactaaataataatatatcctgctccttgatccccaatccttaccattttctaattcaataaagcaagtgctttcatttctttggaagaatgtaacaatccagcccaagcccatttcttgtgttttcttttttccagaaacactgtttcagaaacatcttcgctttttcctagaaaaagctaacatataaggcctttttgcaacagaagttcctgttgactggtcttac

SEQ ID NO: 40305 - DNA, 601 bp, Human
gctttgcacaagatctactactagagagctcaacagattccttggaagagtgaaaaagcacatcaactttggagtcaaacagacgcaatttcaaatcctggctctgctgctgactgtcttgttttatttaaggaagccatgcatttcttcctttttaaaaatgaagatagttgtcttctactgcatagagggggagtaaataagacaatatttaggaaaagtcttgcccagtgctcaacattaactaaataataatatatcctgctccttgatccccaatccttaccattttctaattcartaaagcaagtgctttcatttctttggaagaatgtaacaatccagcccaagcccatttcttgtgttttcttttttccagaaacactgtttcagaaacatcttcgctttttcctagaaaaagctaacatataaggcctttttgcaacagaagttcctgttgactggtcttacttttgtcctcagtcctactttttgtcatcatctgcaacaacattctgttgaaatccagttagggagcctattcatttttgttcgtcctaaagccaacattgtttaccttctgccacatcccaaagaatca

SEQ ID NO: 40306 - DNA, 601 bp, Human
tttcttcctttttaaaaatgaagatagttgtcttctactgcatagagggggagtaaataagacaatatttaggaaaagtcttgcccagtgctcaacattaactaaataataatatatcctgctccttgatccccaatccttaccattttctaattcaataaagcaagtgctttcatttctttggaagaatgtaacaatccagcccaagcccatttcttgtgttttcttttttccagaaacactgtttcagaaacatcttcgctttttcctagaaaaagctaacatataaggcctttttgcmacagaagttcctgttgactggtcttacttttgtcctcagtcctactttttgtcatcatctgcaacaacattctgttgaaatccagttagggagcctattcatttttgttcgtcctaaagccaacattgtttaccttctgccacatcccaaagaatcaagagtgaccactgtgaagacatagaaatgacagtctcatttcctttgcagaatggagttcctaacttcttgaaagacatggcaagagcctgtcagaactacctcaagaaaacctaagaaagagaactgggaacattgcatcca

SEQ ID NO: 40307 - DNA, 601 bp, Human
gggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataataygacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctca

SEQ ID NO: 40308 - DNA, 601 bp, Human
atgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgcttwgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactga

SEQ ID NO: 40309 - DNA, 601 bp, Human
ttctctaaatacataatgtcctcgggaagtttcgtgacgccttaggtcccattcctggcctgtttgggcgcagcttaatgtcgattcttttacttttttattagtcggctgtgaaagaactggatcttgtgactgctggaaaatttcgctttagtgtaaggtccgagtgcttcagccgtgggccacctttgaaaataaaatgtaattgttatttctcattttgccacatcctgtggagacagaagattagtgttgtgctttcattttttactttttccttggggaaaataatattgacagkggagttgagtataaggtaagacatggatctaggtggatgttgctagagggctgtgatttcatccaggtcttggaagagagttctccagctgatgtcattcttgccatctgattatgagtaggttatgttcaaggccgtcctgatccttaaaccacatttgcactccaggggctgtaatcagtttcatattttagctataccttctgatacacgtatctttcaaataattttttgtatttcataaattgaaatagccttaattctacaaactagaatgaaagctctcctcaaataacttgt

SEQ ID NO: 40310 - DNA, 601 bp, Human
ctttctagtgtatttcatagtgttagagtctaaagggtatgtgatagtagtcaggagatcaggattatgaaactggggctgccacttgtgtgaccttgtgtgtgatacttgaatgctgtaggccttcatttcaaaagcgagggggttggaatagaaacctctcagaccctaaatgtgtaagactccaattctgtggctaggcctggtaaggtaaagagtagcagaatatatcaagaactggaagggattagagagacctattatctaaattgctgtccctcctttgccccttgccttcccttttttttttttttttggtgaatttcatatgtaaatttaaaaaatgcagattagttataatcacactctgtttattataaatttggtcacatctaagtgccatggtggtagttactccttccatctctacttctgcatgggaaacattttgctcctttaactttgaaaatatgagggtgtaaatatacaatactataagaatggtgcttctgccaggtgcagtggctcatcctgtaatcctagctactcgggaggctgagacaggaggatctcttgaggccaggagtccgagaccagcttg

SEQ ID NO: 40311 - DNA, 601 bp, Human
tactataagaatggtgcttctgccaggtgcagtggctcatcctgtaatcctagctactcgggaggctgagacaggaggatctcttgaggccaggagtccgagaccagcttgggcaacataacgagaccatgcctctaaaaaaataaaaataaaaaaattagccggccatggtgatgcacacctgtcatgccagttacttggggggctaaggtgggaggattagtgagctgtgattctgccactgcattccagcctgggtgacagagtgagaccctctctcttaaaaaaaaaaaaaaaaaagtgtgcttcttaattattttgagattgtcagttcttttcaaaatctaatagagaaatggactctctgtccctttcaaagtctaatagagaaatggactctctgcctagaaaaatgcacacatagaatttagaatactttttgggctaccagggtacccctgtctaagatctgatgtatacccagagcctgtattaaaatttgttgcttcacaccatgccaccaattccctgcctctccttacaaagtactgttaataacaaaggccatttaaggattagcaattatgagagaaaaacctct

SEQ ID NO: 40312 - DNA, 601 bp, Human
tttgtacatcagtcacagattgaaaacagcaagtgttcatgcattgtatgatgtcatatttcttggcattctctgaatggcacactgtttctaatacacatttatccccaaataacaaataattgtgtaagtgtgtttaatgtttttatgtcagtttttcctaacatacaatactttaaatttgttaacctgtttgcccctttcccccaaatatgtttaatatcaatcagaacggtaatgtctaacagaaaacaatttggaaaatgttggactagagtatggtaaaatgtgttgaacgatrtaagaatgttggctttttccatactaaagtgggggcctgatttccatatgcttttcatggttaatttattatccctttccggccttgctgctgctttgtgaaatccgtagattagagtagtatctgagacttgctggttgcagtgagatttttctctcatagtttcgttttgttttaaatttattttctagttcctgcctaataaaaaggctggcaggtattattgaagagacatttttaccataggcctataaacattttttaaagaagagaggttttccccctggctgtaagaataat

SEQ ID NO: 40313 - DNA, 601 bp, Human
taaataggttcattcttttttttttttctcaacaaattctgagcaactgccttttttcaagaattggtctcagcacaatggttaaactggtgattaaacagatgagtccctgctttatgaaatttacattttctacctagtgtacattgttcactaaccctaacatgagtcagaaataacatgtaataaagaatggcttggttatatgcattttctcaaaaggagatacatagaaaacacttaaaagagcccaacctaaaaatctgttacctaaagtaagacatcccataattttcttcaratcagtggttctcagccttgattctacattaaaagcacctggtaagatttaaaaaaaaaaaaattcctgtcattaccttagaccaattaagcagaaattttttggaagctagactcaagattcccagaaaatttcattgtgcagctggagtttagaaccatgggtttcatttcatgtatgataaaagtcttaaattcaaaacagcagaaaacctttacatagtttcatttttctagagatcagtatttataaataattttgtgacacttgtcagtaagcgaacacatcttatttaagttc

SEQ ID NO: 40314 - DNA, 601 bp, Human
tggaaagtattgagattttcagaaaggaatcgagtacttttacttgctgtatgtccctcatttccatacattagtttacccaatatttattgaacactcaagatgtaacagtggacaaaactgacaaactttctgcccacatggagcttacattctagtaagggagacagacttaaataagtaagtagtgctatgaaggaaataaaacattataaggggagagagaatgactggagtggggactgcttagggaaagttcttagaggctgtcccatttgagcagaaatccctcaggtgaggrtctagagcaagcttgtccaactcatgggctgcatgtggcccaggatggctttgaatgtggcccaacacaaatttgtaaacttccttaaaacattatgagattttgtgcttttttttaagttccagctatcattagtgttattgtatgttatttgtggcccaagactattcttcttcttctaatgtggcccagggaaaccaaaacactggacacccctagtctagagggagatcatctcaggctgagagaggagcaaatatttcctgaggtgggaatcaggctactgtgttaaaggaacag

SEQ ID NO: 40315 - DNA, 601 bp, Human
aaaactgacaaactttctgcccacatggagcttacattctagtaagggagacagacttaaataagtaagtagtgctatgaaggaaataaaacattataaggggagagagaatgactggagtggggactgcttagggaaagttcttagaggctgtcccatttgagcagaaatccctcaggtgaggatctagagcaagcttgtccaactcatgggctgcatgtggcccaggatggctttgaatgtggcccaacacaaatttgtaaacttccttaaaacattatgagattttgtgctttttttwaagttccagctatcattagtgttattgtatgttatttgtggcccaagactattcttcttcttctaatgtggcccagggaaaccaaaacactggacacccctagtctagagggagatcatctcaggctgagagaggagcaaatatttcctgaggtgggaatcaggctactgtgttaaaggaacaggaagaaagcgtgtgtactggagcatagagtgtgttaaggagaaggcagatggtgagagatgccattcaaatggtaaagagatggattgtattccaattgtggtggaaagtagggaa

SEQ ID NO: 40316 - DNA, 601 bp, Human
aggagatacagtgaaggtatagctgacaggatttgtgggtggattgggtatggaggataattaaaaagagcaatcaggcgggtgcagtggctcacgcctgtaatctcagcactttgggaggccgaggcaggcggattacgaggtcaggagatcgagaccatggctaacacggtgaaaccccgtctctactaaaaatacaaaaaattcaccgggcgtggtggcgggtgcctgtagtcccagctacttgggaggctgaggcaggagaattgcttgaacctgggaggcggagcttgcagtgagcgagatcacgccactgcactccagcctgggcgacagagcgagactctgtctcaaaaaaaaaaaaagagagcaatcagagataactccatgttttaggcatgagcagtgaggtagattgtgctgccaataattaggatgtgaaagattgagataagagcaggtttagggtagggaagtgaggaatcaagaatttcactttgacataagaatgagacatttttccgataaccggtggacatggtggtcattggcatttaggtggcattcaaggtcatgtgattagagtggtgacttcaggaaa

SEQ ID NO: 40317 - DNA, 601 bp, Human
tttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaraattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaacca

SEQ ID NO: 40318 - DNA, 601 bp, Human
aagctaaggaaaaatacacaaacaagaaacaattccacatgctctggagtcagcctaagattgggggggtgagggcccggtgtgtgcagcgcgagacagctgacccttgacaatctcctaagggctatttcttggggtcccccatctcaaagggctgggagcctctaggatttctaaccagtatggctgagggtctaaagggacgtgtcttggtgcctcaagggggtgcctcacatcttcctggaacgcccagcttgatgctgggaagcagactggagggggtcccacagagctggaagcyctggggacgcaggcagccctggcgggacagtggcagagaaggtgggaagctctgccttttcgtgggcctcgtcctgcacttgagcaaggagggcctggccgaggccatacctgctcgccatcctcaatcaggactatgctttgacttcctaaggaagttccctgaatttcatgcaatgcaccaggagagcagagagagagtctagggtctcatgtaacgttctccataatgatgagccccccactccgctcactttattggctttgaacactatgcccttaagacctgtttccaaatgag

SEQ ID NO: 40319 - DNA, 601 bp, Human
tcccaccctcctcgctccttttcctcctcaaatctatcatccattcctcagcctgtgttgcttcggcacttcccgggtgaaagtctatattgtgaaatctggggagacatgtgttgtgtggagcctggcagcctggcggatttataaaaggcaacttgttttttcacattcatgtggaaaaacaatgttctgtcaaccagctgggaagctaaggaaaaatacacaaacaagaaacaattccacatgctctggagtcagcctaagattgggggggtgagggcccggtgtgtgcagcgcgagrcagctgacccttgacaatctcctaagggctatttcttggggtcccccatctcaaagggctgggagcctctaggatttctaaccagtatggctgagggtctaaagggacgtgtcttggtgcctcaagggggtgcctcacatcttcctggaacgcccagcttgatgctgggaagcagactggagggggtcccacagagctggaagctctggggacgcaggcagccctggcgggacagtggcagagaaggtgggaagctctgccttttcgtgggcctcgtcctgcacttgagcaaggagggcc

SEQ ID NO: 40320 - DNA, 601 bp, Human
gtcagggtctaacaagatctccccctcttctcccaccctcctcgctccttttcctcctcaaatctatcatccattcctcagcctgtgttgcttcggcacttcccgggtgaaagtctatattgtgaaatctggggagacatgtgttgtgtggagcctggcagcctggcggatttataaaaggcaacttgttttttcacattcatgtggaaaaacaatgttctgtcaaccagctgggaagctaaggaaaaatacacaaacaagaaacaattccacatgctctggagtcagcctaagattgggsgggtgagggcccggtgtgtgcagcgcgagacagctgacccttgacaatctcctaagggctatttcttggggtcccccatctcaaagggctgggagcctctaggatttctaaccagtatggctgagggtctaaagggacgtgtcttggtgcctcaagggggtgcctcacatcttcctggaacgcccagcttgatgctgggaagcagactggagggggtcccacagagctggaagctctggggacgcaggcagccctggcgggacagtggcagagaaggtgggaagctctgccttttcgtgg

SEQ ID NO: 40321 - DNA, 601 bp, Human
atgtcagggtctaacaagatctccccctcttctcccaccctcctcgctccttttcctcctcaaatctatcatccattcctcagcctgtgttgcttcggcacttcccgggtgaaagtctatattgtgaaatctggggagacatgtgttgtgtggagcctggcagcctggcggatttataaaaggcaacttgttttttcacattcatgtggaaaaacaatgttctgtcaaccagctgggaagctaaggaaaaatacacaaacaagaaacaattccacatgctctggagtcagcctaagattgsgggggtgagggcccggtgtgtgcagcgcgagacagctgacccttgacaatctcctaagggctatttcttggggtcccccatctcaaagggctgggagcctctaggatttctaaccagtatggctgagggtctaaagggacgtgtcttggtgcctcaagggggtgcctcacatcttcctggaacgcccagcttgatgctgggaagcagactggagggggtcccacagagctggaagctctggggacgcaggcagccctggcgggacagtggcagagaaggtgggaagctctgccttttcgt

SEQ ID NO: 40322 - DNA, 601 bp, Human
gaatttagggaggaggagaagagagaggagaagagaagctggccattgaagagtccacagccctctcttccaggctaggtctttgtccagcccacttctgcttctgttaagggaagggcagtgagggcctgagcctcaaggaaggggctggggaggggctgcagcctctaaagcaatctgcactgtaaacaaagagtccttaacttataaaacccttccctcaggcccccaggcttgggctgtggagagcaagagcctgcgggaaaatggcggcccaagctggcagctggctcagagctcrgaggccctggccggctggcgtgggaaataaacaggtgggaaaatgttaagcaaccccagctgggtcaaggccttgcggcctgggtgtgtgtcttgaatatgtctgtgcctctccttccccagacacgactacgactgccagtgggcccaaggtgtgagggagcagacagttattgattcccctactccaactctacacacaagaggggtcctcaggcttggcgaggaccgatggggacggaagaatggtccgaccccgctgcacatcctctggccaacctcgaaggctgccctcctctct

SEQ ID NO: 40323 - DNA, 601 bp, Human
aagggatgaatttagggaggaggagaagagagaggagaagagaagctggccattgaagagtccacagccctctcttccaggctaggtctttgtccagcccacttctgcttctgttaagggaagggcagtgagggcctgagcctcaaggaaggggctggggaggggctgcagcctctaaagcaatctgcactgtaaacaaagagtccttaacttataaaacccttccctcaggcccccaggcttgggctgtggagagcaagagcctgcgggaaaatggcggcccaagctggcagctggctcrgagctcagaggccctggccggctggcgtgggaaataaacaggtgggaaaatgttaagcaaccccagctgggtcaaggccttgcggcctgggtgtgtgtcttgaatatgtctgtgcctctccttccccagacacgactacgactgccagtgggcccaaggtgtgagggagcagacagttattgattcccctactccaactctacacacaagaggggtcctcaggcttggcgaggaccgatggggacggaagaatggtccgaccccgctgcacatcctctggccaacctcgaaggctgccct

SEQ ID NO: 40324 - DNA, 601 bp, Human
ggttatatagtagctctatctttaaccttttgaagaactgtcgaactattttctaaagtggccacaccatttttttggtctttgagacagggtcttgctctgtcccccaggctggagtgcagtggcgtgatcatggctcactgcagcctcgacttcctgggcttaagcaatcctcgcacctcagcctcctgtgtagctgggactacagacatgtaccaccacatccgtctaatttatttttaaattttttgtagtgatggggtctcatatattgtccaggatgttatggctgcaccatctyaaattcccaccagcattgtttgaggggttcagtttctccacatcgccattgatgcttggtattgtctctcattcactttttaacacaacctgaagttggtgtcctcacccttattttagagatatgtaactaaagtgtgtaagaagtgacttgccccaagttgatcagatgaagcaatggtggaggaggcgctcttgactgagcccacacgtgggcagggtggccttgggaaagttgtttaagcaacgagaacttcaattgcctcatctctaaaatggatatagtttgatttaccgaaag

SEQ ID NO: 40325 - DNA, 601 bp, Human
atgctgctgtgaacaccgtgttcaattttataagtggacatatgttttcagttgtcttgggtatatatctaagagtggaatttggtaggttatatagtagctctatctttaaccttttgaagaactgtcgaactattttctaaagtggccacaccatttttttggtctttgagacagggtcttgctctgtcccccaggctggagtgcagtggcgtgatcatggctcactgcagcctcgacttcctgggcttaagcaatcctcgcacctcagcctcctgtgtagctgggactacagacatgyaccaccacatccgtctaatttatttttaaattttttgtagtgatggggtctcatatattgtccaggatgttatggctgcaccatctcaaattcccaccagcattgtttgaggggttcagtttctccacatcgccattgatgcttggtattgtctctcattcactttttaacacaacctgaagttggtgtcctcacccttattttagagatatgtaactaaagtgtgtaagaagtgacttgccccaagttgatcagatgaagcaatggtggaggaggcgctcttgactgagcccacacgtg

SEQ ID NO: 40326 - DNA, 601 bp, Human
ctttttagggctgaataatattccattgtgtgatataccacattttgtttatccactcatcaggacatttgggttgtttctactttttggctaccatgaataatgctgctgtgaacaccgtgttcaattttataagtggacatatgttttcagttgtcttgggtatatatctaagagtggaatttggtaggttatatagtagctctatctttaaccttttgaagaactgtcgaactattttctaaagtggccacaccatttttttggtctttgagacagggtcttgctctgtcccccaggytggagtgcagtggcgtgatcatggctcactgcagcctcgacttcctgggcttaagcaatcctcgcacctcagcctcctgtgtagctgggactacagacatgtaccaccacatccgtctaatttatttttaaattttttgtagtgatggggtctcatatattgtccaggatgttatggctgcaccatctcaaattcccaccagcattgtttgaggggttcagtttctccacatcgccattgatgcttggtattgtctctcattcactttttaacacaacctgaagttggtgtcctcaccct

SEQ ID NO: 40327 - DNA, 601 bp, Human
aggttcacacgtgtggtagcatggattagtacttcctttttagggctgaataatattccattgtgtgatataccacattttgtttatccactcatcaggacatttgggttgtttctactttttggctaccatgaataatgctgctgtgaacaccgtgttcaattttataagtggacatatgttttcagttgtcttgggtatatatctaagagtggaatttggtaggttatatagtagctctatctttaaccttttgaagaactgtcgaactattttctaaagtggccacaccatttttttkgtctttgagacagggtcttgctctgtcccccaggctggagtgcagtggcgtgatcatggctcactgcagcctcgacttcctgggcttaagcaatcctcgcacctcagcctcctgtgtagctgggactacagacatgtaccaccacatccgtctaatttatttttaaattttttgtagtgatggggtctcatatattgtccaggatgttatggctgcaccatctcaaattcccaccagcattgtttgaggggttcagtttctccacatcgccattgatgcttggtattgtctctcattcac

SEQ ID NO: 40328 - DNA, 601 bp, Human
attccttggagaggggctggcttcagatcagtcaaaggaggtggggtcaagagagaagcctacgtcttatactcgatgctgtagaccgtgtctggggtgccctctggcccgctgtcccacgtcaggatgttttcaaagttgctggactggaatttcacgtgctggagcagatccgaggggtcctcaggggcgtgagctgcaggagggtgggaggagggtgagcaggggctttcccagggtcaccctgcccatgtatgggctcagtcagagtcctgccccatataaatttcatgcaaagtgyctttgctttcaagatgccagcctggtgggtgggcagggagaccctggcccccagccttctacaaatggaccagcaagaggggatgctccccacgctgttctaaccaaccatccattctcagccattttgctttgcaatgggttgtgattcacattccataaatgtcaccaccttacagtgttcagttcaatggtttcttagcattttcacaacgttgtgcaatcatcgctattatctaattccagaacatttttagcaccccaaaaagaaactgcatgcccattagcagtcactccaccc

SEQ ID NO: 40329 - DNA, 601 bp, Human
cgtgaggttacctgcccaaggttatacaggcgagagcggcatttaagcccagacagcctgaccctatcacctgtactttttacccttatattattctccctctgcaaaagaaacataaaggagcaaagctttatctgggaggggctatgtgacaccagtcctggtggggacatgggaacatatggagaggaggggaattccttggagaggggctggcttcagatcagtcaaaggaggtggggtcaagagagaagcctacgtcttatactcgatgctgtagaccgtgtctggggtgccctcyggcccgctgtcccacgtcaggatgttttcaaagttgctggactggaatttcacgtgctggagcagatccgaggggtcctcaggggcgtgagctgcaggagggtgggaggagggtgagcaggggctttcccagggtcaccctgcccatgtatgggctcagtcagagtcctgccccatataaatttcatgcaaagtgtctttgctttcaagatgccagcctggtgggtgggcagggagaccctggcccccagccttctacaaatggaccagcaagaggggatgctccccacgctgttctaac

SEQ ID NO: 40330 - DNA, 601 bp, Human
ccagtctgagtccacattctgggctcgtcatcaccatagtcctttgatgtgggccctgttatccccattttacagatgagagaaatgaggctcagagagggggaagtgacttgctacaggacaacgtggcatgaccaggagtggaagccaggtttgaggactcctgagcccaggccacccctcctcacctgcatgggagggagaggagcaggaacaggagcgtgggctagaggggctgggtgcatcttcggttgacctagtctcactaataataataaaacaattattggtagcttataawtttccaggcacaagtgctaatgactttatcttgtttaacccacccaacaaccctgtgatgaaagtgctatcattgtcctcactttgtgggtggagaaactgaggcttcgtgaggttacctgcccaaggttatacaggcgagagcggcatttaagcccagacagcctgaccctatcacctgtactttttacccttatattattctccctctgcaaaagaaacataaaggagcaaagctttatctgggaggggctatgtgacaccagtcctggtggggacatgggaacatatggagaggagg

SEQ ID NO: 40331 - DNA, 601 bp, Human
tgtgttgaggagatctctctaaatgctctgtggagaatgggctggaggaggtggtaaagaggagagttggggaaacaagttaggtggccttgactgcagtcgggggtcaagataagggtggtctgaactagggaggttggggtggaggtggagaaaagtgaacaaacctgctaggaacacactgtaattggtgggggtggggggcttccctaaaagccacatccccagctgcccctccccttgcagagagccccttctggaccctccacccactccagaggggaagaggccatcccacccygcaaacacctgcgctttcctcttccctcccctgaaacccacaggggctccaactcactgtgctgcagagagctgaacctgtcagtcatcttggtggctgaccggcctcccgcactgacagcggtgaccctggcatagtagagctccgtgaggttgcccgtctccaccgtcaggttgcaggacttccgggtgatccgctgacagcccttctttgccacccagtccctctctccgtacctgcaggtcaggaaggggccaagtcaccgtggtgatgaaaaggccagcgctaggcctgtggctt

SEQ ID NO: 40332 - DNA, 601 bp, Human
tggggacatggccaaaccatatcagcaactgctgtccactcaaccattcatttactgaatatcttttttatttttttgagataggatctcactgtgtcacctaagttggagtgcagtggggcaatcccagctcactgcagtcttgacctcctgggttcaagctaccctcccacttcaacctcctgagtagctgggactacaagtgtgtgccaccacacccagctaatttttaaattttttgtagagatggggtctcactgtgttccccaggctggtcttgaactcctaggctcaagtgatsctcttgcctcagcctcctaaagtgctgggattacaagtgtgagccaccacgcctggctattgagaatcttctatgtgccaggcactatgctgagggctgggaatgcagtggattctgccgcccacacatacagttctagagctcacattttagagggggaggcagatgataacatgtgtgagcaaacacagtaattgcagcgtgtgatctgagcgatgaagacaataagccctgtattgcactagagaatcacagatggtggcctacagaaatcaggtcatcagggctggaggtggggac

SEQ ID NO: 40333 - DNA, 601 bp, Human
ggtcatgcctttggcttgcccccacacatcccagccccctgcgtccccaccttaagtcagcctagagcacccttcctccctcatctattgagtatgacagctttggggatgtcaatgacatcaactacacatcctaaataatgtttggggcctaatactattgatgcagcctcaaagatcaggctgaagacttctgtctctctcaagatggaattttccaaataaccaaattacctttgctggtttacagactcctttgagaatgtgatgaatgctgtgggtcttcttcctgccaaaatgyatatatacaaaaatcttgcatccaacttcagggattcatggacctcatttaccctgaatctaatttgtaaaaattcctcaatgatcctttggcctccaagattgaagatatctgagtcagaacaatgtttacttcagtgctgctaataaaattgaaaaactgagctgtatgtcctcaaaaagggaaatacataagtaaattagagtatctccctagaatggattattttgcactgtgaaatatcttgttgtgcaaaatgtttaatgatatgggtaaatgttcatgataccaatatatgga

SEQ ID NO: 40334 - DNA, 601 bp, Human
gtggagctcctgcgggctccctgggtccagacaccctgatctgggagtactggacaggctgggccagactgctggggccgctgaggtcaaagacagggatcaggacgtgctcctggatgaagcgcagcggctggaaagtcaggactcgctggacgttctgtgcagggacgacaacagtcacccccctgtggttagggtaagtcccaagctccctactggtgatgtgggtgggtgaggtcctccatagggaggcatctgggggctttttcaagatgcgtctgtcccatatccccatctgctycccagagactcctctaggtgcaagtgcctctctgaagggacagggtctctcagctctttggttctaaagcctgggttatctcagggagagagatctgggctctggtttctccaggaggcggataatccagggagtagatgaccaggatttggggttgccttggggcatgatctcgaggtggtggcccgcattgttgcttggcccacgggtccctgagggcctaatacagggtcagggtgggaaaagaaggagccaggagagaccgggagagctttacagaaaatgcttcatctggacttg

SEQ ID NO: 40335 - DNA, 601 bp, Human
ttctctcaagggcacccgtctgaggccagatcgcagagtgtgtggcatgggcaggcatgggattgacagccaaggatgtgacactgggtagggacagggaggaagcaccaagcctttcccattcccctcaggactcccactgcacagtcagggccaggcctctgaaaagagaatccagttctgtgggctgctccaggtctgaggtctcaggggctgggctcttggcttcatccttgggacacacaagggactccagcaggccccagggacttggaccttggtccgagggggaacatggacsggaaggaggttgcaaagggagggacatggggtggccctcgatctggactgaggagaggagggggagctggccctttaggtactgtggtgtcccttcctccccactgtgtagcacatttgggtcagatgttctgtctgtgcaaatccccaggggctggtgcaatgattttgcttcttgggattcctccatagccaaggaggtcacctcctgcagagaaaggccacctaacatgcagcttccagctggtggctctttctgaagctgacctttaggcctaaggtgtttaggactagaaagtgt

SEQ ID NO: 40336 - DNA, 601 bp, Human
ccaggaatggggcaaggagaggcaaattccctgagcactttgaatccatggtgttaggaggtggggctctggacctcgggagtttccctgcatttcctccttgcactgtcatttctgccttgcagggctcagcgagcacgcgcttgtctacacaagctgctccccagagctcccccgctgcagtccttatcatgctgctttgttccggtgaggagcgcacccatggcaggggccctgcatgccactccctctgcttctctcaagggcacccgtctgaggccagatcgcagagtgtgtggcrtgggcaggcatgggattgacagccaaggatgtgacactgggtagggacagggaggaagcaccaagcctttcccattcccctcaggactcccactgcacagtcagggccaggcctctgaaaagagaatccagttctgtgggctgctccaggtctgaggtctcaggggctgggctcttggcttcatccttgggacacacaagggactccagcaggccccagggacttggaccttggtccgagggggaacatggaccggaaggaggttgcaaagggagggacatggggtggccctcgatctgg

SEQ ID NO: 40337 - DNA, 601 bp, Human
ttccaggcctggttcttttccaggctctcttcccacctttgaacaatgacagaagaggcaggggcctcatgctctgtcgagctagattgtgaaactggccaggaatggggcaaggagaggcaaattccctgagcactttgaatccatggtgttaggaggtggggctctggacctcgggagtttccctgcatttcctccttgcactgtcatttctgccttgcagggctcagcgagcacgcgcttgtctacacaagctgctccccagagctcccccgctgcagtccttatcatgctgctttgytccggtgaggagcgcacccatggcaggggccctgcatgccactccctctgcttctctcaagggcacccgtctgaggccagatcgcagagtgtgtggcatgggcaggcatgggattgacagccaaggatgtgacactgggtagggacagggaggaagcaccaagcctttcccattcccctcaggactcccactgcacagtcagggccaggcctctgaaaagagaatccagttctgtgggctgctccaggtctgaggtctcaggggctgggctcttggcttcatccttgggacacacaaggg

SEQ ID NO: 40338 - DNA, 601 bp, Human
ccccaccctcaccccctgcggattcagaagctgctccaccgagcccgattgtgtcataaaatattttattggaaaaaaagtcaccgtcttcgcaagagggggtaggggccccagcgacatcggggacccggcctccaggccgagccgacgggttgccccggggcaatctcaggccgttgtggcctgagcccaaccgctgggtccccgacgtccagaagcgggtgtgtgcctggaggctccccggccgggagggcaggccccagacggggtgggggtgcaggcgaggagcggggcgtgaatrcgcgtggagcgctctgcgccacggagctcagggtagagactgtagcttccgccgggctggatgcgagtctcccaggttagagcccagaagcgcgctgggacctgggtctggcttttgggtctgtgtccttcctcgtttggccccaattgtccgcattcaagatcataataaaaaggcttaggaagtaaacttcttggacgcggaagggccggctcgcgggtttccgccgagtgagggggctgcgggtggcgcgggcatcccaggccccgcaccgtataccgccctcagtcctcgcggctc

SEQ ID NO: 40339 - DNA, 601 bp, Human
agggtagagactgtagcttccgccgggctggatgcgagtctcccaggttagagcccagaagcgcgctgggacctgggtctggcttttgggtctgtgtccttcctcgtttggccccaattgtccgcattcaagatcataataaaaaggcttaggaagtaaacttcttggacgcggaagggccggctcgcgggtttccgccgagtgagggggctgcgggtggcgcgggcatcccaggccccgcaccgtataccgccctcagtcctcgcggctcctgtcgctgggctcgcccggcacctccgcsggtttctctgcatccttggcgcgctcctgctcagtaagctgctcgctcgttggaattgagttcttcttgggccgccccttgggcttggtgggagactccaggccgccgccctgcagcacctgcacgggggaccgccagcacctgggtgagccagcacgtggactggggacccccgaggagacttgaacccaggtaggactaaggagtgcagggtccatatgaggaaatggtggggaaatgtcccgggaaatggcggccatttgtccaaatgccgcctggggagcggcccggcctggggag

SEQ ID NO: 40340 - DNA, 601 bp, Human
caggtaggactaaggagtgcagggtccatatgaggaaatggtggggaaatgtcccgggaaatggcggccatttgtccaaatgccgcctggggagcggcccggcctggggagcataagactgccaggaggcctgaaggtgccgcgggaaaggacgaaatgttggcttacccaaggggcagaaaaaactgagaggattccggtgcgtaccaggcaccgagggaatcggggggttgggcagagtctcagtggggagaaagaggagagcagctctgcatgcaccggggcatggcccaggaagctraggggtgggaagccaccaggcacactcactattttcttccacttcatcctccgattctggtaccacgtcttcacctgcaactggctcaggcccagggactcagcaagatctattctggaaagagcagggcgcaccctcagcaaggcaagtgaccacactcccacagcccgctggccccagccttgtaccgccctacctgtccggcgtggaaaggtacttctgcttctcgaagcgtttctccaggcccatcagctgcagctcggtgaacacagtgcggctccgacgccccttcttggcttt

SEQ ID NO: 40341 - DNA, 601 bp, Human
agatctcggggttcctgatgaacatgtttgcagctgcgagaaactcggagtgtgtcttgtctttcggggaaagtagaaaccaaaaagaaaacggcagctggtcctaagaagatggcgtttgctccaaccaaatcagccttgctgcgttagaaaaagaacatgcacggagcgtgcacatttgctcttccgtgcgtggcacaacagccatgcggtggccaggagtcatctgggccggagttgggtgcttcccggaaattccaaagtaccctgagaacctggaaattattgttcacgttttctrttttcagacgcttccccatgcagatgtttccattttcttcagtcctaaaatgattgtgtgcccgcttcaaacgaattagtagcaacagagcagatggagacgaaaggtagccgaatggccgagtcccagctggacttagaaggagcgcgctggccctgccgtctccaggctagggagcaccgactaggaggtgggggggtgcagggaaggcgacttgaagggctggggtcccggctacagcgtaggagcctcccttccccgacaggcctgtcactgaggtgcgagtcctagcctggctgg

SEQ ID NO: 40342 - DNA, 601 bp, Human
aatcagccttgctgcgttagaaaaagaacatgcacggagcgtgcacatttgctcttccgtgcgtggcacaacagccatgcggtggccaggagtcatctgggccggagttgggtgcttcccggaaattccaaagtaccctgagaacctggaaattattgttcacgttttctattttcagacgcttccccatgcagatgtttccattttcttcagtcctaaaatgattgtgtgcccgcttcaaacgaattagtagcaacagagcagatggagacgaaaggtagccgaatggccgagtcccagytggacttagaaggagcgcgctggccctgccgtctccaggctagggagcaccgactaggaggtgggggggtgcagggaaggcgacttgaagggctggggtcccggctacagcgtaggagcctcccttccccgacaggcctgtcactgaggtgcgagtcctagcctggctggagtcggaaagggcagggcaaggcgcaggtaaatgtggggcagaggacccgtagggaaaaggtgggagatgggaggcaggccgaccccaatgagagaagcgagggaggccgaccggcagacggttggaaag

SEQ ID NO: 40343 - DNA, 601 bp, Human
tggcacaacagccatgcggtggccaggagtcatctgggccggagttgggtgcttcccggaaattccaaagtaccctgagaacctggaaattattgttcacgttttctattttcagacgcttccccatgcagatgtttccattttcttcagtcctaaaatgattgtgtgcccgcttcaaacgaattagtagcaacagagcagatggagacgaaaggtagccgaatggccgagtcccagctggacttagaaggagcgcgctggccctgccgtctccaggctagggagcaccgactaggaggtgggggggtgcagggaaggcgacttgaagggctggggtcccggctacagcgtaggagcctcccttccccgacaggcctgtcactgaggtgcgagtcctagcctggctggagtcggaaagggcagggcaaggcgcaggtaaatgtggggcagaggacccgtagggaaaaggtgggagatgggaggcaggccgaccccaatgagagaagcgagggaggccgaccggcagacggttggaaagcgagatagggaaagacaagacgagggtggagtgcgatggagacagcaccatcagggcagagca

SEQ ID NO: 40344 - DNA, 601 bp, Human
cctccaagaaagcagtggacccacgccccccctcacatgagaacgtagcccgggctggttgcaggctggatggtgctggaccgcccggccctgcatgaagttctgattcctcttgctggtcccacagctcagggggctgcttcagcaatgctctggggcccagatgctcaccccttgccattggtgcatgtccccccacttgacctcttgggttccttacttcttgggctgagaaaatcactgccccagggcagttgctcctttttgtctttttggtccctgatgacagattacttccgcrctctgcttagcttatttctagatggtttccaccatagcctggcatggtggctcacacctataatcccagcgactcaggaggctgaggtgggagaattgcttgagtccaggagctcgagactgcagtgagctgtgattctcaccactgcactccagcctgggcaacagagcaagaccctatctttaaaaataataataaaaaaataaataaaaagagcaagagagagatggacttttccccatttctgtaaggaagctccagaagtgtatcttctcactgagctgcttttttctggggctg

SEQ ID NO: 40345 - DNA, 601 bp, Human
ggtgctggaccgcccggccctgcatgaagttctgattcctcttgctggtcccacagctcagggggctgcttcagcaatgctctggggcccagatgctcaccccttgccattggtgcatgtccccccacttgacctcttgggttccttacttcttgggctgagaaaatcactgccccagggcagttgctcctttttgtctttttggtccctgatgacagattacttccgcactctgcttagcttatttctagatggtttccaccatagcctggcatggtggctcacacctataatcccagcractcaggaggctgaggtgggagaattgcttgagtccaggagctcgagactgcagtgagctgtgattctcaccactgcactccagcctgggcaacagagcaagaccctatctttaaaaataataataaaaaaataaataaaaagagcaagagagagatggacttttccccatttctgtaaggaagctccagaagtgtatcttctcactgagctgcttttttctggggctgacatgttagctgcacgcctgggactgctgcttacgtatatacttttgtgatttctgaaggccttggtgctg

SEQ ID NO: 40346 - DNA, 601 bp, Human
acacagtgctcccacccacgccggcacaagcatctcacactgggtggggctgtcatgggccctgctgccctagcagcctccctgggccctacaggccgcctggtactcatagtagcaagattgtccttagaacatgagcacggctggcaggctgggtggatgggtggcgctgcccaagggacccaccattcccttcacctcttctcctcttgtggagcagggagcggcatctgcacacagtaggaggcacctgcaggggcagctggggtgctttccccaaagactccaccattcatgatgrgcagagagggggtgtcataggtcgccccaccctacgtgtatgtgcaccatgggcagcagacttgctgaacttgggtagcatttcagggcaccaaggcaggctcaactgacagccctgggttccttggacccaactgtctccaagtgagagtacggagaccctgaaggagccctcagagattcataaaaacgcagccaacactaggatacaaccaggtgtttaagatccactcattgatttattaaatgaatcttaattgagcacctgggtgttctgggcactgtgctagacagggaagtt

SEQ ID NO: 40347 - DNA, 601 bp, Human
tggcaggctgggtggatgggtggcgctgcccaagggacccaccattcccttcacctcttctcctcttgtggagcagggagcggcatctgcacacagtaggaggcacctgcaggggcagctggggtgctttccccaaagactccaccattcatgatgggcagagagggggtgtcataggtcgccccaccctacgtgtatgtgcaccatgggcagcagacttgctgaacttgggtagcatttcagggcaccaaggcaggctcaactgacagccctgggttccttggacccaactgtctccaartgagagtacggagaccctgaaggagccctcagagattcataaaaacgcagccaacactaggatacaaccaggtgtttaagatccactcattgatttattaaatgaatcttaattgagcacctgggtgttctgggcactgtgctagacagggaagttcctagctcaggcacagccgtggcctggaggctcccacccgtggagtcactgcctaccctgccctggggggacaggtgtgcatggaacctgcgtgtccttttccttggagctgctctcagcccagatcttgatggctgtcccccc

SEQ ID NO: 40348 - DNA, 601 bp, Human
gtgatctcgaactcctggcctcaggtgatctgcccgcctcggcctcccaaactgctgggattacaggcgtgagacattgagcctggaccccccaaaaatgtttaagttagcagagcgaggtggtgggtgcatgaggtcccagctacttgggaggctcagatgggaggatgacttgagcctgggctctcaaggctgcagtaagctgtgactgtgccacagcgctccagcctgagcgacagagtgagacatcgtctcaaaaaaaacaaaaaagaatgtgacatatggaaccttttggcttcastttaccttaaaggccctgccttcagatacggtaacgttctaaggtactgggggttagggcttccacgtgaatttgagtggggaggggagatgttatcataactaggactagaaggtggcctcccaggggcatgggctctgtcccctacatcaacatccaacaatgtgtcagcttcatcatttggagacaaaaacagtagagcttccctgaactttcagcagggacgctaatgagaaggggggactttgtcatagcccacatgtaagagggtccctgccagtccagtgatgtcagggtcta

SEQ ID NO: 40349 - DNA, 601 bp, Human
atgatgggctcttcccccgcgtgcagcagtggagccaccagcagcgggtgggcgacctcttccagaagctggtgagtaacccagggccggtgctgggactacaggcgtgtaccaccacgtccagctaattttttgcatttttagtagagacagggttttgctatgttggccaggctggtctcaaactcctaacctcaagtgatccacctgcctcagcctcccaaagtactgagattacaggcgtgagccgccatgcccagcctttttttttttttttctaatttatatttatttagatagktatttttaaaaagagatggggacttactacgttgtccaggctggagtgcagtggctattcacaggcgcaattccactgctcatcagcacgggagttttgacctccttcctttccaaccttggctgtttcactccttcttaggcaaactgatggttcccgactcctgggaggtcaccatattgatgccaaacttagtgtgtagtgcactacagcccagaactcctgactgaagccatcctccggcctcagccttccgcgtagctggggctataggtgcacgccaccacaccctgtgtgtgg

SEQ ID NO: 40350 - DNA, 601 bp, Human
ggcgggcccgggtgagggcgggcccgggtgagggcgggggcggagaggcgaagaagctgcaggaagggagggtgacgagggggaagcgaaggaaggggaagaggaagggaaaagcgagcgagaggggcaaggcggaagaggaagcagggcggaagggaagcccgggccgcagacggcgaaggaggcagcgggccgggggctgaggcgggagcgaggacacgcccaagagaggaagcagagggaggcggaagcgtggaggaaggggcgagaggcatcatcaaaggagatgaggggagcgtakgggccgggaaagaggcacaaggaagaaagtatgggaaggaggaatggagggtcagggctaggcggcgggagggcgccaggccgggaagagtacaaggacaaggaggtcaggtttgggcctacatcccggggacaggggcggccatggcggcggcagccagggaggaggaggaggaggcggctcgggagtcagccgcctgcccggctgcggggccagcgctctggcgcctgccggaagtgctgctgctgcacatgtgctcctacctcgacatgcgggccctcggccgcctggcccaggtgt

SEQ ID NO: 40351 - DNA, 601 bp, Human
aggcggaagcgtggaggaaggggcgagaggcatcatcaaaggagatgaggggagcgtaggggccgggaaagaggcacaaggaagaaagtatgggaaggaggaatggagggtcagggctaggcggcgggagggcgccaggccgggaagagtacaaggacaaggaggtcaggtttgggcctacatcccggggacaggggcggccatggcggcggcagccagggaggaggaggaggaggcggctcgggagtcagccgcctgcccggctgcggggccagcgctctggcgcctgccggaagtgctrctgctgcacatgtgctcctacctcgacatgcgggccctcggccgcctggcccaggtgtaccgctggctgtggcacttcaccaactgcgacctgctccggcgccagatagcctgggcctcgctcaactccggcttcacgcggctcggcaccaacctgatgaccagtgtcccagtgaaggtgtctcagaactggatagtggggtgctgccgagaggggattctgctgaagtggagatgcagtcagatgccctggatgcagctagaggatgatgctttgtacatatcccaggctaatttcatc

SEQ ID NO: 40352 - DNA, 601 bp, Human
aatggagggtcagggctaggcggcgggagggcgccaggccgggaagagtacaaggacaaggaggtcaggtttgggcctacatcccggggacaggggcggccatggcggcggcagccagggaggaggaggaggaggcggctcgggagtcagccgcctgcccggctgcggggccagcgctctggcgcctgccggaagtgctgctgctgcacatgtgctcctacctcgacatgcgggccctcggccgcctggcccaggtgtaccgctggctgtggcacttcaccaactgcgacctgctccggcrccagatagcctgggcctcgctcaactccggcttcacgcggctcggcaccaacctgatgaccagtgtcccagtgaaggtgtctcagaactggatagtggggtgctgccgagaggggattctgctgaagtggagatgcagtcagatgccctggatgcagctagaggatgatgctttgtacatatcccaggctaatttcatcctggcctaccagttccgtccagatggtgccagcttgaaccgtcagcctctgggagtctgctgggcatgatgaggacgtttgccactttgtgctggccacct

SEQ ID NO: 40353 - DNA, 601 bp, Human
tgtgacagggacggcttgttgtgggcacttctcacccctgaaaatctgggacctcaacagtgggcagctgatgacacacttggacagagactttcccccaagggctggggtgctggatgtcatatatgagtcccctttcgcactgctctcctgtggctatgacacctatgttcgctactgggactgccgcaccagtgtccggaaatgtgtcatggagtgggaggagccccacaacagcaccctgtactgcctgcagacagatggcaaccacttgcttgccacaggttcctccttctatagygttgtacggctgtgggaccggcaccaaagggcctgcccgcacaccttcccgctgacgtcgacccgcctcggcagccctgtgtactgcctgcatctcaccaccaagcatctctatgctgcgctgtcttacaacctccacgtcctggatattcaaaacccgtgaccgtcagggccacccctgcctgtgggccaaggagaccagtgagtcagggacctctcttgcatgaagggtgcagtgatagttcctccccactgccccactgtgctcctgggcctgtgaccccagtgctcaggcaccttg

SEQ ID NO: 40354 - DNA, 601 bp, Human
ccgcctcggcagccctgtgtactgcctgcatctcaccaccaagcatctctatgctgcgctgtcttacaacctccacgtcctggatattcaaaacccgtgaccgtcagggccacccctgcctgtgggccaaggagaccagtgagtcagggacctctcttgcatgaagggtgcagtgatagttcctccccactgccccactgtgctcctgggcctgtgaccccagtgctcaggcaccttgcagtagaggcttctgactcctggagctttgtggcttaccagagatgcagtccctcccaggaamctgttggagaggcaggacctgctgctttagaggagtgcagctgaacctcggccctgcgactctgtttggccagagcaaggatctggcctggagaggcccatcctacaccccttattagagccgtgatagcctacagagtgaggtgaggttctcccgccttcccaggtggtttctttctgccacttcctggaaagaaaggtgaggctgccaatagcccgctagcaccagccagacctcacgcttgaccaacctctcggggccagaggttcattcctggggcactgtggcctggttttgttt

SEQ ID NO: 40355 - DNA, 601 bp, Human
ctgtgaccccagtgctcaggcaccttgcagtagaggcttctgactcctggagctttgtggcttaccagagatgcagtccctcccaggaaactgttggagaggcaggacctgctgctttagaggagtgcagctgaacctcggccctgcgactctgtttggccagagcaaggatctggcctggagaggcccatcctacaccccttattagagccgtgatagcctacagagtgaggtgaggttctcccgccttcccaggtggtttctttctgccacttcctggaaagaaaggtgaggctgccartagcccgctagcaccagccagacctcacgcttgaccaacctctcggggccagaggttcattcctggggcactgtggcctggttttgttttgaaaccaagagagggcaaagggaacccagcagttctgagtgagttctagccagccctacctcaggctggctgttgagagattttacaattttcatttttgtaaaaataaagcttgattgttcacagaaaaaaaaagaaaaaaaacctagtggacgtgacttggcctgccgccctcctgagaaatggagaatcgtgttgttggggggaaaa

SEQ ID NO: 40356 - DNA, 601 bp, Human
cccagtgctcaggcaccttgcagtagaggcttctgactcctggagctttgtggcttaccagagatgcagtccctcccaggaaactgttggagaggcaggacctgctgctttagaggagtgcagctgaacctcggccctgcgactctgtttggccagagcaaggatctggcctggagaggcccatcctacaccccttattagagccgtgatagcctacagagtgaggtgaggttctcccgccttcccaggtggtttctttctgccacttcctggaaagaaaggtgaggctgccaatagcccrctagcaccagccagacctcacgcttgaccaacctctcggggccagaggttcattcctggggcactgtggcctggttttgttttgaaaccaagagagggcaaagggaacccagcagttctgagtgagttctagccagccctacctcaggctggctgttgagagattttacaattttcatttttgtaaaaataaagcttgattgttcacagaaaaaaaaagaaaaaaaacctagtggacgtgacttggcctgccgccctcctgagaaatggagaatcgtgttgttggggggaaaaaaacaca

SEQ ID NO: 40357 - DNA, 601 bp, Human
atttttgtaaaaataaagcttgattgttcacagaaaaaaaaagaaaaaaaacctagtggacgtgacttggcctgccgccctcctgagaaatggagaatcgtgttgttggggggaaaaaaacacacatccagagctctttgccagataatattccgaaatcactcagagacttttttaaaactttaatatctgaggaacactggaatttaactttggaaggtttccgctggctgccctggaggccttgagctaccttcatgcgtcagatgatgcagccggaagactcggaggagaggctggsgttgcagtgggaagttgttccccataacgacgagctgagtactcacgtgtgttcaacctgggctgggtgctggggactccccaaggacagataggcccggtgcctgcccttgtccccatgaccagctcagtagggttggcccagcatcgctctgtcaggtttccgggttggacaagtcttaggaccaaaggagcttgcagtgcccttcccagctccggtgcctcttccaagcccaggaactcgtgatccacgtccagtggttcagaaagccagactcagatgcggcttctgccacctcct

SEQ ID NO: 40358 - DNA, 601 bp, Human
gcagtgggaagttgttccccataacgacgagctgagtactcacgtgtgttcaacctgggctgggtgctggggactccccaaggacagataggcccggtgcctgcccttgtccccatgaccagctcagtagggttggcccagcatcgctctgtcaggtttccgggttggacaagtcttaggaccaaaggagcttgcagtgcccttcccagctccggtgcctcttccaagcccaggaactcgtgatccacgtccagtggttcagaaagccagactcagatgcggcttctgccacctcctcctstggggctgcacgggctgacttccctgctctgggttgtggttctggctgaagttttatcaactcagaatttttatttttctaattatttcaaacttacaggagaactgtaagaatggggcaaagagctctagtatagccttcatccagatacactgatgggaactttttgccacatttgctttatctctttctgtgcacacgcaaacgcacatagacacatacacacacaagcacaagaagttttccccctgaatacttcatttgctaagaacaaggacattcctataactcacagtagaa

SEQ ID NO: 40359 - DNA, 601 bp, Human
gaactcgtgatccacgtccagtggttcagaaagccagactcagatgcggcttctgccacctcctcctgtggggctgcacgggctgacttccctgctctgggttgtggttctggctgaagttttatcaactcagaatttttatttttctaattatttcaaacttacaggagaactgtaagaatggggcaaagagctctagtatagccttcatccagatacactgatgggaactttttgccacatttgctttatctctttctgtgcacacgcaaacgcacatagacacatacacacacaagcrcaagaagttttccccctgaatacttcatttgctaagaacaaggacattcctataactcacagtagaatttgtcaaattcaggaaatttcacattcatgagatactattatttaatatgtagttcatataaacttcccccaagttaacaattacattcttcacagctgttttcattctctgattcaggacccggtttaagatcatgttatgtacttggttgtcccatctctctagtctccttccatctgtaccagttccttagactttgcttgtcttccatgaccttgacttttttttttt

SEQ ID NO: 40360 - DNA, 601 bp, Human
aggaagagctctgggcctcatcactgcacggatgaggaagaacctagaattggaggatgcaaggactcctccaggtggtcagcatggcaggggcctggcaggtgtcttccagctgctaccctttcctcgtacactctaagacccttcttgcagcccttgtagggagcagggccagaagatcagacagtgccaagggtgcctggtttatccagcatctgggattgtcatctgtagaaacataaaattcaatataaatgcaaatgcacatggaaataaaatttaggtttgacacaaaacaaacaccaggagccgtgaatgccttgggcttccagcttgcagtcagctacagtgggagtctccagccctgaccagtgcatctcctgggtctgcccttatactccccaggcctaggtttgctgatttttccctcgctgcccataaaggtgttgtggggcccagagatggcagtgtctgctgcactcacacaagttgttgctgaatcgagtgtgtgtctgagctggaggtgcagtgaggagatctattattgccattggtttaataaagaacaaacaacacctctcgccttacagccggtcggtct

SEQ ID NO: 40361 - DNA, 601 bp, Human
atggagcatcacgggcttcgctctgatgtctccagtggtgacagtacctgccgctctgttcttccagagtctgtggggcaccctgctccgccaggtgctgctggtaacaggctctgcatgtatccggggctccagctccctccccactgccagcctccctctggaccattcaatctgttctcttttcctttttcattaaatgagcaaccctcctcccccacagctggaatggtggcatcgaatttcaagtgaccttgacaaatcagggacctgatcttttaagaacaggttacagttaagygggcaagttcaagtccacccagacaggtttctgcagaggagggaggaaacaccatgggacgccacctggggatcacgtggtgccaccaaccatgcaccagtggattctgagccatggttgagatgcagggagtgggatggggctcaggaccagctgcaaaccgacccaccgtgaaagtttgtggcacctgcaccatcagggcgacatgcactttggttctctgtgtttcaaaaaagacccagaggaattggagccacccaaagaaagcagagtcaaacgcaaggaagagaaagcagcaag

SEQ ID NO: 40362 - DNA, 601 bp, Human
aaagtttgtggcacctgcaccatcagggcgacatgcactttggttctctgtgtttcaaaaaagacccagaggaattggagccacccaaagaaagcagagtcaaacgcaaggaagagaaagcagcaagccctgcagaggtgttggggggtcagtgctcaggcgtgggagttcgaagatcaccctcaagtacaggaaggagtggagtagtgtccgtcttctcctgggacagtcctgagagatgggcagcatccagttagatctggttccatggaacaccagctctccagacggtaggaatagraattacatgaaaagggctttgggagtcaggccagtttgggaaatgcagggttaaaccaaactcacaagttttcttgaggcaggttttcctggagctcctagataactcccaagcatcacactgtccacggacacgtgggccgcctcccaggctcttgtgagcccagcacctggtttttgcagtcttttgtttggctctcccacccccttacaccctttgggaactgctgagtcagatatacagaagaacagtcactgcgagggctgttaaactctcaggaaaggtaccaaagtgcatggc

SEQ ID NO: 40363 - DNA, 601 bp, Human
tgcagaggtgttggggggtcagtgctcaggcgtgggagttcgaagatcaccctcaagtacaggaaggagtggagtagtgtccgtcttctcctgggacagtcctgagagatgggcagcatccagttagatctggttccatggaacaccagctctccagacggtaggaataggaattacatgaaaagggctttgggagtcaggccagtttgggaaatgcagggttaaaccaaactcacaagttttcttgaggcaggttttcctggagctcctagataactcccaagcatcacactgtccacgracacgtgggccgcctcccaggctcttgtgagcccagcacctggtttttgcagtcttttgtttggctctcccacccccttacaccctttgggaactgctgagtcagatatacagaagaacagtcactgcgagggctgttaaactctcaggaaaggtaccaaagtgcatggcagcgtttggccccagtgagctggaaaacactttcgtctggtcttgagatgtttcctgcagcacaagaggttggcagagcaacctcagaacctcttctgtctctgtttatgcttttgttcagaagcttagt

SEQ ID NO: 40364 - DNA, 601 bp, Human
aacagtgacgtgtgtttaggagcatgctcctgttggcctccatttacaggatcctctgtgtcagaggatctcagccaggcgtgattttgttcacaagggacacttggcaatgcctggagacattttggttgtcaaaacagcaggaaggcagacgtgctcctgtacctataggtagaggccagggcagctgctcagcaccctaaggtgcccaggacagctgctcagagaatctgtagcccaaaatgtcaacagtgacctggctgagaagccctgtcccaggtggaccgcagcatccagggcrtcctgcgtgctcggcttgctcgtgggtccctgcacaccctgtgacttcattatcagctcagaatgcacctggggtttgttgtagtgagggaaagctgaaattgttgccaaagggggaactgtctgcatcatcaaagctgcttctgtcatctgtgtgaacatgcgcttttctctctgcagaacctgagagccagaagcaacaaagatgccaaggatccaacgaccaagaactctctggaaagtgagttctgcatgctgaggtctctgtgtgccctcgtcagggaggctgctgctggcagag

SEQ ID NO: 40365 - DNA, 601 bp, Human
gagccagaagcaacaaagatgccaaggatccaacgaccaagaactctctggaaagtgagttctgcatgctgaggtctctgtgtgccctcgtcagggaggctgctgctggcagagggggcgttgtggaaaagcagacacagtgcccacttgggtcatcccttggtgccttccctgttctctcttcagatagagtgggcacgaggaaagaacagctcagggagggcagggaaggataccatcaggaccagtttgccaccaacattagcaacaaggtgctgcttaaattgacttaaatgttatyctgttgaccccagtggcctcataaggaggattttttttttttgaggcggagttttggctcactgcaacctccacttcccgggttcaagtgatcctcctgcctcagcctcccgagtagctgggattacaggcacacaccaccacagccagctaatttttgtatttttaatagagatggggtttccctccgtattggtcaggcttgtctgaactcctgacctaaagtgccttggcctcccaaagtgctgggattacaggtgtgagctaccgcacctggcagtaacaaggattttattttctg

SEQ ID NO: 40366 - DNA, 601 bp, Human
actctctggaaagtgagttctgcatgctgaggtctctgtgtgccctcgtcagggaggctgctgctggcagagggggcgttgtggaaaagcagacacagtgcccacttgggtcatcccttggtgccttccctgttctctcttcagatagagtgggcacgaggaaagaacagctcagggagggcagggaaggataccatcaggaccagtttgccaccaacattagcaacaaggtgctgcttaaattgacttaaatgttatcctgttgaccccagtggcctcataaggaggattttttttttttgaggcggagttttggctcactgcaacctccacttcccgggttcaagtgatcctcctgcctcagcctcccgagtagctgggattacaggcacacaccaccacagccagctaatttttgtatttttaatagagatggggtttccctccgtattggtcaggcttgtctgaactcctgacctaaagtgccttggcctcccaaagtgctgggattacaggtgtgagctaccgcacctggcagtaacaaggattttattttctgtttttgccaatgacaagtttggtcataaagtaatctgtgcag

SEQ ID NO: 40367 - DNA, 601 bp, Human
cctcagcctcccgagtagctgggattacaggcacacaccaccacagccagctaatttttgtatttttaatagagatggggtttccctccgtattggtcaggcttgtctgaactcctgacctaaagtgccttggcctcccaaagtgctgggattacaggtgtgagctaccgcacctggcagtaacaaggattttattttctgtttttgccaatgacaagtttggtcataaagtaatctgtgcagagcacaggctttaagtggctgggcaggaattgagtccagagttgctgggaaagtgctrtcaggaattgtcagtcacttcttattttcagttgttagggtgttgtgaatagttacacttgcaaagaacagcagcccccggagctttgtcctccaagcctcagtttccctatctgcaaaatgaaaatagcgatgagtgccttatgctggttgtgggagtcttgtgaagaacatacttggcatgtctcagaacacacctaagcgtctgtgcctgggacgggccacactcactgtcatcatggagaagcacgggtggctgaggctggccagggctcccaccatgccagggagttgctcccac

SEQ ID NO: 40368 - DNA, 601 bp, Human
atcccagtctgtcccatggaacacgtgctgggttttaggtcaggtaaaccatgtatggccgagaacactggctcttgggctcttgacagcagtgacatcagccatagaaggcagtcggtgcatgtgaacgttcttctctccccatccccagcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagartgacatccagagagagaaggtgcacaccaggggagcaagggccgggtttggtgtggtcagagtggcagcagcccccgcacacggccagtgggtgctttctccgtcaggcctctgggccccaggtctggtctctgggacccctgtaagctctcagctcttggagggctgggcatctgggcacaactaggtgtccagttgttctgagaacccccagctaaatggggagcaccataccagagcggctgccaacccaaccctccagaaaaatgaagggaactggtcgtggtctctacagtgcgc

SEQ ID NO: 40369 - DNA, 601 bp, Human
acacctcctagtttttcggaaacacagcaccacaataggaaacaagttcagagattttacctacaggttttggacaaggaggtgccatgagtagggagggcagtcttctgtccctgggtcatgcaaggcagaaatgaagagttagcgcatgacagctagcagtatttataagggaacagggtgtgatcactttaagttcacaggcaaatgcctggatggtccttttaaggaagcagcaggaatgcgggagctcagtcagccgggcgggagagaggcttccgggttctcacctctggccacrggcttgagctgttcaagtgtgtggtctcctgatacccaggctgcgtcctttgccgtgtggttccattacatgggtgaagtactgagtcaccagagagaaagtcacagccagacagtggagggcttggagtagtccaggatgcagggttgggggaggtgctggctgtcccccatacaagctaccctgatgggggccaggcccaggtggcagtgccacccctctaggtgttcaggactacctgcccttggttttttccagagatgtttgaagactgtaaaaatggtgaggacaagcccctca

SEQ ID NO: 40370 - DNA, 601 bp, Human
ctcagggcagctgagccctattgactgttactgttgcattctccatgttcagctctttgggggatgggatggggtggggccctacctggtgacaggcagcacagttttctcctccccagggatagtggcttctagagtgaaacccatggctcagcataggaagggccttcccatccaggttctgttgacggtcgtctggtcttctgctggcatctccacaaacatgcccaggggcccgatgctgaaacctagttggattaggaagagggtgagggaccctgtaggtcacagcagcctcctrgacattgtctgaatttgggaaaatgaaaggcagggatgttggtaaaagtttcttctctccgcccttgtgagaggaaagacttaattcctccaaaaaaggtttactgagcatgtcctgcagcttatgccatgccttgaccctgtaaaaaagctgtttctgtcctccagaggccaccagcaactgcggtctggggccctggtctgtgctgagtggagagatgggattcttgccctctgcaggctgaatgcagctggtggtggggatggatggaatgggagtgggttgtgtggagcgctggaa

SEQ ID NO: 40371 - DNA, 601 bp, Human
tccagaggccaccagcaactgcggtctggggccctggtctgtgctgagtggagagatgggattcttgccctctgcaggctgaatgcagctggtggtggggatggatggaatgggagtgggttgtgtggagcgctggaatgggaaggtgaggctgtggcatctccccacagagggcgaacaagggcagcaaggctacggagaggctgaagaagaagctgtcggagcaggagtcactgctgctgcttatgtctcccagcatggccttcagggtgcacagccgcaacggcaaggtgagcgcctsctgttccggcccctcctgctctcctggcctgggatgggctcctggttgcctaatggcagtgcgttttcacttggatgcgccccactctgagagaggcatgtccggcatggtgcatgcaagcacgcacattcctttgtctggggctttgggctgtagcccccaggttgagtggcagctggctcagctcccacagctgggagtggacagggtctccagggagggtatagggcaggggagcctagcaggtttgtgcagatctggcccttggtacagggatgctgtcctggggccttgagggcc

SEQ ID NO: 40372 - DNA, 601 bp, Human
ggctgaatgcagctggtggtggggatggatggaatgggagtgggttgtgtggagcgctggaatgggaaggtgaggctgtggcatctccccacagagggcgaacaagggcagcaaggctacggagaggctgaagaagaagctgtcggagcaggagtcactgctgctgcttatgtctcccagcatggccttcagggtgcacagccgcaacggcaaggtgagcgcctgctgttccggcccctcctgctctcctggcctgggatgggctcctggttgcctaatggcagtgcgttttcacttggaygcgccccactctgagagaggcatgtccggcatggtgcatgcaagcacgcacattcctttgtctggggctttgggctgtagcccccaggttgagtggcagctggctcagctcccacagctgggagtggacagggtctccagggagggtatagggcaggggagcctagcaggtttgtgcagatctggcccttggtacagggatgctgtcctggggccttgagggccagagacacaccttctgtcctgagtctggctcctgctgccatctgtaacctgggcctctccctcctgtcaatacatg

SEQ ID NO: 40373 - DNA, 601 bp, Human
ggagcgctggaatgggaaggtgaggctgtggcatctccccacagagggcgaacaagggcagcaaggctacggagaggctgaagaagaagctgtcggagcaggagtcactgctgctgcttatgtctcccagcatggccttcagggtgcacagccgcaacggcaaggtgagcgcctgctgttccggcccctcctgctctcctggcctgggatgggctcctggttgcctaatggcagtgcgttttcacttggatgcgccccactctgagagaggcatgtccggcatggtgcatgcaagcacgcwcattcctttgtctggggctttgggctgtagcccccaggttgagtggcagctggctcagctcccacagctgggagtggacagggtctccagggagggtatagggcaggggagcctagcaggtttgtgcagatctggcccttggtacagggatgctgtcctggggccttgagggccagagacacaccttctgtcctgagtctggctcctgctgccatctgtaacctgggcctctccctcctgtcaatacatgtctgtcaatgtccagaatggcttgttttctagcctgaccaggagaggcag

SEQ ID NO: 40374 - DNA, 601 bp, Human
ccccactctgagagaggcatgtccggcatggtgcatgcaagcacgcacattcctttgtctggggctttgggctgtagcccccaggttgagtggcagctggctcagctcccacagctgggagtggacagggtctccagggagggtatagggcaggggagcctagcaggtttgtgcagatctggcccttggtacagggatgctgtcctggggccttgagggccagagacacaccttctgtcctgagtctggctcctgctgccatctgtaacctgggcctctccctcctgtcaatacatgtctrtcaatgtccagaatggcttgttttctagcctgaccaggagaggcagctggtgggctctgcagaagcctcacctctgggctagtgtggggcttgtgaattgaatgcaggaggtcaggtctggatcaacgttcacctctgcagatcccacctggttacctccatgtccctaagctgtgcccctctgccagcatcacaccctgacccatgtagttcgggtgagagatggtgtgccagaggtgctgtggcacccagctggcaggaagggtagggagtgccggaagcgacatgccaggccgtgag

SEQ ID NO: 40375 - DNA, 601 bp, Human
cgtgcagagtggagggagaacatccgggagcagcagaagaagtgtgagtatcctctgtcctgagaggggctgggcttcaaaccattagggccaggctggcagctcctgtggttttaaaccttcttttttatttcgaggggttttatccaagtgaagtgttgcatggagggctaatttagaaaagaagttggcgacagccatcccgataggcccccagccctcttgttcccctgccagcctatcctgcccccatcacctgggcactcatttccccactgccctgtgatcccctgtgaatccyccttccccaggccctttccagattccacacctgcccctacacacacccctgccatctccccctagtctgctgcccatacaccgcacccccggcctgccccctagtcctttctgggaccctgccaccaccccattttcttggcctcccccatttctcctcatctactccccgccccctgggccttccctgccccagcaggtgctgatgctaaaggggcctttggctgggcccacttgggcattcacactgtgctggccccactgccctgttcatatggccggggttgcccgctctcagctc

SEQ ID NO: 40376 - DNA, 601 bp, Human
gggctgggcttcaaaccattagggccaggctggcagctcctgtggttttaaaccttcttttttatttcgaggggttttatccaagtgaagtgttgcatggagggctaatttagaaaagaagttggcgacagccatcccgataggcccccagccctcttgttcccctgccagcctatcctgcccccatcacctgggcactcatttccccactgccctgtgatcccctgtgaatcccccttccccaggccctttccagattccacacctgcccctacacacacccctgccatctccccctagyctgctgcccatacaccgcacccccggcctgccccctagtcctttctgggaccctgccaccaccccattttcttggcctcccccatttctcctcatctactccccgccccctgggccttccctgccccagcaggtgctgatgctaaaggggcctttggctgggcccacttgggcattcacactgtgctggccccactgccctgttcatatggccggggttgcccgctctcagctcaggggcgctccctcctgtctggggcagccccttccttctctgggcacttccctctgtcagggcgct

SEQ ID NO: 40377 - DNA, 601 bp, Human
gcttcaaaccattagggccaggctggcagctcctgtggttttaaaccttcttttttatttcgaggggttttatccaagtgaagtgttgcatggagggctaatttagaaaagaagttggcgacagccatcccgataggcccccagccctcttgttcccctgccagcctatcctgcccccatcacctgggcactcatttccccactgccctgtgatcccctgtgaatcccccttccccaggccctttccagattccacacctgcccctacacacacccctgccatctccccctagtctgctgyccatacaccgcacccccggcctgccccctagtcctttctgggaccctgccaccaccccattttcttggcctcccccatttctcctcatctactccccgccccctgggccttccctgccccagcaggtgctgatgctaaaggggcctttggctgggcccacttgggcattcacactgtgctggccccactgccctgttcatatggccggggttgcccgctctcagctcaggggcgctccctcctgtctggggcagccccttccttctctgggcacttccctctgtcagggcgctccttcct

SEQ ID NO: 40378 - DNA, 601 bp, Human
tgccctgttcatatggccggggttgcccgctctcagctcaggggcgctccctcctgtctggggcagccccttccttctctgggcacttccctctgtcagggcgctccttccttcgggtcctgcctggcagtgtcggtggggaaggcagacccggttccctccttggaggtttgggattcaccctgagctggggctctgcatgcctctggcctggcctgacctcccgcgccctcaggctcatcattctcacctatgcagagccacctctcggcccccaatgccaccgtggcctgggggatcraggatctccgggcagccctgccagtgcttgtgtcccagggtttcctgtcataacataggagccccagccatttccagagtggcagcctctgttccctgttcagcattatgcccagaaataagccccttttcctcacctggtggagaaacgggggcctgtgttagcagaggacgggcagagccatgctgctgtctgtatggggagacctcacagggaggtgctcccagtccagccactcattctcagacctgccttgtggctgtgcttaggtagcgtgggatgtgtgtgtttgtaagtctc

SEQ ID NO: 40379 - DNA, 601 bp, Human
gggattcaccctgagctggggctctgcatgcctctggcctggcctgacctcccgcgccctcaggctcatcattctcacctatgcagagccacctctcggcccccaatgccaccgtggcctgggggatcaaggatctccgggcagccctgccagtgcttgtgtcccagggtttcctgtcataacataggagccccagccatttccagagtggcagcctctgttccctgttcagcattatgcccagaaataagccccttttcctcacctggtggagaaacgggggcctgtgttagcagaggaygggcagagccatgctgctgtctgtatggggagacctcacagggaggtgctcccagtccagccactcattctcagacctgccttgtggctgtgcttaggtagcgtgggatgtgtgtgtttgtaagtctcatgctaagactcctccaggcctgggctctccagggccacacctcactctgccgccagaccagcactgcacttgagagccaagtgccctctcctgagcccccaagccctggcaccagttcttgccgtgccccttccccagggtgtgtggtggaggtccagtgggaggggccag

SEQ ID NO: 40380 - DNA, 601 bp, Human
gttagcagaggacgggcagagccatgctgctgtctgtatggggagacctcacagggaggtgctcccagtccagccactcattctcagacctgccttgtggctgtgcttaggtagcgtgggatgtgtgtgtttgtaagtctcatgctaagactcctccaggcctgggctctccagggccacacctcactctgccgccagaccagcactgcacttgagagccaagtgccctctcctgagcccccaagccctggcaccagttcttgccgtgccccttccccagggtgtgtggtggaggtccagygggaggggccagagggccaaggagcagattgaccaattggtgcacctcttttccaacctcccaggtttcagaagcttctccctgacatccgtggagctgcagatgctgaccaactcgtgtgtgaaactccagactgtccacagcattccgctgaccatcaataaggaaggtgggcccccccgtttccgtgtacagggcacctgcagggagggcaggcagctagcctgaaggctgatccccccttcctgttagcacttttgatgggactagtggactttggttcagaaggaagagctatgc

SEQ ID NO: 40381 - DNA, 601 bp, Human
tgggctctccagggccacacctcactctgccgccagaccagcactgcacttgagagccaagtgccctctcctgagcccccaagccctggcaccagttcttgccgtgccccttccccagggtgtgtggtggaggtccagtgggaggggccagagggccaaggagcagattgaccaattggtgcacctcttttccaacctcccaggtttcagaagcttctccctgacatccgtggagctgcagatgctgaccaactcgtgtgtgaaactccagactgtccacagcattccgctgaccatcaayaaggaaggtgggcccccccgtttccgtgtacagggcacctgcagggagggcaggcagctagcctgaaggctgatccccccttcctgttagcacttttgatgggactagtggactttggttcagaaggaagagctatgcttgttagggcctcttgtctcctcccaggagtggacaaggtgggttaggagcagtttctccctgagtggctgctgctgggtggttgaggagatgcacggcttctgttcctagtcacaaggctgcagcagacgctcctcagatgctctgtgccttggatctggc

SEQ ID NO: 40382 - DNA, 601 bp, Human
cctcactctgccgccagaccagcactgcacttgagagccaagtgccctctcctgagcccccaagccctggcaccagttcttgccgtgccccttccccagggtgtgtggtggaggtccagtgggaggggccagagggccaaggagcagattgaccaattggtgcacctcttttccaacctcccaggtttcagaagcttctccctgacatccgtggagctgcagatgctgaccaactcgtgtgtgaaactccagactgtccacagcattccgctgaccatcaataaggaaggtgggcccccccgtttccgtgtacagggcacctgcagggagggcaggcagctagcctgaaggctgatccccccttcctgttagcacttttgatgggactagtggactttggttcagaaggaagagctatgcttgttagggcctcttgtctcctcccaggagtggacaaggtgggttaggagcagtttctccctgagtggctgctgctgggtggttgaggagatgcacggcttctgttcctagtcacaaggctgcagcagacgctcctcagatgctctgtgccttggatctggccccactcccgtcctcccag

SEQ ID NO: 40383 - DNA, 601 bp, Human
attgtgaaaccaactggatcctgagatccccaagacagaaatcatgatgagtatgtttttggcccatgacactggcttaccttgtgccaggcagatggcagccacacagtgtccaccggatggttgattttgaagcagagttagcttgtcacctgcctccctttcccgggacaacagaagctgacctctttgatctcttgcgcagatgatgagtctccggggctctatgggtttctgaatgtcatcgtccactcagccactggatttaagcagagttcaagtaagtactggtttggggagsagggttgcagcggccgagccagggtctccacccaggaaggactcatcgggcagggtgtggggaaacagggaggttgttcagatgaccacgggacacctttgaccctggccgctgtggagtgtttgtgctggttgatgccttctgggtgtggaattgtttttcccggagtggcctctgccctctcccctagcctgtctcagatcctgggagctggtgagctgccccctgcaggtggatcgagtaattgcaggggtttggcaaggactttgacagacatccccaggggtgcccgggagtgtg

SEQ ID NO: 40384 - DNA, 601 bp, Human
gcagcggccgagccagggtctccacccaggaaggactcatcgggcagggtgtggggaaacagggaggttgttcagatgaccacgggacacctttgaccctggccgctgtggagtgtttgtgctggttgatgccttctgggtgtggaattgtttttcccggagtggcctctgccctctcccctagcctgtctcagatcctgggagctggtgagctgccccctgcaggtggatcgagtaattgcaggggtttggcaaggactttgacagacatccccaggggtgcccgggagtgtggggtccmagccaggagggctgtcagcagtgcaccttcaccccacagcagagcagatttggctgctctgtcgagctggatggatactactttttttttcctttccctctaagtgggggtctcccccagctactggagctgtcagaacagtgaaggctggtaacacatgagttgcactgtgtaagtttctcgaggccgggcgcagtggctcatgcctgtaatcccagcactttgggaggctgaggcaggtggatcgcttgagctcaggagttggagaccagcctgaccaacatggtgaaaccctgtgtc

SEQ ID NO: 40385 - DNA, 601 bp, Human
caccttcaccccacagcagagcagatttggctgctctgtcgagctggatggatactactttttttttcctttccctctaagtgggggtctcccccagctactggagctgtcagaacagtgaaggctggtaacacatgagttgcactgtgtaagtttctcgaggccgggcgcagtggctcatgcctgtaatcccagcactttgggaggctgaggcaggtggatcgcttgagctcaggagttggagaccagcctgaccaacatggtgaaaccctgtgtctactaaaaatacaaagattagccrggctaggcagtgggcacctgtaatcacaactgcttgggaggctgagggaagagaatcgcttgaacccaggaggcggaggttgcagtgagccgagcttgtgccactgcattccagcctgggcgacagagcaagactccgcctcaaaaaaaaaaaaaaaaagttcctagaaacagcaaaatgtggagacagaaagcttaccagggattgttggggaatggggttgggagagaggactaactgcagatgaacccaagggggactttttaggtgagagcagtgtcgtgaaaagactgtggtgct

SEQ ID NO: 40386 - DNA, 601 bp, Human
tcgcttgagctcaggagttggagaccagcctgaccaacatggtgaaaccctgtgtctactaaaaatacaaagattagccgggctaggcagtgggcacctgtaatcacaactgcttgggaggctgagggaagagaatcgcttgaacccaggaggcggaggttgcagtgagccgagcttgtgccactgcattccagcctgggcgacagagcaagactccgcctcaaaaaaaaaaaaaaaaagttcctagaaacagcaaaatgtggagacagaaagcttaccagggattgttggggaatggggytgggagagaggactaactgcagatgaacccaagggggactttttaggtgagagcagtgtcgtgaaaagactgtggtgctgtttgcgctcacatttacatttcctaaaattctttaaaccctacacttggaatggatgaattacatgacatgcagattgcaccttcataacataatctttctcctgggcccctgtctctggctgcctcataaacgctggtgtttccctcgtgggcctccctgcatccctgcatctcctcccgggtcctgtctgtgagcaatacagcgtgacaccctacgct

SEQ ID NO: 40387 - DNA, 601 bp, Human
actgtggtgctgtttgcgctcacatttacatttcctaaaattctttaaaccctacacttggaatggatgaattacatgacatgcagattgcaccttcataacataatctttctcctgggcccctgtctctggctgcctcataaacgctggtgtttccctcgtgggcctccctgcatccctgcatctcctcccgggtcctgtctgtgagcaatacagcgtgacaccctacgctgccccgtggtcccgggcttgtctctccttgcctccctgttacctttctttctatctcttccttgccccrtgcactcaaccttgcatccccaaaccaaacctattattcatggaccccaaacttgttcctcttatgtcctgtccctttgaggggcaccaccatccacccgcatggccaagccagaaaccgtggtctgctctccctccgttaaatgccattctccatcagtgaggcttcttagtcatctctggctgcctggccaggccctggctgtggcctcctccctggtctttgtagctctggatatccctgcagaaagggtccccactaccaggcctctccatccccagtctcaggtagtttttctaa

SEQ ID NO: 40388 - DNA, 601 bp, Human
ataatctttctcctgggcccctgtctctggctgcctcataaacgctggtgtttccctcgtgggcctccctgcatccctgcatctcctcccgggtcctgtctgtgagcaatacagcgtgacaccctacgctgccccgtggtcccgggcttgtctctccttgcctccctgttacctttctttctatctcttccttgccccgtgcactcaaccttgcatccccaaaccaaacctattattcatggaccccaaacttgttcctcttatgtcctgtccctttgaggggcaccaccatccacccgcrtggccaagccagaaaccgtggtctgctctccctccgttaaatgccattctccatcagtgaggcttcttagtcatctctggctgcctggccaggccctggctgtggcctcctccctggtctttgtagctctggatatccctgcagaaagggtccccactaccaggcctctccatccccagtctcaggtagtttttctaaaatgcaaaccccaccctgcaacttaccgcccacagcccagcccactcttctccaggcctcgcctccctcccttccccctgcaccccacgacttctccagcac

SEQ ID NO: 40389 - DNA, 601 bp, Human
acccccagtcctgcccatcttcttacttgcattgtatgtggtgtggccaacattcacagagagggacttgcctaggtctgcatggatgggagtgatagtgggggcccaggccacctcctggtcctgctagtgcactttgctggaagcttaaaactacctcaagtgttcgggtgtggtggctcatgcctgtaatcccagcactttgggaggccaaggcaggataaccaatcccaggtgtttgaaaccagtctgggcaatgtggcaaaccccatctctagaaaaaataaaaagaaaaattagscaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtccccagcacctgagatggacttggaggcttgggccccaaagacctcccaccagc

SEQ ID NO: 40390 - DNA, 601 bp, Human; identical to SEQ ID NO: 29285

SEQ ID NO: 40391 - DNA, 601 bp, Human; identical to SEQ ID NO: 29286

SEQ ID NO: 40392 - DNA, 601 bp, Human; identical to SEQ ID NO: 29287

SEQ ID NO: 40393 - DNA, 601 bp, Human; identical to SEQ ID NO: 29288

SEQ ID NO: 40394 - DNA, 601 bp, Human; identical to SEQ ID NO: 29289

SEQ ID NO: 40395 - DNA, 601 bp, Human; identical to SEQ ID NO: 29290

SEQ ID NO: 40396 - DNA, 601 bp, Human; identical to SEQ ID NO: 29291

SEQ ID NO: 40397 - DNA, 601 bp, Human; identical to SEQ ID NO: 29292

SEQ ID NO: 40398 - DNA, 601 bp, Human; identical to SEQ ID NO: 29293

SEQ ID NO: 40399 - DNA, 601 bp, Human; identical to SEQ ID NO: 29294

SEQ ID NO: 40400 - DNA, 601 bp, Human; identical to SEQ ID NO: 29295

SEQ ID NO: 40401 - DNA, 601 bp, Human; identical to SEQ ID NO: 29296

SEQ ID NO: 40402 - DNA, 601 bp, Human; identical to SEQ ID NO: 29297

SEQ ID NO: 40403 - DNA, 601 bp, Human
cccgttcagggttggggctcggtgggaacctccccgtgcccgaagggacgaccccgtcagagagtcccccgacccttgcacctaccgtccttggcaggacgtggagctgctcggaagccattccgggttggcccccttacccgtgtgccacgacccctcggcgggcccctgccgcccgagtgccctcaccgccagcctccggagcggcggagtctcggcttccccgagcacgagcggcctgtcctgcctgtccagctcccgctcagcccgctgccggccccgtctccccgagcgcccgagsactgggaggggtggaacagggtccctccgatctccggggattccctgcggggcgccccaaccaatccttagggcccaaggctacgcgctcggcagccggctcctccggagcgtccccggacgcgagccccggcgccgcctcgccctggctcccccctcggacccgctggggctgactctgcgctcttggccgcggggcttttcccggccctccgtccccaccctccgcgactcaggagccgccagtgctccgaggctcccccggcccaaggcgctcgggggcggtgcggggcgccccctg

SEQ ID NO: 40404 - DNA, 601 bp, Human
gtcactcacctccggctaacaaggaaatcggcagagcctcaggggacctggcccagctgggcctctctggcctgcccagcccctggttgaccctccccgccccaccctgccccctcagccaccccactcacaatgttcatgagtgtcagcaggtacttctgtacgtgctccttcccgtggaactgcaccacagagtcatccacgcccagcaggacctcgatgttgtagtcatcgtctgcagcatgcctgcgtgccctccgcctcgagctgttggcgtgctcctctaggatgcccagggcgyggctgaggctgtccaggctgtccagggaggcccctgcaaggagaggacaccgtcttcagcggcagggcaaacccacccggacacaaacctaccaggcgccagcttggccatcctctcatttaaaactcatagcaccctgaaccgagggtattattccattttacagaggaaagcgaggtgcagaggaagatggcagagacttgccaagctgtctcagacacagcagggcccagacaggcacctctgtgacttccaggaccgctcgttccccagcccctggtggcaaccccagccacagca

SEQ ID NO: 40405 - DNA, 601 bp, Human
cctgagactgtgtcactcacctccggctaacaaggaaatcggcagagcctcaggggacctggcccagctgggcctctctggcctgcccagcccctggttgaccctccccgccccaccctgccccctcagccaccccactcacaatgttcatgagtgtcagcaggtacttctgtacgtgctccttcccgtggaactgcaccacagagtcatccacgcccagcaggacctcgatgttgtagtcatcgtctgcagcatgcctgcgtgccctccgcctcgagctgttggcgtgctcctctaggaygcccagggcgcggctgaggctgtccaggctgtccagggaggcccctgcaaggagaggacaccgtcttcagcggcagggcaaacccacccggacacaaacctaccaggcgccagcttggccatcctctcatttaaaactcatagcaccctgaaccgagggtattattccattttacagaggaaagcgaggtgcagaggaagatggcagagacttgccaagctgtctcagacacagcagggcccagacaggcacctctgtgacttccaggaccgctcgttccccagcccctggtggcaaccc

SEQ ID NO: 40406 - DNA, 601 bp, Human
tgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttagccaagatggtctcgatctcctgacctcgtgatctacctgcctccgactcccaaagtgctgggattacaggtgtgaaccaccgcgcccggccttttgtctctttttaaaraaaacatctcttactccaagaacatggagccatccacctacgttatcttctttcattattttgcgtttcttatttagacctaaaatccatgtgagatgctctctgtctatagagtgagtggaggtgacaggcctcctttctttccaaattggccccacaccatttgttaggctgttttcctcctcttctctgaaatgtcacttttgtgacacattagcgtccctatacacataggtccaattcaggacactggattctcttctaatgatgtatttgtccatcagtgcactgccccacacc

SEQ ID NO: 40407 - DNA, 601 bp, Human
tgcctttaatgcacaaacttttgaaatgtgctactatttatcagttttttccattgagttcatggtttgtttggttttttttgtctcttttttttttgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttagccaagatggtctygatctcctgacctcgtgatctacctgcctccgactcccaaagtgctgggattacaggtgtgaaccaccgcgcccggccttttgtctctttttaaagaaaacatctcttactccaagaacatggagccatccacctacgttatcttctttcattattttgcgtttcttatttagacctaaaatccatgtgagatgctctctgtctatagagtgagtggaggtgacaggcctcctttctttccaaattggccccacaccatttgttaggctgttttcctcctcttctctgaaatgtcacttt

SEQ ID NO: 40408 - DNA, 601 bp, Human
catgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttcacatacttcagatataaatccttttttataaatatttcccccagtggattagcgtgcctttaatgcacaaacttttgaaatgtgctactatttatcagttttttccattgagttcatggtttgtttggktttttttgtctcttttttttttgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttagccaagatggtctcgatctcctgacctcgtgatctacctgcctccgactcccaaagtgctgggattacaggtgtgaaccaccgcgccc

SEQ ID NO: 40409 - DNA, 601 bp, Human
ccatgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttcacatacttcagatataaatccttttttataaatatttcccccagtggattagcgtgcctttaatgcacaaacttttgaaatgtgctactatttatcagttttttccattgagttcatggtttgtttgkttttttttgtctcttttttttttgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttagccaagatggtctcgatctcctgacctcgtgatctacctgcctccgactcccaaagtgctgggattacaggtgtgaaccaccgcgcc

SEQ ID NO: 40410 - DNA, 601 bp, Human
agtggtgtgatcatagctcacttcctgggctcaaacaatcctcccacctcaggttcccgagtggctgggactacaggcatccaccaccatgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttcacatacttcagatataaatccttttttataaatatttccccyagtggattagcgtgcctttaatgcacaaacttttgaaatgtgctactatttatcagttttttccattgagttcatggtttgtttggttttttttgtctcttttttttttgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttag

SEQ ID NO: 40411 - DNA, 601 bp, Human
gctgtgtcggtttcccctcctaggggatagctctgctccccattagtgccctccccaagacaaaacagccaacagcactctcatcacatggtcagggcaacacctggctgcgctgtgtttgaggggagctatccactcctcacccagacatggtagtttcagtctttttaacctagctatgctattaggtgcgtcttgatatttcattgtgtttttaaattttcctttttttttttttttgtaagacaaggcctcgctctgtcacccaggctggagtgcagtggtgtgatcatagctcacytcctgggctcaaacaatcctcccacctcaggttcccgagtggctgggactacaggcatccaccaccatgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttcacatacttcagatataaatccttttttataaatatttcccccagtggattagcgtgcctttaa

SEQ ID NO: 40412 - DNA, 601 bp, Human
tgagccaccacacccagccaatttcacatttttaaatgagggatcaggtcacttaatataaaagctgtgtcggtttcccctcctaggggatagctctgctccccattagtgccctccccaagacaaaacagccaacagcactctcatcacatggtcagggcaacacctggctgcgctgtgtttgaggggagctatccactcctcacccagacatggtagtttcagtctttttaacctagctatgctattaggtgcgtcttgatatttcattgtgtttttaaattttccttttttttttttyttgtaagacaaggcctcgctctgtcacccaggctggagtgcagtggtgtgatcatagctcacttcctgggctcaaacaatcctcccacctcaggttcccgagtggctgggactacaggcatccaccaccatgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttc

SEQ ID NO: 40413 - DNA, 601 bp, Human
cattacaggagcctgcgagatctgaaagcgcatctttatgtttttctttgttttcttccctcttattttactttgtggctgttttctctctccggaatcttattagatagagtgtgcctcctcgatggagggtctgtctcctaacttttctctcatgttaatctttttgtcttttgctcccattgggagatggccttgactttttatttcagctttcgattttttttttttttttttgagatggagtctcactctgccgtccaggctggagtgcagtggtgtgatctcggctcactgcaasctccgcctcctgggttcagtccattctactgcctcagcctcctgagtagctgggactacaggcacccgccaccatgctcagctaatttttgtatttttactagagacgggatttcaccatgttagccaggatggtctccatctcctgacctcgtgacctgcccgcctcggcctcccacagtgctgggattacaggcgtgagccaccgcgccccgtctacctttcgaattttttacttcccccatcctatccataattttatacaaatggtttgttgttctctaatttttcatagaaaact

SEQ ID NO: 40414 - DNA, 601 bp, Human
tgggaagacaggagaccacaccccaagtggctttgacacagggcgtgtccctcttaaggcacagaggagaagtgggcagccagggctggggatcctagggtggcccctctgtgccccacccttccccaggccacttacacgtggccagtctcatgggccaccacaaacgctgaggagaagccgtcctcatggttcagggtgcagctgcggaccggatggcacatgccggtgacaggagcatagcctgggaggagacaagaggcggctccagatgctgccatagcctggccgggaaggtgargcctggcctaactcccaggcgctgcttctcctcaaggccccaatgccctctctaccacaggcaactgcccccggctggcacagctcagaagacaccacagcagacagctcatagcctgtgacatctggctgacagcaggcccccagcccgtcaccacacaagccccgtggccgttctgcctgtaacagccacactgcagctggggccctctgcttagtcagatgtcacctgctatggcttgtctgacacctgactttcctgcctgccgttctctttcacgccacctgcctctgccccctg

SEQ ID NO: 40415 - DNA, 601 bp, Human
ggggcaaggtccccagctctagctggcccagagcgcctgctcagtctgcaggcaagcccttcctccttcaattggttccttcagcaaaagtgggcctcgggccagcactgcccagcgctgggaagacaggagaccacaccccaagtggctttgacacagggcgtgtccctcttaaggcacagaggagaagtgggcagccagggctggggatcctagggtggcccctctgtgccccacccttccccaggccacttacacgtggccagtctcatgggccaccacaaacgctgaggagaagccrtcctcatggttcagggtgcagctgcggaccggatggcacatgccggtgacaggagcatagcctgggaggagacaagaggcggctccagatgctgccatagcctggccgggaaggtgaggcctggcctaactcccaggcgctgcttctcctcaaggccccaatgccctctctaccacaggcaactgcccccggctggcacagctcagaagacaccacagcagacagctcatagcctgtgacatctggctgacagcaggcccccagcccgtcaccacacaagccccgtggccgttctgcctg

SEQ ID NO: 40416 - DNA, 601 bp, Human
tccgagcctcctctataacatggggtagagcccaccctgcctgggggcttggatgtgataatggggcaaggtccccagctctagctggcccagagcgcctgctcagtctgcaggcaagcccttcctccttcaattggttccttcagcaaaagtgggcctcgggccagcactgcccagcgctgggaagacaggagaccacaccccaagtggctttgacacagggcgtgtccctcttaaggcacagaggagaagtgggcagccagggctggggatcctagggtggcccctctgtgccccaccyttccccaggccacttacacgtggccagtctcatgggccaccacaaacgctgaggagaagccgtcctcatggttcagggtgcagctgcggaccggatggcacatgccggtgacaggagcatagcctgggaggagacaagaggcggctccagatgctgccatagcctggccgggaaggtgaggcctggcctaactcccaggcgctgcttctcctcaaggccccaatgccctctctaccacaggcaactgcccccggctggcacagctcagaagacaccacagcagacagctcatagcctgtg

SEQ ID NO: 40417 - DNA, 601 bp, Human
ccacaggcctgccctctctgcagcctcggcctcccctggacttcacagtcctgttccctggcctttctgcttcctgtcctgatagcacttcctgcaggacgtccctgagggatcagctgaaactcagacgtggccctgagcctcccctactcaagcctttccagagcccccatcgccatgagaatcgagtccactgtgctccttagggagtcttggaaggaggtggccctcctgcgttggtactcgactctaccacttgctcgctttgtgggctcaggcaggttacctagcctctccgggyctctgtttcctcatctgtaaaatgggactactttgcttctttccttcatgcagcagaggcgagcattaagacgctcatagacactgaagctcccacagtgtggcctccatgccgatggccggttcctctgacggctcagccctggcacttggccctggagagcagcgagtgctcctgtgcctgccgcgctctcctccaggcctctgcgtccgtggcctctgcgtccgtggccctcccttcctgaatgccctctccttccgcttagcctgcaggcctcccttcttccttgggagccctcct

SEQ ID NO: 40418 - DNA, 601 bp, Human
ggcacctgctgaccctttgccgtggatttccctcctaaaccctggcgaagccctacccccacccccacaggcctgccctctctgcagcctcggcctcccctggacttcacagtcctgttccctggcctttctgcttcctgtcctgatagcacttcctgcaggacgtccctgagggatcagctgaaactcagacgtggccctgagcctcccctactcaagcctttccagagcccccatcgccatgagaatcgagtccactgtgctccttagggagtcttggaaggaggtggccctcctgcgytggtactcgactctaccacttgctcgctttgtgggctcaggcaggttacctagcctctccgggtctctgtttcctcatctgtaaaatgggactactttgcttctttccttcatgcagcagaggcgagcattaagacgctcatagacactgaagctcccacagtgtggcctccatgccgatggccggttcctctgacggctcagccctggcacttggccctggagagcagcgagtgctcctgtgcctgccgcgctctcctccaggcctctgcgtccgtggcctctgcgtccgtggccctcc

SEQ ID NO: 40419 - DNA, 601 bp, Human
cctggacgcggctgggcctctctgcctccagtctttggaggctgcacacctcagggagcctggcgggcagctgggccctaagtgccagcctgaggctaggtgggcacctgctgaccctttgccgtggatttccctcctaaaccctggcgaagccctacccccacccccacaggcctgccctctctgcagcctcggcctcccctggacttcacagtcctgttccctggcctttctgcttcctgtcctgatagcacttcctgcaggacgtccctgagggatcagctgaaactcagacgtggcyctgagcctcccctactcaagcctttccagagcccccatcgccatgagaatcgagtccactgtgctccttagggagtcttggaaggaggtggccctcctgcgttggtactcgactctaccacttgctcgctttgtgggctcaggcaggttacctagcctctccgggtctctgtttcctcatctgtaaaatgggactactttgcttctttccttcatgcagcagaggcgagcattaagacgctcatagacactgaagctcccacagtgtggcctccatgccgatggccggttcctctgacgg

SEQ ID NO: 40420 - DNA, 601 bp, Human
ttctgtaaactgtctgagtgcagagatgttctttacaatcccaatacagtacagatttcttccccaaaacgaaatgagcaaggaaaaacagaaaaagagctatatcaaatgtgctcatgaagaaccaagccaatctcacctttctttaaaaacaaaacaaaacgatccttttgaatgtgtggtgcagacgcaggactgaagccacaggcttttggggtgctgtgagcccagggctttgctcagctcacagctagcgcggcgggcagagcaacccttcggcccaagccatcctcgcagcttrcacagaagcttcctgaacctaagggatccgttcccagctctccttaaattcccagtccccaccctgggcctctctccctaacgatcttgtcgctttgggagcccctgaagtgaaccctgaaatactccctccgtcaactctgggctcagacctttgcccttctctgtgtcacaaggaaatttcggtcaagagggtgggaacaggtggtttcagaccgtgcagcaaagccactgccaggtaagttttaaggcaaattttatctcttcttattcagtctgagccggacctaaccttctcacc

SEQ ID NO: 40421 - DNA, 601 bp, Human
aaaaatctggaaggtcaggtgcggtggctcacacctgtaatcccagcactttgcgaggctgaggagggcggatcacgaggtcaggagtttgagaccagcctgaccaacatagtgaaaccccatctttactaaaaatacaaaaattagccgggcgtggtggcgggtgcctgtaatcccagctactcaggaatttgaggcaggagaatcgcttgaacctgggatgcggagaggttgcagtgagccgagattatgtcactttcactgcactccagcctcggtgacagagcgagactccgtatcaaaaaaaaaaaaaaaaatctgtaaagtgggggaaacaatataacccaactcatgggcttgattgaaagagtgagtgagtggatatttgtaaagcagaacaaagtctggcgcatagtgcacttatgagtatttgcttagcaatcttccttcctgggccacacttatattctatgaatccaagggaaagtctttgaatgaggaaaacccaaggacaatggctctaccagattcaggtgccccagtgccccagcaacagaatgtggcaggcacagacagggtccccacaagggcaaacaaaaca

SEQ ID NO: 40422 - DNA, 601 bp, Human
aaaccaaaaaacacatagtcaaatgcaacatgtggaccttgtgtggattctgatttgaaaaaaacatctgccaggagataccctagaggtaatcagatatatttcaatattgactaataggtgatagtgagaaattattattaatactattatcactacccagaacaatcttgttcatgtatttctggacccatttccccgcccaagacactagaagcagaatggtgtctgtctcattaaagacagtaggtatagagcactgaggttaagagtgtgaatcccacttgaccatttactgagygatcttgtgcaagttacttccttctgtgcctgcttggttaaaaaaaaatctggaaggtcaggtgcggtggctcacacctgtaatcccagcactttgcgaggctgaggagggcggatcacgaggtcaggagtttgagaccagcctgaccaacatagtgaaaccccatctttactaaaaatacaaaaattagccgggcgtggtggcgggtgcctgtaatcccagctactcaggaatttgaggcaggagaatcgcttgaacctgggatgcggagaggttgcagtgagccgagattatgtcact

SEQ ID NO: 40423 - DNA, 601 bp, Human
caaaaccaaaaaacacatagtcaaatgcaacatgtggaccttgtgtggattctgatttgaaaaaaacatctgccaggagataccctagaggtaatcagatatatttcaatattgactaataggtgatagtgagaaattattattaatactattatcactacccagaacaatcttgttcatgtatttctggacccatttccccgcccaagacactagaagcagaatggtgtctgtctcattaaagacagtaggtatagagcactgaggttaagagtgtgaatcccacttgaccatttactgmgcgatcttgtgcaagttacttccttctgtgcctgcttggttaaaaaaaaatctggaaggtcaggtgcggtggctcacacctgtaatcccagcactttgcgaggctgaggagggcggatcacgaggtcaggagtttgagaccagcctgaccaacatagtgaaaccccatctttactaaaaatacaaaaattagccgggcgtggtggcgggtgcctgtaatcccagctactcaggaatttgaggcaggagaatcgcttgaacctgggatgcggagaggttgcagtgagccgagattatgtca

SEQ ID NO: 40424 - DNA, 601 bp, Human
catttattttaattaccttattttttaaaagtaaatcatacttccaaatctatgacagaaaaaggaagagactattttataggaaaataactcagggccgggcgcggtggctcacgcctgtaatcccagcactctgggaggccaagacaggcagatcaccttaggtcaggagttggagaccagcctggccaaacatggtgaaaccctgtctttactaaatacacaaaaagtagccaggtgtggtggcacgtgcttgtaatcctagctacccaggaggctgaggcaggagaatcactggagccaggagtccgaagctgcagtgagctgagatcacgccactgcactccagtctgggcgacagagagagactccatctcaaacaaaaacaaaaacaaaaaccaaaaccaaaaaacacatagtcaaatgcaacatgtggaccttgtgtggattctgatttgaaaaaaacatctgccaggagataccctagaggtaatcagatatatttcaatattgactaataggtgatagtgagaaattattattaatactattatcactacccagaacaatcttgttcatgtatttctggacccatttcccc

SEQ ID NO: 40425 - DNA, 601 bp, Human
tgggattacaggcgtgagccaccgtgcccggctggtaatttattttcttattagtgctttgctgcattttccagatagtctacatcagacttttactacaatgataaaatcagaaatttctagttggttaaaggaggcttaggtggagtttgtctttgtccagctatcactgcagagagacaggtgcctgcaaaaccatctcccagctgacctgagtacccagttagccagagaagtccaggggcatgaattacccgctctgcactaaaaggtgtcagagctcccatgcacactctcaacmccaggactgtgggctgggccaggctgtggctgaagctgtgcctggcccccaagccctggccacatctgccaactctgccagtcctggtgatgcagctgcatggcatcccccagaggcagggggctgggactgcaaggcccagatgctgatggagaaaacagatctgccttcaaaatctactgggaaatgaattctaattagcctgggaaaggagcctcaagcctccctggctcagagccactgccctggggcatttcagagcagataagcagatagcaacacacaaacccttttccttgg

SEQ ID NO: 40426 - DNA, 601 bp, Human
caaaaaaaaaaaaaaaaaaaaaaaggccgggcacagtggctcacgcctgtaatcccagcactttgggaggccaaggctggtggatcacctgaggtcgggagttcgagaccagcctgaccaacatggagaaattccgtctctactaagaatacaaaattagccaggcatggtggcgcatgcctgtaaacccagctactcgggaggctgaggcaggagaatcacttgaacctgggaggcagaggttgtggtgagccgagatcgcaccattgcactccagcctgggcaacaagagtgaaactcygtctcaaaaaaaaaggaaagatgcttaacatttttaggcagcggggaaatgcaaattaaaccacagtgacaagtcactttccatccaccaagaaggttacaatcttaaaaaggtaattataataaataatatataattacaagtgttggtgagatgacagagacgtggggatcctcataaaatggggatgtcagatggtgcatttcctgaagaaacaatttggtggtttctcgaaaggttgaatagagtgaccatatgatacagcagatccactcctgggtacacaccctagagaactga

SEQ ID NO: 40427 - DNA, 601 bp, Human
ttagatttctctgtttagagttggctggaggtcatccctgttcgagaatcccaaagccacctgggcacggtggctcatgtctataatcccagcactttgggaggccgaggcaggtggatcacctgaggtcaggagtttgagaccagcctggccaacatggtgaaacctcgtctctactaaaaatacaaaaattagccaccatggtggcaggtgcctatttgtaaccccagctactccagaggctgaggcaggagaattgtttgagtctgggaggtggaggttgcagtgagcagagatcatragccattgcattccagcctgggcaacaagagcaaagccccgtcacaaggagaaaaaaaaaaaaaaaagaatcccaaaggctggaaaaaacatacccaatgaggagtcagtggccttgaggcatcaagagctacaactggggccaaactgctctagtggagccctgggcatttggaagggggaaggctaacaaggagcaaaagaaagaggaagaaagaagagagaagaaaacagaaaatgagacaaaacataaagcagggaacataaaacataaaacaggccaggtgcggtggctcatgcc

SEQ ID NO: 40428 - DNA, 601 bp, Human
tactcgggaggcggagtcaggagaatcgctggaacccaggaggcagaggttgcagtgagctcagatcatgccactgcactctagcctggcaacagagtaacactccacctcaaaaaacaaacaaacaaacaaaaccaaaacaacaacaagacacagcagctcttcttgttaccagcctgttccagccctgttcatagaatctaagggaacaaaatgtaacactaggtatagatcccaggtttagatttctctgtttagagttggctggaggtcatccctgttcgagaatcccaaagccacstgggcacggtggctcatgtctataatcccagcactttgggaggccgaggcaggtggatcacctgaggtcaggagtttgagaccagcctggccaacatggtgaaacctcgtctctactaaaaatacaaaaattagccaccatggtggcaggtgcctatttgtaaccccagctactccagaggctgaggcaggagaattgtttgagtctgggaggtggaggttgcagtgagcagagatcatgagccattgcattccagcctgggcaacaagagcaaagccccgtcacaaggagaaaaaaaaa

SEQ ID NO: 40429 - DNA, 601 bp, Human
cctgtaatcatagcacttgggaggctgagtagggtggatcacaaggtcaagagatcgacatcttcttggctaacacagtgaaaccctgtctctactaaaaatacaaaaaattagccgggcgtggtggcgggcacctgtagtcccagctactcaggaggctgaggtgggagaatggcgtgaatctgggaggcagagcttgcagtgagctgagatcgtgccactgcactccagcctgggtgacagacagagtgagactccgtcccccctaaaaaaaaaaaaaaaaaaaaaaagagaaaaaatmcaaaaattagccaggtgtggtggtgggcacctgtaatcccagctactcgggaggcggagtcaggagaatcgctggaacccaggaggcagaggttgcagtgagctcagatcatgccactgcactctagcctggcaacagagtaacactccacctcaaaaaacaaacaaacaaacaaaaccaaaacaacaacaagacacagcagctcttcttgttaccagcctgttccagccctgttcatagaatctaagggaacaaaatgtaacactaggtatagatcccaggtttagatttctctgttta

SEQ ID NO: 40430 - DNA, 601 bp, Human
ttcatccaggaaagccagtgctcaggatcccgatcctggcagagctgacaatcaagttggggacactgaagacacatctggctatgtgacggtcaagggacctgatggtgtcccagtggatggcctggacatccagccgcgggagggtcatgctggtcctggctgcatccttatctcctggattccagcaaagtccccacctggcctcccttcagtccatcttgtacagttgcccccagaggtgcctacaccacacatctgatcctgtcattctccttttcagtaaccttcagctttccarccttatctcccatatcccaggcttcagatggccgggaataatcagtgttcatcaaacaagctccatctctcccaactccctcacccatgctatgagtgcgcagccctgactcccactgggaggcatttcagcctcgcctgcagccacctcctctgtgcctgtcaaggcatgccccactctgccctgcattgtactttgctttcccttcttgcctgtgagcaacccggaactttggattgtggtttttcgcaagcgaacacctgttctccggtgactagtgtgaggatcagcactgcacag

SEQ ID NO: 40431 - DNA, 601 bp, Human
caggaggagcaccctaagcagtggtccttcttaagtcacagaaactttttttgacattaactctttttaaaatttatttttgtcaaaacactacacatagcttgagaaaggataaaatatgcctggaggccaggcacggtggctcgtgcctgtaatcctagcactttgggaggccaaggtgggaggatctcttgagcccaggagttcaaggttgcagtgagttatatcattctactgctcaccagcttgggcaacagagtgtgaccctctttcttaaaaaaaatcaaaaacctaaaaccasagcaaaacactccagctcacagctgaagctcacagctcacagctgaagtactgagagtacatttcctttcttgttttttcttgtttcccttagttttccttggggctaattgcattagatattagaaacgttgaaagaaaaatttaaaagatgtgaaaagtagaacaaaaaacataaatgacagataaaggttggaaaatagagaagagataagatcagcaaaagattcatccaggaaagccagtgctcaggatcccgatcctggcagagctgacaatcaagttggggacactgaagaca

SEQ ID NO: 40432 - DNA, 601 bp, Human
accaacatggtgaaaccccgtctctactaaaaatataaaaatagccaggcatgatggcaggcacctgtagtcccagctactcgggaggctgaggcaggagaattgcttgaatccaggaggtggaggttgcagtgagccaagatcacaccactgcactccagcctgggtgacagagcgagactccgtctcaaaaagtaaataaataaataaacaaacaaacatacataaatacatcgaagaaccagactctcactgcagggctctgtggtgggtgtcgcagtcctgagcctttgtccagtgycctttcccatcctggaaggcctatctcccccttgaaagtcttcccttgatgaggggcacatatttattatatgtttactttttggaaaagttaacacataggtgttgtataaaattctaagccacgcatggtggctcacgcctgtaatcccagcactttgggaggctgaggcgggcagatcactagaggtcagtagatcgagaccagcctgaccaacatgacaaaaccctactaaaaatacaaaaattagccgggtgtggtggtgagtgcctgtagtcccaggtacttgggaagctgagg

SEQ ID NO: 40433 - DNA, 601 bp, Human
ggaggattgcttgagcctaggaggcacaggttgcagtgagcagagactgtgtgactgcactccagcctggaaaacggagaaagaccctgtctcaaaaataaataaataataaataaataaataggccgggtgtgcggtgactcacgcctgtaaacccagcacttcgggaggctgaggcgggtggatcacctaaggtcaggaatttgagactagcctgaccaacatggtgaaaccccgtctctactaaaaatataaaaatagccaggcatgatggcaggcacctgtagtcccagctactcgrgaggctgaggcaggagaattgcttgaatccaggaggtggaggttgcagtgagccaagatcacaccactgcactccagcctgggtgacagagcgagactccgtctcaaaaagtaaataaataaataaacaaacaaacatacataaatacatcgaagaaccagactctcactgcagggctctgtggtgggtgtcgcagtcctgagcctttgtccagtgccctttcccatcctggaaggcctatctcccccttgaaagtcttcccttgatgaggggcacatatttattatatgtttacttttt

SEQ ID NO: 40434 - DNA, 601 bp, Human
agctgagagcattctgataggagccttacgttcagcacagtagacatttgggccaaggttttgacattaggaagaacaagtcaggcaggccctgtgataggtacttctgtcttcatgattaaatgctatcatcccaagtccctgggaggcagaaatgaccatacctctctgttttaattgaagcagtggggctcagagacatgaatatccagtaagaaggaggaagggcaggggcttaaatccaagagccagccgggtacggtaactcatgcctgtaattagggcactttgggaggctgargcgggtgaattgcttgggcccagaagctcaagaccagcctgggcaacatggccaaaccccatctctactaaaaatacaaaaattagcccagtgcagtggcgcggacctgtagtcccaactactcaggaggctgaggtgggaggattgcttgagcctaggaggcacaggttgcagtgagcagagactgtgtgactgcactccagcctggaaaacggagaaagaccctgtctcaaaaataaataaataataaataaataaataggccgggtgtgcggtgactcacgcctgtaaacccagcac

SEQ ID NO: 40435 - DNA, 601 bp, Human
aacagcaacaacaacaaaaatgtcacacatgtctcacagggtggaaggaacactgagccagcttcccgcattccaaggtcccaaagtgttcttctgtttgcacctgttgcatctgcaatgatctcaaggctgggtgactttggaagggaggagcctggaagttttctccttgctcctgcatcctttgctccttgcctgcccccttcccctgtccacatcgcccactgagagaagccagggtctaacttgtgagcagatctcctctctgcccatttccctcatcaggaggcaacaggggtgrgtggaggatgcccagcagctctgtcaccagccgactccagatcccacagccactctgggaaaacctggaagacagggagagtagccactcatctgctctgcacatgatcaacgctcctccagtgccagtgggctgacgatggttggcttcctgccaatggggcgccgaaagagaagggaactcattttctgacttcaatgatcacaagtgctaggtgcttcaagtccacgcgatgacttaactcaacgggccctgaggtgggcacgatgatgtcaatttttcaggtgaaagactcaaggc

SEQ ID NO: 40436 - DNA, 601 bp, Human
gttgggagtttgagaccagcctgaccaacatggagaaaccctatctctcctaaaaatacaaaattagccaggcgttgtggcacatgcctgtactagggaggctgaggcaggaaaatcacttgaacctgggaagcagaggttgtggtgagccgagatcatgccactgcactccagcctgggcaacaagggggaaactccgtctcaaaacagcaacaacaacaaaaatgtcacacatgtctcacagggtggaaggaacactgagccagcttcccgcattccaaggtcccaaagtgttcttctstttgcacctgttgcatctgcaatgatctcaaggctgggtgactttggaagggaggagcctggaagttttctccttgctcctgcatcctttgctccttgcctgcccccttcccctgtccacatcgcccactgagagaagccagggtctaacttgtgagcagatctcctctctgcccatttccctcatcaggaggcaacaggggtgggtggaggatgcccagcagctctgtcaccagccgactccagatcccacagccactctgggaaaacctggaagacagggagagtagccactcatctg

SEQ ID NO: 40437 - DNA, 601 bp, Human
ccccattactgttactgtccctgtgctgagctactgtttggagaggaggaacccctccccctggggagtctccccccagaggagacacccacaggccacctactcttccaatcccagtatctcacaggccaccctctggcctccaaccaccagccctttcgtggaccttaagaatgtcacataggtcgggtatggaggttcatgctggtaatcccagcactttgggaggccaaggcaggcagatcacctgaggttgggagtttgagaccagcctgaccaacatggagaaaccctatctctmctaaaaatacaaaattagccaggcgttgtggcacatgcctgtactagggaggctgaggcaggaaaatcacttgaacctgggaagcagaggttgtggtgagccgagatcatgccactgcactccagcctgggcaacaagggggaaactccgtctcaaaacagcaacaacaacaaaaatgtcacacatgtctcacagggtggaaggaacactgagccagcttcccgcattccaaggtcccaaagtgttcttctgtttgcacctgttgcatctgcaatgatctcaaggctgggtgactttgga

SEQ ID NO: 40438 - DNA, 601 bp, Human
ggtttgcaaggagaccagctgaggcggagctgggatggagccagagaagcagagaggtgagagcagaggactgtcccggccagctgaggggactcaccactgtccagggctgctgggagagctgcaacgctgatcacaaatccatgggagatgattagaggttcctcagcacctggtaaagcaggagggcgatggagtcacactctacaggggaagatagccccaaaagcgacacaacttctctgaggctcgatttccacttctgtaggatgggatgtgcaacatttaacctcttagggcagtgagatgctgctgcaaacacctatgaagagggggcctgggaaagcattccttacacacatgcccccattactgttactgtccctgtgctgagctactgtttggagaggaggaacccctccccctggggagtctccccccagaggagacacccacaggccacctactcttccaatcccagtatctcacaggccaccctctggcctccaaccaccagccctttcgtggaccttaagaatgtcacataggtcgggtatggaggttcatgctggtaatcccagcactttgggaggccaaggca

SEQ ID NO: 40439 - DNA, 601 bp, Human
ttgcttttttctgggatcaacttgattttttccctgtttgtcctctatccagatactaagaaagcttatagcttgactgtagtgtgattcccttctcataggagaaactccaggcagtcctcaagaggctgaagaaggaagaggaggaagctgagaagctggaagctgacatcagagaagagaaaacttcctggaaggcaagaggagattctgaaggatttctgagacaggaatcttgacaggaccttaatccaaggaggcctcgtcctttttattccttgacattgcatgagtcctgaarccatttgattagttctcttctctgtcctgtccctgttgggggtggaggctagaaagtggacatgttacaattacacatacatacctggaactgagcacaaagatagactctatgatgaggaaggctagcaaatactgtgttccattgctcttttccaacagggctctactacttctggtggaagacactacataaaggactatggttttcctcaagattcaaattaggagtgtggtaaggcaggcagtcatgaatatccaggaaagctatctagaagctaagccttatgttttatatttt

SEQ ID NO: 40440 - DNA, 601 bp, Human
ggaagctgacatcagagaagagaaaacttcctggaaggcaagaggagattctgaaggatttctgagacaggaatcttgacaggaccttaatccaaggaggcctcgtcctttttattccttgacattgcatgagtcctgaaaccatttgattagttctcttctctgtcctgtccctgttgggggtggaggctagaaagtggacatgttacaattacacatacatacctggaactgagcacaaagatagactctatgatgaggaaggctagcaaatactgtgttccattgctcttttccaacrgggctctactacttctggtggaagacactacataaaggactatggttttcctcaagattcaaattaggagtgtggtaaggcaggcagtcatgaatatccaggaaagctatctagaagctaagccttatgttttatattttgtctcagggttggcctagataagacagtttgaggtcattgttttggtaggtactgaaaggaaaatagtaggaaaaaatagcttccctccaagtacctctattgcttctactcccttgctgatttgaactccctgaaaaaaaaaatcgatatatagataat

SEQ ID NO: 40441 - DNA, 601 bp, Human
acataaaggactatggttttcctcaagattcaaattaggagtgtggtaaggcaggcagtcatgaatatccaggaaagctatctagaagctaagccttatgttttatattttgtctcagggttggcctagataagacagtttgaggtcattgttttggtaggtactgaaaggaaaatagtaggaaaaaatagcttccctccaagtacctctattgcttctactcccttgctgatttgaactccctgaaaaaaaaaatcgatatatagataatacaaatatatatatacagataatataaatccacacacacacacacacacacacacacacacacacacatatatatatatatatatttccctactggctcctaatcccttgcacaataggccttagcctgacaaacttactacaactctctcttgtccatccttgcagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagc

SEQ ID NO: 40442 - DNA, 601 bp, Human
ggagtgtggtaaggcaggcagtcatgaatatccaggaaagctatctagaagctaagccttatgttttatattttgtctcagggttggcctagataagacagtttgaggtcattgttttggtaggtactgaaaggaaaatagtaggaaaaaatagcttccctccaagtacctctattgcttctactcccttgctgatttgaactccctgaaaaaaaaaatcgatatatagataatacaaatatatatatacagataatataaatacacacacacacacacacacacacacacacacacacayatatatatatatatatatttccctactggctcctaatcccttgcacaataggccttagcctgacaaacttactacaactctctcttgtccatccttgcagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcg

SEQ ID NO: 40443 - DNA, 601 bp, Human
attcatcctctgtccctgcatccagccctggatcttttattttatatgtgtttgtcatacacatggagggccttgtcaaatcctaaaatagggcatggagacagcttctttatatgtactttgcttacttagaaatagaaggtaccggatcattatgcaaggttctctttagatttccaaaagtagactcgagcctcaggacggtagctgtgactctggtgatgataattaatctctgccagttcacacactttagaagctcctatggaaaagtgtagtccttgttccttgtgtctaccaytgccaacccacttggaaacatcaagtttcttacaaagacataaaattctaaccatttttagttaggttgtcataacttctcctttgccgagtgttcgtgtttcccaggaatctgaaatctcaaatatgcgccattccactggagttcaggctttgaactcgggcacaggctgacaggatttccctacagagccccgtatcacagtcaggatctacagctcagaataccacatctctggcccctcccagaaggcccactgagatgcagtgagttttccacatatcacataccatttctaca

SEQ ID NO: 40444 - DNA, 601 bp, Human
ttatatgtgtttgtcatacacatggagggccttgtcaaatcctaaaatagggcatggagacagcttctttatatgtactttgcttacttagaaatagaaggtaccggatcattatgcaaggttctctttagatttccaaaagtagactcgagcctcaggacggtagctgtgactctggtgatgataattaatctctgccagttcacacactttagaagctcctatggaaaagtgtagtccttgttccttgtgtctaccattgccaacccacttggaaacatcaagtttcttacaaagacawaaaattctaaccatttttagttaggttgtcataacttctcctttgccgagtgttcgtgtttcccaggaatctgaaatctcaaatatgcgccattccactggagttcaggctttgaactcgggcacaggctgacaggatttccctacagagccccgtatcacagtcaggatctacagctcagaataccacatctctggcccctcccagaaggcccactgagatgcagtgagttttccacatatcacataccatttctacaggtagcaaagtcttttcctatcgttttatccaattttttat

SEQ ID NO: 40445 - DNA, 601 bp, Human
ttaatctctgccagttcacacactttagaagctcctatggaaaagtgtagtccttgttccttgtgtctaccattgccaacccacttggaaacatcaagtttcttacaaagacataaaattctaaccatttttagttaggttgtcataacttctcctttgccgagtgttcgtgtttcccaggaatctgaaatctcaaatatgcgccattccactggagttcaggctttgaactcgggcacaggctgacaggatttccctacagagccccgtatcacagtcaggatctacagctcagaatacyacatctctggcccctcccagaaggcccactgagatgcagtgagttttccacatatcacataccatttctacaggtagcaaagtcttttcctatcgttttatccaattttttattatttccattagatatcaaaggagggtttaattatttcatttttaaggaagaaactgtgctttcaagaaatgaagaccttctcaaggtcacccagaggataagagggaaagtagacacagtcacatttcttctggatccagggtccggctctcccttctccccctcctcaggctcagggagaagggt

SEQ ID NO: 40446 - DNA, 601 bp, Human
tgagttttccacatatcacataccatttctacaggtagcaaagtcttttcctatcgttttatccaattttttattatttccattagatatcaaaggagggtttaattatttcatttttaaggaagaaactgtgctttcaagaaatgaagaccttctcaaggtcacccagaggataagagggaaagtagacacagtcacatttcttctggatccagggtccggctctcccttctccccctcctcaggctcagggagaagggttcaagtgcatcagtgatgtgaaggagatgaaaccagtgaygtgggagggatggacacaggatgagagatgtgggggtcaaaaaatttttttcatccctaggagtgagatctggaggctgaaaaagccaaaaatggtttccaagaaactgaagactgtattccatgctccagatctgagtaggatgctgcaaatgtttagaggtgaggagaagcagacaaagactgtggatgtgggattgttgtggtgtcaggtaataaactgtctaggtgggataacttaaaattgaggacagaagagaggagggaggtcagagaataaggaatattctgtggtgaagag

SEQ ID NO: 40447 - DNA, 601 bp, Human
ggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggmtccctcatttacaagttctctaaatgttgcttttctcagcctgtttatccatatttcaatccttggaactgtccagctcccatgactctatgcccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatatttt

SEQ ID NO: 40448 - DNA, 601 bp, Human
ggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtctygacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatgtgaagaggcccaaagcctgttagccaccatccatgctacctaggtagtc

SEQ ID NO: 40449 - DNA, 601 bp, Human
agcctgtttatccatatttcaatccttggaactgtccagctcccatgactctatgcccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcartatgggtataacatccttgccttcccatttatccatgtttcactttatcactgatgtgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatg

SEQ ID NO: 40450 - DNA, 601 bp, Human
ccaccaagctcttgaattttctcatttcttcacctacaaccctttgtctcgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatrtgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgta

SEQ ID NO: 40451 - DNA, 601 bp, Human; identical to SEQ ID NO: 31880

SEQ ID NO: 40452 - DNA, 601 bp, Human
agacttttatggaggcagtgtgagctttaatttgagagacatgtcaatgaaacctccagtatcaataacaaattgttatgataattgcttattttttcaggacctttgaagcaaaataaatagaaatcagttttcatcttgaaaatggtttactactttgtcattagtaaacactttgcttctcacaaataactccacctgtgccttcctgggaaactaccaccagtttcaaatctcaataagatgttagtttcacaggaaatgtggagctgaacaaagaaatgatgagtatgcttggccraactatgcagcactatattaatatttctttgctaaattttttataaaataaacaaataagccgattttttaaagtaaatataaggatatgtaattaccatctaaatgaagatttaaatttaaagagacatatatattttttgttcttttgtgcaaactgagagtatgggattctttatgaagcaattatttggaaattaaatagttatggcttccttcaaaaataaaactgcagatttaattaacgaatattaaatacagatcaatctactgataggcagtcatgttctacatatatgag

SEQ ID NO: 40453 - DNA, 601 bp, Human
aatgtggagctgaacaaagaaatgatgagtatgcttggccgaactatgcagcactatattaatatttctttgctaaattttttataaaataaacaaataagccgattttttaaagtaaatataaggatatgtaattaccatctaaatgaagatttaaatttaaagagacatatatattttttgttcttttgtgcaaactgagagtatgggattctttatgaagcaattatttggaaattaaatagttatggcttccttcaaaaataaaactgcagatttaattaacgaatattaaatacaratcaatctactgataggcagtcatgttctacatatatgagtaaacatgacacttcttttagtcaactaataggaaattcaattagaaaaaaattgaattattcaggtaatatacaatattaagaatgtagaatagaactaaaagaaaaagaagtcacataatctcttattagaaataatgaaagtaaaatgagaattataatatcagtactgcatgttacatattcttctttaaaattttgtaataaacattgacagtgtttggtaggcacagggaaacaggataacgtagagtcattac

SEQ ID NO: 40454 - DNA, 601 bp, Human; identical to SEQ ID NO: 31881

SEQ ID NO: 40455 - DNA, 601 bp, Human
attttcagacattggaagcaggtagaaacagtatctaagccaggcatggtggctcacgcctataatcccaatactttgagagcctgaggagggaagatcacttgaggccaggagctgaagaccagcctgggcaacatactgagaccctgtctctataaaaataaataaaaacaagtcacttggtatggtggtgtgtgcctggagtcccagctacttgggggaaaaaaaaaagaaatactatctagaagcattttctctacagactctattaaactgaacactgtcagatgtttacataaasctaaatcagatcacgtgactcctttaattaaagccatctcaactcactcaggaataaaagtcaaaatagttgcaacagcctatcagcctctgcctgatctacccttcaccctcccctcacctctgacctcatcttccagactgaattctacactcccacctccacacacctgtctggcagcctcctgccttagagcctttagaggtctatttcccccaacctctctgctttaccgcattgccacaggaggagggtagttttttaaagtagggatttccttctgcttctcccacactcagc

SEQ ID NO: 40456 - DNA, 601 bp, Human
gaatgtttacctgtgaccatctccagggtttatgcaccaagagtgcagctcaagtaaacaacaatagaaatgtgcttatattttcagacattggaagcaggtagaaacagtatctaagccaggcatggtggctcacgcctataatcccaatactttgagagcctgaggagggaagatcacttgaggccaggagctgaagaccagcctgggcaacatactgagaccctgtctctataaaaataaataaaaacaagtcacttggtatggtggtgtgtgcctggagtcccagctacttgggggaaaaaaaaaagaaatactatctagaagcattttctctacagactctattaaactgaacactgtcagatgtttacataaagctaaatcagatcacgtgactcctttaattaaagccatctcaactcactcaggaataaaagtcaaaatagttgcaacagcctatcagcctctgcctgatctacccttcaccctcccctcacctctgacctcatcttccagactgaattctacactcccacctccacacacctgtctggcagcctcctgccttagagcctttagaggtctatttcccccaacc

SEQ ID NO: 40457 - DNA, 601 bp, Human
tcaccctttcagtgttgaacaggagaatctaaaacactgaatgtttacctgtgaccatctccagggtttatgcaccaagagtgcagctcaagtaaacaacaatagaaatgtgcttatattttcagacattggaagcaggtagaaacagtatctaagccaggcatggtggctcacgcctataatcccaatactttgagagcctgaggagggaagatcacttgaggccaggagctgaagaccagcctgggcaacatactgagaccctgtctctataaaaataaataaaaacaagtcacttggyatggtggtgtgtgcctggagtcccagctacttgggggaaaaaaaaaagaaatactatctagaagcattttctctacagactctattaaactgaacactgtcagatgtttacataaagctaaatcagatcacgtgactcctttaattaaagccatctcaactcactcaggaataaaagtcaaaatagttgcaacagcctatcagcctctgcctgatctacccttcaccctcccctcacctctgacctcatcttccagactgaattctacactcccacctccacacacctgtctggcagcct

SEQ ID NO: 40458 - DNA, 601 bp, Human
tatgatgtcattaggcagcttttgaggtcaactcaatatttatttattccccttcagtaaagcaccatcaacagaaagcgactccacagccaggatctctctggtacagcagcagccttaaaggaccacaaaaacaaatcaccctttcagtgttgaacaggagaatctaaaacactgaatgtttacctgtgaccatctccagggtttatgcaccaagagtgcagctcaagtaaacaacaatagaaatgtgcttatattttcagacattggaagcaggtagaaacagtatctaagccaggcrtggtggctcacgcctataatcccaatactttgagagcctgaggagggaagatcacttgaggccaggagctgaagaccagcctgggcaacatactgagaccctgtctctataaaaataaataaaaacaagtcacttggtatggtggtgtgtgcctggagtcccagctacttgggggaaaaaaaaaagaaatactatctagaagcattttctctacagactctattaaactgaacactgtcagatgtttacataaagctaaatcagatcacgtgactcctttaattaaagccatctcaactc

SEQ ID NO: 40459 - DNA, 601 bp, Human
tggcataaaacagaaactaaagtcaggattgcgattttggctgtgccattaactgctgagctcttgggtctaatcagttgcatttctttgtacaatggataggtgggactaggtagtttctctctaacaatgcttcagatctcaattttttttttttttttttttttttttgagacagagtttcactcttgttgcccaggctggagtgcagtggtgtgatcttggctcaccgcaacctccacctcccaggttcaagcaattctcctgcctcagtctcccgagtagctgggattacaggcawgcgccaccatgcccggctaattttgtatttttagtagaaacagggtttctccatgttggtcaggctggtctcgaaatcccaacctcaggtgatcctcctgcctcagcctcccaaagtgctgggattacaggcatgagccaccacacccagccctcaatttttattatctatatttttacattttcataagaagagtcagaattactatcggctgtctctgggaagccaatacagagaggagctatgatgtcattaggcagcttttgaggtcaactcaatatttatttattccccttcagt

SEQ ID NO: 40460 - DNA, 601 bp, Human
atgagccactgtgcctggccaaaaaaaaaaagtattctgtatatgaaaggccaggtaccattactgagatggcataaaacagaaactaaagtcaggattgcgattttggctgtgccattaactgctgagctcttgggtctaatcagttgcatttctttgtacaatggataggtgggactaggtagtttctctctaacaatgcttcagatctcaattttttttttttttttttttttttttgagacagagtttcactcttgttgcccaggctggagtgcagtggtgtgatcttggctcaccrcaacctccacctcccaggttcaagcaattctcctgcctcagtctcccgagtagctgggattacaggcaagcgccaccatgcccggctaattttgtatttttagtagaaacagggtttctccatgttggtcaggctggtctcgaaatcccaacctcaggtgatcctcctgcctcagcctcccaaagtgctgggattacaggcatgagccaccacacccagccctcaatttttattatctatatttttacattttcataagaagagtcagaattactatcggctgtctctgggaagccaata

SEQ ID NO: 40461 - DNA, 601 bp, Human
agctacctcggaggacaaatctattaacaaagtttcaatagacttaataaagatgaaaatcaaattgctgtatcataggaataaatataatttattcgatcttatttaaataaaaattcatttaaaaaaacagttttctttttcttttttttttttttgagatggagtttcgctcttattgcccaggctggagtggaatggcgcgatctcggctcactgcaaactccacctcccaagttcaagcaatcctcctccctcagcctcctgagtagctggattacaggcatgcgccatcacgccyggctaattttgtatttttagtagagatggggtttttccatgttggccaggctggtctcgaactcccgacctcaagtgatccatccacctcgtcctcccaaagtgctgggattacaggcatgagccactgtgcctggccaaaaaaaaaaagtattctgtatatgaaaggccaggtaccattactgagatggcataaaacagaaactaaagtcaggattgcgattttggctgtgccattaactgctgagctcttgggtctaatcagttgcatttctttgtacaatggataggtgggactagg

SEQ ID NO: 40462 - DNA, 601 bp, Human
agtccaagatcaaggtgcttacagcttctttgataagagcctacttcttggttcacagaactgaggcttcttactgtgtcctcacatggcggaagaggcctttgagctccctcggccctcttttataagggctctgccctcatgacctaatcacctacccaaagacctcacctcctaataccatcaccctgggggttgctatttgattaattcatatcatatgaattttgggggcacagaaacattcagaccatactataccctgcataaaatcttccatccacataagaaataaaaaggyatgacttgaattcacacaggtgaattcagtattcatttgtgactctgaataaaaggggcattcaagaaaaattttaaatttaaaatcactttttcctttttgcctacaaacatcctcactcccaacaattccttcccttcactgatggcagagtaatcagattccaaaattcagctacctcggaggacaaatctattaacaaagtttcaatagacttaataaagatgaaaatcaaattgctgtatcataggaataaatataatttattcgatcttatttaaataaaaattcatttaaaaa

SEQ ID NO: 40463 - DNA, 601 bp, Human
tccaccctgtcttagtctgttctggctgctataacaaaatgctataaactgggtggtttataaacaacagaaatttatttctccctgttctgggggctggaaagtccaagatcaaggtgcttacagcttctttgataagagcctacttcttggttcacagaactgaggcttcttactgtgtcctcacatggcggaagaggcctttgagctccctcggccctcttttataagggctctgccctcatgacctaatcacctacccaaagacctcacctcctaataccatcaccctgggggttgytatttgattaattcatatcatatgaattttgggggcacagaaacattcagaccatactataccctgcataaaatcttccatccacataagaaataaaaaggcatgacttgaattcacacaggtgaattcagtattcatttgtgactctgaataaaaggggcattcaagaaaaattttaaatttaaaatcactttttcctttttgcctacaaacatcctcactcccaacaattccttcccttcactgatggcagagtaatcagattccaaaattcagctacctcggaggacaaatctatta

SEQ ID NO: 40464 - DNA, 601 bp, Human
ccctcctggaactccaggtgaggggtctggagcaccagccattctgaaagacacaaatatgataagaaaaagttgtaaggatagattccaagggtttttcagtctcagaggtacgttactcacagaacttgacatgatgtctggcagacagaaatgaagatgcttcatgacagatgtgagcattctcttataggcaatatatggtattatatctgtgggacttctaaaagcagaagttttcagaggtttcaaagatgcagagcagatatttaaaacaattctgaggaatttaaaatactaygtttgagtagagaaatgagcgcatttcagtaactgtagaggctactcgacagggcctgaagccgtcagtttttgtggtctggggattactaatttaatggtaaattttgtacaagctttgggaagtgagggtgggcagccttgaactgtattagcaaagaagtagagccttcttccccccttttttccacatgctgttgctggttaaaaaaaaaaaaaatagagccttaatcatccctcatccaccctgtcttagtctgttctggctgctataacaaaatgctataaactgggtggttta

SEQ ID NO: 40465 - DNA, 601 bp, Human
atttctgggattttccattctggaagaatgtgaccttgaccagaggcttgtccttccagctgtggcacctcagcatgatggtttctccctcctggaactccaggtgaggggtctggagcaccagccattctgaaagacacaaatatgataagaaaaagttgtaaggatagattccaagggtttttcagtctcagaggtacgttactcacagaacttgacatgatgtctggcagacagaaatgaagatgcttcatgacagatgtgagcattctcttataggcaatatatggtattatatctrtgggacttctaaaagcagaagttttcagaggtttcaaagatgcagagcagatatttaaaacaattctgaggaatttaaaatactacgtttgagtagagaaatgagcgcatttcagtaactgtagaggctactcgacagggcctgaagccgtcagtttttgtggtctggggattactaatttaatggtaaattttgtacaagctttgggaagtgagggtgggcagccttgaactgtattagcaaagaagtagagccttcttccccccttttttccacatgctgttgctggttaaaaaaaaa

SEQ ID NO: 40466 - DNA, 601 bp, Human
tctcccctccctacatcttggcagactccccataccttggacagtgatggtcacaggcttggatgagaacagcgtgtagcctatgtttcctgtgcagtggtaatcaccactgtgactgtggtttgcttgtgggatggagaaggtgggatccaaatgggagaatttctgggattttccattctggaagaatgtgaccttgaccagaggcttgtccttccagctgtggcacctcagcatgatggtttctccctcctggaactccaggtgaggggtctggagcaccagccattctgaaagacayaaatatgataagaaaaagttgtaaggatagattccaagggtttttcagtctcagaggtacgttactcacagaacttgacatgatgtctggcagacagaaatgaagatgcttcatgacagatgtgagcattctcttataggcaatatatggtattatatctgtgggacttctaaaagcagaagttttcagaggtttcaaagatgcagagcagatatttaaaacaattctgaggaatttaaaatactacgtttgagtagagaaatgagcgcatttcagtaactgtagaggctactcgacagg

SEQ ID NO: 40467 - DNA, 601 bp, Human
tccaagctctggcccctacttgttggtcaatacttagccaggcttccaccccactcctctttgctccagtgcccaattttgctgctatgggctttctcagacctccatgtaggcccatgtgacctcagcccttgtccatcccctcttctcccctccctacatcttggcagactccccataccttggacagtgatggtcacaggcttggatgagaacagcgtgtagcctatgtttcctgtgcagtggtaatcaccactgtgactgtggtttgcttgtgggatggagaaggtgggatccaaaygggagaatttctgggattttccattctggaagaatgtgaccttgaccagaggcttgtccttccagctgtggcacctcagcatgatggtttctccctcctggaactccaggtgaggggtctggagcaccagccattctgaaagacacaaatatgataagaaaaagttgtaaggatagattccaagggtttttcagtctcagaggtacgttactcacagaacttgacatgatgtctggcagacagaaatgaagatgcttcatgacagatgtgagcattctcttataggcaatatatggtatt

SEQ ID NO: 40468 - DNA, 601 bp, Human
ctttcatccccatggcaaccctgtgaggtgactcctattagtgctcttgttgaggatgaactaataaatgaactaataaataaaaggtgggcctagatcggaatgcatatctagccctaagagcgggattctggcaatgtctggggttaggccctgggccaaatggaaactgataacaaaagggactgggaggagctacaaacctgaaatccgctttttcctgcagtagatcaaggccactacagcagcaacaatggctgctacagcagtcgcaatgaccacagccacaatgatccccatyggtgaagagctgcccatgctgggcactagggaagacagacattagggcaggatggggggttactattttaatgacaacgtttgtattctccctgtcccacctcccacctccaatgctatgtcccagtgcttgtcacctgaagctcttctgtgtctgagtcactcaccaatgcaagattcaccacatccccagcctcactggcacagggtttctgtggctggacttgtgcctcctccctacccaggtttctccaccaaatgaatgaaagcacactggtgagcatgcaggagcagagggaag

SEQ ID NO: 40469 - DNA, 601 bp, Human
ccctgctcaggggctgctcccacctggaaaagggctagtccagaggcagaattcagctcacccatggggacgcccaggagtgtcagaaaggccacgccatggcatctgtctgaggcttgctctgccttttaaaaacacccctgtgtctcacagtctgcctctctctctctctgtttctctgtatttacttatcatcagtaactgaggtgttggctatgaaccaattgcaaagtgctttgtgaggtgttagtgggattatttctctttctcagaggcttgcagtaccctatctactcccccmtcatataagccccacccagcctcagtccctgccttggcccagtgcctggagagtcctccttccctagctaagcgctgccctcacataccacctcctccagaatggcaacagccctgtttgtgtgctgttactgcctaccaggcactggtgtaagagcatcagcctctttcatccccatggcaaccctgtgaggtgactcctattagtgctcttgttgaggatgaactaataaatgaactaataaataaaaggtgggcctagatcggaatgcatatctagccctaagagcgggattctggc

SEQ ID NO: 40470 - DNA, 601 bp, Human
tcagtactcattgcatttttttacttaggctcttgatgttagtggatactggtattatatgcaacttctgaataagttttaaagaatttgaataatcagttgaataaaaacctgaaaagtggtgaatgaaaatttgagagataaggaaaggctagagttggcattcaggggacacaaatagtttgaagactctggtagtagaattatgcaagttttcttaaaattaggcaatatataatattgatactacgaaattcagtacttttccgtaggagggggtcaggtctcattgccttttccrtaccccaaaatatgaaaggtggtctacaattttgttgtggcattgtcacagcagttggccccatgttacatttcctcttgtggcacctctgagaggtgtttcttcattacctcttgacaagagtatattttgattgactgctctatgtgcttgtttattttttatagcatttaaatcaaacggtattgagatggattgggttatgaaacataatggtccaaatgacgctagtgatgggacagtacgacttcgtggactaccatttggttgcagcaaagaggaaatagttcagttctttca

SEQ ID NO: 40471 - DNA, 601 bp, Human
catatgatagaccaataggaggaagagggggttattatggagctgggcgtggaagtatgtatgacagaatgcgacgaggaggtgatggatatgatggtggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaawtaagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatggg

SEQ ID NO: 40472 - DNA, 601 bp, Human
gcgcgatctcggctcactgcaacctccacctcccgggttcaagttattcttctgcctcagcctcctgaatagctgggattacaggggcacaccccaccactcctggctaactttttgtatttttagtagagatggggtttcaccatgttgatcgggctggtcctgacctcatgatccgcctgccctggcctcccaaagtgctgggattacaggcgtgagccactgcgcctgacctgtattagggtttgaaagagtgaatatataaatattagtgatttggtttggctttctaggctagatrgtgattagaaactgaggagttggaaataacaggaatagatgctgctgttgtcactgatgtgaaactggttggtttcagatttgttaggaggtcagcaaacttcagtccatgggctaaatccggtcacaccattcctctacctgttgagtggttacattagagacccaatggccattcaggccaaaagtactgactctggctttgaaagcaatggtgtgctctagatcttactgggaatcagctggcctgagttccaactgcttttaatgatagtttaaaacctggctaacttgtgattag

SEQ ID NO: 40473 - DNA, 601 bp, Human
gattacaggcgtgagccactgcgcctgacctgtattagggtttgaaagagtgaatatataaatattagtgatttggtttggctttctaggctagatagtgattagaaactgaggagttggaaataacaggaatagatgctgctgttgtcactgatgtgaaactggttggtttcagatttgttaggaggtcagcaaacttcagtccatgggctaaatccggtcacaccattcctctacctgttgagtggttacattagagacccaatggccattcaggccaaaagtactgactctggctttraaagcaatggtgtgctctagatcttactgggaatcagctggcctgagttccaactgcttttaatgatagtttaaaacctggctaacttgtgattagaaccaaatgatatcttttggggaacaatttcatatagtcttaaataggtggctttattcaaaccgcatagttccaaatcatgatatcccgtatttctctctgtgtgtttgtgtgctttttttttttgacagagtctcccactctgtctctctgaggctggagtgcagtggcgtgatctctgcttactgcagctcccacctcctg

SEQ ID NO: 40474 - DNA, 601 bp, Human
gaactcttcttgaattctactcctggaggcggctctggcatgggaggttctggaatgggaggctacggaagagatggaatgggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggtaagtatctctagttcagtttgtgttagtccgcatatgtagtgcaarctttaaagtgcaggtattacttttattattttatgcagatatctcctgctgagtgattcttaatatctttttcttaaggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagatt

SEQ ID NO: 40475 - DNA, 601 bp, Human
gctttacttcattccatgtactcttatatttgatactattattctatttcattctattttatctttcaatgctggctggaagctagtgaattggttttatgacttagtaatggggttgcaagttgcaaaatactaccctgtacagtccacttgtcccacaggtgatcccatctccaagctcctataaagcaatattaacaacccccatctgtctacaggattgtggttatggagagggtggagatgcctactgcacagcctgccctcctcgcaggtacaaaagcagctggggccaccacaratgtcagagttgcatcacctgtgctgtcatcaatcgtgttcagaaggtcaactgcacagctacctctaatgctgtctgtggggactgtttgcccaggtgagcttgctttatgagaccaagcttgtctgggcttttctagctgttggaggtttctcccatcctcacctctcagaacttagtcgaaatattcttcttataaacataatattcagtttaagctcccagaagagagaagtggtgtcttcccaagatacctctataaagtgcttagcacattgtcagtcacagatgagtacttga

SEQ ID NO: 40476 - DNA, 601 bp, Human
acttgtcccacaggtgatcccatctccaagctcctataaagcaatattaacaacccccatctgtctacaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggtgagcttgctttatgagaccaagcttgtctgggcttttctagctgttggargtttctcccatcctcacctctcagaacttagtcgaaatattcttcttataaacataatattcagtttaagctcccagaagagagaagtggtgtcttcccaagatacctctataaagtgcttagcacattgtcagtcacagatgagtacttgaccgcttttccatcatcactctcagctgaagaccaaagttcaaggtaaatctcactgtagacttaaaagaagttatgatgtacttggtatcaaagcagtgcacccctctcttgtggaattaggtctccttttggctacatggtgtcatg

SEQ ID NO: 40477 - DNA, 601 bp, Human; identical to SEQ ID NO: 39261

SEQ ID NO: 40478 - DNA, 601 bp, Human
aacatggagctgggaaagagagtaatgcagaagtggaaaaatggcagggtacagtggatcacacctgtaatctcaacactttgggaggctgaggcaggaggattgctggggcccaggagtttggcaatctgagcaatgtagtgagaccctgtctctacaaaaatatttgaaaattggccaggcgtggtggctcacgcttataatcccagcactttgggaggccaaggcgggtggatcacgaggtcaggagatcgagactatcttgctaacatggtgaaaccctgtctctactaaaaatacaaaaaaaaaaaaaaattagccgggcgtggtggcaggcacctgtagtcccagctacttgggaggctgaggcagaatggcgtgaacccgggaggcggagcttgcagtgagcggagatcgcgccactgcactccatcctgggtgacagagtgagactccgtctcaaaaaatatatatatataatatatatatatttaaaaattagctgggcatggtagcatgcacctttggtcccagctactcaggaggctgaggtgggaggattgcttgagcctgggaggttgagactgcagtgagccgtgct

SEQ ID NO: 40479 - DNA, 601 bp, Human
cagggaactgaaagatttgagtggccccagcatcgtggtcagtagttcaaagagctttggtcatggggggaagtacttttccctctcccattctttctctttttttttttcttttttgagacggagtctcgctctgttgcccaggctggagtgcagtggcacaatcttggctcactgcaacctccgcctcccggattcaagcgattctcctgcctcagcctcccaagaagctgggactataggtgcatgccaccatgcccagctaattttttgtatttttagtagagatggggtttcaccrtgttagccaggatggtcttgatttcctgacatcgtgatccactcgactcggcctcccaaagttctgggattacaggcgtgagccattgtacccagcccctctccccattcttatcactcctccctgccctgtcagcccccctttctgctttgctcatgtcctcttactcctgctttcctccttctgccccctgttccccaggcaagccaggaagcagacaatgttctgatcctgcaggacaggaagctggtaaccgggccagggaaacggtatctgcaggtgtccaagaaccgctttgat

SEQ ID NO: 40480 - DNA, 601 bp, Human
ctgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattsaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgct

SEQ ID NO: 40481 - DNA, 601 bp, Human
taagatcgtgccattgcactccagtctgggcgacaagagcaaaaactctgtctcaaaaaacaaaaaacaaaacaaaacaaaaaattggaagtttacaaaggaaacctctctgggtctgagaagtctaactgagttagaagtaaaaactttgcatatcctccatggcttgttttttaaaccagacgcacatattccttttattttttaacatagttgagaaggcttgtcctatataaagaataaagatggccagatgcagtggcccctgtctgtaatcccagcactttgggaggccgagatsgtggatcacttgaggtgaggagttcaagaccagcctggccaacatggtgaaactctgtctctactaaaaataacaaaaatcacccaggcgtggtgctgtgcacctgtagtcccagctacttgagaggctgaggcacaagaatcgcttgaacccaggaggcagaggttgcagtgagccaagatcacacaactgcactccagcctggacgacagagcaagactctcaaaaaaataaataaataaagaataattcagtcaattctccatgtgtctgttttttgatactgaataaagcttccta

SEQ ID NO: 40482 - DNA, 601 bp, Human
tcctggccaacatggtgaaacctcatctctactaaaaatacaaaaattagctgagcatggcagtgggctcctgtaatcccagctactcgggaagctgaggcaggagaactgcttgaacccgagaggtggaggcttcagtgagctaagatcgtgccattgcactccagtctgggcgacaagagcaaaaactctgtctcaaaaaacaaaaaacaaaacaaaacaaaaaattggaagtttacaaaggaaacctctctgggtctgagaagtctaactgagttagaagtaaaaactttgcatatcmtccatggcttgttttttaaaccagacgcacatattccttttattttttaacatagttgagaaggcttgtcctatataaagaataaagatggccagatgcagtggcccctgtctgtaatcccagcactttgggaggccgagatcgtggatcacttgaggtgaggagttcaagaccagcctggccaacatggtgaaactctgtctctactaaaaataacaaaaatcacccaggcgtggtgctgtgcacctgtagtcccagctacttgagaggctgaggcacaagaatcgcttgaacccagga

SEQ ID NO: 40483 - DNA, 601 bp, Human
aattactttgccttccactgctatcgaaaaacggaatcttctcatttaccatcaagtaatgaggggtttcatagagttaattcagccctgatacaaactgattacttcagctatctttgtttttgttcttgttttaaactttaatgacgcaatatgatagaaaagaaagggtatgggctttggagtctgacaaacttggcttaagtcctactttcatttactcactgtccgaccttggcctcaatctttgaatcctaagtatttatctacaaatggaaataatatcacctaataactgaayggttttggggattaaaggaaataacctattttaaaacacctggtataaaattccatagactgttagataaatttcccattaaatatttagtatggaaactttgtaaaataaattacatacttccctgctttcttacacagagaaaagataacaagtggctacgatttaatattttcttagggaatcaatgtcatctacgaaacttgaaagagaaatatgtaaggctatggaagtttttgcctctagaatacggattctacaggccacttcaaatccaaagaaacccaaaaagctaaactt

SEQ ID NO: 40484 - DNA, 601 bp, Human
tcctgacctcatgacctcatgatccatccagctcggcctcccaaagtgctgggattacatgtgtgagtcaccacgcctagctgataatttcttgatttataacaaaaaggaaatgaaacttgtaaggcaaattttaaacaagtttctttttttcttaagttacttcaactcttcatacaacctctcagtgtttctatgctttttcaacctctaatagttacatccaaatttaatgcaatgatcttggtttaaattactttgccttccactgctatcgaaaaacggaatcttctcatttacyatcaagtaatgaggggtttcatagagttaattcagccctgatacaaactgattacttcagctatctttgtttttgttcttgttttaaactttaatgacgcaatatgatagaaaagaaagggtatgggctttggagtctgacaaacttggcttaagtcctactttcatttactcactgtccgaccttggcctcaatctttgaatcctaagtatttatctacaaatggaaataatatcacctaataactgaacggttttggggattaaaggaaataacctattttaaaacacctggtataaa

SEQ ID NO: 40485 - DNA, 601 bp, Human
tttagtcaggtatatcactttcatttctttatcagttctagaccttctcaagtaatctgatatatttcacttttaggagaaacatttaactttttccaaaaaaattcaggcaacatcaaaaaagtatcaaaacagtatatactccgcagctttttcgttatttaaaaataagataatttcttgatttttttttttttttgagacggagtctcactctgtcgcccaggctggagtgcagtggcgcaatctcggctaactgcaagctccacctcctgggttcacgccattcccctgcctcagmctcccaaatagctgggactacaggcgcctgctaccacgcctggctaattttttgtatttttagtagagacggggtttcaccgtgttagccaggatggtctcgatctcctgacctcatgacctcatgatccatccagctcggcctcccaaagtgctgggattacatgtgtgagtcaccacgcctagctgataatttcttgatttataacaaaaaggaaatgaaacttgtaaggcaaattttaaacaagtttctttttttcttaagttacttcaactcttcatacaacctctcagtgtttct

SEQ ID NO: 40486 - DNA, 601 bp, Human
actctcaataaaaattaaatccttcagggtggaatttgcctagtactgtgagagctctgcaaaacaagaaacaaaggctccagaaagaagctagataatctcaactcctaaggggtagcctcaagtttagtcacttgaaacctatccctttcccaaaacaaacaaaactgctaagattttcttctggaataattttatctacttctaggtaaaggaagaactaagagagacagaaagcatgatttagaatgtacaggcctaggaactatactatttgtggatttcaatgacattttttttyctcattgcagaaaaaggtcaaaaagtaaactgcaattgcttgtttgataaattttctcaaatacatacgtaataggatcaccaagtattttatctccaagcttccctgtttaaaatatcataaagaaagcttacagtcactgaggaaaagaaaggttaaattcctatcacttaagaagaatttaattttaatcattaaaccagccagctagtatgacatttagataatactcatttccttctattagaatgttcctgcctctaaacttatatacctcaaagaaaagtcaaagaatagcac

SEQ ID NO: 40487 - DNA, 601 bp, Human
tacttgggaggctaaggcaggagaatcgcctgaaccggggaggcagaggttatagtgagccaagatcacgccattgcactctagcctgggtgacagagcaagactccgtctcaaaaaacaaacaaacaaacaaaaaaaaccctaatttagatctatattaacacgaaaaggttcataatcatattgttaaacgaaaaatgtgtgaagacaaactgtacatattgtatggtcctagttttgcaggaaaaaatagtgggtataactatatttatttgtgtatttacacatagaaaaaaaaatktggaaggatgtctgtcaaaatgtcaatagtagttatctgtccaagtacagataatctattttccgaattttgcaatgagcatatattttaaaataaaggtattcttaaaaaataaattgatttgaaagaacaggcaaatttaagacattccagtgatgctttgcctattctagaatgaatgcatttataatattagttcctttactttctactaaatttctgactctttctggtaggccagactcctcaaaacattgacattaaatagcttaaacattaacaaactataacatactgcaa

SEQ ID NO: 40488 - DNA, 601 bp, Human
aaaaaattagccggacatcatggcgcacacctgcagtcccagctacttgggaggctaaggcaggagaatcgcctgaaccggggaggcagaggttatagtgagccaagatcacgccattgcactctagcctgggtgacagagcaagactccgtctcaaaaaacaaacaaacaaacaaaaaaaaccctaatttagatctatattaacacgaaaaggttcataatcatattgttaaacgaaaaatgtgtgaagacaaactgtacatattgtatggtcctagttttgcaggaaaaaatagtgggyataactatatttatttgtgtatttacacatagaaaaaaaaatttggaaggatgtctgtcaaaatgtcaatagtagttatctgtccaagtacagataatctattttccgaattttgcaatgagcatatattttaaaataaaggtattcttaaaaaataaattgatttgaaagaacaggcaaatttaagacattccagtgatgctttgcctattctagaatgaatgcatttataatattagttcctttactttctactaaatttctgactctttctggtaggccagactcctcaaaacattg

SEQ ID NO: 40489 - DNA, 601 bp, Human
gagctactcaagggtctaaggcgggagaaccgcctgaacccaggagccagaggttgcagtgagccgagaccacgccagtgcactctagcctgagtgacagagtgatactccatctcaaaaaaaagaaaaaaaattagccggacatcatggcgcacacctgcagtcccagctacttgggaggctaaggcaggagaatcgcctgaaccggggaggcagaggttatagtgagccaagatcacgccattgcactctagcctgggtgacagagcaagactccgtctcaaaaaacaaacaaacaaamaaaaaaaaccctaatttagatctatattaacacgaaaaggttcataatcatattgttaaacgaaaaatgtgtgaagacaaactgtacatattgtatggtcctagttttgcaggaaaaaatagtgggtataactatatttatttgtgtatttacacatagaaaaaaaaatttggaaggatgtctgtcaaaatgtcaatagtagttatctgtccaagtacagataatctattttccgaattttgcaatgagcatatattttaaaataaaggtattcttaaaaaataaattgatttgaaagaa

SEQ ID NO: 40490 - DNA, 601 bp, Human
acctatcatccagactattccaactaaacacatgcaccaaaaggtgtgcccaaggctgttcactacaataccttttatttcaaaagttagaaacaaaacagttgaggccaggcacagtggctcacgcctataatcccagcacttttcagaggccgaggctggcagatcatgaggtcaggagatcgagaccatcctggccaacatggtgaaaccccgtctctactaaaaatacaaaaattagccaggtgaggtagcatgtgcctgtagtctgagctactcaagggtctaaggcgggagaacygcctgaacccaggagccagaggttgcagtgagccgagaccacgccagtgcactctagcctgagtgacagagtgatactccatctcaaaaaaaagaaaaaaaattagccggacatcatggcgcacacctgcagtcccagctacttgggaggctaaggcaggagaatcgcctgaaccggggaggcagaggttatagtgagccaagatcacgccattgcactctagcctgggtgacagagcaagactccgtctcaaaaaacaaacaaacaaacaaaaaaaaccctaatttagatctatattaa

SEQ ID NO: 40491 - DNA, 601 bp, Human
aaaaaaatgtaatctgagcaaatttaacttggatcctaaagacacatattttggcttaagaattaataagctggccaggcacagtggctcacgcctttaatctcagcactttcagaggccgaggctggcagatcatgaggtcaggagatcgagaccatcctggccaacattgtgaaaccctgtctctaccaaaaatacaaaaattagctgggtgtggtggtgcgcacctgtaatcccagctactcgggaggctgaggcaggagaatggcttgaacccaggaggcagagtctgcagtgagcygagatcacgccactgcactccagcctggtaacagagtgagactcagtctcaaaaaaacaaaaaagaataaattattctaaggaaataagcagacatatgcactgcagcaaaaacaatgctgtgcatttaccacactattttctctttctgagctcaaattacgactatcttttccattctcctttgtagcaggtcagagataaagtgttctagaatgtattgaacggaaggccatttccaagcctggcccttaatatcctgtataattctctagctctgttttctttctgtgagaactac

SEQ ID NO: 40492 - DNA, 601 bp, Human
cactttgggaggccaagatgggcagatcacgaggtcaggagttcaagaccagcctggccaacacagtgaaaccccatctctactaaaactacaaaaattaacggggcatggtggcacacgcctgtaattccagctactcaagggactgaggcaggagaatcgctttaacctgggaggcagaggatgtggtgagccgagatcgcgccattgcactccagtctgggtgacagggcgagatgccatcttaaaaaaaaaaaaatgtaatctgagcaaatttaacttggatcctaaagacacatawtttggcttaagaattaataagctggccaggcacagtggctcacgcctttaatctcagcactttcagaggccgaggctggcagatcatgaggtcaggagatcgagaccatcctggccaacattgtgaaaccctgtctctaccaaaaatacaaaaattagctgggtgtggtggtgcgcacctgtaatcccagctactcgggaggctgaggcaggagaatggcttgaacccaggaggcagagtctgcagtgagccgagatcacgccactgcactccagcctggtaacagagtgagactcagtc

SEQ ID NO: 40493 - DNA, 601 bp, Human
ggatggaaacagaattcctatttttccaaaaggaagtatttgaaaaaaatgagtaatctagctgggcgtggtggctcatgcctataatctcagcactttgggaggccaagatgggcagatcacgaggtcaggagttcaagaccagcctggccaacacagtgaaaccccatctctactaaaactacaaaaattaacggggcatggtggcacacgcctgtaattccagctactcaagggactgaggcaggagaatcgctttaacctgggaggcagaggatgtggtgagccgagatcgcgccaytgcactccagtctgggtgacagggcgagatgccatcttaaaaaaaaaaaaatgtaatctgagcaaatttaacttggatcctaaagacacatattttggcttaagaattaataagctggccaggcacagtggctcacgcctttaatctcagcactttcagaggccgaggctggcagatcatgaggtcaggagatcgagaccatcctggccaacattgtgaaaccctgtctctaccaaaaatacaaaaattagctgggtgtggtggtgcgcacctgtaatcccagctactcgggaggctgag

SEQ ID NO: 40494 - DNA, 601 bp, Human
cccctgtaagtagtaaatcattttttcaataaacattattaatttcatgcaaaagtccctcaaggtatctgatgagtatacttgtaagtaaacatctttgtgtgtgtgtatgtgtgagatagggtctcgctctgtcacccaggctggagtgcagcagtacaatctcagctcactgcagtctccgccttccgaattcaactgatcctactgcttcagcattctaagtagctgagaccacaggcatgtgccaccatgcccagctaatttttttttttttttttttttgtggaggagtagagayaaggtctccctatattgcctgggctggtctcaaattcctgggctcaagcagtccacccgcctcagcctcccaaagtgctgattacaagtgtgagccactgtgcctggctaagtaaatatcttacaatgaaatattagttatactcatttttgtacttagtgaaacaaaggtatggatggaaacagaattcctatttttccaaaaggaagtatttgaaaaaaatgagtaatctagctgggcgtggtggctcatgcctataatctcagcactttgggaggccaagatgggcagatcacgagg

SEQ ID NO: 40495 - DNA, 601 bp, Human
catggtgaaaccccgtctctactaaaaatacaaaaattaggccggatgcagtggctcatgcctgtaatcccagcaccttgggaggccgacgcgggtggatcacctgagaccaggagttcaagaccagcctggccaacgtggcaaaaccctgtctctaccaaaaatataaaaactagccgggcacagtggcgtgtgcctgtaatcccagctacttgggaggctgaggcaggagaaatgcttgaacctgggaggcggagactgcagtgagccgagattgcgccactgcactccagcctgggcracagagcaagactccatctcaaataaataaataaaagttgggggaaatattatctcactatgcaagtttaacccaggattatttatataaatagtaagctatggtaaagtcagtgacggtttaaaatatttaacggctgcgcacagtggctcacacctgtaatcccagcactttgggaggccaagcaagaggattgcttacagtcagacatttgagatcagcctgggcaacacagtgagacctcatcaaaaatctgatacactctacaaaaatttaacaaattagttgggcatggtggca

SEQ ID NO: 40496 - DNA, 601 bp, Human
tagatccctggttgcctagagctgggggagttagggaggaagggggaagtatggctaaaggatacagcgtttctttttcaggtgataaaaatgttctaaaattgaatgaggtggtgtttgcacaactccatcaatatacgaaaactgccgggcgcgatggctcacgcctgtaatctcagcactttggggaggccatggtgggcagataacttgagtccaggagttcgagaacagcctgaccaacacggtgaaaccccatctctactgaaacacaaaaatcagccgggcatggtggtgggcrcctgtaatcccagctactcaacaggctgaggccacagaatcacttgaacccaggaggcagaggttgcagtgatcgtgccactgcactccagcctgggtgacagagtgagactccatctcaaaaatacacacacacacacacacacacacaaaactacaaaattgtatacattaagtgggtgaataatatagtatgtgaattttatctcaataaaactgttaaatattatatgcatatacatctttggtaatccatgtatgaggcagatgtaagaaacaagggttacagaatttcagggtt

SEQ ID NO: 40497 - DNA, 601 bp, Human
agtaccatatgacccagcaattctgctcctagtatataaccaagagaaatgaaaacacaagcagtaatgtaaatatagctaaaaagtggaaacaacccaaatgtccatcaacaactaatcaatgaataaacaaaatgcagtttatccatacaatggaatactattcagcaataaaaataaataagatacagatacatgctacaacacagatgaaccttggaaacattattctaagtgaaagaagccacacacaggctgggcgtggtggctcatgtctttaatcccagcacttcgggaggcygaggcaggtggatcacttgaggtcaggagtttgagaacagcctggccaacatagtgaaaccccgactctagtaaaaaatacaaaaattagtcaggcatggtggcaggagcctgtaatcccagctacccgggaggctgaggcaagagaatcagttgaacccaggaggcaaaagttgcagtgagctgagatcatgccactgcactccagcctgggtgacagagcaagactccatctcaaaaaaataaaaaaattgaagccacacacaaaagacatgttatgtaattccatttatatgagatg

SEQ ID NO: 40498 - DNA, 601 bp, Human
tttagaaaacagtctggcaggtcctcaaaggttaaaagtagaagtaccatatgacccagcaattctgctcctagtatataaccaagagaaatgaaaacacaagcagtaatgtaaatatagctaaaaagtggaaacaacccaaatgtccatcaacaactaatcaatgaataaacaaaatgcagtttatccatacaatggaatactattcagcaataaaaataaataagatacagatacatgctacaacacagatgaaccttggaaacattattctaagtgaaagaagccacacacaggctgrgcgtggtggctcatgtctttaatcccagcacttcgggaggccgaggcaggtggatcacttgaggtcaggagtttgagaacagcctggccaacatagtgaaaccccgactctagtaaaaaatacaaaaattagtcaggcatggtggcaggagcctgtaatcccagctacccgggaggctgaggcaagagaatcagttgaacccaggaggcaaaagttgcagtgagctgagatcatgccactgcactccagcctgggtgacagagcaagactccatctcaaaaaaataaaaaaattgaagcc

SEQ ID NO: 40499 - DNA, 601 bp, Human
ctttatttatatattaaaatgctaatatataattttaataacataaccgtctttggccgggcatgttggtgcacgcctgtaatcccaacactttgggaggctgaggtgggcagatcacttgaggccaggagtttgagaacagcctgaccaacatggtgaaaccccatctccactaaaaatacaaaaattagccaggcctggtggcacatgcctataatccagctactcaggagtctgaggcaggagaatcacctgaacctggaagtcaaaggttgcagtgagccgagatcgcgctgcaaasaaaacaaaacaaaacaaaacaaaacaaaaaacctaaccagaggtgttttgggcagtaaaattccaagatggttacgttttttaaatgaccctaaatggattgtcccaagatggatataaccttcttgtattctaagcagtatatatataggtccctcctactaccaattaatttcttataaactctaaagattgtctttccaccatattattttatcatttctaaatatctgcaggaatattttccctcagatcactccatttcccttttccctaatcttttttaaagtctaatctctgt

SEQ ID NO: 40500 - DNA, 601 bp, Human
caggaggattgcttaagcttagaagtttgagaccatcctgggaaattctccatctctactaaaaatcaaaaaacttagccaggaagggtgaacacctgttgtcccagctagaggaggctgaggtgggaagattgctttggcccgggcaatagaggctgcagcaagctatgatttcaccactgcactccggcctgggcgacagagccttaaaaaaaaaaagtcacgtgaggattttcgactgcagagggaagaaggtcagtgcttctaaccacacccccgcactgttcctgggtcaactgtrttcccttctaaaaagaattccatcttcactctatctcttggtgagtacctcgaatgtcttccccagaaacaagtaaggggccgtggcagacaactgccaaccctattcccccactctcaccccaaaaagttcagcactgaggaatgggtaagaagacagccagaaagaacaaggttcatttcagcaaccctccttcttttgttctctgatttgggaaaactggagaaggaaggcagtatagtttccaaggaaaatgacatgagaaagaacaaaatgctaattacctatctttttctcaaa

SEQ ID NO: 40501 - DNA, 601 bp, Human
tgtcaccagagacaatatgatcaactcttcctcttcctcctcagcctactcaacatgaagaccattatgatgatccacttccacttagtgaatagtaaatgtatttttctcttccttatgattttcttttttttttttcaagagacaaggtcttgctctgtcaccaggggtgcagtacagcggcacgatcatagctcactacagcctgaatttctggactcaagcaatcctctcacctcagcctcctgagtaacagaagactacaggcacacaccaccatgccgggctttttttttttttwatgattttcatcataacattttcctttctctagcttacttgattgtaagaacacagtaataatacatattttaaaaatgtgttaatcaacttattttattggtaaggcttctggtcaacagtagactattagtagttaaatttttggagaatcaaagttatacagtggccgggcatagtggctcatgcctgtaatcccagcaccttgggaggctgaggcaggaggattgcttaagcttagaagtttgagaccatcctgggaaattctccatctctactaaaaatcaaaaaacttagccag

SEQ ID NO: 40502 - DNA, 601 bp, Human
ttgcaaaagtttctactttcgcaaaaactagcattgagatgttactgtatcagagtattcccaacctttggccccaaacttaaagtgctgttaccagaataaaacaatggtatagtttaacctaaatttcaggtactcaattgcacatggaaccaaaatgacaagtaacaggcttttttaaaactaccgtttcagccaataataaaaattaaatttaaaagtcaatcagtatacctgaaatacagttgacccttgaacaacagatttgaacttcaagtgtccacttacatatggatttccytgagcctctgtcaccagagacaatatgatcaactcttcctcttcctcctcagcctactcaacatgaagaccattatgatgatccacttccacttagtgaatagtaaatgtatttttctcttccttatgattttcttttttttttttcaagagacaaggtcttgctctgtcaccaggggtgcagtacagcggcacgatcatagctcactacagcctgaatttctggactcaagcaatcctctcacctcagcctcctgagtaacagaagactacaggcacacaccaccatgccgggcttttt

SEQ ID NO: 40503 - DNA, 601 bp, Human
ttttcactggcttttgtactgtgtacatgttacctattcaaataataacttaaaaagaaaatgcgtaacagtgaaagagaatgaaaagggaaaaataattctcttagttttatacaagtaatatcaaagtttaacatttataaacatggtgaatgatttttaaaaattttttcaacctctaaattctatactatataacttataaaaatatggtttactacaaaaagcttggaaaaaaatagagataacaatttatataatttacatatcaaaatgtctctctgcccaaagcaataccctwtgtcagaagcctttttaattagtcctagcaatttgaaataacttttaatatgagctattattaagatgacattaatataacattactagacacactctgttaacagattacaagaaatcagaaggagatatctgagaggaaagaacctaaaggttctgtatatataaatacagccttgcaaaggtacacagtattttttagtaaattttctgactaaggattcaatggtgcatgccagagttttaactaaagacttaagcataatcggaggggggaagaaaactacagagaatataaagg

SEQ ID NO: 40504 - DNA, 601 bp, Human
agcccaccatgatacacatctaaaccacaccctccaatccatccttcatcagatgtaaagaagttaatgttttaatctcctatattattcctgtttcttcaactggttccaaatgcctaaagcaaaaagaaaatttacaggttccctgaaactcaaacatgatgcagctatttataataaaacaagtgaagcagctttacatgcatgaacatgaagtactctccaacatactgtgaaatgaaaaagcaaggtgtaaaagtgtactgcatagcaccgttgtgtcaaatacagacatatacayacactatacctgcatacgacatctctagaaagatacatatgaaactagtgacatgaatgtctttggggaaaggaactggtttgacaataaacaggctgcagagacttacttttcactggcttttgtactgtgtacatgttacctattcaaataataacttaaaaagaaaatgcgtaacagtgaaagagaatgaaaagggaaaaataattctcttagttttatacaagtaatatcaaagtttaacatttataaacatggtgaatgatttttaaaaattttttcaacctctaaattctatac

SEQ ID NO: 40505 - DNA, 601 bp, Human
gaaccaccatgcctagccaaaaccctcaatgtttaaaatgctttaaatgagaggccagagagccctatatgaggaatgaagtgtggttacatggggattctgatagttccgtggtaaaaggatgaggcttctaagaatattctaggaggcttagggaagaaaactggagaggaccatctgtcaacataagtcatttttctctttggttcctcccctgccatgggctgtctggaggctcacagaaaagcagacaggcgcagtggttcagctgttctaggagtcaggagatctgtgctcaatwcaacctctgccatcaccagttgtatgactaatcagacaagtcatttaatcttcctgctactggctgaattgtgccaccccacaattcaaatgttgaagtcctaaccctcaacagtaccccagaatgtgactctatctggaaacagggcccttaaggaggtaattaaggtacactgaggtcatatgggtgggccttaatccaatatggctggtgtcctgataaggagatcagaatatacacacacactgagggaaggaccatgtgagaacacagggagaagacagcatctacaccacaagt

SEQ ID NO: 40506 - DNA, 601 bp, Human
cactccaggccaaaacagatccctctcaagtatttcaaggattcaattggttttatagaaattttaatcttaaacttttttgagcttcataatatattgtcatttatataaatatacacttatagaaaagcatacatacccagttttatgttactaaaataaagattttacatccatttaaatcaacactgcaggtttgagaggattttttttttcttaatttaaaagggcttcatacattactttaaaaacctctaccataaccgtccagcgtctccaagtttaaaaaaaccttaatttgggggggggtttgatttattttgcttgagacagggtctcgctgtgtcacctaggctggaatgcagtgacgcaatcacagctcactgcagcctcgacctcccaggctcaagtgaacctcccacctcagcctcccaagaagctggtaccaaaggcgtgcctcaccatgcccggctaatttttgtattttttgtacaacatgttgcccaagctagccttgaactcctgggctcaaacaatccactgcctcatcctcagcctcccaaagtgctgggattacaggcatgaaccaccatgcctagcc

SEQ ID NO: 40507 - DNA, 601 bp, Human
tttctcccatgaggcttgtagtcaggcaaactatgtgtttaactgcaaaagttaataaaaacgtgtaaactgtacatgtaaattgtagagttaaaatgaatgacaacttgtaaatgaaatgacaaatttttaacataaagcctgagcccaccagaccctgaaatccagaactccaaaaaaagccattattattagtaatttttcctagagctcaaatctacaccattaagcttgacaacaaagtccaaatgatagttttaaccagatttagatgaaccgtgcttcaccccaaaacacacarccacgtttcaaggtactttgtaatttgcacatccatccctagggaaacgcctaggaatggaatacgtttctgagctctcattatgatcattatacacagcctctttccaaaccacataaaaaattctcgacacacacataccttattgttctcgtgatcgccactcacagctatgggatacatgacatatttccctccctggtcctcattcggggcacattctgctagaccatccggatcatgttctgctccaaaattatgtcccaattcatgagttgtaaccaggtcagcttccttaag

SEQ ID NO: 40508 - DNA, 601 bp, Human
ctagtggctactatactgggcagagcagacacaaaacatcccccgccccgcagcagaaagttctattgggcagcactgaactatagtgaacatgattagaaatgcagagactatgaaaagagaaggaaaattcaacagtttgacaggttggaagagtagacaaaaaggggtagaaaaatgtttctctggcacaagttgtcaagcagaggaaaaataaaacataacatgcaaagtaacagaggaactgtttacacataacagccaaagaaaatgagatgcagaaaatatacataaaaagccaaaaaaaaatgagatgcaacaatcaaagatcacaaaaagaacaggaggcagaaatttcagaaagcagggtgtcagagccagggaaaagcagaagtaatcttgccctctgtgtccagggaaggcttgcacattagcccacagccaagctcaaaataggagtcaggacaaatacttcacaatcttttgtgattagaatcagactcctttaagctctccccaccgaccctctttaactcagcagtgcaactattgttttcctcacactgctttatgctgtttaacttcaaataaaatgaaagaa

SEQ ID NO: 40509 - DNA, 601 bp, Human
tcactcatgtccttttacagttaatgcccattcccgtctcccatcacaggcaaacattattaaaaatttaaataaaatagaatttacaattcagttcctcagtttctagccacatttcaattgctccactgggctagtggctactatactgggcagagcagacacaaaacatcccccgccccgcagcagaaagttctattgggcagcactgaactatagtgaacatgattagaaatgcagagactatgaaaagagaaggaaaattcaacagtttgacaggttggaagagtagacaaaaagkggtagaaaaatgtttctctggcacaagttgtcaagcagaggaaaaataaaacataacatgcaaagtaacagaggaactgtttacacataacagccaaagaaaatgagatgcagaaaatatacataaaaagccaaaaaaaaatgagatgcaacaatcaaagatcacaaaaagaacaggaggcagaaatttcagaaagcagggtgtcagagccagggaaaagcagaagtaatcttgccctctgtgtccagggaaggcttgcacattagcccacagccaagctcaaaataggagtcaggacaa

SEQ ID NO: 40510 - DNA, 601 bp, Human
aaatattcaagcatctatgaagtagacaggatggtatcatgaatgcccccgtgcccctcaccagcttcaacaataatcaacttatgacttcacagctcctctacatccgcgctacttttcctctgctcccacactgctgtttttgtttgttggcttattaacaactttattaagacatatttcacatatcacaaaattgatccatttcaagtatataactcagtgatttctaataactttaccaagtgttgaaaccattgctataagtcaattttaggacatttccatccttccagtaatstcactcatgtccttttacagttaatgcccattcccgtctcccatcacaggcaaacattattaaaaatttaaataaaatagaatttacaattcagttcctcagtttctagccacatttcaattgctccactgggctagtggctactatactgggcagagcagacacaaaacatcccccgccccgcagcagaaagttctattgggcagcactgaactatagtgaacatgattagaaatgcagagactatgaaaagagaaggaaaattcaacagtttgacaggttggaagagtagacaaaaag

SEQ ID NO: 40511 - DNA, 601 bp, Human
caagtgatctgcccacctcggcctctcaaagtgctgggattacaggtgtgagccaccatgcctcactggcaagttcttacagggctgttttgaagagccccagaactggcagcaggaagagtcagcagcatgcatgtccacccaggcagtctgcaaagtaaaacattttgctcccaagttctgacactatcctcataaccaagaagcatatgacctattacttagagaaacagtatgcaatatggtagccaccaaccatatgtggctacttaaattttgttcctagtcacatattttacastttctattacagaaatattcaagcatctatgaagtagacaggatggtatcatgaatgcccccgtgcccctcaccagcttcaacaataatcaacttatgacttcacagctcctctacatccgcgctacttttcctctgctcccacactgctgtttttgtttgttggcttattaacaactttattaagacatatttcacatatcacaaaattgatccatttcaagtatataactcagtgatttctaataactttaccaagtgttgaaaccattgctataagtcaattttaggacatttccat

SEQ ID NO: 40512 - DNA, 601 bp, Human
cttggctcactgccgccttgaactccccgggttcctcctaccttagcctcctgagtagctgggactacaagcatgtgcttctatgcccagctaatttttgtattttctgtagagatggagtttcacatgttgtccaggctgatcctgaactcctaggctcaagtgatctgcccacctcggcctctcaaagtgctgggattacaggtgtgagccaccatgcctcactggcaagttcttacagggctgttttgaagagccccagaactggcagcaggaagagtcagcagcatgcatgtccacycaggcagtctgcaaagtaaaacattttgctcccaagttctgacactatcctcataaccaagaagcatatgacctattacttagagaaacagtatgcaatatggtagccaccaaccatatgtggctacttaaattttgttcctagtcacatattttacagtttctattacagaaatattcaagcatctatgaagtagacaggatggtatcatgaatgcccccgtgcccctcaccagcttcaacaataatcaacttatgacttcacagctcctctacatccgcgctacttttcctctgctcc

SEQ ID NO: 40513 - DNA, 601 bp, Human
tctggcagcttctgtttgcatccttgtcataagacttcctcttccgttcagcaaaccttcctaagaagttacaatctcaaaggtcctacattccttttcactaatgtcatctgtccacagagaagtccacctgtggcaaactgctcttcataggcttgcctagtagagggtgatgggttctgtctttctaggtcaaggaactactttatttttgtcctgtaagcccttttcatcagttaaaaatatttttattaaggaattcatttaaaacataggctgggcacagcagctcatgcctgtmatcccagcactttgagaggtcgaggcaggtggatcacctgaggtcaggagtttgttgaccagtcagttgaccaacctggccaacatggtgaaaccccatcctactaaaactacaaaaattggccaggtgtggtggcatgcacctgtaaccccagctactcaggaggctaaggcaggagaatcgcttgaacctgggaggtggaggttgcagtgagcagagatcacaccactgcactccagcctgggcgacagagtgagactccactcaaaaaatcataataaataataataaataaataaa

SEQ ID NO: 40514 - DNA, 601 bp, Human
cccaaatctgtcgttacagtacagatgtctaaggggtctggttattctaatcggggcctcaggcagttgtcattttggtgggtttattcatcaacatcatgtatctctgggttccattttatcaggttaaaatggagttaaaattcacagtgaacagataagaagacctcttcactgatttgtcagagttacaactcccaagcagctggagagcactaacgataaaaggaccaacccgcaactctggctttctgcctacacatccctgaagatctggcagcttctgtttgcatccttgtcmtaagacttcctcttccgttcagcaaaccttcctaagaagttacaatctcaaaggtcctacattccttttcactaatgtcatctgtccacagagaagtccacctgtggcaaactgctcttcataggcttgcctagtagagggtgatgggttctgtctttctaggtcaaggaactactttatttttgtcctgtaagcccttttcatcagttaaaaatatttttattaaggaattcatttaaaacataggctgggcacagcagctcatgcctgtaatcccagcactttgagaggtcgaggcag

SEQ ID NO: 40515 - DNA, 601 bp, Human
cctgtaaccaccaaatcagacaccaaaggagctactttcagaaagatagcaaagacctcatcttacacagaaatactaactggctttttaaaaaacatcttcaaatctgtttttttttttttttttttttttttttagatggagtcttgctctgtcaccaggctggactacagaggcacaatcttggcttattgtaacctccgcctcccgggttcaagtgattcttctgcctcagcctcctgagtagctaggactacaggtgcatgccaccacgcccagctaatttttgtattttttgtaraaacagggtttcaccatgttgaccaggatggtctcgatctcttgacctcatgatctgcccacctcggtctccaaagtgctgggattacaggcgtgagccaccgcgcccggcccaaatctgtcgttacagtacagatgtctaaggggtctggttattctaatcggggcctcaggcagttgtcattttggtgggtttattcatcaacatcatgtatctctgggttccattttatcaggttaaaatggagttaaaattcacagtgaacagataagaagacctcttcactgatttgtcagagtt

SEQ ID NO: 40516 - DNA, 601 bp, Human
ttaggtcggggtctccaaagtgctctgcagatgccaaaatggcttcactttcaccccagacaacaatcatgaagcccctgagagccaagtgtatgagaccctccaaaggtgcctgtaaccaccaaatcagacaccaaaggagctactttcagaaagatagcaaagacctcatcttacacagaaatactaactggctttttaaaaaacatcttcaaatctgtttttttttttttttttttttttttttagatggagtcttgctctgtcaccaggctggactacagaggcacaatcttggctyattgtaacctccgcctcccgggttcaagtgattcttctgcctcagcctcctgagtagctaggactacaggtgcatgccaccacgcccagctaatttttgtattttttgtagaaacagggtttcaccatgttgaccaggatggtctcgatctcttgacctcatgatctgcccacctcggtctccaaagtgctgggattacaggcgtgagccaccgcgcccggcccaaatctgtcgttacagtacagatgtctaaggggtctggttattctaatcggggcctcaggcagttgtcattttggt

SEQ ID NO: 40517 - DNA, 601 bp, Human
aagaccagtgtctcaaaaagtctctacactaccttcccaccctggagtacagaaccactaggataactcccttttaaggctgagggttttatcaggagctctaaaactgcggtcattttccagacctcctgaagttatcaaaaaaagaagaggcttagggaaaactgagcatagttacttcttaggtcggggtctccaaagtgctctgcagatgccaaaatggcttcactttcaccccagacaacaatcatgaagcccctgagagccaagtgtatgagaccctccaaaggtgcctgtaacyaccaaatcagacaccaaaggagctactttcagaaagatagcaaagacctcatcttacacagaaatactaactggctttttaaaaaacatcttcaaatctgtttttttttttttttttttttttttttagatggagtcttgctctgtcaccaggctggactacagaggcacaatcttggcttattgtaacctccgcctcccgggttcaagtgattcttctgcctcagcctcctgagtagctaggactacaggtgcatgccaccacgcccagctaatttttgtattttttgtagaaacaggg

SEQ ID NO: 40518 - DNA, 601 bp, Human
aaacatcttgagagaaaaaaggcaataaggacccaaaataatatcataaaaatgtattcccatgcaatgtttgtgtcttctctagagacaaactcttaatgtaaaaccaccatcagagccaccctggagttatggcaaggccaccacagtctcctccaaaggccactgatatggaactgggaacctccctccatagaatgctaaatggctgatgtgaacttggttaaggatctataattcttcttacgaaggtaagcaagctatacaaatactgagaccaaacatcccagtcaaagcccayttaaggacaagcagaatagcacaacagagagctcgtagctccatcagacttgaaatctcctcacctcaggcatgccactcatgcagtgacaagaattaagaacctctgtaggttaatgttgtcccagacaaaacaattcagaaatgcaggagaaggggtttcttctccttctttggctacttatatggatgatccaagtttaaagttgtttaaatatttgagcttagtaataggcataatagtacattttatataaattaaatccccaattgttacctaaacattttcatcaaccagcaa

SEQ ID NO: 40519 - DNA, 601 bp, Human
aggcatggtgcctcatacctagaatctccacactttaggaggcttagaagggtggatcacttgagcccaggactttacaacaagcttgggcaacatggcaaaaccccatctctataaaaaatacaaaaaaaattagccaggtggcacacacctgtagtcctgtctatccgggaggctgaggtggaaggactgattgagcctgggaggttgaggctgcagtgagccatgatcatgccactgcactccatcttgggcaacagactgagaccctgtctcaaaaagaaaataaaggccaggcacrgtggctcccctctgtaatcccagcactttgggaggccaaggtgggcagatcatgaagtcaggagatcgagaccatcctggccaacatgctaaaactccgtctctactaaaatacaaaaaatcagccaggcgtgatggtgcgtacctgtagtcccagttattggggaggctgaggcaggggaatcgcttgaacctgggaggcggagattgcagtgcgctgagatcgcgccactgcactccagcctggcaacagagcgagacgccgtctcaaaataaataaataaattaaattaaataaaaa

SEQ ID NO: 40520 - DNA, 601 bp, Human
tgcccaaaagattctttgggcagccaggagcagtggctcacgcctgtaatcccaacactttgggaggctgaggcaggcagatcacgaagtcaggagttcgagaccagcctggccaacatggtgaaaccccatctctactaaaaacacaaaaattagctgggcgtggtggtgcacactgtaatcccagctactggggaggctgaggcaggggaatggcttgaacccaggaggcggaggttgcagtgagccaagatcacgccactgcactccagcctgggcgacagagcaagactccgtctcaaaaaaaaaaaaaaaagaaataaaagattatttgggccaggcatggtgcctcatacctagaatctccacactttaggaggcttagaagggtggatcacttgagcccaggactttacaacaagcttgggcaacatggcaaaaccccatctctataaaaaatacaaaaaaaattagccaggtggcacacacctgtagtcctgtctatccgggaggctgaggtggaaggactgattgagcctgggaggttgaggctgcagtgagccatgatcatgccactgcactccatcttgggcaacagact

SEQ ID NO: 40521 - DNA, 601 bp, Human
cactgtatccagttaaatctcaattattcaccagaaaactgaagtttaacccttttacttctaagccaggcactggtctatcagtgtatataaaaaatgaaaacctgggtaactttctaacttgtaacctacttcctccacactattccagtatatagaatcatgataacattcatatcccaagactgtcattttgattgtttccaaaattttgctattaggatgtagccataaaaaaaccttgttaaatcttatacccttgttaaatcttatctctgttgcccaaaagattctttgggcrgccaggagcagtggctcacgcctgtaatcccaacactttgggaggctgaggcaggcagatcacgaagtcaggagttcgagaccagcctggccaacatggtgaaaccccatctctactaaaaacacaaaaattagctgggcgtggtggtgcacactgtaatcccagctactggggaggctgaggcaggggaatggcttgaacccaggaggcggaggttgcagtgagccaagatcacgccactgcactccagcctgggcgacagagcaagactccgtctcaaaaaaaaaaaaaaaagaaata

SEQ ID NO: 40522 - DNA, 601 bp, Human
cagagcaattcaaattatggccccatatcaaatcaaacgctacagttacgttacagtgacctgaagatcaccggggaagacctcctggctccgtcacccactcctacatcatcagacatctccgctgctagagctacctgcacacactttgtcccttcctaatgtgcgtgaggtcacataaatgccacactataggagaaaagaatgggaacacagcaatcacctgtgaaacatcttggtgcccttggttttcattcatttaacgcattaatttaaaaaagacaagatgggctgggcgagrtggctcacacctataatcccaacccaacactttgggaggccgaggtgggtggatcacctgaggtcaggagagttcgagatgagcctggccaacatggtgaaaccccatctctactaaaaatacaaaaattagctgggcgtggtggtgcgctcctgtaatcccagctacttagaaggctgaggcaggagaatcgcctggaccccggagacagaggttgcagtgagccgagatcgcaccactgcactccagcctaggcaacaagagagaaattctgtctcaaaaaaaaaaaaaaaaaaaaaa

SEQ ID NO: 40523 - DNA, 601 bp, Human
tgaacaaaacataatcttgtttttcaaagacacacacacacttgacccacagcattccaaggaagcaacaagaacacgaacctgtgcagtaggacacgcctttgcaagtagcattaatcgcctcctggcacttcttctgggcagtctcaaactgacagtttttacagcaaggactgttcctgtcactggagaagaacagcagacaggaacagagcaattcaaattatggccccatatcaaatcaaacgctacagttacgttacagtgacctgaagatcaccggggaagacctcctggctcygtcacccactcctacatcatcagacatctccgctgctagagctacctgcacacactttgtcccttcctaatgtgcgtgaggtcacataaatgccacactataggagaaaagaatgggaacacagcaatcacctgtgaaacatcttggtgcccttggttttcattcatttaacgcattaatttaaaaaagacaagatgggctgggcgaggtggctcacacctataatcccaacccaacactttgggaggccgaggtgggtggatcacctgaggtcaggagagttcgagatgagcctggcca

SEQ ID NO: 40524 - DNA, 601 bp, Human
actcaacccggcatatgagattaaaaataaggtgtctctcatctgaacaaaacataatcttgtttttcaaagacacacacacacttgacccacagcattccaaggaagcaacaagaacacgaacctgtgcagtaggacacgcctttgcaagtagcattaatcgcctcctggcacttcttctgggcagtctcaaactgacagtttttacagcaaggactgttcctgtcactggagaagaacagcagacaggaacagagcaattcaaattatggccccatatcaaatcaaacgctacagttaygttacagtgacctgaagatcaccggggaagacctcctggctccgtcacccactcctacatcatcagacatctccgctgctagagctacctgcacacactttgtcccttcctaatgtgcgtgaggtcacataaatgccacactataggagaaaagaatgggaacacagcaatcacctgtgaaacatcttggtgcccttggttttcattcatttaacgcattaatttaaaaaagacaagatgggctgggcgaggtggctcacacctataatcccaacccaacactttgggaggccgaggtgg

SEQ ID NO: 40525 - DNA, 601 bp, Human
gttggccagaacgtcaggataaggagtcctcagacacaggcaacctagcagtggtgctctagagaccagcacatcctgcctctgtgactacacaatgacactcctcagtacccagagaaacacacaggttcctgaagggacgtaggaggatgtgatctgtgtcctatctggaatatcaaggggatgaaggcaatggaagtagctaccacttggtgacttgtaagtaaaacacagccaatcatataactaaacaatatgtaggtgtccccaacagtgaaatacatatagatacatatagaaraactggttacccttctaacttgtatcctgcttcctccacactattccagtgcatagattcatgataacattcattatcccaagattgtcattttgattgtttccaaaattttgctattaggatgtagccattaaaaaccttgttatattatctgtagcacaatatgggtaattctttaaaacatgatactgaattttttaaaagtaaatttaaggtagaatatcattttggcacattaaaaacacatacatgcacaaaataacactatatgatctttcaaggatatacacatatccaggc

SEQ ID NO: 40526 - DNA, 601 bp, Human
tagagatatgtccgtttatatacctagtaataacatagctttgaaatttttaaagcaacaattgaccgaacaaaagatactggacacctggaaaggttagctccagaaagattcaagtcctgaatgtaaaaggacaacttatgaagctaatagaagcagctgtggaaaatatctttttaaccatccgccatggcttttctgaaccatgtgtttaaaaaatacacacacacaacaaaatgatggatttgattacgttaaagatttctgttctgagaatggcaacagataggagacgtatgcacaaatggatgattacataagaactcctccaaattcacagtagtgaaataacatgaaacccaatttttaaaaaatgaaccaaatatatgaactggctattcacaggagaaatctgaatagctgaaaaatataaagagatgctcaagaaaaatgtaagtaagtgcattaggacaagggctgttaaaaaaaaaagtaagaacaagagattactttatactcatcatgctaataggacagcagggtaattccaagcgttggccagaacgtcaggataaggagtcctcagacacaggcaacctag

SEQ ID NO: 40527 - DNA, 601 bp, Human
atgttcacagcagcattatttgttatagcaaaaaagtggaagcaacccaaatgtctatcaaccaatgaatgaataaacaaaatgtggcatatccatgcaatggaatttacccagcaataaaagtacatgaagtactgatacatgctacaacatacatgaaccttaaaaatgctatgttcagtgaaagaagccagtcatacaatatgtggtcacgaaaccatattgtataattccatttatatgaaatgttcaaaacagacaactccataaagaatagggtggttagtggttgctctgagtygtggggaatggggggattggaggatcatagctaaaggatacagggtttctttctggagtaatgtaaatgttctaaaattaattgtgatgactgcataaatctgaatatactaaaaatcattaaactgtacactttaaatgggcaaactacatgagtgtgaattatgtatcaataaagctattacaaaatcaaaccaaccaaccaagagagacaaattttgaaaaatataagaatgggacagatagatatatcagaggaacaaaaaaactagaatagcaaactgaatattgctttttgaca

SEQ ID NO: 40528 - DNA, 601 bp, Human
tttagtagacacagggtttcaccgtgttagccaggatggtctcgatctcctgatctcgtgatctgcccacctcggcctcccaaagtgctaggattacaggtgtgagccactgtgccgggccatcaggttcctaacatttggcaaagtaatgtgatagtgacagatcccaaaagataaaaacatgggcaacatgtcatactatgcacacggaaaaccaaaatcaagccaaaataggacacaacttcattcactaggtccctgaagacctccagctttctgtttgcatccttatcacaaaacytaggatagttacaataaaaaagataacaagtgttggtgaggatatggagaagctgggaccctcatacaatgctgctgagactgtaaaatggtgtagccattttggaaaacagtctgacagctcctcaaaagattaagcatagttaccacatgacccagaaattctattcctgaataatatccaaaggaactgtccacacaaaaactcatagataaatgttcacagcagcattatttgttatagcaaaaaagtggaagcaacccaaatgtctatcaaccaatgaatgaataaacaaaatgt

SEQ ID NO: 40529 - DNA, 601 bp, Human
tctgaaaatggtatcatctatctagcatggtccccaaagtttagcatgcatggaaatcacctgacagaaggttacacagcacagactgctggcctcccttcccacattttttgatgcagtagatccagggaggggactgacaatttccatttctaataagctcccaggtgatgctgctgctgctggttgtgaaatgctaattgctttttttctttcttcttcttttttttttttttttttgaggttgttgttctctagcttttcctgctagaaaatactgattccttatcaggaacttatmctctgctatctactattttgtataaaatatcaagggaacaaaaggctgtttgataagaacaaacgttttcaaattgttttacttacgtttatttaaaagaaagcatttttctcaatctattttattattacagtgaagatgaaacattgagcatagctagcaaatgcttctttaaagcttgatttagatattcaggttcctaacatttgtttttttggtttttttttgagatggagtcttgctctgttgcccaggctggagtgcagtggcgtgatctcggctcactgcaagctccgcctc

SEQ ID NO: 40530 - DNA, 601 bp, Human
gtggatcattattgtatttttggtatatgatactgccctgatacattaaaaaatgctcaataaatatctgttgagcatctgttcttaaaagactaaagtcagagtattagacaggtaggaaaataattctgaaaatggtatcatctatctagcatggtccccaaagtttagcatgcatggaaatcacctgacagaaggttacacagcacagactgctggcctcccttcccacattttttgatgcagtagatccagggaggggactgacaatttccatttctaataagctcccaggtgatgytgctgctgctggttgtgaaatgctaattgctttttttctttcttcttcttttttttttttttttttgaggttgttgttctctagcttttcctgctagaaaatactgattccttatcaggaacttatcctctgctatctactattttgtataaaatatcaagggaacaaaaggctgtttgataagaacaaacgttttcaaattgttttacttacgtttatttaaaagaaagcatttttctcaatctattttattattacagtgaagatgaaacattgagcatagctagcaaatgcttcttt

SEQ ID NO: 40531 - DNA, 601 bp, Human
taactgcaaaaatcctcatctagtggggttaggtcctggaatcagctctctctggtggagttgttgcaggagtatcctagttccatgccaatgtaatgtagatagctactgctgcttttgtggtttgtatgatatggagcagaggaaggctaggacacacctctacctacccacccactcacccccaacaaaattccctcctctcccacctcaaagcctgccatatggcctgaaactgcagcaagaagaaacaccaacaggataggtctcccaggtatggtggatctgcatgcagagatgsctgtctccagacaccaccctgcccttccccatcccctcatcctcggcttggatctcaccactgctgtcattcgcacaacctccaaatggaggaagggagcctggcagacaaaggccatgttttctcctgctgctggactgggaataaaactgctcaccattacatgcacaggactccagctgctgttccctctcgcagaaagggatgcatttcccatccttacacttgccaagatccaagcaaacagtgtcatcttcagcatttcctggaggcgggcactcactgctattacctggaagc

SEQ ID NO: 40532 - DNA, 601 bp, Human
ctcaaagcctcccaccacagaaggaaactacaggcagggacctgaaagcactccgtcttctcctcctaagtaatacccgtagataacaatgggccagaaggatgtagccccacttgtgttttgatttgttttcatctgcaaaatcaagtacttacaaaataaaaacttcctatctggctgttacagaaaaagctgtacataaatactcacattcatgtcacaaaatcctactgtacagggctttcctttcctcaaaaataagttcttttgttcagcatcgacatagggcacacagcggccrgaaaggtccctgcagcacaccttgcaggagttgtcagtttctggaacagagaacacgcattgacagctggattgttctgagacctgcctctcctcctgcctcctctttcctccctgaccatgctcccaaagaggtaagaaatcacatttattttttatttaaatagctaatactatccatagcccccaccaaggagtagtttctgaggtcacactcctcagccttcagtgacagaggccacaaggtttaaaaaaaaatgcagagaaaaatccattctagattcaagacctctcttcaaag

SEQ ID NO: 40533 - DNA, 601 bp, Human
acaaggcaataacttccgcgtaatgagtacccaagaaagtagaacatctgtcattaacactttcataattactccatttttacaagtgatttagaattaccaggagacaaaaatcaaggaaaccagtttgctaaagatgaggcattccagtaaggactctacacatacacagtggacagtgaacaacacagccagactccctgtgaagcctcgtaaatcttaaaaccctctcccatcattctgcatgagaaaaattatgcttctctagagaacaaaagggtctggcttaagtaagtcaagyagccttctaggtctttcctactcattcagcacctgtttcaaaatcacaccctgaataattttgcaatcttagtcagttctgtaagtaatctaggaaaacataattaggacccactgcctgaaaccaaccaactttaccataaagtccccaccccagtccttctcagtctctgggctcaaagcctcccaccacagaaggaaactacaggcagggacctgaaagcactccgtcttctcctcctaagtaatacccgtagataacaatgggccagaaggatgtagccccacttgtgttttgatt

SEQ ID NO: 40534 - DNA, 601 bp, Human
tctgaaagcacacttttctaatgtcatcacagaaattgactcagctctcagtaagtaatctggggaaatcacctaccaaaagtattgatgctcagctggtcaatgaaatcccaaaatcgttcaattacatcctgtactcgtttctcacatttgccctatgaagaaaaaacatacatacagcatcattcccaaacacaatgtattcagaagcaatgtagctttataaaaataactgacatgtaaagggcttcattaaaatcaaacgttttcccatctttgacacaaggcaataacttccgcrtaatgagtacccaagaaagtagaacatctgtcattaacactttcataattactccatttttacaagtgatttagaattaccaggagacaaaaatcaaggaaaccagtttgctaaagatgaggcattccagtaaggactctacacatacacagtggacagtgaacaacacagccagactccctgtgaagcctcgtaaatcttaaaaccctctcccatcattctgcatgagaaaaattatgcttctctagagaacaaaagggtctggcttaagtaagtcaagtagccttctaggtctttcct

SEQ ID NO: 40535 - DNA, 601 bp, Human
ttttttttaaaagaccattagttaagctttctacaagacatgttcccctaggaataacaacaaaaaaagctattggaaatatcaggccaaactttgctaagaacaagttttaccttttccagagattacatggttggagttgatcaaaatttaaataaaacatttaattacttaaaagttgatgacttaccacacaatggacaagaatgctgaaaggaatccaaaatatcaaggagaaaaccaggacagacccaacgatgttgtctgctaaaaactttcctgtgaacaattccaaacagtkaatgtcttgaccaagtacttcacaaatctaaagtgaaatgctcttaggatattaccattgtgtcaaatgccagagctgctggctagacatactaccgagagcagaatgtctgtgctgcctgtattacaccacaccatctctccataccaagtgcttttaaagaaatagccctcatatactggctgacaggaagagattgcagaatattcaacatgttacctggagtagctgtgtcaacagattaatatggaatgctactactagtaaatgcttaagaagacaaagtttttgttacctgga

SEQ ID NO: 40536 - DNA, 601 bp, Human
atttatgaaaaagggcctcaaatttataaaggaccaggagttccttagtcaaagcccaattcaacttgtagctgttactgattctgaatgagaacagaaaagactgcttactcttattttttggggaagatgtaaatactctatatgacagctgggccccagtccctacatcctatttgtgcagaaggctgaagacatagccatctgctgccaataatctacatgatatatggggaacatctgaaatgccgatgtttgatatttgctctattgcaacgaagtcagcctgaaaatgctcttmaataagggctttactcatcaaaggacctggacaaatccagttaaacagtctcctatgcttaaaagtataaaattcctaagaaatttatatattaaaacaccaacacacaaaaatagtattttttttaaaagaccattagttaagctttctacaagacatgttcccctaggaataacaacaaaaaaagctattggaaatatcaggccaaactttgctaagaacaagttttaccttttccagagattacatggttggagttgatcaaaatttaaataaaacatttaattacttaaaagttga

SEQ ID NO: 40537 - DNA, 601 bp, Human
acaaatccccattccccacagatgcaagtgaatggattcgtaagaacatttatgaaaaagggcctcaaatttataaaggaccaggagttccttagtcaaagcccaattcaacttgtagctgttactgattctgaatgagaacagaaaagactgcttactcttattttttggggaagatgtaaatactctatatgacagctgggccccagtccctacatcctatttgtgcagaaggctgaagacatagccatctgctgccaataatctacatgatatatggggaacatctgaaatgccgatrtttgatatttgctctattgcaacgaagtcagcctgaaaatgctcttcaataagggctttactcatcaaaggacctggacaaatccagttaaacagtctcctatgcttaaaagtataaaattcctaagaaatttatatattaaaacaccaacacacaaaaatagtattttttttaaaagaccattagttaagctttctacaagacatgttcccctaggaataacaacaaaaaaagctattggaaatatcaggccaaactttgctaagaacaagttttaccttttccagagattacatggtt

SEQ ID NO: 40538 - DNA, 601 bp, Human
ccatccatgcaactaatcgaagttcaccatcactgttgtcagaagggtaaacattccaacctagacccttcctgctgcaacatgaccttccatcagccagtgaaagctcttgctgggtcaggtgaaggtctttgcctaacagggcctcagaccaggcgaagattatgtttctttcatatggtatacttacactggggtgaaacagagacagagattcatactgtttatccaatttcttatcctagaaagaaacagcaagaaggtcattccctacaaatacaattcagttagtgagtactayttcatcacaggctattcctaacactaactgaagaacttagaacctgagttgtagaaagtgatagcaggctcaacagatgacaatccatttctcacccaagctttagttatgccaccagtctagaagtgtttcctttgcactcaaaggaaatacattttggcgttaagtacagaaagaggcaaggtttaagtgctatgttttctgagaaatttatccctctgtgggcaggggaataataaaggcatcttcctgtgcatgaaatgacaaatgtcccagatgctgggtacaccaggaccgcac

SEQ ID NO: 40539 - DNA, 601 bp, Human
aaaaaaaactgatcatttccctagtcagtgctgttatcaatataaaagattaatttacaaaaacgtaaatattcataacccaatccagctgtattttctgcttttgcaccacaggtcaaaagatattttaaaaactaaaacctgaaagcctcaaaataagctagattcaccttcaccttaccttttcaaaaggagaagggccaaaccacacaagaactgtttacctgcaggaagttcaaacacatgaccagcatctgctaagtcacttcccagtcttcacaaaatacaagctgtgattgatttgtaggtcaaatctataaaaatattttgcacacttaagtcagaagagctgagaactaaattagcactctgtttctttgctgtcaacacgattctgacgctgcagtttaaaggaggcagccttttcacttctggtgaccggatggtccgtgagatcctcaaatgacttggcagctgtgctgctatttgggaaggggtccttctcaaacccatcctcgtccatatgtgagtctgtgctggggtcttcctggatggtgtccattctctggtggtccagttttggagctgctggcgccgaagg

SEQ ID NO: 40540 - DNA, 601 bp, Human
cattacagtgtataaaaaaaaactgatcatttccctagtcagtgctgttatcaatataaaagattaatttacaaaaacgtaaatattcataacccaatccagctgtattttctgcttttgcaccacaggtcaaaagatattttaaaaactaaaacctgaaagcctcaaaataagctagattcaccttcaccttaccttttcaaaaggagaagggccaaaccacacaagaactgtttacctgcaggaagttcaaacacatgaccagcatctgctaagtcacttcccagtcttcacaaaatayaagctgtgattgatttgtaggtcaaatctataaaaatattttgcacacttaagtcagaagagctgagaactaaattagcactctgtttctttgctgtcaacacgattctgacgctgcagtttaaaggaggcagccttttcacttctggtgaccggatggtccgtgagatcctcaaatgacttggcagctgtgctgctatttgggaaggggtccttctcaaacccatcctcgtccatatgtgagtctgtgctggggtcttcctggatggtgtccattctctggtggtccagttttggagct

SEQ ID NO: 40541 - DNA, 601 bp, Human
agcgggaggatgccggcgtgtacgtgtgcaaggccaccaacggcttcggcagcctgagcgtcaactacaccctcgtcgtgctgggttagtcgctgctgcggtcagaggtcatgggctgggttggagccaggcaggggtgtgcaggagggcggacggggacacacctggggcccgagagtcagccagcccccggcagaaagccttccttcggtgccctgccccacctcagctggctgcacctctgccaccatcccccaggtatcctgtcccgttcctgtccccgtcaggctccagcctcggrgccttcctcccagcggagggcggagggtggagggcgggagccgaaggcagtggtcccacagaagggctggggcccgaggccttggcagggtgtgccggccgtcggctgtgactttgaggctcgggtttcggagttcagaggagccgccgggatgcgtggcctttctgttctcttctgcgcctggggcccgggcgctgggcttggacaggtgtccagagagacacgccctccatacctagggacccggcaccccgcctgctccgctgggctcctgggtgtggggccctcgggtggagctcc

SEQ ID NO: 40542 - DNA, 601 bp, Human
acaccatgggctacagcttccgcagcgccttcctcaccgtgctgccaggtgcgcggctgccacgccacgccacaccatgctggtgcccggacccgccccctgggcccggcgtcccacccaccgggtggggccccacccttccctcccgggccgtgctggccaggtcatctgccgagggagggcagcccaggggcaccgtctccacagcccctgggatgggtctggggtgctctcctggtctttgtgtcggcgttcccctccctacctcctttcctctcgctcttgcagacccaaaaccgcmagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggccc

SEQ ID NO: 40543 - DNA, 601 bp, Human
agttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactrcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacaca

SEQ ID NO: 40544 - DNA, 601 bp, Human
cacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgygtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctg

SEQ ID NO: 40545 - DNA, 601 bp, Human
cgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacasgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgc

SEQ ID NO: 40546 - DNA, 601 bp, Human
gatcccgtttaccgaccagagtcaccaccccgcccccagcccgccaactcatacctcccgcaagccaccagtttcaagggatgcggaagccaagcaccccgtggtccccagcaccaggtgacccgcacgtgcactcaccgtagcagggaacctgcaaggccgcgctgtggccgctgctgccttcctggagtttgaggctgccgtccgggggcgtcttgcaggcgcctcgctgcaagtaaagatgcggttgcgcgggcggctggggctgcggctgctgctgctgcggctgcggctgcggcgrcggctggggctgcggggtcgacggctggggctggaacttgttaaaggagccccgcgccccagctccactctccaggggtgtcgccaggtcctgctgcccagcgccgtaacgggcccggctcttggcgtccccgaatccctgtgctttggcggcggccgacaggaaagttgtgccgaacttgtcgcctccgggaaatgccctaaaaggcgacgagccctcccgactctgcgacaccgggctgtagtaggcgtccatggcagcggccggcgactcgcagtaagagacgcaagtctcagcatt

SEQ ID NO: 40547 - DNA, 601 bp, Human
aggccctccttcctttgcaaccccccaccacagtgcagaagcccaatattaaagaggataaaagcagagtcgctctagttgggacaggggcatgaggggcaggctaggagcccccactttcaggttctcaatgaactgaggaaaggaaagccatggtgtggttggtgggcagtcaggagacctcaactgcagccaagagcccagggacaggctctgctttaccagcctcactcccaggtggccctcactgacctgcacgcgggcctcagtgaggtctgtcctcatggccagctgttcccgygcatacacgtctgggtagtgggtcttctggaagaccttctccagctcctccagctggtagctggtgaaggtggtccggttccgccgcttcttgcccttgttgctctccgagtcggccttctccaatgggctggggaggtctgagctggcccggtcctggggccccttcaccccagcctccttgacactcaggtagctgctgtccatccccacagtgtcagagtcagggggtaactctggctcacccagggagctctctttagctgagggaggaggaaacaaagtcagaaaccaatggttg

SEQ ID NO: 40548 - DNA, 601 bp, Human
actgagttgggttgagtgtgttgagttccactgtgttgtgttgtgttgagttgagttctattgggttgtgttctgttgggttgcaatgagttgggttgagtgttgggttccactgtattgtactgggttgggtgttttggttgttggctggtaataggggggctactgctttagccacagtggtcaggaagacttctcagaggaggtatgagttgggacttgaaaaatggagggggatgcagccatctaggcagaaggaagagctaaactgttctctgtttctgcccattgggatgctgtrgacattgtcttcatgtttgtcctgtttcctgtctaagagataggccttctagagcagggacaagtaacccttctctgtgtgaaagagccaggactctcacactgtgtaaagcccagaaacagccagcagcagccttcctgcccctctgctggaggccctccttcctttgcaaccccccaccacagtgcagaagcccaatattaaagaggataaaagcagagtcgctctagttgggacaggggcatgaggggcaggctaggagcccccactttcaggttctcaatgaactgaggaaaggaa

SEQ ID NO: 40549 - DNA, 601 bp, Human
aatcccagcagtatgggaggctgaggtgagggattacttgaggccaggagtttgagaccaacatggacaacaaagcaagaccctatctctacaaaaaataaaaaaacttatcccaggcgtggtggtgtatgcctgtggtcccagctactcaggaaactgaggcgggaggatccattgagcccacgaagttaaggctacagtgagccatgatcacaccactgtactccacgctgggtgacagagagagacccagtctctttaaaaaaaataaacaaaaatacccaaaagataaaatgggccyaggcatggtggctcatgcctataattctagcactttgggaggttgaggtgggatgatcactttagcctaggagtttgaggctgcagtgagctataatcatcttattgcactccagcctgggtgatagaatgagaccctgtctctaaaaagaaaacaaaaaaaatttaaaaaatttttaagaagataaaataggacagtgtaacaaaaggtgagctggtttgcttctgttgtgttgggttgggttgagttctattgggttgtgttgagtgggttgagtgtgtcaggttccattgtgttgtg

SEQ ID NO: 40550 - DNA, 601 bp, Human
ggtgacacagtgagatcctgtctcaaaaaataaaaaaataaaaaaaaaatggcaggctgccctcagggaacttacagcaactcaaccgtgcagctcttcagcatcacttctggtagctgcagtttctgaacagctacatatttactgataaccactagtccttttccacattagccattttggaaaaaaagtttgtagactctattagagatgcctctgccttcttaaacagaaaatggttgtaactgatgaatcttttactgatgccttagaacaatgctgctgaagatgctttcatgarttaattcaagagtccctggggcctgctgaggattgcagggttggggcatctctgtcctaacattgaagggctcagcccactgagctgcatggcgctttgctgattaaaaaaaaaaaaaaaaaaagatttctctttgttctgaagctattgatttttctggcccactggagagggaaaaactgctatgtggcaacgttttatttgctatttccaacatgctttgggttggaaaagcggactgattatgacatttattttgtgttaaattgaaacttaaacttgagtgtgtgaattttgtca

SEQ ID NO: 40551 - DNA, 601 bp, Human
ggctgggcatggtggctcacgcctgtaatctcagcactttgggagaccaaagcaggtgcaccacttgaggtcatgagttcaagaccaacctggccaacatggtgaaacctccatctctaccaaaaaataaaaaaaattagctgggtgtagtggtgcatgcctgtagtcacagctacttgggaggctgaggcatgagaatcgcttgaacccaggaggtggaggccgcagtgagccaagatcacaccactgcactccaacctgggtgacacagtgagatcctgtctcaaaaaataaaaaaataaaaaaaaaatggcaggctgccctcagggaacttacagcaactcaaccgtgcagctcttcagcatcacttctggtagctgcagtttctgaacagctacatatttactgataaccactagtccttttccacattagccattttggaaaaaaagtttgtagactctattagagatgcctctgccttcttaaacagaaaatggttgtaactgatgaatcttttactgatgccttagaacaatgctgctgaagatgctttcatgagttaattcaagagtccctggggcctgctgaggattgcagg

SEQ ID NO: 40552 - DNA, 601 bp, Human
cttcatcaaacattcattaggcactggaggggaataaaatggcagtcttgccaggtgcagtggctcatgcctgtaatcccagcactttgggaggctgaggtgggtggatcacctgaggtcaggagttgaagaccagccaaccaacatggtgaaaccccatctctattaaatatacaaaaattagccgggtgtggtggtgcacacctgtaatcccagctactcaggaggctgaggcaggagaatcgcttgaacccgggaggcagaggttgcagtgagccaagattgcaccactgcactccarcctgggcgacagaacaagactctgtctaaaaaaaaaaaggcagtctgggctgggcatggtggctcacgcctgtaatctcagcactttgggagaccaaagcaggtgcaccacttgaggtcatgagttcaagaccaacctggccaacatggtgaaacctccatctctaccaaaaaataaaaaaaattagctgggtgtagtggtgcatgcctgtagtcacagctacttgggaggctgaggcatgagaatcgcttgaacccaggaggtggaggccgcagtgagccaagatcacaccactgcact

SEQ ID NO: 40553 - DNA, 601 bp, Human
attttggaagtaggtataagtgtgtgtgtgtgcgcgcgcatgtgtgtgtgcagagaacactctgttttagttgtatggtggcaactgaaaaatgctctgtgcgcctttgttttcatgttttgtactcaaggcgtcattcttctttcagtacttagtgaattctactcccgggcactcccatatgtttgttaggaagcatgcatgcaacccacatatgcaaacacaaatgtacacacatactgcacagaaaaggaacaggtttatcccacaccaacacagcacctacagggctgtcccatamccagctatgcccctttctctacctacacctgtgggtcctccccaatccatttgctggagatcaggctagatgctaggattcctgtccaaactcaggcatgtaaggtcatgtgagtggctggttgtccaaattcaagtgagatctgggtgtgtgagggcttctggattcacaggaaagccccagctgccctgtcatccttcatcaaacattcattaggcactggaggggaataaaatggcagtcttgccaggtgcagtggctcatgcctgtaatcccagcactttgggaggctgaggtggg

SEQ ID NO: 40554 - DNA, 601 bp, Human
aatttttttttaccacattacctctgcatttcatgccattgttcttgtttttagattgaacaaataaatctttaattgtaagctacctcaactccattttggaagtaggtataagtgtgtgtgtgtgcgcgcgcatgtgtgtgtgcagagaacactctgttttagttgtatggtggcaactgaaaaatgctctgtgcgcctttgttttcatgttttgtactcaaggcgtcattcttctttcagtacttagtgaattctactcccgggcactcccatatgtttgttaggaagcatgcatgcmacccacatatgcaaacacaaatgtacacacatactgcacagaaaaggaacaggtttatcccacaccaacacagcacctacagggctgtcccataaccagctatgcccctttctctacctacacctgtgggtcctccccaatccatttgctggagatcaggctagatgctaggattcctgtccaaactcaggcatgtaaggtcatgtgagtggctggttgtccaaattcaagtgagatctgggtgtgtgagggcttctggattcacaggaaagccccagctgccctgtcatccttcatcaa

SEQ ID NO: 40555 - DNA, 601 bp, Human
ccctgcagccccctggagcagggccaaaccctaggcttcttcccaggaaaagtccatcttggggcccccattgccccgtccctgtccccaccaccactctacgccaggcacctggcttgccaccagctgagtatgggccctgaacaaacacagcagaggcaggcagggggttccatcaccacccccttaccccccccagggcactgccaggcttagggctcaacccagaggtctgacgcacatgaagatcccacccaccctgctgcctttatacaaagaaaagcctctgaacaatctggcwtgtgtccttgtacagcaaactaaagtcaaagaagcactaggctgcgactcaggagtcccggattccagtcgcagtgctgctactgagtggctgctgttaacttcaggttatgacttcccacctatgggcctcttcttcctcgtctatcaaatgggaagatggggtgatcatttccagcactaccgttctatagttctgtggtcctcccactaggtgataagatatgcagcacgtcagagtttccctttctgccttggctgccaggaagctccaagttgaagtttgtgctcaatggcaacc

SEQ ID NO: 40556 - DNA, 601 bp, Human
ggggaggcctctgtcttattgtcttcagacaccagctgcagagattggaatcccagacagcagagagaggcccctgcagccccctggagcagggccaaaccctaggcttcttcccaggaaaagtccatcttggggcccccattgccccgtccctgtccccaccaccactctacgccaggcacctggcttgccaccagctgagtatgggccctgaacaaacacagcagaggcaggcagggggttccatcaccacccccttaccccccccagggcactgccaggcttagggctcaacccagargtctgacgcacatgaagatcccacccaccctgctgcctttatacaaagaaaagcctctgaacaatctggcatgtgtccttgtacagcaaactaaagtcaaagaagcactaggctgcgactcaggagtcccggattccagtcgcagtgctgctactgagtggctgctgttaacttcaggttatgacttcccacctatgggcctcttcttcctcgtctatcaaatgggaagatggggtgatcatttccagcactaccgttctatagttctgtggtcctcccactaggtgataagatatgcag

SEQ ID NO: 40557 - DNA, 601 bp, Human
gcccatctggggccagggcggggtggcccagggcggggaggcctctgtcttattgtcttcagacaccagctgcagagattggaatcccagacagcagagagaggcccctgcagccccctggagcagggccaaaccctaggcttcttcccaggaaaagtccatcttggggcccccattgccccgtccctgtccccaccaccactctacgccaggcacctggcttgccaccagctgagtatgggccctgaacaaacacagcagaggcaggcagggggttccatcaccacccccttaccccccmcagggcactgccaggcttagggctcaacccagaggtctgacgcacatgaagatcccacccaccctgctgcctttatacaaagaaaagcctctgaacaatctggcatgtgtccttgtacagcaaactaaagtcaaagaagcactaggctgcgactcaggagtcccggattccagtcgcagtgctgctactgagtggctgctgttaacttcaggttatgacttcccacctatgggcctcttcttcctcgtctatcaaatgggaagatggggtgatcatttccagcactaccgttctatagtt

SEQ ID NO: 40558 - DNA, 601 bp, Human
ataggagcactggtattgccaagggcctcagtttctgcatggcgaatggtacctcatagtcgcagcaggggagatagatgggaaatgcagtccaagaatgtttagagtacttcccatttgtttctttacagctcctgacctttctcactgtcttttgctagaggaaagaggtcaaggaagatggggatgtatctcatgttactgtgaggagggtgggggtgagcaggggtgtacattattatgtttctccactcctgtaccaactcactttcccctccctaatcctaagcatgtgtgtgcrtgcacgagtgtacccactagtgtggctacacgcacgtgcatgtgtgcacacacattgactgggggaggagaagcctcttccttagaaacggaccctctccccagtttggggtctcagcccctgccctggcctcccagggccccttttcctccagggattcctagggtccaggccctggctgcccactgggagccaaggacagatggggtctcctctctgtgctgctgaaatgggatccctctttatcagtggcctgggatgggagactggggccaggatgagagaatgaatcagaggagc

SEQ ID NO: 40559 - DNA, 601 bp, Human
gctgacaatctagaatcatccactctgagctgggaaggtatcttacccccactagccatgggcgtgatcctgagccagaacttttatttttctaagcttgagaatctagagcagccaagtgtcaccacctataaaacaagtcactggtcatcttagcagtcatctaagcagactcctgtggagaagctgataaaagctacaaatgctcctccagatgtgttctcctagacaatcacacacagttttgccacagttttccaaaaggttcatggctctctaaggcttattggtccagattcasaatgccttcctccctgcatcctgtctgcagccttcttgttggagacagtctcccagctcagaactcccctgtgttaaagggagaacaggggctctgctgggcaacagaggcagtcagggaagacttcctggaggagggacaggagctgggccttgaatggttggctgaaaggaggaaagccaaggcctaggtttagaaacagcaaggcatactccaaaaacctaaagaggtcaatttgaaggaagcggtgggagagaaagaaacagagtcagatcgcagggggccttgactgccaagtga

SEQ ID NO: 40560 - DNA, 601 bp, Human
cgcttcctccacttggcccttcggttctggaaccagacctacaagacgcgaaaaagccattgtcaccagggtgagatgcccgcctggaggcctcactttcaggcagtgcaaactgttcccttgagccccccatcagttgcagtgcgtttgggaagcggtgcggccacacataaatatcaaccttggtctttgtcctcaagagctgacaatctagaatcatccactctgagctgggaaggtatcttacccccactagccatgggcgtgatcctgagccagaacttttatttttctaagcttsagaatctagagcagccaagtgtcaccacctataaaacaagtcactggtcatcttagcagtcatctaagcagactcctgtggagaagctgataaaagctacaaatgctcctccagatgtgttctcctagacaatcacacacagttttgccacagttttccaaaaggttcatggctctctaaggcttattggtccagattcagaatgccttcctccctgcatcctgtctgcagccttcttgttggagacagtctcccagctcagaactcccctgtgttaaagggagaacaggggctctgctg

SEQ ID NO: 40561 - DNA, 601 bp, Human
gatcggtggcggcagctcagggcgggacttacctgggcgtagttctcagctcgggtgaggaggggcagctcatatgcagtggagaagtgggttcgaacctgctgcatctgcccaaaacgctcccgcttcctccacttggcccttcggttctggaaccagacctacaagacgcgaaaaagccattgtcaccagggtgagatgcccgcctggaggcctcactttcaggcagtgcaaactgttcccttgagccccccatcagttgcagtgcgtttgggaagcggtgcggccacacataaatatsaaccttggtctttgtcctcaagagctgacaatctagaatcatccactctgagctgggaaggtatcttacccccactagccatgggcgtgatcctgagccagaacttttatttttctaagcttgagaatctagagcagccaagtgtcaccacctataaaacaagtcactggtcatcttagcagtcatctaagcagactcctgtggagaagctgataaaagctacaaatgctcctccagatgtgttctcctagacaatcacacacagttttgccacagttttccaaaaggttcatggctctc

SEQ ID NO: 40562 - DNA, 601 bp, Human
aaaagtggccaaagctagtggaggaaagagccgttctcactgccccaaccttcccttccctaaagttcagccaagcctggttcaatgattagttggatagattaaccctgggcctcccacactctggtataaacaggcacacccctggaatgagacggaagggcagcctggagccataagtcatctcggggtgcctgggctctcctccaaggggctcattctcagagcaccaggggctggggatcggtggcggcagctcagggcgggacttacctgggcgtagttctcagctcgggtgagraggggcagctcatatgcagtggagaagtgggttcgaacctgctgcatctgcccaaaacgctcccgcttcctccacttggcccttcggttctggaaccagacctacaagacgcgaaaaagccattgtcaccagggtgagatgcccgcctggaggcctcactttcaggcagtgcaaactgttcccttgagccccccatcagttgcagtgcgtttgggaagcggtgcggccacacataaatatcaaccttggtctttgtcctcaagagctgacaatctagaatcatccactctgagctgggaa

SEQ ID NO: 40563 - DNA, 601 bp, Human
tccagctcctccccaggcccctcacatccataggcacctgagcaaggtgagcagacctcaactcggagagctttggcctcgcaggttcccttgggcccccaccagtagcagggaagatggaggggttgggtgaggtgggcggcagggacctaaacctctcagaaaccaagggtcagtggctgaggttccagggcctgaactaggaggcttcagaactaactcaggatggaaggggctgcctcaggagtggacagccagatctgagaccggacctcctcgtgccaaaggggcgagggcatgygcagggatgagttggccatcttatcttccatctgtgccactgggcttcccttccctccccaacgttcacctggggctcccatcttcctctaccttctaggcacgtataaggaggtagaattagggtgtgggggagacccgggaacctctcagcttatgcacacgggattcctggtaacctcatgtgggcttctgctggcctgccctcctgcatgtgtctggagcacactcgagggaggcattttaaagcagggagaaagagctcagcccccatcctggagggaaccacatttctctctgc

SEQ ID NO: 40564 - DNA, 601 bp, Human
aagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacctcgccactccagctgcgcctccggctgcagcgcacacgtctcctgcgcctcctcctccggagcgtcgctgtccgtcgggttcatccctcgcagcagtctccaggcgagagagggggccagagtgctcgcacttytcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcat

SEQ ID NO: 40565 - DNA, 601 bp, Human
cagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagarctctggaaattttattagcattttaaaatttgcattctcgaccgaagattaaagtgcaaattactttgaagctgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagaca

SEQ ID NO: 40566 - DNA, 601 bp, Human
ttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagaactctggaaattttattagcattttaaaatttgcattctcgaccgaagattaaagtgcaaattactttgaagmtgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgctaacgatgtgctacttttgattaggaacgtgtaa

SEQ ID NO: 40567 - DNA, 601 bp, Human
gcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagaactctggaaattttattagcattttaaaatttgcattctcgaccgaagattaaagtgcaaattactttgaagctgttttaaagcacgcttaagaattttaaaraatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgctaacgatgtgctacttttgattaggaacgtgtaaatatcctccattgaaaacaaatgcccgaag

SEQ ID NO: 40568 - DNA, 601 bp, Human
ttaaagtgcaaattactttgaagctgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgctaacgatgtgstacttttgattaggaacgtgtaaatatcctccattgaaaacaaatgcccgaaggttatatgcttttatataatatatcagatttttacaaatgtgttttatactaaacgtattttggcttcacagatggcgagtgcagtcatgaaaatagatattgttttgcttaatttcttaatagatttttaaagcttaatctgtagtgggtgaaaagaatacactgggtgtggcagtaaaatgcatcacaatgagtttactgaaaaaaattaatggacttttaaattatactctgggcagaaaaatt

SEQ ID NO: 40569 - DNA, 601 bp, Human
agcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgctaacgatgtgctacttttgattaggaacgtgtaaatatcctcyattgaaaacaaatgcccgaaggttatatgcttttatataatatatcagatttttacaaatgtgttttatactaaacgtattttggcttcacagatggcgagtgcagtcatgaaaatagatattgttttgcttaatttcttaatagatttttaaagcttaatctgtagtgggtgaaaagaatacactgggtgtggcagtaaaatgcatcacaatgagtttactgaaaaaaattaatggacttttaaattatactctgggcagaaaaattctctaaacatttagtcgttggcttatttagtg

SEQ ID NO: 40570 - DNA, 601 bp, Human
aggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgctaacgatgtgctacttttgattaggaacgtgtaaatatcctccattgaaaacaaatgcccgaaggttatatgcttttatataatatatcagatttttacaaatgtgttttatactaaacgtattttggcttcasagatggcgagtgcagtcatgaaaatagatattgttttgcttaatttcttaatagatttttaaagcttaatctgtagtgggtgaaaagaatacactgggtgtggcagtaaaatgcatcacaatgagtttactgaaaaaaattaatggacttttaaattatactctgggcagaaaaattctctaaacatttagtcgttggcttatttagtgtggagaacatgcttgggggatttctcaaaatgtagtaaaaatattctagtagaggaattaattttgaataacctttattagtagaggaggc

SEQ ID NO: 40571 - DNA, 601 bp, Human
aatgaaaagataacgaagaaatgtttgctaacgatgtgctacttttgattaggaacgtgtaaatatcctccattgaaaacaaatgcccgaaggttatatgcttttatataatatatcagatttttacaaatgtgttttatactaaacgtattttggcttcacagatggcgagtgcagtcatgaaaatagatattgttttgcttaatttcttaatagatttttaaagcttaatctgtagtgggtgaaaagaatacactgggtgtggcagtaaaatgcatcacaatgagtttactgaaaaaaattaatggacttttaaattatactctgggcagaaaaattctctaaacatttagtcgttggcttatttagtgtggagaacatgcttgggggatttctcaaaatgtagtaaaaatattctagtagaggaattaattttgaataacctttattagtagaggaggctgcttacaccgttaaaaacaaaagcaactcaaggtcacttagaatgggaaacttcagtattttctacaccagaaggtgtgtactgtgccagatgaatccttaaaaatccataaaacaactacttctagtcatttttaaa

SEQ ID NO: 40572 - DNA, 601 bp, Human
gataacgaagaaatgtttgctaacgatgtgctacttttgattaggaacgtgtaaatatcctccattgaaaacaaatgcccgaaggttatatgcttttatataatatatcagatttttacaaatgtgttttatactaaacgtattttggcttcacagatggcgagtgcagtcatgaaaatagatattgttttgcttaatttcttaatagatttttaaagcttaatctgtagtgggtgaaaagaatacactgggtgtggcagtaaaatgcatcacaatgagtttactgaaaaaaattaatggrcttttaaattatactctgggcagaaaaattctctaaacatttagtcgttggcttatttagtgtggagaacatgcttgggggatttctcaaaatgtagtaaaaatattctagtagaggaattaattttgaataacctttattagtagaggaggctgcttacaccgttaaaaacaaaagcaactcaaggtcacttagaatgggaaacttcagtattttctacaccagaaggtgtgtactgtgccagatgaatccttaaaaatccataaaacaactacttctagtcatttttaaatagtttga

SEQ ID NO: 40573 - DNA, 601 bp, Human
aacgatgtgctacttttgattaggaacgtgtaaatatcctccattgaaaacaaatgcccgaaggttatatgcttttatataatatatcagatttttacaaatgtgttttatactaaacgtattttggcttcacagatggcgagtgcagtcatgaaaatagatattgttttgcttaatttcttaatagatttttaaagcttaatctgtagtgggtgaaaagaatacactgggtgtggcagtaaaatgcatcacaatgagtttactgaaaaaaattaatggacttttaaattatactctgggyagaaaaattctctaaacatttagtcgttggcttatttagtgtggagaacatgcttgggggatttctcaaaatgtagtaaaaatattctagtagaggaattaattttgaataacctttattagtagaggaggctgcttacaccgttaaaaacaaaagcaactcaaggtcacttagaatgggaaacttcagtattttctacaccagaaggtgtgtactgtgccagatgaatccttaaaaatccataaaacaactacttctagtcatttttaaatagtttgaaattgatcttacgtatgattc

SEQ ID NO: 40574 - DNA, 601 bp, Human
gttacatgtagaaagcaaaaatacaattaattttctttaaacctgttttttcaatcttattatttatttatttatttttttgagacggagtcttgctccattgcccaggctggagtgcagtggctcgatttcggctcactgcaacctccacctcctggcttcaagtaattctcctctcggcctcctgagtacctgggattacaggcgcacaccaccatgcctggctagtttttgtatttttagtagagatggggtttcaccatattggtcaggctggtctcgagctcctgacctcaggtgwtacacctgcctcagcatcgcaaagtgatgggattacaggtgtgagcaaccccgcctggccttttttcaatctttaacggtgttattgaagagggaccatgaagagcttcttgggtatgtcaggtcctttccagtccccagttctggctctcttcttcctgtctgtctggaatatcacacacctgtcttctcccttcctccctgccttcagcctcttcttccttcagggacttcaacaccaaattccagcccctttccccactgcttctcccgcatgctccctccaccccaggaatcaggg

SEQ ID NO: 40575 - DNA, 601 bp, Human
cagtggctcgatttcggctcactgcaacctccacctcctggcttcaagtaattctcctctcggcctcctgagtacctgggattacaggcgcacaccaccatgcctggctagtttttgtatttttagtagagatggggtttcaccatattggtcaggctggtctcgagctcctgacctcaggtgttacacctgcctcagcatcgcaaagtgatgggattacaggtgtgagcaaccccgcctggccttttttcaatctttaacggtgttattgaagagggaccatgaagagcttcttgggtaygtcaggtcctttccagtccccagttctggctctcttcttcctgtctgtctggaatatcacacacctgtcttctcccttcctccctgccttcagcctcttcttccttcagggacttcaacaccaaattccagcccctttccccactgcttctcccgcatgctccctccaccccaggaatcagggctctgcaggctttcctaagcagaccttgcctttcctgcccaccctgttccatattattccgatatgtactgccccttcatccttgcctgtcccagtcctcctcatcctattcttcaa

SEQ ID NO: 40576 - DNA, 601 bp, Human
ctggctagtttttgtatttttagtagagatggggtttcaccatattggtcaggctggtctcgagctcctgacctcaggtgttacacctgcctcagcatcgcaaagtgatgggattacaggtgtgagcaaccccgcctggccttttttcaatctttaacggtgttattgaagagggaccatgaagagcttcttgggtatgtcaggtcctttccagtccccagttctggctctcttcttcctgtctgtctggaatatcacacacctgtcttctcccttcctccctgccttcagcctcttcttycttcagggacttcaacaccaaattccagcccctttccccactgcttctcccgcatgctccctccaccccaggaatcagggctctgcaggctttcctaagcagaccttgcctttcctgcccaccctgttccatattattccgatatgtactgccccttcatccttgcctgtcccagtcctcctcatcctattcttcaaggctctgtccaaatactactgctggctgattttaacatgtgaaagacatttctctctctgactttcttctgtaggagtgaaaggtacttctgtgtaccactct

SEQ ID NO: 40577 - DNA, 601 bp, Human
tgatgggattacaggtgtgagcaaccccgcctggccttttttcaatctttaacggtgttattgaagagggaccatgaagagcttcttgggtatgtcaggtcctttccagtccccagttctggctctcttcttcctgtctgtctggaatatcacacacctgtcttctcccttcctccctgccttcagcctcttcttccttcagggacttcaacaccaaattccagcccctttccccactgcttctcccgcatgctccctccaccccaggaatcagggctctgcaggctttcctaagcagaccttgcctttcctgcccaccctgttccatattattccgatatgtactgccccttcatccttgcctgtcccagtcctcctcatcctattcttcaaggctctgtccaaatactactgctggctgattttaacatgtgaaagacatttctctctctgactttcttctgtaggagtgaaaggtacttctgtgtaccactcttgtggtgttggtctcagtttgccttttgttgcagttgcatgtttgcctcctgtttttgcctttttttttttttttttggagacatagtcttgttttgtcgcccag

SEQ ID NO: 40578 - DNA, 601 bp, Human
gatgggattacaggtgtgagcaaccccgcctggccttttttcaatctttaacggtgttattgaagagggaccatgaagagcttcttgggtatgtcaggtcctttccagtccccagttctggctctcttcttcctgtctgtctggaatatcacacacctgtcttctcccttcctccctgccttcagcctcttcttccttcagggacttcaacaccaaattccagcccctttccccactgcttctcccgcatgctccctccaccccaggaatcagggctctgcaggctttcctaagcagaccctgcctttcctgcccaccctgttccatattattccgatatgtactgccccttcatccttgcctgtcccagtcctcctcatcctattcttcaaggctctgtccaaatactactgctggctgattttaacatgtgaaagacatttctctctctgactttcttctgtaggagtgaaaggtacttctgtgtaccactcttgtggtgttggtctcagtttgccttttgttgcagttgcatgtttgcctcctgtttttgcctttttttttttttttttggagacatagtcttgttttgtcgcccagg

SEQ ID NO: 40579 - DNA, 601 bp, Human
atctttaacggtgttattgaagagggaccatgaagagcttcttgggtatgtcaggtcctttccagtccccagttctggctctcttcttcctgtctgtctggaatatcacacacctgtcttctcccttcctccctgccttcagcctcttcttccttcagggacttcaacaccaaattccagcccctttccccactgcttctcccgcatgctccctccaccccaggaatcagggctctgcaggctttcctaagcagaccttgcctttcctgcccaccctgttccatattattccgatatgtastgccccttcatccttgcctgtcccagtcctcctcatcctattcttcaaggctctgtccaaatactactgctggctgattttaacatgtgaaagacatttctctctctgactttcttctgtaggagtgaaaggtacttctgtgtaccactcttgtggtgttggtctcagtttgccttttgttgcagttgcatgtttgcctcctgtttttgcctttttttttttttttttggagacatagtcttgttttgtcgcccaggctggagtgcagtgtcgcgatctcggctcactgcaacctctgcc

SEQ ID NO: 40580 - DNA, 601 bp, Human
ttgcctgtcccagtcctcctcatcctattcttcaaggctctgtccaaatactactgctggctgattttaacatgtgaaagacatttctctctctgactttcttctgtaggagtgaaaggtacttctgtgtaccactcttgtggtgttggtctcagtttgccttttgttgcagttgcatgtttgcctcctgtttttgcctttttttttttttttttggagacatagtcttgttttgtcgcccaggctggagtgcagtgtcgcgatctcggctcactgcaacctctgcctcctgggttcaagsaattcccctgcctcagcctcccgagtagctgggactacaggtgggctaacatgcctggctaatttttgtattttttttagtggagatggggtttcaccatgttggccaggccgatctcgaactcctgacctccggtgatcggcccacctctgcctcccaaagtgctgggattacaggtgcgaaccaccactcctggccctgtttcatttgttaaacagtaagtaatgtaggatacaatctactcttactggtacctgtttttagtacagtggccttttacaagtttatggaatgaaggag

SEQ ID NO: 40581 - DNA, 601 bp, Human
gcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatggagtactttgttatataacagaagccatcctgaaatgaaactagtctaaaaaaattcattgttctrcttagttgcagctgtacctgaaataaaaatgttattgatgactgaattttcttgtgtgtatatttggtgagcggtattaaacaggaaaaaagaaattacttgtattttcttcgctctgtgctttgaaaacatctatttgatttcacccccatctgttgtaatcaataacctgaccatcttgttttttattaaatgcacttactcttaatttcatccaccagtggttttagagagaataatgtggagttacctatataggtttgacattataaatcacttcttggggctgaatcgtatagc

SEQ ID NO: 40582 - DNA, 601 bp, Human
ggtctttgactcaatgtagtacaatctcagtcttcatctcagccacagtcggcctaagaaggtaggccaccccagccctcccgaggccgcgggcagggtgcggaggtcagacttccagggaaggccaaggggcgctttaagcagtgagaaggccacggccaggaggtggacgcagaaaaaacttgcaccctggctcagattcttcccgtgtgacccaaatctccactcgtggcccgtgccctgctgctagacgccctgacctccgcgcccggaggccttgctccccgcctgtgcccaggcyaggcctgggactccattgctgcatcccgctcacctccagactgcagtcgccgccgccgttaggccgtagctccgaaggcgggctccgggctcctccaacctgggggccgagccagggccccggacgggggctcgcgccggaccggccgggtccccggcggtgcgggcggggtgggaaccccgggggatcccgggaggggagggggtcccgggccggggccgggggtggggtctggcaccggagctttcagtttgttccgctgtttgaaattggcgccggcggagcgttaaggtcacgtga

SEQ ID NO: 40583 - DNA, 601 bp, Human
aaagggccctgcaaaagggtaagtaagatggaggcggtgttgcctagtggtgagacagcctgggagcaggggagtgtgtatgcaggttggtctttgactcaatgtagtacaatctcagtcttcatctcagccacagtcggcctaagaaggtaggccaccccagccctcccgaggccgcgggcagggtgcggaggtcagacttccagggaaggccaaggggcgctttaagcagtgagaaggccacggccaggaggtggacgcagaaaaaacttgcaccctggctcagattcttcccgtgtgrcccaaatctccactcgtggcccgtgccctgctgctagacgccctgacctccgcgcccggaggccttgctccccgcctgtgcccaggccaggcctgggactccattgctgcatcccgctcacctccagactgcagtcgccgccgccgttaggccgtagctccgaaggcgggctccgggctcctccaacctgggggccgagccagggccccggacgggggctcgcgccggaccggccgggtccccggcggtgcgggcggggtgggaaccccgggggatcccgggaggggagggggtcccggg

SEQ ID NO: 40584 - DNA, 601 bp, Human
tatggacagaaatggaagatgctagaataggaaagcatatggtaattaggagtcctgaagaaactctgatcccataatccattcaagacaaaggattttaattttttttttttttttttttttgagacagagtctcactttgtcacccaggctggagtgcagtggcacgatctcagttcactgcaacctctgcctcctgggtttaagcgagtcccacgtctcagcctcctgagtagctgggattacaggtgcccaccaccacgcccggctagtttttgtatttttagtagagacagggttkcaccatgttggtcaggctggtctcaaactcctgacctcaggtcatctgcccgcctcggcctcccaaagtgctgggattacaggcgtgagccaccgcgtctggccaagccttttgatttttatattactttgtaaataggaccagtgcacacagaatcagggaagaaaggcagattgtactattgccacactactggaaaaatcatctcccagtttacaaaacctcacataaaatggaaacctctactgaaggcccatgtaaagttgtgcagcttgtgcactgaacaactctagagggtga

SEQ ID NO: 40585 - DNA, 601 bp, Human
ctcgtctctactaaaaatacaaaattagctgggtgtggtggcacacgcctgtagtcccagctactcaggaggctgagacaggagaattgctcgaacccgggagacgaaggctgcagtgagccaacattgcgccactacactccagcctgagtgagactctgtctcagaaaaataaaaaataaaaaagaaagaattggtggctagggatcacttgtccaagacctctgcctttagggacggagaacacatgctgaatctattgtggctctaagttactctgccccattatgcatttcaggamaaatttaggagcatagttcaaattgcatttcaagctgagccacactgagccttagagatcaatcaaggcaggcttacaaaagaattattgagatatgcacaccaaaaaagtcacttttcagcctgggcaatatagtgggaccccatctctgcaaaaagaaaaaaaaaattaactgggaatgatggtgcatgcctatagtcccagctacttgggaggctgatgtgggagaatggcttgagtccaggcattcgaggctagagtgagccgtgattgcgccactgcactctagcctgggtgaca

SEQ ID NO: 40586 - DNA, 601 bp, Human
tggatcacgaggtcaggagttcaagaccagcctggccaacatagtgaaaccccatctctactaaaaatacaaaaattagccgggcgtggcagcgggcacctgtaatcccagctactcagaagtctgaggcaggagaatcacttgacctgggaggtggaggtagcagtgagctgaaatcgcagcactgcactccagcctaggagacagagaaagactacgtctcaaaaaaaaaaaaaaaaaaaaaaaaagcaggagctaaacattgagcacacatggatatgaagaagggaacactagacascagggccttcttgagggtggagagtgggaggagggggagacagaaaaactacctagcaggtactatactcactacctgggtgacaaaatcatttgtacactaaaccccagcgacacacaatatacccatgtaacacacctgcacatgtaccccctgaacctaaaataaaagttgagaaaaaaaagaaaataaaggttgaatgagtgatttacacatatatacaatagaatctagatgtgttatattggtaactgtgggaaaaaaacccagactacacaattgggttagatcaattttgat

SEQ ID NO: 40587 - DNA, 601 bp, Human
atacctttttagctcttctaatgctattacacttccctatgtttttatgccttttctacccaactagatttataagctctcaaggaacacttatcagagtgctttgcaagctgaaggtccaacattcttaattggccagaatctctcttcagaggaaaataggacacccaccttgggggcaatgcggactcgcttgctatggcgggcaagctctgagctcatgagggaagccgccaggggcaatggcaccttcaccgagggctgcaacaccagtgactggttcaccgggaactggataggyaccaggtatgagctgacccgtggtagcagtggcttcatcttccgccctaggaggaaacacgagagatcaggagcagggggactggagtacaccccttctcagccccaggagctttgctctccttctctgggctcagatccctttgaggtgggaacagaatcccagagtctggttccctaaagatatggccccagaacaaggaccaggcccaaggcccactctcccatactaacgtgcgcccagggggagttcggttttgatggtcatgttccggcggagctctggattcggtcgtttctg

SEQ ID NO: 40588 - DNA, 601 bp, Human
cgcctccatggcactgcccattagcatgctctctctacacctgtttgcttacccaaatctactttttttcttttcttttttgagacagggcctcactgttgcccaggctggagtgcagtggtgcaaacagggctcactgcagcctcaacctcctggactcaagtgatccttctgcctcagcctcctgagtagctggtaccacaggcatgtactaccaccgtggctaatttttttttttgcatttttagcagagactggggtcttgctatgttgcccaggctggtctcgaactcttggctgkaagcaatacccctgcctcggcctcccaaagtgtcgggattacaagtgagacccacagcgtctagcctcaaatccacttctttcttttctttttttttttttgagacagagtctcgctctgtcacccaggctggagtgcagtgatctcggctcactgcaacttcccttcctgggctcatgtgattctccagcctcagcctcccaagtagctgggattacaggcatgtgccaccaagcccagctaatttttgtattttttagtagagacggggtttcgccacgttggccaggctggtctcaa

SEQ ID NO: 40589 - DNA, 601 bp, Human
tgtgtaatatgttttatttataattaaagaaaatgttttttagagacagggtctcattttgttgcctaagctagaatgcagtggcacgattatagctcattgcagcctccagctctggagctcaagtaatccttctgcctcagcctcccaagtggctgggacaacaggtatacatgaaaatgcctggctaattaaaaaaaaatttttttttttttgttacagacagggtcttactttgctgcccaggctggtcttgaactcctggcctcaagtgatcctcctgccttggcctcccaaaatrctaggattataggtgtgagccactgtgcatggcctaaaagattttatatattaaaaaaaaagcaaacccaagtcgctctaaactccagactctatgctattttcatctctctgaaggggatgggggaagcttttcactttggttacatgtcagcccgtactcacagaaccctttaacagtgttaagtgcagatctgatggctgatccaagttggctctgaatttacccttctcaccttcccctcaagctagaccagtgatactcaagcaggggtgattccctccctgccaggggacattt

SEQ ID NO: 40590 - DNA, 601 bp, Human
aggggagaaaaacccactgcatgaaaacccaaacagggcacatgctacggccacatgaatgaatttacgctaaattatgtatgtgtggtataattttgtgtgtaatatgttttatttataattaaagaaaatgttttttagagacagggtctcattttgttgcctaagctagaatgcagtggcacgattatagctcattgcagcctccagctctggagctcaagtaatccttctgcctcagcctcccaagtggctgggacaacaggtatacatgaaaatgcctggctaattaaaaaaaaatttttttttttttgttacagacagggtcttactttgctgcccaggctggtcttgaactcctggcctcaagtgatcctcctgccttggcctcccaaaatactaggattataggtgtgagccactgtgcatggcctaaaagattttatatattaaaaaaaaagcaaacccaagtcgctctaaactccagactctatgctattttcatctctctgaaggggatgggggaagcttttcactttggttacatgtcagcccgtactcacagaaccctttaacagtgttaagtgcagatctgatggct

SEQ ID NO: 40591 - DNA, 601 bp, Human
aaggggagaaaaacccactgcatgaaaacccaaacagggcacatgctacggccacatgaatgaatttacgctaaattatgtatgtgtggtataattttgtgtgtaatatgttttatttataattaaagaaaatgttttttagagacagggtctcattttgttgcctaagctagaatgcagtggcacgattatagctcattgcagcctccagctctggagctcaagtaatccttctgcctcagcctcccaagtggctgggacaacaggtatacatgaaaatgcctggctaattaaaaaaaawtttttttttttttgttacagacagggtcttactttgctgcccaggctggtcttgaactcctggcctcaagtgatcctcctgccttggcctcccaaaatactaggattataggtgtgagccactgtgcatggcctaaaagattttatatattaaaaaaaaagcaaacccaagtcgctctaaactccagactctatgctattttcatctctctgaaggggatgggggaagcttttcactttggttacatgtcagcccgtactcacagaaccctttaacagtgttaagtgcagatctgatggc

SEQ ID NO: 40592 - DNA, 601 bp, Human
ctatgccaagtgacttggaagaaattccatgaggcattgttgagttagagacatgtagaggctgggcgtggtgggtcattcctgtaatctcaacactttgggaggccaaggcaggcggatcatgaggtcaggagctcgagaccagcctgaccaacatggtgaaaccccatctctactaaaaatacaaaaattagctgggcgtggtgacgtgcgcctgtgatcgcagctactcaggaggccgaggcaggagaatcgcttgaacccaggaggcggaggttgcagtgagccaagatcatgccaytgcactccagcctgggcgacagagtgagactccgtctcaggaaaaaaaaaaaaaaaaagagacatgtagagaagtatgcacaacatgattacattatcaatgttctgtgtgttgtatgtgtacatataaaatggctatcgctatacatgtatagtataactaagagcattgataaaatatgcaagaaagcatcataaattatcaaccagttatcttgggagtaggggtgatgtgggtgatggtagggtggagagggagccaaaaaggaaaggggagaaaaacccactgcatgaaaaccca

SEQ ID NO: 40593 - DNA, 601 bp, Human
ataaaagtggaatggctgaaaaatctgtggtgtagccacatcatggaatattacatggacactaaaaaataatgaattaggactatgccaagtgacttggaagaaattccatgaggcattgttgagttagagacatgtagaggctgggcgtggtgggtcattcctgtaatctcaacactttgggaggccaaggcaggcggatcatgaggtcaggagctcgagaccagcctgaccaacatggtgaaaccccatctctactaaaaatacaaaaattagctgggcgtggtgacgtgcgcctgtratcgcagctactcaggaggccgaggcaggagaatcgcttgaacccaggaggcggaggttgcagtgagccaagatcatgccattgcactccagcctgggcgacagagtgagactccgtctcaggaaaaaaaaaaaaaaaaagagacatgtagagaagtatgcacaacatgattacattatcaatgttctgtgtgttgtatgtgtacatataaaatggctatcgctatacatgtatagtataactaagagcattgataaaatatgcaagaaagcatcataaattatcaaccagttatcttgg

SEQ ID NO: 40594 - DNA, 601 bp, Human
tttaaaataccttctcacccaacaatctcacatctgggactctatcctagagaaatgaaagcactagtaagagagatccttgcaaacatatttattgcagtgtcgttcattgggcaaaatttgagaaacagaatctgtccataaaagtggaatggctgaaaaatctgtggtgtagccacatcatggaatattacatggacactaaaaaataatgaattaggactatgccaagtgacttggaagaaattccatgaggcattgttgagttagagacatgtagaggctgggcgtggtgggtcaytcctgtaatctcaacactttgggaggccaaggcaggcggatcatgaggtcaggagctcgagaccagcctgaccaacatggtgaaaccccatctctactaaaaatacaaaaattagctgggcgtggtgacgtgcgcctgtgatcgcagctactcaggaggccgaggcaggagaatcgcttgaacccaggaggcggaggttgcagtgagccaagatcatgccattgcactccagcctgggcgacagagtgagactccgtctcaggaaaaaaaaaaaaaaaaagagacatgtagagaagtatg

SEQ ID NO: 40595 - DNA, 601 bp, Human
atatagatcttatcatatattgctggtttaaacatgacttatcatagcttttttggaaagcaatctagcaatatttagtagaatttaaaataccttctcacccaacaatctcacatctgggactctatcctagagaaatgaaagcactagtaagagagatccttgcaaacatatttattgcagtgtcgttcattgggcaaaatttgagaaacagaatctgtccataaaagtggaatggctgaaaaatctgtggtgtagccacatcatggaatattacatggacactaaaaaataatgaatyaggactatgccaagtgacttggaagaaattccatgaggcattgttgagttagagacatgtagaggctgggcgtggtgggtcattcctgtaatctcaacactttgggaggccaaggcaggcggatcatgaggtcaggagctcgagaccagcctgaccaacatggtgaaaccccatctctactaaaaatacaaaaattagctgggcgtggtgacgtgcgcctgtgatcgcagctactcaggaggccgaggcaggagaatcgcttgaacccaggaggcggaggttgcagtgagccaagatcat

SEQ ID NO: 40596 - DNA, 601 bp, Human
agacatttgactacataaaactttaaaattttactgtggcaagagataccataaacaaagttaagaaacaacaaacaatgcctgtaatcccagcactgcaagacactgaggccagtttgagaccagcctgagcaacatagtgagatcccatctctacaaaaaaattttttttaattagctggatgtggtggcatgcacctgtagttccagctacaggtgggaggctgaggtgggaagatcacttgagcctgggaggtcaaggatgtagtgagccttcattacaccactgcactccagactrggcaacatagcaagatcctgtctcagaaaagaaaagaaaggaaagtaaagagataaacaatagaagtagaaaaatatcttcagcataaaagaaagaagattattttaacaacaaagagctctcacagggggctgggtgcggtggctcacgcctgtaatccagcactttgggaggccaaggcaggcagatcacctgaggtcagaagttcgagaccagcctgaccaacatggtgaaaccttgtctctactaaaaatacaaaattagccgggcgtggtggcatgcacctgtaatcccagctac

SEQ ID NO: 40597 - DNA, 601 bp, Human
gactctggcaagcagatccacttgtctgggtccctgcagtgaagaacccaagatccaggtacctcagcctggaagaaaccgtgcactgcaggtcttcccttctatcaaaactaaaagcaaggaacagaagtcaattgaaaccccaggtcatcctacccaccttctggcagtctctggataatgatctaaggaaataagcttacatttataattagaggataatttggagaatttatactatttacacggaccaccctgcaaagatcagggaaggtaagagactgctgggcagagaatggaracaggctggggggttcctaatctcttttcaccattgcctttgttgttcccacccttcagctcctggcagggacagcagaggaatcagatactcttggggaacacaaggtcccagcagtggctagggtgtgactgctacttttgcataatcaggcagcagggagctatgaggagcagaacagtccctgcctgctgtcctcactcagaggcttggggtgcactgagccttggagtgcccgggatggtggacagcttgagcacaggggcaagggcagggctctactgtagctcaggaataaac

SEQ ID NO: 40598 - DNA, 601 bp, Human
ataaaagagaaagaaaagaaaaagagaaaaaggagaatatgagacaaaaaccatattttagataagcaataaaataaatatacgcatgcaataatataggcattttgtttttacttttctaaacttctttttataatgcaatattttgatattgatattttgatacaatgttttgatattgctgcaatactttaagctatgatgtcaacccctctccactgtcatggtcagtaatacataagtacattctactcttctttggcaaataaagatgagttcaaacataagaactcactggttyctcctacaaacttctgacaaatcttggaaagggttaccaacagttcactgccattagaaggagaagaaatggcaaaggaataaaccaccaaacaaacagtgatgaaagcttggagaatgtagatatgtattttagatcacttcattttaggaaagttattaacagtagaacaaaacctccacaagtggtaacagcaatctcataattttaaaacatctcattttatcaggacaaagtaaaaaaggatcttgtgttatcttcatactttgttcaaaatgcctgctcccagtcaaaactggg

SEQ ID NO: 40599 - DNA, 601 bp, Human
tagaaggagaagaaatggcaaaggaataaaccaccaaacaaacagtgatgaaagcttggagaatgtagatatgtattttagatcacttcattttaggaaagttattaacagtagaacaaaacctccacaagtggtaacagcaatctcataattttaaaacatctcattttatcaggacaaagtaaaaaaggatcttgtgttatcttcatactttgttcaaaatgcctgctcccagtcaaaactgggattttgggcttcgtctatgtttataataatctcaaactcccctgttgccctttcyatacaggcaaaacgttttgctgtaaagataaaattaaatcattactaaggcttagaacatacaccagacaagttaaagtccttatttttacaattcagggtaaataaaatgaacttttaggataaagaaaagttttctcttcttaagttgaaatatccaaaagctgttttattatttatgtactcaggattattgttttgtaggcaaggtgattgtcttcgtgtttattattcacttgtggtaagttcaccttggactttttattttgggtaaacatcgcatacatcatcattaatcagg

SEQ ID NO: 40600 - DNA, 601 bp, Human
ccacaagtggtaacagcaatctcataattttaaaacatctcattttatcaggacaaagtaaaaaaggatcttgtgttatcttcatactttgttcaaaatgcctgctcccagtcaaaactgggattttgggcttcgtctatgtttataataatctcaaactcccctgttgccctttccatacaggcaaaacgttttgctgtaaagataaaattaaatcattactaaggcttagaacatacaccagacaagttaaagtccttatttttacaattcagggtaaataaaatgaacttttaggatraagaaaagttttctcttcttaagttgaaatatccaaaagctgttttattatttatgtactcaggattattgttttgtaggcaaggtgattgtcttcgtgtttattattcacttgtggtaagttcaccttggactttttattttgggtaaacatcgcatacatcatcattaatcaggctttggggttccttttccccattattcaatgtctctctgctcttggaagtcaaaccaatttaatatcagactgcaaaaactccatatacatacacacacaaacacacatgcatatagatacaca

SEQ ID NO: 40601 - DNA, 601 bp, Human
tatataaaatggaacttccaggtcctgagcccctagctctgatgtataatcagtacagtatggttaagtggatatactcagtatgggtaagtggttaagtggataatcagtacagtatggttaattggatatactctgaaaccatattcccagctcagattcttgctccacaacaaatttttgcctgtgcaaccctcatctatgttatctaactcacctgtgcctctgtttcttcaaaatagcgatagtaatagcatttaattcagaggataattgggaggaataaacaagataatatacrcaaagctctgagaacaatgcctggtaatagcaagtgctttatgtcattatattattattatcttaaaattattattgattctatgaaccagactgattcatattattgtgattttttttgagtacgacaagtctttgcatccagtttctgaagctgatagatttgcaatgactataagtcaatgtaataggccatgactaaagacaacctttgtagtaatagctaaaaatagttactatttgattgtgcatcttcttgtgccaggcacctcttaggcatttaaggcaaccaatgcagcta

SEQ ID NO: 40602 - DNA, 601 bp, Human
tctcatatcctcagatcccagccaggcaccttcaaaaccaatcccttatggactactgaattaaggacagcaagttacacctctgttcctgtcatctgggtgaagccaaaagtagtgacttttagagagagagtgtgggaccactgaggaagagggaaaaaagtgaatctaaattaatgcatatttcaaaagttatgtgaatctgcaagtatcatcctttgaaggaagaaactaacctgacaaatgcttcctggctccagttgaaaataatttgttttactatgtaattaatgagtctgcmtagttataaaataatcttaagtcttatatcaaatgttccttggaatttacataaaagcggactaaagatttcatttgaaaaaaaaaaaacagtaaattggttaaatgacttatggaatggccacttaatagactgacaaaaataaagtagcttagtgttactgtcatgaaagatacactaactgaaaacaaacaagttgaagctaaaagagtttgaataatttgatttcgtgtgtatgtatatatatgtatatttatatatgtatagaacatcacctctctctacaaggaatgttaagtg

SEQ ID NO: 40603 - DNA, 601 bp, Human
tgtcatctgggtgaagccaaaagtagtgacttttagagagagagtgtgggaccactgaggaagagggaaaaaagtgaatctaaattaatgcatatttcaaaagttatgtgaatctgcaagtatcatcctttgaaggaagaaactaacctgacaaatgcttcctggctccagttgaaaataatttgttttactatgtaattaatgagtctgcctagttataaaataatcttaagtcttatatcaaatgttccttggaatttacataaaagcggactaaagatttcatttgaaaaaaaaaaaacagtaaattggttaaatgacttatggaatggccacttaatagactgacaaaaataaagtagcttagtgttactgtcatgaaagatacactaactgaaaacaaacaagttgaagctaaaagagtttgaataatttgatttcgtgtgtatgtatatatatgtatatttatatatgtatagaacatcacctctctctacaaggaatgttaagtggtaccttaacaggctatagctgaagccattaaaatattaaggcctgattttttactaaatcattaaacaataatggtgcagataagtga

SEQ ID NO: 40604 - DNA, 601 bp, Human
ttggttaaatgacttatggaatggccacttaatagactgacaaaaataaagtagcttagtgttactgtcatgaaagatacactaactgaaaacaaacaagttgaagctaaaagagtttgaataatttgatttcgtgtgtatgtatatatatgtatatttatatatgtatagaacatcacctctctctacaaggaatgttaagtggtaccttaacaggctatagctgaagccattaaaatattaaggcctgattttttactaaatcattaaacaataatggtgcagataagtgaagagcaarctcaaaaacaacatgaataattcagtccagcaaattattcactgagcactaaagaacacagcctctgttctagatggctgggatacactgaacaaatcagccaaaggtccctgaccccttgaagctcacctagtgcaccaccatgctcaatcattgtagatgagtgtaaagaaaaattacatgtgtatacttctgagaatttagggatggtgataagccaggaatttaataattattcattctcctccacctttactagtcacatttttgggatgaggaaaaagatttaatcaatatgaa

SEQ ID NO: 40605 - DNA, 601 bp, Human
acttatggaatggccacttaatagactgacaaaaataaagtagcttagtgttactgtcatgaaagatacactaactgaaaacaaacaagttgaagctaaaagagtttgaataatttgatttcgtgtgtatgtatatatatgtatatttatatatgtatagaacatcacctctctctacaaggaatgttaagtggtaccttaacaggctatagctgaagccattaaaatattaaggcctgattttttactaaatcattaaacaataatggtgcagataagtgaagagcaagctcaaaaacawcatgaataattcagtccagcaaattattcactgagcactaaagaacacagcctctgttctagatggctgggatacactgaacaaatcagccaaaggtccctgaccccttgaagctcacctagtgcaccaccatgctcaatcattgtagatgagtgtaaagaaaaattacatgtgtatacttctgagaatttagggatggtgataagccaggaatttaataattattcattctcctccacctttactagtcacatttttgggatgaggaaaaagatttaatcaatatgaactctggtgaca

SEQ ID NO: 40606 - DNA, 601 bp, Human
ctggagtattctgttttaaaccaaatgagtcatccctttttccttccccttaaggtttccaaatgttgtgaagaagtaagagattacgttgaagaacgatctggcgaggatccactggtaaagggcatcccagaggacaaaaatcccttcaaggagctcaaaggaggctgtgtgatttcataatacaaacaaaaagaaaaaaaattaaacaaattcttggaaatatctcaaatgttaataacaatatgaatttttctcatgcatactattactactaagcatgtacgtgaatttttaaatktatagatgtaaacttttaataaaaattggggtgtggtaacccatcattctatgtttttcttaacatagctggcacagggtttaacacataattgccaataaatattgcttaaagttctttaaaaagaactatgttttataaatgattctatattattctgagttgtcagcatatatttactgttttatgttttctcacttccctttcaacacttacaattttctacccagaaattgtatggttaagtttctattttgtttcccaaactttctcttggttaaggaattaggaagcttattt

SEQ ID NO: 40607 - DNA, 601 bp, Human
agaaaaaaaattaaacaaattcttggaaatatctcaaatgttaataacaatatgaatttttctcatgcatactattactactaagcatgtacgtgaatttttaaatttatagatgtaaacttttaataaaaattggggtgtggtaacccatcattctatgtttttcttaacatagctggcacagggtttaacacataattgccaataaatattgcttaaagttctttaaaaagaactatgttttataaatgattctatattattctgagttgtcagcatatatttactgttttatgttttytcacttccctttcaacacttacaattttctacccagaaattgtatggttaagtttctattttgtttcccaaactttctcttggttaaggaattaggaagcttatttttctgatatgcagttcaactgtcttgtgacttttccccagaatgccaactgggttgagggttcagtctgtggtcacggagcacggtgaatttaaccagcagcagaatcacggttataagcatgcacttaggagccagacagttctggctctgccactttactgcccaactcactttggataagctacttaattc

SEQ ID NO: 40608 - DNA, 601 bp, Human
gcagttcaactgtcttgtgacttttccccagaatgccaactgggttgagggttcagtctgtggtcacggagcacggtgaatttaaccagcagcagaatcacggttataagcatgcacttaggagccagacagttctggctctgccactttactgcccaactcactttggataagctacttaattctttctaaatttgtttctcctagcataggatgaagacaataatggttatatcttctgttttgtgtaggggttaagtaatacactaatgcaactataacactcagcatattacctggyccatggtaagatacaataagtgttaactagtattattactgagaaaggatctagacaaaatttccaaaatcctttaagatacatgatgttttaccctatcctcataagactctcaacaccacagtcttttctttaacaaggtgagcacacatgagagagaaatctccatcacctacatcaggtccttctggcatcctattgagtttacatgagtcacatttcactaccattgtgttaatgactaagagaaaacttgcctctgcttctgtaacaaatgacaagttgtaattacctaaacca

SEQ ID NO: 40609 - DNA, 601 bp, Human
tattgacttaattcatgattaaatcaccagtaggggacaattcctgttgcttaaaacacagattgtcagcaggttttgagtaagagagaaatcacaggaaggaagtatagagaaagatggtccaggaagaaggaaatgaaatcatgactgtcccacaggctacagagctataactgtcagtgactttggtttgttcagaatttgttatttcaggactgggataactaggttaaagaaaatgaagtaagactacaaggcaacaaaaaccactcccacacaaccttaacatgtgactctttamcaaaattttctggtgtcattaatgagaatgagttattatagatactacaatatatcatttgagctacttggactttaaacatattttgcacacatagatgagtgtaagctttagtaagaaaaagaaaaaagaaaagaaaacacctcactgttgttttaatttgtactggttttattttagccaaattttaaaaccaagctaatatcaatcttcctaaattactaaaatatgagttaacatgaggaaaatagtaaactgagtaatgagaatgatcaattatgtatgatgggagttaaagtc

SEQ ID NO: 40610 - DNA, 601 bp, Human
acttggcattctcttcatctagaaaaggaatcttagggtcaggtgcagtggctcatgcctgtaatctcagcactttgggaggcctaaatgggaggatcacctgagatcagcagttcgagaccagcctggccaacatggtgaaccctgtctctaccaaaacaaaaacaaacttaaatatacaaaattagctgggcatggtggcgtgtgcctctaattccagctactcaggaggctgaggcaggagaatcacttgaacccagaaggtggaggatggaggttgcagtgagtggagatcacgccwtgtatatacttctgagaatttagggatgatgataagcctggaatttaataattattctcttccacctttacgagtcacatttttggaatgaggaaaaagatttaatcagtatgaaatctgatgacattcttgacttccgttgccagttgtgttctgattcctgggtcttgtctcctttgatgttggaggcagtgtctacggggaatctttagctggagcatggccagctgtttttcctttgtctggagatatatccagaaggagtgggaagggtgcaactttcttctttcctacaaagta

SEQ ID NO: 40611 - DNA, 601 bp, Human
ctacggggaatctttagctggagcatggccagctgtttttcctttgtctggagatatatccagaaggagtgggaagggtgcaactttcttctttcctacaaagtacgtatgcattggtggaaagcagagagaatcaaactgaaattatacgacctgaaaacttattgcagtaaataaattcttggcatctggagtattctgttttaaaccaaatgagtcatccgtttttccttccccttaaggtatccaaatgttgtgaagaagagattacgttgaagaatgatctggcaaggatccactrgtaaagggcatcccagaggacaaaaatcccttcaaagagctcaaaggaggctgtgtgatttcaaaataccaaaaaaaaaagaaaaaaaattaaacaaattcttggaaatatctcaaacgttaacaacaatatggatttttttcacacataatgctactactatgcatgtacatgaatttttaaatttatagatgtaaacttttaataaaaattggggtgtggtaacccatcattctatgtttttcttaacatagctggcacagggtttaacacataattgccaaaaaaatattgcttaaa

SEQ ID NO: 40612 - DNA, 601 bp, Human
ttttcctttgtctggagatatatccagaaggagtgggaagggtgcaactttcttctttcctacaaagtacgtatgcattggtggaaagcagagagaatcaaactgaaattatacgacctgaaaacttattgcagtaaataaattcttggcatctggagtattctgttttaaaccaaatgagtcatccgtttttccttccccttaaggtatccaaatgttgtgaagaagagattacgttgaagaatgatctggcaaggatccactggtaaagggcatcccagaggacaaaaatcccttcaargagctcaaaggaggctgtgtgatttcaaaataccaaaaaaaaaagaaaaaaaattaaacaaattcttggaaatatctcaaacgttaacaacaatatggatttttttcacacataatgctactactatgcatgtacatgaatttttaaatttatagatgtaaacttttaataaaaattggggtgtggtaacccatcattctatgtttttcttaacatagctggcacagggtttaacacataattgccaaaaaaatattgcttaaagttctttaaaaagaactatgttttataaatgattct

SEQ ID NO: 40613 - DNA, 601 bp, Human
agccaaatatataaagatgactgagtacttgtctaatgacttttctgtttttctactcagtgtgactgatccatatgaaatcactctctaagagctatagcaggttttgtgtggctgagtgttcgcataacccgacatgtatcatcagataggtggaaatgttcatctgtgtgtgagcatagctaattgcacgagtaaagggggaaccatgtggcttttgattaagaaatggaaaatgtaaaaactgttcagtgaatttgagaagctgcactattccctcattcccctcatataaactagwcttccaaaacaagcactgcccccttaaattaaaaaatattcatcctctctctccttgcctgtctccctcccctgacattatttatagaattatttgaacattgagctgcagggtgagttaattcccttgtaacaaacggaaagtgttcagagtcagacaaaattttaaattagtgaaaagtagatatatattttttaaaaacacaaatctttcttgagaatgatacctttgggtttaaaataataatgtggtatctgttggcacactggcacctctcctctcattattgacagaccttta

SEQ ID NO: 40614 - DNA, 601 bp, Human
gagcatgttagagataacgttttcttctttatacaaagaaaaatgggatatatatttcccttacctcttccctcttcctccttgcaaaccatctaccacaagttctacaagttatattgactataaatttccctttcccttgcttttcagactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggtaagtyaggagaagaacatctgccttgtctcttttgttgtcaagctgaatgaagtgagattattgtggtttttctagcaagtgtccttttactttatgtttaatttaaattttctctcttactccaaataagcaaaattaacatttttactaaataataccaaatgaaaggtgaggggaaacaaaatatctatcaaagtatctatgagggttagcatttacctttctgaatctttattacttttcctttatgtagagatatagattaataaaggaatgtttatattttaggcaacaaaatataaaa

SEQ ID NO: 40615 - DNA, 601 bp, Human
taagactagttttgccaatttaaaatgtaacattttaaagttttaaaattagtaaataaagcaaaaaaatcccaaatttgaaaaactgacagtaaaggaagaaaaaaaaccatatttcttcataagagttatcatacctatcataaggtttgattttaagtttttgttgtgtatttaatatccactttgaagaaattcatttagtgattgcattacagatctgaagaagtggaaatttatgttgttataaaatgttgtttctaaaaaaggcatcgtgctattgcatgtttaattttatgcrgaaatgcattaattcattactgtttcatttataaactatttcctaaagtgaaaatacataactacatgtcaaaagaaaaagtttaatttaccaataaataatctttaatacatattgtaagcatggcctactaaattgaaatgtttattgtataattattaatatatatgtaaactatatttttatatatagtttatgaatatttaaacctaaaacttgaaaatccagaaaacttttacatgagctaacctaagtttgtggcatctctttctaaataactcaaatgaagaatcagtagtt

SEQ ID NO: 40616 - DNA, 601 bp, Human
aaatacataactacatgtcaaaagaaaaagtttaatttaccaataaataatctttaatacatattgtaagcatggcctactaaattgaaatgtttattgtataattattaatatatatgtaaactatatttttatatatagtttatgaatatttaaacctaaaacttgaaaatccagaaaacttttacatgagctaacctaagtttgtggcatctctttctaaataactcaaatgaagaatcagtagttatatttttcctttcctacattttcttacattttgggtccaagggttttttggttttttttttttttttcccttaggcttactctacccttagaagacattattgtagttctttcaaaataacagaagtgaatgaaaaagcccgtcatatggcacaaggttattttataagtagtgttgagtaatacaagtcacccaggcaaaactgctagtcgtctgttaataattagtagtctggagggagttatcctcataataaacatctgaccatagcaagactttcgttttaaaagtttcatatctctttgacaaagaaaacattctttttttctacttatattttaaaaaaatatt

SEQ ID NO: 40617 - DNA, 601 bp, Human
tgtaatatatacattactagctggttgttcatttcagtatcgggtggagattttctttaaactagcccacttttatagaatattttaattatcatgggttgagtgtttaaagtgtgacatttgttataacttttacaatgaaaattttcaaaccttcaaggatgttatgtgacaagtctgttgaggatgattttaatattgatcttggacagttacagtttatgtatcttgtaatatttaatttttctgtgttcttctgtagaggtccttctgtagtgccatggtagaagaattgaggatrtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatt

SEQ ID NO: 40618 - DNA, 601 bp, Human
ggagctagtccgtcggagggagccacggggctctgactcatccgtcgggccggaaccgaaccccaagccccagggagaaagccccggagcaggcgcccttctcagggattgtaggcttagtcacacggcgggggcgccctcggaggcaccggacctcagctctctggacttcccgggaacctggctccccgcgcgtggtcccgggatttagtcgggcgctccccacctctggcagctgcggccccggactccgccagcgctgtcttctctccctcaggtccagccgccgcagggaatgacrccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccaggtttgtggggttcctgctgggaagggctgtagggggattcctgttcctcgccaggaatgatggaacgcccagctggacgaaaggggctgtggacgatcgggagaaacattatccctcacg

SEQ ID NO: 40619 - DNA, 601 bp, Human
tcggagggagccacggggctctgactcatccgtcgggccggaaccgaaccccaagccccagggagaaagccccggagcaggcgcccttctcagggattgtaggcttagtcacacggcgggggcgccctcggaggcaccggacctcagctctctggacttcccgggaacctggctccccgcgcgtggtcccgggatttagtcgggcgctccccacctctggcagctgcggccccggactccgccagcgctgtcttctctccctcaggtccagccgccgcagggaatgacgccggtgctcctrcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccaggtttgtggggttcctgctgggaagggctgtagggggattcctgttcctcgccaggaatgatggaacgcccagctggacgaaaggggctgtggacgatcgggagaaacattatccctcacgaggccagaagcc

SEQ ID NO: 40620 - DNA, 601 bp, Human
gacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtataygtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctgg

SEQ ID NO: 40621 - DNA, 601 bp, Human
cgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgccgccttccccaaccgytcggctccccttgtgccgtgccgcggcggctggcgctacgcccaggcccactccaccatcgtcagcgaggtaagggcgccccggccctttggaagccggcgggagaggacgatgctggctcccaggcggacaagccgcgtgtgagacgctggccgccaggggaggtcggtggagacggggaccggtcggctacctctggggacagacaggattcagcgcacccttggaagtgccgcgtcgtaaatgctgggaaaagcctttcgttatctgcctgagcccgtgagttaatgcacagatact

SEQ ID NO: 40622 - DNA, 601 bp, Human
tctctcgccctctccacagctgtcctttgcatgtgagtttctgctggatcctttcatgtgtgatgccctttcccctttttcttctttttatcgatgtccttttctcctgttctacttctagccctttcaagcttcatctttcctttcctaatttcccccacatgccactctttttttgctggctacaatttggaactgtgcagtttaaatatttatttattttgttttgtttttactctttctaatttggatattaggttttgcttcatctgtgttttttttctcttactcagtcaataamcatatctccaaactaaattaacgttactaaagtggggaatttccccttcctatattctcataagtgattgagcatctgtcctcatataggacttgctgccttggaggggaggggccagacctgggaaaaagaggagccatgaataactctgcttcctacatttggcttcttctcttcctccatatccatgatttatatatgtgaaggaagaacaagaaataacttaataggccatttgtcaatgagagtacagtgtaggaagggtggaaagtgaatataaaatctagattggggcttctg

SEQ ID NO: 40623 - DNA, 601 bp, Human
gaagaacaagaaataacttaataggccatttgtcaatgagagtacagtgtaggaagggtggaaagtgaatataaaatctagattggggcttctggtttcctgttcagcctataaggagcttagaatttgccactcagtcttgacaacaagtaaaatgctgaacaaactgaaaaatcaataattcttctcagatccataagagaagtgagattacagggcaaactactaccttcagcatcaccccgcacccccaaccccactaaatagaaagacaggagaatacagagaatcataacacagrcgcagaaacctccttgagagagccagggtagataaacatgaactgtaattgatgaattcctggaggatcactgtggatgacctgaaggattaaaaactctagagggactcactcaaaggagggcccaagcttttgtgatttttttttttttttttttttttttgccacctgaagctctacaaggttccaaaggtgaatattaaggaaaatccctcatgctctggcagccagaggggaaaaggaacaattttgaaatatgccagaatatcgttcttaacaatgtctgccctcaggagaaga

SEQ ID NO: 40624 - DNA, 601 bp, Human
cagaactaaattcagatatggcagggatgttggaatgatcaggctaagaatgtaaaacaactatgccaagaagtctgatgcataaagtagcatgcaagaacagttgggctatgtaagtagagagatggaaattctaaaaaaagaaaccaaatgaaatgctagagatcaaaaacactgtaacagaaatgaaaaacgttgttactgggcttattaggagattgggcatagctgaggaaagaatctctggccttgaggatatcccagtagaaacctccaaaactgaaaaaaaaaaaaaaaaaaacccacacacacaataacaaccacctgaaaaagcagaacagaatgttcaataactgtgggacaattacaaaagatataatatatgtgtaataggaataccaaaaggagaataaagagagcgagaaatagaaaaaatattttaaacaataatgactgagaatttttcaaaattaatggcagacaccacagatccaggaaactcaaaggaaatcaagcaagataaacataaaaaagtatacctagttatatcgtagtcaaactacagaaagccaaagataaaggaaaaattctgaaagaagag

SEQ ID NO: 40625 - DNA, 601 bp, Human
gataaaaattacaccctacttcttttcagaaaccaggtaagcaagaagaaagtggaatacttaaagtgtcaagaaaaaaaatccaatctagaattctatactgtgcaaagttatcatttaaaagtgaaggagaaataaagactttgttagacaaaaattgagggaatttgatgccttgtaataaatgttaaaagaaattatttagagagaatgaaaatgatctaggttagaaatccagatctacataaaggaaaggcattggagaggaataagcaattgagaatatgtttcttattctcarttgatctaacagataatagtttattcaaaataatagcaacaatgtgtttggttgtgtatgtttatatatataagcatacataagcatatatagagtattttttgttataaggtactcatactactcatgaagtgatacagtgttatttgaaagtggatttgaattagttataaatgtatattgtaaactctaaagcaactactaaaaaaagattttttttaaaaaagcatgactgatatgctaaaatgaagaaaatgtggaatcctataaactgctgttcaatgaaaccacaaaagccag

SEQ ID NO: 40626 - DNA, 601 bp, Human
gaaaggcattggagaggaataagcaattgagaatatgtttcttattctcaattgatctaacagataatagtttattcaaaataatagcaacaatgtgtttggttgtgtatgtttatatatataagcatacataagcatatatagagtattttttgttataaggtactcatactactcatgaagtgatacagtgttatttgaaagtggatttgaattagttataaatgtatattgtaaactctaaagcaactactaaaaaaagattttttttaaaaaagcatgactgatatgctaaaatgargaaaatgtggaatcctataaactgctgttcaatgaaaccacaaaagccaggaaaaagtgtggaatacaaacataagaataaaaaataagggaaacaaatagaagatgataacaaatacggtagacattaatccaaccatgccaatactcactttaaatgtaagatggtctaaatgagccaactaaaagacagagattttcacagtggatcaacaaacaagacccaaccatatatgttgtctacaagaaatccactttcaatatacagacacatatacactaatagtaaatggatggagaa

SEQ ID NO: 40627 - DNA, 601 bp, Human
aaataaattgaatcaatagttaattacttttcaaaacaggaagcaccaggcccagatgggttcacaggtgaatttgccaaacgtttagagaagaaactctaccaattccctaaaagctctttccaaagatagaagtagagggattgctttctaacttattctgagaccagcattactttaatacctaaattggacagacattacaacaaaagaaaactacagactaatatatttcatgaacataagtgcaaaaatcctcaacaaaaatttgcaagtagaatccaatagtgtataaaaaaaattatacaccacaaccaaatactgtagcataccaagtgtgtagtatcccaagtatgtaaaactggttcagcattctaaagtcaattaatgtcatccatcacatcgacaaactaaggaagaaaaaatgacatgatcatatcaatagatacagacaaagtatttgtcaaaatccaacatctatatatgacaaaagctctcagtaaactagaaatataggggaacttcctcaacttgataaggaatgtctattaaaaaaactacagttaacatcatacttaatgacgataaactgtacagaagc

SEQ ID NO: 40628 - DNA, 601 bp, Human
gacaaactagttctaaagtttatatgtagagacaaaagacccagaatagccaacgcagtactgaaggagaagaacaaagccagaggactggcactacttaacgtcaagacttaccgtaaagcgacagtaatcacgacagtgtggtatttgtgaaagaatagacctctaccaatagttcagtggaataaaatagagggcctagaaatagacccacataaatatagtcaactgacctttgacaaagcagaaaacaaaaggtactggaacaactggacaaccacatgcaaaaaaaaaaaaaaaatgaatctagacacagaccttacaccctttaaaaaaaatggatcacagacctaaatgtaaaatacaaaactgtaaaactcctagaggatgggataggaaaaaaatctagatgaccttttagatacaacaccaaaagcataatccatgaaaaaaagaactgataagctggacttcattaaaattgaaattttcttgttgtgagagagacattatcaagagaacaaatgaaatgacaagacacagactgggagaaaatattaacaaaaggcaaatatttgataaagaactgttatccaaaata

SEQ ID NO: 40629 - DNA, 601 bp, Human
cacgacagtgtggtatttgtgaaagaatagacctctaccaatagttcagtggaataaaatagagggcctagaaatagacccacataaatatagtcaactgacctttgacaaagcagaaaacaaaaggtactggaacaactggacaaccacatgcaaaaaaaaaaaaaaaatgaatctagacacagaccttacaccctttaaaaaaaatggatcacagacctaaatgtaaaatacaaaactgtaaaactcctagaggatgggataggaaaaaaatctagatgaccttttagatacaacaccraaagcataatccatgaaaaaaagaactgataagctggacttcattaaaattgaaattttcttgttgtgagagagacattatcaagagaacaaatgaaatgacaagacacagactgggagaaaatattaacaaaaggcaaatatttgataaagaactgttatccaaaatatataaagaactcttaaaacacaacaataagaaaataaacaacccaactaaaaagcgggccaaagatcttaacagatagctcaccaaagagagtatacagatgataataagcatatgaaatgatgctctacg

SEQ ID NO: 40630 - DNA, 601 bp, Human
ggaataaaatagagggcctagaaatagacccacataaatatagtcaactgacctttgacaaagcagaaaacaaaaggtactggaacaactggacaaccacatgcaaaaaaaaaaaaaaaatgaatctagacacagaccttacaccctttaaaaaaaatggatcacagacctaaatgtaaaatacaaaactgtaaaactcctagaggatgggataggaaaaaaatctagatgaccttttagatacaacaccaaaagcataatccatgaaaaaaagaactgataagctggacttcattaaaaytgaaattttcttgttgtgagagagacattatcaagagaacaaatgaaatgacaagacacagactgggagaaaatattaacaaaaggcaaatatttgataaagaactgttatccaaaatatataaagaactcttaaaacacaacaataagaaaataaacaacccaactaaaaagcgggccaaagatcttaacagatagctcaccaaagagagtatacagatgataataagcatatgaaatgatgctctacgtcatatatcatcagggaaatgcccattaaaacagcagtgagataccacta

SEQ ID NO: 40631 - DNA, 601 bp, Human
taccagacaataatttgacaccactatgctgaaccaattcacaccagtctctcagaatgttgtgcatgttaccttgttccttttcctaaactatttaataacacatatgccaatggtgaaaataaaatacaaaatttaagaacaactgacattggctgtgaactttgtagtttataaaacactttcacattaacatctcatttgatcctctctacaacctccctctagaaaaaggtgggaataaacaaaaacaagcaagcaaaaccttcgttttgaagaccttaggaattagcccaaggtyttatgactggtagatggttgaggtgagattcaaggcaaggccttctggccataacacaccattccttcttctttctgcctctctgtccttatgacttgacacataaaaaatgctagaaagtgtcacatctgtaccaccggggagactctgtgtgaaacaatagtttcaaggagggtcatcttttcagaaactgcaatcacaaaggatgcattctgtactttaaattttgtaattccagcctaggcaacatagggacaccctgtctctacaaaacatctttaaaataaaatgatataatgt

SEQ ID NO: 40632 - DNA, 601 bp, Human
taataacacatatgccaatggtgaaaataaaatacaaaatttaagaacaactgacattggctgtgaactttgtagtttataaaacactttcacattaacatctcatttgatcctctctacaacctccctctagaaaaaggtgggaataaacaaaaacaagcaagcaaaaccttcgttttgaagaccttaggaattagcccaaggtcttatgactggtagatggttgaggtgagattcaaggcaaggccttctggccataacacaccattccttcttctttctgcctctctgtccttatgayttgacacataaaaaatgctagaaagtgtcacatctgtaccaccggggagactctgtgtgaaacaatagtttcaaggagggtcatcttttcagaaactgcaatcacaaaggatgcattctgtactttaaattttgtaattccagcctaggcaacatagggacaccctgtctctacaaaacatctttaaaataaaatgatataatgtaatacagtataatatggtatgatataatattttatgttatattttcccattgtgttgaagaaaatgtttaaggtgagctcttttcctgtctttct

SEQ ID NO: 40633 - DNA, 601 bp, Human
tgtagtttataaaacactttcacattaacatctcatttgatcctctctacaacctccctctagaaaaaggtgggaataaacaaaaacaagcaagcaaaaccttcgttttgaagaccttaggaattagcccaaggtcttatgactggtagatggttgaggtgagattcaaggcaaggccttctggccataacacaccattccttcttctttctgcctctctgtccttatgacttgacacataaaaaatgctagaaagtgtcacatctgtaccaccggggagactctgtgtgaaacaatagtktcaaggagggtcatcttttcagaaactgcaatcacaaaggatgcattctgtactttaaattttgtaattccagcctaggcaacatagggacaccctgtctctacaaaacatctttaaaataaaatgatataatgtaatacagtataatatggtatgatataatattttatgttatattttcccattgtgttgaagaaaatgtttaaggtgagctcttttcctgtctttctcaaaaaggtatggcaggatcgtcatttacttgctatcctgccttggtgttggcgtcactggggttgtggt

SEQ ID NO: 40634 - DNA, 601 bp, Human
atactcatttgggtatatacccagtaatgggatggctgggtcaaatggtatttctagttctagatccctgaggaatcgccacactgacttccacaatggttgaactagtttacagtcccaccaacagtgttttcaaacatctctaaaatggctacatgctttgagaatttttagagaattttaggatttaaagagagtatttgttgatgattttattaataattgtgaagaaaaatgaattaataaaataccagaacgcaaaattttaagtagggtactgcattatgttttgttttgtaayaaatagcttcatgaaaactataaagtaaccaaccatatctgccagtatttcaacatgcaaattaaatgcaatgaagtctatttgtttctctgtgtgttctataaagcaaatgaatattactcagaaattctctgaggaataaggaaatgttaagagcatcaaaaaattacattatcaaaaagcaacagaaaagcatttgatttttgttgttgctgttttgagatggagtctcactctgttgcccaggctggagtgcagtggtgcgatctcggctcactgcaacctctgcctctcagattc

SEQ ID NO: 40635 - DNA, 601 bp, Human
aagcaaagcctaaataacacatgttgacaaaccttctgctccagagcagacagtggcccagcacatcagcacaaccctggcctcctcactgcctgatataaccgttaacgtgacagctacaagggttctcatgtgggaaaaacatcaagtgcaccaggatgtccttggccagtttgcagtcaaaatatgtaaacttcagactcccagaaatggtttggattcttgagccatcttttccttacacctgtgctcctgggcaattgttttatttaatgaattttagctttttttttttttttttgacttggctattctctagagagaacacacagaagtctactgggcttgattctcttctttcatcctcctcattcatttctactaaaaaattatatattcaggaaggttcaataattcccctaggaaacaggaggactatttagtgctaaatgaacatatgtgttggatataaagggaaaatgaaaggcacatgaacactggacatgcttcgttttgctttggagagcagatatggtcttgttcatgcagacatatgtcctcaataccaaatcccctaggaaaggatgacatcaattgcaca

SEQ ID NO: 40636 - DNA, 601 bp, Human
tttgccttagtggtaacacacagaatagatgtccccttccaaagatcctggtcctcaaagcttgctccactctagaaaccaaggtcagctcacgtgaggagctccccaggtgtgctgggaacggctattccttgtgtcaccaccgcaaggtatgcacagaaaggacagctgggcaccagctgtgggaacgtggtggctcaaaggcatgactggaaactaccacctggacaaaaagccagtgtgctttggctctctaggaggtcattgcctggaacaatgttccaatgtagtggctgctcaygctcaacaaacggttcttgaattgtacttcctataatccaacctgctcagaaaggcatctagcgctctaaaatattagctatcatctagtttcattgttgttgaaatttggttacattattagaaagttctatcatttgtgcttaaaattggcaaagacttcagactggaggccactaagcaaatactttttgttgttctgtaaaatgttaatgaaatcagacccctaactcctccctttcaaactttctgtgtttgcaggaatagcatggttgaggaccacagtggctacattgggaag

SEQ ID NO: 40637 - DNA, 601 bp, Human
gccactaagcaaatactttttgttgttctgtaaaatgttaatgaaatcagacccctaactcctccctttcaaactttctgtgtttgcaggaatagcatggttgaggaccacagtggctacattgggaagactagggataaccatggcctttgaaattgtttatttggtaaattcagaattgtacccaacaacattacggtaattctaacaaacgttatagtttctcctaagtaactctgtagaccagcgttttaagttgatttagttaaaaactatgaagtcgtttccttagctcagtgayatattagcctaggctgaatccagctagtaaagaagatatgctttgagttatcactgctttctgcattgctgcctgctgcattttgtgataaaagtatttctcatattaatatcttcacacactgttacggttttgaggaaaggcccttaacttgaaaccagaagacctctaggtgcccttgcttagactgtgggttaaatctgtatccatcagcatcacctgctgcaagactatggcctctctttgactgcattacatgcattgcagtggtgagcagctggttatgaaggatgaaatgaa

SEQ ID NO: 40638 - DNA, 601 bp, Human
ctggagacttcctcactagccttactgtgaaacgtgcagaatggaaatgttttgcttagagttctgagagtagtcgttttcaaagttagaaaatgcaaagtatcttcacacttcctttggttttttaatatgtctgaatatgttgattatcttgaagtcacttgttgaaatagttttcacttaaaattacttttcattcaacagaaatttcggagtttcgctctgttcaggtctgtgtgattttgggggaatcatagccccatttctgctctttcggctagcagccgtgtggctagaactrcctctgatcatctttggtaagaactcatttgctattcttaagagccttcatctacattctttgtactaaaagagacctataataattgttaggttcaataatgataatgatagtcatttatcttattataataactatttcattgataattatgatattaatttcatcttattataataactatttcagttttgagagccaattcagttataatgaatggttttaatttactttatattaaagggtgctgataaataatgttcaattagcattctttgggttctgagttaaatgctatga

SEQ ID NO: 40639 - DNA, 601 bp, Human
aggctgcagtgagctatggtcacgccattgcactccagcctgggcaacagggtaagaacctatctctaaaataaataaataataaaaaataacaaaaataagcctaatgtctaattgtatttctggtgttctctctctatggatatcatatcttcattggcccgatgctaaaaatccatgtggagggagcaggtgacacaggatcccgggcacacattccatcacctcctccaggtccctcgagtgcacctctcctcctacctccagcttccataggacttgtgaaggaacagaatcatastctaggagggaccttggggaattcagtgtcccacttctccagggctgctccaacggtcctgcctgggtttcacacacttcccctgtgccctcttctgcagtaaaggatacgggttggcccctttctcacgcaaccgtttctctatctccacttccttacttctggtagagaatgtttttcatttatggttcagcagttgaaatttgaatgaaaatactgagcccatgaggacagaccttctgcttcatgcaaaagtcctttgacagtgtgagggacaaagagtcggcttctaccacttga

SEQ ID NO: 40640 - DNA, 601 bp, Human
attgcactccagcctgggcaacagggtaagaacctatctctaaaataaataaataataaaaaataacaaaaataagcctaatgtctaattgtatttctggtgttctctctctatggatatcatatcttcattggcccgatgctaaaaatccatgtggagggagcaggtgacacaggatcccgggcacacattccatcacctcctccaggtccctcgagtgcacctctcctcctacctccagcttccataggacttgtgaaggaacagaatcatactctaggagggaccttggggaattcastgtcccacttctccagggctgctccaacggtcctgcctgggtttcacacacttcccctgtgccctcttctgcagtaaaggatacgggttggcccctttctcacgcaaccgtttctctatctccacttccttacttctggtagagaatgtttttcatttatggttcagcagttgaaatttgaatgaaaatactgagcccatgaggacagaccttctgcttcatgcaaaagtcctttgacagtgtgagggacaaagagtcggcttctaccacttgacaccagtgacctcaatacaggatcac

SEQ ID NO: 40641 - DNA, 601 bp, Human
ggctctgtgtccgctgtgcataatttgaggcacctggaagagttcaagtggaaatagaaaccagcaggctcaacaccgctgagctcaggagggaagagtggccttgggatgaagagctggaagccacctggcagtagagaatggttgaagctgagggagtggcccaagccccccagaaaatcaggacaaagcaagaggaaagcaggaggcctaggacagagacctgaggggtggcaaagtgacagacctaggcagaaggagaggaggtggccaaggaagtggaaaccaagtgagaagcccraggcaggagggcacgagaccaggtccaacctaaggactgaaagtagcacatgtggatctggtggccagcaagaggcagaaggaacctgactggagcagagccagggagaatataggctgagtctggaggagggcaggcagaggcaggacctggagcatggtcctatgctggtgctggcacctcccactcaccagggccaactgctaccatattagttcgtttgccactgctataaataactgcccaagactgggtaatttataaagaaaagaggtttaattgactcacagtttcacatga

SEQ ID NO: 40642 - DNA, 601 bp, Human
tgtaagaacagggagtaggtacaaagatcacatgcttcaaagggcaaaaaggagaacaaagatcacaaggcaaagggcaaaaacaaacatcacaagacaaagagcaaaagcagaatgactgaaaagggtctatgttcagcggtgcatgtattgtcttgataaacatcttaaacaacagaaaacagggttctagagcagagaactggtctgacctcaaatttaccagggcggggtttcccaatcctagtaagcctgagggtactgcaggaggccagggtgtatttcagtccttatctcaacygcataaggcagactctcccagtgcgactgtttatagacctccccctaggaacgcattcctttcccagggtcttaattattaatattccttgctaggaaaagacttcagcaatatcttccctacttgcacatccatttataggctctctgcaagaagaaaaatatggctgtattctgcccgatcccacaagcagtcagaccttatggttgtcttctcttgttccctgaaaatcgctgttactctgttctatttcaaggtgcactgatttcatattgttcaaacacacatgttttataatca

SEQ ID NO: 40643 - DNA, 601 bp, Human
ttttcttgtgttccctgtggtctctgacccattaggctaaagagagacaagagaagcccccaacctgattctcatgacagctccatcaagaatgtgggatgtgccgaccaaggatttgagaaagttgtacagaaatgtgttcatcaaatctggtcaagggactaagctcctagctgaccattcattctgaagattgcatggaggatgaacatctgggaatcctgttaatgagaaggctgaatcacaggcacctgggccaaagggtgtgagcattcatgttctctgctcaccttggtttccrcacaccttcgcaatgtgaacaggtcaggagtccctcccgtccacctcctctgtaacagctggggttccaggcatggtttaggccctgttccagcaataagaaccaatctgctgtacaatctgaggacttggctctgttatttacaaaatgatgctgtggttctgagattatttgggacatttttggctctcctttagtggacacctagagccacagattcccttctttactaaacaaatcccatggattctgatttctgggtcttaggattttaaaagtgaagggatatttttcttatat

SEQ ID NO: 40644 - DNA, 601 bp, Human
atgtgttcatcaaatctggtcaagggactaagctcctagctgaccattcattctgaagattgcatggaggatgaacatctgggaatcctgttaatgagaaggctgaatcacaggcacctgggccaaagggtgtgagcattcatgttctctgctcaccttggtttccgcacaccttcgcaatgtgaacaggtcaggagtccctcccgtccacctcctctgtaacagctggggttccaggcatggtttaggccctgttccagcaataagaaccaatctgctgtacaatctgaggacttggctstgttatttacaaaatgatgctgtggttctgagattatttgggacatttttggctctcctttagtggacacctagagccacagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccat

SEQ ID NO: 40645 - DNA, 601 bp, Human
aaatcaattaatttaggctgggcgcagtggctcatgcctgtaaatcccagcactttgagaggctgaagcgggtggatcatgaggtcaagagatcgagaccatcctggctaacacggtgaaaccccatttctactaaaaatacaaaaaaaaaaaaccccaaaaaacaaaaaaacaaaaacaaacaaacaaaccaaaaaaacacaacaactagccaggcgtagtggcaggcgcttgtaatcccagctagtcgggaggctgaggcaggaggagaatggagtgaacccaggaggcagagcttgcmgtgagctgagatcgcgccacagcactccagcctgggcaacagagcgagactccatctcaggaaaaaaaaaattaattaattaaaaaaacagtaagataaataacacttctcccatttcagtaaaaggatgaagccagtttctcaatgaataaaaacaagagactgttgaatgtcaagttttatagacagtccagacaacacagggagacaccatctctacacacacacacacacacacacacacacacacacacacacacacacacaaaatagctgcgtatggtggcatgggcctgtagt

SEQ ID NO: 40646 - DNA, 601 bp, Human
taaaaattaaaaagaagccgggtgcagtggctcacacctgtaatcccagcactttgagaggctggggtgggtggatcacctgaggtcagtagttcaaaaccagcctggccaacatagtgaaaccccatctctactaaaaatacaaaattaggcgtggtggcaggcgcctgtaatcccagctactagggatgctgaggcaggagaatcgcttgaacccggaaggcagaggttgcagtgagccaaaatcgcaccactgcactccagcctgggcaacaagagcaaaactctgtctcaaaaaaawaaaaataaaaataaaaacaaaaaagaaatccagtttacctccttgtgcaattcctaataaattgctgagaagtgatcttacataggaatcttgtataatttattctgatgctcataatccagaagaatatagggttgtgataaaggcattttcaactcaacagtcatttcagccttctcaccctgtggtccacctctagaaataacttcagtgaattgttgcattcagagaatttctaaaaataagttaagtagtaccagattaataaactataaattagacaacaaactttcaaaaacc

SEQ ID NO: 40647 - DNA, 601 bp, Human
gaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgayacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaag

SEQ ID NO: 40648 - DNA, 601 bp, Human
agaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttattttt

SEQ ID NO: 40649 - DNA, 601 bp, Human
aagagcctgactctatctctacctgtttttttttctttttccccagtaagaggagtgttaaacatataccatcacacttgtagtttcatgttttcatgtgtacaggaagggcaatgacaatggcaatgaggtcatcctcattgtcaatgcaatatggatttagaataccagctagtgattccaactttgtccattgtgataaaccagtgagattaattcaagtaagtaaaattaatgagagggaaatggtgctatttttccatagattcatgtgttgaaacagcatcctgcagtgaaaagagtatgagacttcagatccgaaaaccagcctgaacctggcaatgtcccttatggcacatggccttgggaaagtcgcttagctactgtgactgtttccttaaatgtacaatggctatgaaaacaatacggggttgcctaagattgttttgtgagtagttagattaattatgtgaaaggagtttataaatggtaagctgtgaaagcaccacacacatttttattattattaagtacctaaatttagtcagtataacagtttaagaaatctccagaaatttgtctttaaaaaaaatcccttaga

SEQ ID NO: 40650 - DNA, 601 bp, Human
gccattccaaatgggagagactggccaaaacagaggggcaacaggccccatgcaagtctgaaattcaaccgggcagtcaaatcttaaagcttaaaatgatcaactttgactccatgtctcaaattcaggtcgtgctgatacaagagatgggttcccatggtcttgggcagctccacccttgtggcttcgcagggtatagcccctctcctggctgcttccacaggctggcattgagtgtctgtggattttccaggtgcacagtgcaagctgtcggtggaactaccattctggggtctgaagracagtggccctcttctcacagcttcaataggtggtgccccaggagggactctgagtgggggctctaacctcacatttcccttctgcactgccctagcagaggttctccatgagggccctgcccctgtagtgaacttctgcctgggcatccaggcatttcccatacatcctctgaaatcaaggtggaggttcccaaactttgatgcttgacttccatgtacctgcaggctcaacaccatgtggaagtttccaaggattaaggcttgaaccctctgaagcaatagctcaagctataccttgg

SEQ ID NO: 40651 - DNA, 601 bp, Human
tcattccaccactggcccctgccaaatctcatgtcctcacatttcaaaaccaactgtgccttcccaagagtccctccaaagtctgaactcatttcagcattaactcaaaagtccacagtccaaagtctcacctgagacaaagcaagtcccttctgcctatgagcctgtaaaatccaaagtaagctagttacttcctaggtacaatggggatacaaacattgggtaaatacagccattccaaatgggagagactggccaaaacagaggggcaacaggccccatgcaagtctgaaattcaacygggcagtcaaatcttaaagcttaaaatgatcaactttgactccatgtctcaaattcaggtcgtgctgatacaagagatgggttcccatggtcttgggcagctccacccttgtggcttcgcagggtatagcccctctcctggctgcttccacaggctggcattgagtgtctgtggattttccaggtgcacagtgcaagctgtcggtggaactaccattctggggtctgaaggacagtggccctcttctcacagcttcaataggtggtgccccaggagggactctgagtgggggctctaacc

SEQ ID NO: 40652 - DNA, 601 bp, Human
gccagtttttggaagagttggtcacaggcatttctccactagcagcagggtcaaaaggaggacgatgcaggcataagtctgaaaaatagagataatagtaaatagaacttaagagagagcttgccccttcttatctaggaaaaatgagagagagagggaaggagggacagatggatggacagaggaagggatggatgtggaacattctaaaagggcatggcatctgaaataagtaggaaacaagccaagtaaacatttagccaagctaaaatggccagtcttaagtgaaatggctgcaacytaagcaaaactttggaaatattatcagcaatttgttaaactggcagtctggatattcaacttttggaatgagtttcacagcaattggtccacacccatactaatccctatccacaaccaacagccacagcaagctaatgaagtccccaaagctatgcctatggtatgtaggtgtatcctgcaccagagaatccaaaggaggagcagatggggacagaaacccagcctcagtgccccccaccacaggagaggtcctagctggagctgactgtgctctggagtgcaagagaatttttgtaaa

SEQ ID NO: 40653 - DNA, 601 bp, Human
atagttttagccaaagtccacatggatttcttcattggctctgtgtcaactcactgaaagaaagttcgccaaaacctctcaaatagcttaagccagtttttggaagagttggtcacaggcatttctccactagcagcagggtcaaaaggaggacgatgcaggcataagtctgaaaaatagagataatagtaaatagaacttaagagagagcttgccccttcttatctaggaaaaatgagagagagagggaaggagggacagatggatggacagaggaagggatggatgtggaacattctaraagggcatggcatctgaaataagtaggaaacaagccaagtaaacatttagccaagctaaaatggccagtcttaagtgaaatggctgcaacctaagcaaaactttggaaatattatcagcaatttgttaaactggcagtctggatattcaacttttggaatgagtttcacagcaattggtccacacccatactaatccctatccacaaccaacagccacagcaagctaatgaagtccccaaagctatgcctatggtatgtaggtgtatcctgcaccagagaatccaaaggaggagcagatg

SEQ ID NO: 40654 - DNA, 601 bp, Human
ggtgggataaaaagagaactactaaatcctcacctcagaagggacagttaaaaaaaattaccaaacagcacttagtggttagtagcatgtgatgtataaatacaaatgcagaatcagaaaaaacagttaatatatcataacaacgctgaagaaatgaaagtatgggagagactttgaaaatggaactattggccaggtgcagcggctcacgcctataatcccagcactttgggaagccgaggcgggtggataacctgaggtcaggagttcgagaccagcctgagcaacatggagaaacccygtctctactaaaaatacaaaattagctgggcatggtggcacatgtctgtaatcccaactactcgggaggctgaggcaggagaatcacttgaaccttggaaatagagattgcagtgagccaagattgtgccactgcactccagcctgggggacagagtgagactccatctcaaaaaaaaaaaaaagaaaaagaaaagaaaatggaattattgggttttatttaaagccctgtcattctttttcacttttaagttcaggggtgcatgtgcaggtttgttacacaagcggttggttgtacaga

SEQ ID NO: 40655 - DNA, 601 bp, Human
cagaagtctcttgacattgagaaacactaaaacgtagtataagggttgtggtgcagcatcccctgattgatcagacttctgaagacaaaggcatcatgtacacccaattaggaccaaaactattccccaaatcacaatggttaaagataattgagctctgattccatactgaagaagaactacagcctaatctcagaatgaattgcccatcctttatcatctgtgctaaatacttatgtacatatatttagaatttctaattgccccagcctaggtaggtagtgactcttgaagtatatawctttgctaaatacttatgtacatatatttagaatttctaattgccccagcctaggtaggtagtgactcttgaagtatacatctttgcctgctttgttatatattttagcttgttttgtctccctcacaacaacctgtgaaatagctgttatcttagtttacagattaaaattctgaactttggggaagttgcgtagcttgctcaaagtccaacatctcaaaggactagatcccagggagatgcccttcactttccattccctcaggcttcctgttttgaggagaaccagtctagtgtaaa

SEQ ID NO: 40656 - DNA, 601 bp, Human
actatggatcattgtgttagtcgagatgaagtaggttatactgtaggaacataagacatatcccacttgttaaaataacagcagtttatgtctatctagcactgcctgtctataaagaattggctggggctttctggacccaggctgacaattaagaagatgtaactgtggcagaaggaaaagagatccctggagaagttttttttttagttatttatttgtggcaaataaacattccatcccacaagtgatacacatcacttccaatcacaacatattgtccagaactggttaggtggcmccactcaaatatacaaagccaggaagtacacctaccatgcgccagaatatttgatgaagcatacctatgacaaccacagacagttggcagaactggctctatcttacgtagtacattctacgtatgtactcagatgtagaatggaaataatcccaaagatcaagctcatgcatcagccttgatcagtcaggctaacatatttattgtcaacagaaaaactaaaattgttgctgaattctggtcctggagcaatggtgtgctattggaagatgcagtgataaagaagagggatggttctgt

SEQ ID NO: 40657 - DNA, 601 bp, Human
ctgctagacagacttcacagtaaaggcaaagcagagaaaacaagggacatcaaggccacaccttgactgctcaccaaaaagcacatgtccctgactatggatcattgtgttagtcgagatgaagtaggttatactgtaggaacataagacatatcccacttgttaaaataacagcagtttatgtctatctagcactgcctgtctataaagaattggctggggctttctggacccaggctgacaattaagaagatgtaactgtggcagaaggaaaagagatccctggagaagttttttttttagttatttatttgtggcaaataaacattccatcccacaagtgatacacatcacttccaatcacaacatattgtccagaactggttaggtggccccactcaaatatacaaagccaggaagtacacctaccatgcgccagaatatttgatgaagcatacctatgacaaccacagacagttggcagaactggctctatcttacgtagtacattctacgtatgtactcagatgtagaatggaaataatcccaaagatcaagctcatgcatcagccttgatcagtcaggctaacatatttattgt

SEQ ID NO: 40658 - DNA, 601 bp, Human
tggctgctatgtgacaggcaaaacattaatggctggtacaaggaaatacagaaaaaaaaattaaggaaaagaaaacgaaactatgaaaggtactaagtttcattgccccaagacatctattattagggtcttaaattttctcagactgctagacagacttcacagtaaaggcaaagcagagaaaacaagggacatcaaggccacaccttgactgctcaccaaaaagcacatgtccctgactatggatcattgtgttagtcgagatgaagtaggttatactgtaggaacataagacatatcycacttgttaaaataacagcagtttatgtctatctagcactgcctgtctataaagaattggctggggctttctggacccaggctgacaattaagaagatgtaactgtggcagaaggaaaagagatccctggagaagttttttttttagttatttatttgtggcaaataaacattccatcccacaagtgatacacatcacttccaatcacaacatattgtccagaactggttaggtggccccactcaaatatacaaagccaggaagtacacctaccatgcgccagaatatttgatgaagcat

SEQ ID NO: 40659 - DNA, 601 bp, Human
ccataaacacactttgagtggcatggccctaacactaggaccaacccagagtcagcccagactctcacctgcctgcctgtccccttgaccatgtctcccccactcatcaagtcatacaccctcttgccaccatttttcctccagagcgaatataggtgtgtgtatgactgtgtcccccaaaaaggcaactctcgtctcttgggatttattgattctcctttcattcccattggcttacagaccacactttgttatgaagccaattaagatctctgctgtgattggctcattgctatttccyagttgttcatgttgatattggtgtgttttaactgtaatctctttgagagtaaggacaacgtagtagataatctccacagcaaccaatatttttccagtaaaaaagtcaggtgttgttatttcccattttgctggtatataaactatctggatgaaaaatctatgcatcctggaaattagtatataaatgagagacttattaatcttataaatacagacttaatcataaaatatttatttcaaaaaaatggtaggtgccatttattgtgcatttattaagagccagacactaggctaagtg

SEQ ID NO: 40660 - DNA, 601 bp, Human
acccccatttcccaaccatcaccaccaacctacgtggcagaagaccagggaaagggcaagaaacagggccatccaggtaattgcttcatccactatgagccctcgaaataaggagctgatgcagtatgaggcacacatttaagaactatgctaaacttttaatcctgggtcactgcaacagcttgccatatatgtcagtgatctgttctgtgtgattacgagatagtttattttatttttgcgtcacaagtctatctgtgaagacccaaaatattctgcatatgcagtactgaaagaacgyataatggttcccaaatacttctttactggttttcaaatacaaggactttttaatataaggcatttcaaaaaccttcacccaagatccatgttattttaggtttggatgcctggaaaatgtctaatggcaaaaagctgctaggaatcagtaacagttccaaatggattttatgttttgtcataatgacatctaggtacatttggaacaaagaattattacatttatgcacgagctacctcgtttctgcagttttaagcctacagtggaagtgcatatgcttttaagtaccctctattttgt

SEQ ID NO: 40661 - DNA, 601 bp, Human
attaattccacttgttctcagatgggcataatctcttagaactgaataattggaaataccttagagatcacaaaggttcatgctctcattttcaagataaagaaactgaggttaagaaaggtgaaggaacttatttgacttcatacaggtcagccaaggctaagccagtgtcagaactgtggccatgagttggagtggtctgaacaaagcatgagaagataatttctttgacgctaaataatacaggctgtatttgagccagataagagcaaggggacagggtattttattttctcttctyaacctcattcattatgaaacacttgggagcaaaaacaactcttcaacctcctttttccactcaccgtgcccatccttctttagcgtctgtttggtagatgaaggtccccacctgatggctttagaaggcaggggaaacgagaaaaacggagatatcagtgactctcactgatcatgagtaaatgctgaatgacttgcaacttgcgttgcatctaaatcaggtgttgttattccccactttgcaaatgaagaaactgagagaggtctgagagaggttagtgaggtaaccagcccaaagtta

SEQ ID NO: 40662 - DNA, 601 bp, Human
tgatgtataagattccatatcctgaatgggaaacaagggagtgtgtttatatgcacaggcttgcacccactgggggtgagagctggggagagaggattagtaaatgttctggaagaaatcaatatgggtttgtggctgggaaaagcatcctccaaaagaattgcagccctcagctctctctccttggcaaaagcttcaactttagcatgtgcccccctgccccatcactcagtggaaaactttatgcaaaaaaatgcatttttggaagacacgagcacacacgtgttcatagcagcacaaytggcaattgcaaaaatataaaatgggcctaaatgcccatcaaccaatgagtggataaagaaaatgtggtataattacagcatggaatactactcagccacaaaaaggaatgaaacaatggcatttgcagcaacccggatggagctggaggccattattctatgtgaagtaactcaggattggaaaaccaaatactgtatgttctctaagtggaagctaagctatgaggaggcaaagacataaggataatatatgaactttggggactcagagggaagggtgggaggtggatgagggataa

SEQ ID NO: 40663 - DNA, 601 bp, Human
ctaagtgctgatgccctttctgtagaacaagtgtcagcactctgcaatttttcattctgcaaagtgttttgttctatactgtctaatacaatcttgtacttctcttcctatcactcttatgcactgatttgtcattttcacttcaggagcctgggaaacttttgatgaagcatgactcatggctcaggaagagaaaagaaggaagtaccagctgatgctaagaggctggaaggtcaaatattatactttcttgctccctggagttggaaatgggatcggctttcctgaatctcattagctrctagaaagagaaaaaaaagatcaaggtttcaaaaggaaggagcaaggggaaatggatttcataaaacaactgtgtcctttacatcattacatagctataaagtatagtgcaaaaataaacaacaaaagcattagttcattagatgtaggaccagaaagcttgggaccctccagtttctaaccatgtgattttgaaaaattaaacatcaggtttcagtcctcagtctcactctccacagaataaataataattcggagtgacctgatagtaagtggcattatcactctctctgccatctgc

SEQ ID NO: 40664 - DNA, 601 bp, Human
tcatgttgctcaggctagtcttgaactcctgagctcaagcaatccacccacttcagcctcccaaagtgctgtgattacaggcatgagccactgtgtccagactcttttaaatacatcaatgcaaaaatcctcaacaaaatattatcaaacccaacccagcaacatataaaaaggattatacctatgatcaaggagattttaccctaggagtgcaaggttagtttagcacagtaaaatcaatcaatataatataccatattaatagactaagtgaccaaacccacatgatcatctcaatagmcatagaaatagcatttttgtaaaaacccaacatctgtccatgattaaaaaccactcaacaaaactaggaatataagggaacgtcctcaacctaataaaggacatctatttttttaaaaaaactcactgccaacatcacacttaatagtaaaagactgaatgttttctctcttagataaggcaaaaaagatgtcttctttcatcacttctattcaacacagtactggtatattcatacaattgaataatatccagcaattacaaggaaggaaggcctgatacatccgataacatagatgaa

SEQ ID NO: 40665 - DNA, 601 bp, Human
acactgagagaacccatcataagaagatccatcctacaagaaatactaaaaagaacccttctgctaaaatgaaggaacactttacagtaacttgagtatccatggagaaataaagaccaccaataaaggtaaccacataggtaaatatgaaggacagtattaataagttttgtttataattcttctatcagatttaaatggaaacagcataaaccaataattataagataatgttgatatagttataatgtgtaaagaggtcattgatatgacaataattacacaaaagagaaggaaacasagctgtatatgaactaagtttttgaaaactattaaaattaagttgatattaacctgaactacattgttttaggatttcaaatgtaatcctcagaaaaaagcagtaataaagtaactcaaaaataggtggaagagataattaaaatgatacattaggaaatagatgtttaacacaaaagaagacagtaatgaaagaatggagaaaaaatataaagaaagatttcaagcaaataatatatcctcacaccttaagaaactagaagaagaaaaactaaaccaaaagcaaacagaaggaagaaaa

SEQ ID NO: 40666 - DNA, 601 bp, Human
gtataatagaaatcaacagcaaaatgtgaccctataatcaacatatttcattcctacattgagagatattttatttccccttcatccattcattaagcatctattaagcatctattacaaataagcactgtgttgggtgctgattttgagaaacagaagtgctactcgatagcaccaggaggttctttcttccagttaacaatagcttatcactaacatttatgagtgcttgccatgtgccaggcatttttctaggcaactagtatggtttggatatttgttccttccaaatctcatgttraaatgtgatccacattgttggagatggggcctggcaggaggtgtttgggtcatggtgctggatccctcatgaatggcttggtgccatccccttggtgatgagttacttctcactctattagttcacatgggagctggttgtttaaaggaacttggcatctccctctttcaccatgtgacatgtctgatctccctttgcttctgccatgagtaaaagctccctgagggcctcaccagaagcctagcagaggctggtgccatgcttgcatggcctgcagaaccgtgaaccaaataaacttct

SEQ ID NO: 40667 - DNA, 601 bp, Human
gtattcccccaaacacaacaaggggcacttggaaaatattatctgtagtagatcctcatagtactattacctaggtaacaccatagttttgctatattcatgctctgttcttttcaagaattctctagttgatatgttaatctatagcaaggattgcacacttcttcagaaaagaacaagaaaataaatattttagcctttgaagaccacacaatctcagtcacaactactccactctgtcactgtagcacaaaagtagccacagataatacataaatgaataagcatggctgtattccartaaaactttatttacaaaaacagccagcgagatctggtccatgggccatagtttgccgactctttatttcttctttgactatgttacagattgtgtattaccaacacacacacacacacacacacacacacacacacacacactggaaccactctttcgcccaggcctatgacagtatgctgcattcaaagccagagaaaagggatcaatgtattcatgatccgaagactgactctggatatgactgcaataagctactgtgagaaactgtgaaattctttcttatggaatttcaaaagc

SEQ ID NO: 40668 - DNA, 601 bp, Human
aagtgaattaatggcttcaaagaatttataatttaaaaggagaaacaagaacaaggattctcttattcacccataacacaggtctcaatgaaagtttggggaataactgaaagcataaatgaataaaagagtaggtagaaaactgggtatccccacaaagggagctgataaaggactacagaaatttaatggagagagacatgacactcttttttactttttgtttctcattttagtaccctaagctgcaaagcttaaaataaatgaatgcaaaagatttggaagtgggagaggttttttwaaaaaaaataaaataaaaataaaaagactaccacccactccccatgctaccctcccactgaaatgactatagttttagcatccgtaatgggattgttgcagttttgagaatgttgccatagtaaccaacctcagcccttcccctaatataagataagatttagcaaaagaaataaataacagactcccatagaaacattatcaaacctttccatataaataacctgggtaattaaatgtttcaaaacagaatatttagggagccgtgaaaaagaaaacattctacaaagtgtatttttaa

SEQ ID NO: 40669 - DNA, 601 bp, Human
cccccttcccttcccttcactgtcttccacttctaaactggaacactcaattgctcctccttctgaacttttcaatggttcccaatgtcgaaatccaacctcccagacatgacttctcttgatggctacgtctccagactgttcttctaccaatcatccatgtgttttctaaattctcctgctcatggccaaggactcctcgcctgtatatctctattcttgttggtctagattggttggaatgccctgcatacccaaacccataaatacacacacacacacacacacacacacacatacacacacacacacacctccatccccctgccatacacacacacatctaggccctaaccagaaaatgcctatctggtaacccaaatgtcacctccctgcagtcatttctatgctttctaggctggggagttaagtggattaagtgcccctgtgtaagcatttatcaaattttatttcaatcatctctgtgcttcactatgtgcccttccctgtgctgcccaacaaaacaaaatgttaatcttcaacagaatcccttttttcttttttgtcttcttatgcaagtatgattcttgatacaaagcaa

SEQ ID NO: 40670 - DNA, 601 bp, Human
ttcccccttcccttcccttcactgtcttccacttctaaactggaacactcaattgctcctccttctgaacttttcaatggttcccaatgtcgaaatccaacctcccagacatgacttctcttgatggctacgtctccagactgttcttctaccaatcatccatgtgttttctaaattctcctgctcatggccaaggactcctcgcctgtatatctctattcttgttggtctagattggttggaatgccctgcatacccaaacccataaatacacacacacacacacacacacacacacatacacacacacacacacctccatccccctgccatacacacacacatctaggccctaaccagaaaatgcctatctggtaacccaaatgtcacctccctgcagtcatttctatgctttctaggctggggagttaagtggattaagtgcccctgtgtaagcatttatcaaattttatttcaatcatctctgtgcttcactatgtgcccttccctgtgctgcccaacaaaacaaaatgttaatcttcaacagaatcccttttttcttttttgtcttcttatgcaagtatgattcttgatacaaagc

SEQ ID NO: 40671 - DNA, 601 bp, Human
cccaatcccatcttcccccttcccttcccttcactgtcttccacttctaaactggaacactcaattgctcctccttctgaacttttcaatggttcccaatgtcgaaatccaacctcccagacatgacttctcttgatggctacgtctccagactgttcttctaccaatcatccatgtgttttctaaattctcctgctcatggccaaggactcctcgcctgtatatctctattcttgttggtctagattggttggaatgccctgcatacccaaacccataaatacacacacacacacacacacacacacacatacacacacacacacacctccatccccctgccatacacacacacatctaggccctaaccagaaaatgcctatctggtaacccaaatgtcacctccctgcagtcatttctatgctttctaggctggggagttaagtggattaagtgcccctgtgtaagcatttatcaaattttatttcaatcatctctgtgcttcactatgtgcccttccctgtgctgcccaacaaaacaaaatgttaatcttcaacagaatcccttttttcttttttgtcttcttatgcaagtatgattc

SEQ ID NO: 40672 - DNA, 601 bp, Human
ggaaactgtcaggggtagcaagggaaaaaagactacacattgggtacagtgtacactgctcaagtgatggtgcaccaaaatctcagaaatcacccctaaagaacttattcatgtaaccaaacaccacctgttccctaaaaacctattgaaataaaaaataaaaaattataaaaatattttggtcacatcaacacttaaaaatctttttagaaatacttaatattttactaaaagtgagacagcatattagggatacgataatgtgtaatttctcttgaggttcctgttcctccttcaaagscttctctgatcatatccagatctctgggtcccatccacacttcttgtcagttctggagccacatttccagctgcctactggacggtccaacttgatggggttcatttaaaactcatcatgtcccaaggtgaatcttgccatttttacaagtctccatatctcttcccaatcccatcttcccccttcccttcccttcactgtcttccacttctaaactggaacactcaattgctcctccttctgaacttttcaatggttcccaatgtcgaaatccaacctcccagacatgacttctcttga

SEQ ID NO: 40673 - DNA, 601 bp, Human
agcatcactaattatcagggaaatgcaaatcaaaattgcattttgatacgaccttactcctgcaagaatgcccataagcaaaaaaccataaagtaatagatgttggcatggatgcaatgaaaacatttttacactgttggtggaatgtaaactagtacatagttccactatggaaaacagtgtggagattccttaaagaactaaaaatagatctaccatttgatccagcaatcccactactaggtatctactcagaggaagtcattatatgaaaaagatacttgcacacacatgtttaagyggcacaacttgcaatagcaaaaatatggaaccagcccaaatgcccatcaatcaatgagtggataaagaaaatttggtgtatatacagacggaatactactcagccatgaaaaggaatgaaataatggcatttgcagcaacctggatgaaactggacactattatgctatgaggacacaaaagcataagaatgacacattggactctgggaactcaggggaaactgtcaggggtagcaagggaaaaaagactacacattgggtacagtgtacactgctcaagtgatggtgcaccaaaatct

SEQ ID NO: 40674 - DNA, 601 bp, Human
tcagtaaatttaagaaaatagaaattatatcaagtaccctcccagaccacagtggaataaaactgtaaatcaactccaaaagaacccctcaaaaccatataagcacatggaaattaaataacttgttcctgaatgatcactgggtaaacaaatcacgatggaaattaaaaaattatttgaactgaatgataatagtgacacaacctatcaaaacctctgggatacagcaaaagcagtgctaagaggaaagttcatagcattaaatgcctgtatcaaaaagtctgaaagagcacaaatagaygatctaaggtcacacctcatggaactggagaaacaagaacaatctaaactcaaaccaagcagaagaaaagaaataacaaagatcagagcagaactaaatgaaactgaaacaacaacaaaaaaacaatacaaaagatagattaaacaaaaagctggttctttgaaaatataaataaaattgatagaccattagtgagattaaccaagaaaagaagaaagaagatccaaataagctcaattagaaacaaaatgggagatattacaactaataccacagaaatacaaggctactatgaacacc

SEQ ID NO: 40675 - DNA, 601 bp, Human
aaaaacacaaggtattcaggcaacaaatagcatgatgaatagaatagtatttcacatctcaatactgacattgaatgtaaatggcctaaatgttccacttaaaagatacagaatggcagaatggataaagaattcaccaaccaagtttctgctgtcttcaggaaactcacctgacacataaggactcagataaatttaaggcaaaggggtagaaaaagatattccatgcaactggacactaaaatccagcagtagtagcaattcttatatcaggcaaaacaaactttaaagcaacagcagytaaaaaagacaaagagggacattatagaatgataaaaagacaagtccaacaggaaaatatcacaattttaaatacgtatgcacctaacactggagctcccaaatttataaaacaattactactagacctaagaaatgagatagatggcaatataataatagtgggggactttaatactccactgacagcactagacaggtcatcaagatcgaaaatgaacaaagaaacaatggacttaaactataccctataacaaatgaacttaacagatatttatagaacattctacccaacaactat

SEQ ID NO: 40676 - DNA, 601 bp, Human
aacaataacacagtgtaaaaaacacaaggtattcaggcaacaaatagcatgatgaatagaatagtatttcacatctcaatactgacattgaatgtaaatggcctaaatgttccacttaaaagatacagaatggcagaatggataaagaattcaccaaccaagtttctgctgtcttcaggaaactcacctgacacataaggactcagataaatttaaggcaaaggggtagaaaaagatattccatgcaactggacactaaaatccagcagtagtagcaattcttatatcaggcaaaacaaaytttaaagcaacagcagctaaaaaagacaaagagggacattatagaatgataaaaagacaagtccaacaggaaaatatcacaattttaaatacgtatgcacctaacactggagctcccaaatttataaaacaattactactagacctaagaaatgagatagatggcaatataataatagtgggggactttaatactccactgacagcactagacaggtcatcaagatcgaaaatgaacaaagaaacaatggacttaaactataccctataacaaatgaacttaacagatatttatagaaca

SEQ ID NO: 40677 - DNA, 601 bp, Human
tagagatctagacatccaaataaaagcagctcaaagaacacctgggaaattcattgtgaaaagatcattgcctaggcacatagttgtcaggttatccaaagtccagacaaaggaaagagtcttaagagctgtgaggcaaaagcagcaggtaacctatacagaaaaacctatcagattaacagcagatttcttagcagaaaccatataaactagaagggactgggattctatttttagcctccttaagcaaaacagttaccagccaagaattttgtatccagtgaaactaagcttcataaaygagggatagatacagtcttttccagacaaacaaatgctgagagaatttgccactcccaagtcagcattacaagaactgctaaaagaagctctaaatcttgaaacaaatcctcaaaatagaaccttcttaaatcataaacctcacagtacctatataacaataacacagtgtaaaaaacacaaggtattcaggcaacaaatagcatgatgaatagaatagtatttcacatctcaatactgacattgaatgtaaatggcctaaatgttccacttaaaagatacagaatggcagaatggataa

SEQ ID NO: 40678 - DNA, 601 bp, Human
gctgaaagacctgaagatggatcacatcacaggactcattgcagacactctccagtaccagctcagagctctgtagctccactgggtggctagcaaaacaatcactatagttcggctctcaggaagtcccattcctaggcgaaaggggagaacaccacatcaagggagcaccccgtgggacaaatgaatctaaacagcagcgcttgaagcccagatctttcctctgacatagtctacccaaatgagaagaaaccagaaaaacaattctggtaatatgacaaaacaagattattaacacccygaaaaatcataccagctcatgagcaatggatccaaaccaagatgaaatctctgaattgacaaaaaaagaattcagaaggccgactattaagctaatcaaggaggcaccagagaaaggtgtagtccaacttaaacaaatcaaaaacgtgatacaggatatgaaaggaaagttcttcagtgaaatagactgcataaataagaaaccatcacaacttctggaaatcaaggacacacagaaatgcaaaatgcactagaaagtctcagcaatagaatcaaacaaacagaaggaagaatttcaaag

SEQ ID NO: 40679 - DNA, 601 bp, Human
ttatatttccttcctcctcctctctctcaacccaatttaatggggtctgagactgaggctagcctagagaagaaaaggggtgaaggaatactgaggagaaagagggaagctgaccactctccttccatgactgcagggctggggcaggcccctgttggaggagggaagaaagctcaattctaaatcaactccagtgtttttgctagtacataatgctggacgtttcaggtactgaattatctggtgtttttaacctgaatgttttgttttgttttgttttttaattgcctaagagtgaccrgaattgccagggaaggacatgtcccactgtgcaggtttaaagaataaatggagggagaaggcaaagctgtttgatgatggcatcctacgagttgagcatggtcatctcaagtgctacattttaatcatagcagtgattcctcaatctgtcaaaatggctctaaacattttggttaccactgtcaattaagatggtggataggaggcaggaatagcttgcagctcctgctcagacagacagagcagcatgtggagactcacaccatgaacttttgctccaagaactactgtaggaacatac

SEQ ID NO: 40680 - DNA, 601 bp, Human
catatctcaacagatgaaatattggcatcattggctctttagttatttactatgtcactgctttcgactcatcaatgtcttttattctctttaaagaattcttctatttatatacatagatttttaagtcttcatctggttcattttctgaggctcctggaaagctttcctctggataactgaggcatttctgtggttctaactttaccttgttaatcgcatattggtatttaaatattcagtgccatgagtgagaagacaaagggaaaatatttgggaatgaccagatacctaaaatttygtcataaatacacctaaaatgcaaccatcatgtggctattcagtccgttcaccttcccttatttcctcaacaagaatactaggcgattggcaatcacaggtaagacatggaccctaccaaggcgtacacagctcacagtgtaataagtgattaaacaattaaatataagttgatgagttttgtgatactaaaacataacaaaaacattaggaaaatatgaaagtatgagtagcccactttcaataacgcccagaagttttcaccaatgagttggtacttcgagctgacttttgaagaact

SEQ ID NO: 40681 - DNA, 601 bp, Human
aggcctcactctttgcagtgtccttcttcattcccaaatcttccatgttgggaaaattaaggtaacaagaaaatctcctctgttctttttccactaaatccaaaatcatgacacagaactctgttgaaatacatcataaaggtagaattttaaaacaaaaggctgaataaaatggagaggaagatacttaactccatggctacctctctcttagccagcatcatgttatttaaatattatctgcttttggtctgttctgtctccccaactagactgtgaattcacatgtgagagctattcstgattcaccctggagccctgggtgaccggcacagtgtctgacacaaggcactcaagagattgcacttaaactggactgggcctacttaagggaggtatcaaaaaaacattaaagtaatacacacatctggttagaaaaaagaaagcttgcagaatggtttataatgaatgacctaagcccccagatctgttccccatcctgctcactaaaggcaaccattcgtaactatgagaatttgtttttaaggtttcatcacatgtattgctaattcaaaaaaaaagaagaagaaaaagaatgcca

SEQ ID NO: 40682 - DNA, 601 bp, Human
gaatcagcagctgtgggcttctggaaataacgtcctggcacttacacgaccttgttccaattcagagttaaggctgctctacactgtgtgcattcgtgtccgtaaagaaagtagcaaaataaaaatcatgactggtttccattttaggcctcactctttgcagtgtccttcttcattcccaaatcttccatgttgggaaaattaaggtaacaagaaaatctcctctgttctttttccactaaatccaaaatcatgacacagaactctgttgaaatacatcataaaggtagaattttaaaacaaaaggctgaataaaatggagaggaagatacttaactccatggctacctctctcttagccagcatcatgttatttaaatattatctgcttttggtctgttctgtctccccaactagactgtgaattcacatgtgagagctattcgtgattcaccctggagccctgggtgaccggcacagtgtctgacacaaggcactcaagagattgcacttaaactggactgggcctacttaagggaggtatcaaaaaaacattaaagtaatacacacatctggttagaaaaaagaaagcttgcagaat

SEQ ID NO: 40683 - DNA, 601 bp, Human
aatcagcaagggaagatcaaactagtaccattcactgagtgataacaattaagaattagttttatcaccaaaagcaattgcaacaaaagccaaaattgacaaatgagatccaattaaactaaacagcttctgcacagcaaaagaaactaccatcagagtgaacaggcaacctatgaatgggagaaaatttttgcaatctactcatttgacaaaggtctaatatgcagaatctacaaggaacttaaacaaatttacaagaaaaaaaaacaaccccatcaaaaagtgggcaaaggatatgaayagacacttctcaaaagaagacatttatgcggccaacaaacatgaaaaatagctcatcatcactgatcactagagaaatgcaaatcaaaaccacaatgagatactatcacatgccagtcagaacggcaattgttaaaaagtcaggaaacaatagatgctggcaaggctgtggagaaatgggaacgcttttacactgttggtgggagtataaattagttcaaccattgtggaagccagtgtggcgattcctcaaggatctagaaccagaaataccattggacccagcaatcccattactggg

SEQ ID NO: 40684 - DNA, 601 bp, Human
gtaatagtcattgtcagaggtgccagcagatgaaaataccagtcactataagagatttctgaagaagtcagaaaaaaaagtcaattttgtcttctcaaaaaatagaaagtgggtcaggaaattctgagaaaagacagcatttatgcatagggatttcgcattctgattacggagccctactacatgataataatctcttgctgcttctgcgacacccaagggagacacgggagaaaatgcaaaagaagccgagacgtgttagacccggtagatgaactctgactgtggcagatccagcaayggtggtcgagggtaaagttctgtaagaagagtttggtaccaaatgtccctgaaaatttggaactaaagtgaaagctatctgagtcaaagaaatgggtttcaagtgaactggaaagaactggattaatcagcaagggaagatcaaactagtaccattcactgagtgataacaattaagaattagttttatcaccaaaagcaattgcaacaaaagccaaaattgacaaatgagatccaattaaactaaacagcttctgcacagcaaaagaaactaccatcagagtgaacaggcaacctatga

SEQ ID NO: 40685 - DNA, 601 bp, Human
tttacagaggaagcatttcttttagaagatgaggtgttagcactctgtattctgaggcacgttgtaatagtcattgtcagaggtgccagcagatgaaaataccagtcactataagagatttctgaagaagtcagaaaaaaaagtcaattttgtcttctcaaaaaatagaaagtgggtcaggaaattctgagaaaagacagcatttatgcatagggatttcgcattctgattacggagccctactacatgataataatctcttgctgcttctgcgacacccaagggagacacgggagaaaakgcaaaagaagccgagacgtgttagacccggtagatgaactctgactgtggcagatccagcaatggtggtcgagggtaaagttctgtaagaagagtttggtaccaaatgtccctgaaaatttggaactaaagtgaaagctatctgagtcaaagaaatgggtttcaagtgaactggaaagaactggattaatcagcaagggaagatcaaactagtaccattcactgagtgataacaattaagaattagttttatcaccaaaagcaattgcaacaaaagccaaaattgacaaatgagatccaa

SEQ ID NO: 40686 - DNA, 601 bp, Human
agtgggaggatgttaagtggacacaagatgttcatctaaaatggtaccatctcatagaaagatgatggtattaggtcggtacctaatactatcatcttggcaaaaccaaaattacttttgcaccaacctaacagataatgtctacaattggcaaaccaaatgatcatagtataaacatagtatttagaaacacagatataaataaataccagaaggataagctagagaaatggaaagttgctgtcaggggagcaggactcaatagtggggagggagtgaggcataacaatgtgaatacttyatttttagaatcatttaaaaacacacatattttaaatagcttcgtcacactgagctaaaacccagagggatgacaagagacgactctcaagaagcagcttctgcaaaagctaagcaccaattctgagcaaaaaatatcctttccagctgctttaaaaccaaacaaaaagtaagcaaagggcacatttccaggggaaagggaggcaacccgactgcatgcacgtacaggccccgggcagaatcacgctgtgcctcattacataaggtgccctgaatctttgccccatcctgcccttctctg

SEQ ID NO: 40687 - DNA, 601 bp, Human
gcaaagtcactgcccagagcaagtccaagatctgagaattttaaaatgacctcactaatgatattccttgtcttgtctgtgatgtcacagtcttccaaagagccttcctgcagaaaccgttcacttgtcaaggtttagaaccactgccaccatcagccctttgtaatgataagtcaacatgagagtcttcatagagatgatgcagctgaatcccacgtcgtttactaaacaattcagctaagtagccctcaggtctggatggactctaaggacaggcagcatacgatacggaggcctcccrgaatcctgcagccccaagtcacccaaccttcccactggctaaagagagaaaggagacacactctattgtcaatttcacccccaaagctttatctatgttcctaggagaagtcacatctataccttacactggtatcaggcatttaaatcagtatggcaagtcaggttttcagaaaatatcactgaaaggaaaaggccaagagaagctacctgaacaggagatttcctaaatgtcagatctagttcctgcctgaaaccagctctcagcccctttcatttacagatgaagataagaggagaa

SEQ ID NO: 40688 - DNA, 601 bp, Human
tccttacaccttcctcatccagagagaatttcaggccatgcctgtctgctccaagtctccaataaggtctcaacctccacatagagcaattttcagtctcttgtaataattagcaaagcatgctgtaatacttctaaccagtaaggatagggtagtctaggcctgaaaaacagaccgctaaataagggacaggtcgtctacctgctttggcatttgttcagtgtttgcatattgtcacaacatttattttaagcccctaacagtgtcaagtgatggctcccacatggactttgatcagacrctatcacagatctaggcccagagcccacgaatatttactaaatatgcagtaggtggatgctcaccctagatgtgaacggtgttgccctaggacagatcatattccttaaagtgcccctcccctcctctgactctttgtccagggtggcaccctgggaagctgtgtttttaaaaagcttcctgagcacaccagaattattgttccaggtgaacagattctgaacctttaagttaatttcatccttcagaaggaacttttacattgagaaagggtcagagttcctttttctgccctcttttt

SEQ ID NO: 40689 - DNA, 601 bp, Human
gggctaaaaagttttgactcatgtagctcaggccagtgtttccttacaccttcctcatccagagagaatttcaggccatgcctgtctgctccaagtctccaataaggtctcaacctccacatagagcaattttcagtctcttgtaataattagcaaagcatgctgtaatacttctaaccagtaaggatagggtagtctaggcctgaaaaacagaccgctaaataagggacaggtcgtctacctgctttggcatttgttcagtgtttgcatattgtcacaacatttattttaagcccctaamagtgtcaagtgatggctcccacatggactttgatcagacgctatcacagatctaggcccagagcccacgaatatttactaaatatgcagtaggtggatgctcaccctagatgtgaacggtgttgccctaggacagatcatattccttaaagtgcccctcccctcctctgactctttgtccagggtggcaccctgggaagctgtgtttttaaaaagcttcctgagcacaccagaattattgttccaggtgaacagattctgaacctttaagttaatttcatccttcagaaggaacttttac

SEQ ID NO: 40690 - DNA, 601 bp, Human
aaatgctggcctctaagataaaagagcatgccctttatgttacaactgctcctttttagagtatccctagagtctttctcacattctatactccagcagcagggaacgctaaagtgagaaaaatatgtaacacctctctctcttccagttctctgccattgatgagcattgcaaattggttttccatgttgtctcacacccaggtcctggttatgacatcattatagttgctgcctgaatgtggaacaccctcaccccagcatggatcacagctaactcctttttttcaaaaccattcaartatcaccttctccagatatctgatctccttgctcggttcaatagctctccccaagcccttacccacctcaagctttcatgagatctggttcattgtgtgctcctatagcatccggggctgacctccaccaaagtattacaggatacgtctgcctcctgctctccttgctatggcgtgcacatctcctgatctcagcacctagcctgttccagacaaatagggaatttaatattgtggactgagtgacaaagaatgattccagtaggctttagctccattgtccagctattcatatctgtt

SEQ ID NO: 40691 - DNA, 601 bp, Human
tctgcaagccctttgtagcctttttgccactgtgtttcctaacaagtgattgtggtggtcaacacacaggacttcggcatcctttcatttatgttcaaatcttggccctggcatttatcaactttgtgcctttggtcaagttatttaccctttctgctgcctcagtttccccatgtttccttgacgtaaatagcaggggctacctcacctggttattgtggtgattaaataagacaacatttgtaaaacaaccacagcagtgctcactcaaagaaagtacacagaaatcattaatgactaytttcttacctgaatccctcagcagcactcagcgatctcttcctcttgatactcttcaccatgttctcctctttcttcttctttccctgtattttcccccttgggctcccatttgaaagcctcattagctttctttcatagaatggtccacagattcctgttctggaccatctgttcctctcaactaaacattctcactaagcaatctgagttatacccaaggctttaactaccacagtagatggtgggcccacaaatctctatgttcctccagacttctctcctagactccagacccata

SEQ ID NO: 40692 - DNA, 601 bp, Human
ttgatagagattctcaagcagctatagaagtgggtggcaatagaacaagggaaaaagatttccaagaaattcttaactaattacaggcctaggctgggtgaagagtttacaccaagatgaactcattctccctttctttctctgtttctctctcctccttttcgtccctccctccctcacacacattttgagcatcctcagaaaaaaaaacagagtcttgatattctcatgcctcattctccagaagtaaaaaatgtggtatcctgaaaaactagaaacaaaaaggcatactagttgtggygcctttgctaccatagcgtgagtgagaaaatagagctaaacagaaaaatatatgtaccctgagacacacagatagactgaggcaattgaggcaatcgacagggaatcctcctaatcctcttctgtgcctccagtcacagaggagtcactccctctttctttgaatcagcagagcccacctcacctactaatctttcctgcgggccctctcctttctttcccttgcactcactgttggtgactatggtgatttctctaacaaccaagagccctgcgggaagaaacggcattttccaaaact

SEQ ID NO: 40693 - DNA, 601 bp, Human
cactgcaacctccgcctcccaggttcaaacgattctcttgcctcagcctcccgagtagctgggattacaggcgcctgccaccacgcctggctaatttttgtatttttagtagagacggggtttcaccatgttggccaggctcgtctcgaactcctgacctcaggtgatctgcccgcctcagcctcccaaagtgctaggattacaggcgtaagccaccatgcccagcccttctacattcttattgatagagattctcaagcagctatagaagtgggtggcaatagaacaagggaaaaagatytccaagaaattcttaactaattacaggcctaggctgggtgaagagtttacaccaagatgaactcattctccctttctttctctgtttctctctcctccttttcgtccctccctccctcacacacattttgagcatcctcagaaaaaaaaacagagtcttgatattctcatgcctcattctccagaagtaaaaaatgtggtatcctgaaaaactagaaacaaaaaggcatactagttgtggcgcctttgctaccatagcgtgagtgagaaaatagagctaaacagaaaaatatatgtaccc

SEQ ID NO: 40694 - DNA, 601 bp, Human
gcgcgatctcagctcactgcaacctccgcctcccaggttcaaacgattctcttgcctcagcctcccgagtagctgggattacaggcgcctgccaccacgcctggctaatttttgtatttttagtagagacggggtttcaccatgttggccaggctcgtctcgaactcctgacctcaggtgatctgcccgcctcagcctcccaaagtgctaggattacaggcgtaagccaccatgcccagcccttctacattcttattgatagagattctcaagcagctatagaagtgggtggcaatagaamaagggaaaaagatttccaagaaattcttaactaattacaggcctaggctgggtgaagagtttacaccaagatgaactcattctccctttctttctctgtttctctctcctccttttcgtccctccctccctcacacacattttgagcatcctcagaaaaaaaaacagagtcttgatattctcatgcctcattctccagaagtaaaaaatgtggtatcctgaaaaactagaaacaaaaaggcatactagttgtggcgcctttgctaccatagcgtgagtgagaaaatagagctaaacagaa

SEQ ID NO: 40695 - DNA, 601 bp, Human
aatcgacctgaatgctcttaagtctcttagggcattgaattgccaaataaaccacagtcctcatctgaaaaatcttgtaactgccaatcccccaagggaaccccaacttctccaaaagccccaccaacaggaaaggggctgtgaacattgtgcaggtcatgggaagggcactcctcctatgcccacttcagatacagcctggaggataatggatgaggaagaggctaaacaaactgtaggaggagaaacaaccaactgcaattgcaaaaaaaaatacatctcaggatcgcagaaactgacyatataaactctaagtgttggcatccacaagccaaagagcaaactgcaaaactctgaaaattgaaagaaaaagacttgggttcctggtccagttcctaatgggtaaccaagcatgtccttcagccttgcaaaaggtcagtcatggaagttcttaggagaggtatattttgagccagacattcaacaaacacgtcagttgaacaaaataagttcttccttatgcagtcatcaacagtaacagacacagaagaatctgagctgagaatgcaacagaagccccagtgtacatacatcaccaata

SEQ ID NO: 40696 - DNA, 601 bp, Human
caggaatccttttgttacaagtggcaaaaaccaattcaatatggtaagaaacatgaattaaaaaatgataaagatgtgaggtctttttcaacatgtcccatgaagagttccccaccaaacgagggggccaatccatggcaaagattagattaagggtgcacctttccatccaagcctattttttcacatggcctcaagatggttgactttagtttaagggcagagggaggagggagaaacagagaatcgagacaagtgagcttttcaggcttaaaaattgcttctaggtctagattgagayctttgccttggtcactcacacgtggaacaaagtggaaacaaatcgacctgaatgctcttaagtctcttagggcattgaattgccaaataaaccacagtcctcatctgaaaaatcttgtaactgccaatcccccaagggaaccccaacttctccaaaagccccaccaacaggaaaggggctgtgaacattgtgcaggtcatgggaagggcactcctcctatgcccacttcagatacagcctggaggataatggatgaggaagaggctaaacaaactgtaggaggagaaacaaccaactgca

SEQ ID NO: 40697 - DNA, 601 bp, Human
tgtgcgacctctgccaccccctcatctctcacctcagggcacctgcctcaaataacttcccttgtgttgtcattcacctcatggataattgatagcatgtcaagttgatgctaagaaaagaacaaggtgggtagacgtgtgcctactataaatagatccacgacatgaccagcatttgccaacttttgagcaaagaaaggcagaggcagaaacggcagcgatggcagcttcccctgggtccttggaagagctggcttcacactgacagccacagccctgcttgagtggtttgactcacagmagaggggtgggaagatgcctttctccatttgggagcaaaatttaaaatatcacacgtgatggaactttcagggttgtttgacagacgcataaaagctcaaacaacgcatactttaaaacgtctgctttctttctcctacattatctttttctctgtatgttttaggaactttattctttattttgctctcaggggcatatctgcttctaagtttttatatacatatgctcacacaattacatatgtaattggcacctacacagattataaattaggtatatattagaccctgcagctaca

SEQ ID NO: 40698 - DNA, 601 bp, Human
caggcacagggaagaagggcagtgggagactgctgcgtgaccagctcagggtttcccaccaacctgtctgcaatcattcaccagccagatgcagcaagggacgtttgttttacccttttcattcggagctgtcactgtgcgacctctgccaccccctcatctctcacctcagggcacctgcctcaaataacttcccttgtgttgtcattcacctcatggataattgatagcatgtcaagttgatgctaagaaaagaacaaggtgggtagacgtgtgcctactataaatagatccacgacakgaccagcatttgccaacttttgagcaaagaaaggcagaggcagaaacggcagcgatggcagcttcccctgggtccttggaagagctggcttcacactgacagccacagccctgcttgagtggtttgactcacagcagaggggtgggaagatgcctttctccatttgggagcaaaatttaaaatatcacacgtgatggaactttcagggttgtttgacagacgcataaaagctcaaacaacgcatactttaaaacgtctgctttctttctcctacattatctttttctctgtatgttttag

SEQ ID NO: 40699 - DNA, 601 bp, Human
tatccccagaaacctcttctatcctattccaaaagatttctccctggataataaaagttgtggggggagcaaagaggaagaggtggtcaaatagtaacagcacaaaagtgtgggtggtgaactcccatccctgagaaatagcaaaatcaacaatacaaaaaaaaaaagtcagatctcacaatccctaaaaaggtatcgatagggggtcctggttcacaaactttagtctacaaagagggaaaaggaaggcctcatatttataaacttcagttttttggttataacttagaacaaaatgtayggaattccgctaagggaggagaccacccctcatattgtcttatgcccaatttctgcctccaaagaaagaagaagtaaaaactaaaaggcagaaatgaaatccacaggcagatagcccagcgccgcaccttgggcctggttacagattgacccctgacctaacgggttatgttatctgtagattccagacattgtatggaaaagcattgtgaaaatccctgtcctgttctgttccattctgattaccagtgcttgcagcccccagtcacataacccctgcttgctcaatcgatcacgaccc

SEQ ID NO: 40700 - DNA, 601 bp, Human
gcctatttccaaaacttatccccagaaacctcttctatcctattccaaaagatttctccctggataataaaagttgtggggggagcaaagaggaagaggtggtcaaatagtaacagcacaaaagtgtgggtggtgaactcccatccctgagaaatagcaaaatcaacaatacaaaaaaaaaaagtcagatctcacaatccctaaaaaggtatcgatagggggtcctggttcacaaactttagtctacaaagagggaaaaggaaggcctcatatttataaacttcagttttttggttataayttagaacaaaatgtacggaattccgctaagggaggagaccacccctcatattgtcttatgcccaatttctgcctccaaagaaagaagaagtaaaaactaaaaggcagaaatgaaatccacaggcagatagcccagcgccgcaccttgggcctggttacagattgacccctgacctaacgggttatgttatctgtagattccagacattgtatggaaaagcattgtgaaaatccctgtcctgttctgttccattctgattaccagtgcttgcagcccccagtcacataacccctgcttgct

SEQ ID NO: 40701 - DNA, 601 bp, Human
aagcagcatcactttattaattatgtctaggcattatccaattatttaaatgtatttaacgcaatgtacataaggctgtgtacccaaatacataactacatacaatcactacatttcagaatcataaatcctactacaatgtccttcagactaaaaatttgcctatttccaaaacttatccccagaaacctcttctatcctattccaaaagatttctccctggataataaaagttgtggggggagcaaagaggaagaggtggtcaaatagtaacagcacaaaagtgtgggtggtgaactcycatccctgagaaatagcaaaatcaacaatacaaaaaaaaaaagtcagatctcacaatccctaaaaaggtatcgatagggggtcctggttcacaaactttagtctacaaagagggaaaaggaaggcctcatatttataaacttcagttttttggttataacttagaacaaaatgtacggaattccgctaagggaggagaccacccctcatattgtcttatgcccaatttctgcctccaaagaaagaagaagtaaaaactaaaaggcagaaatgaaatccacaggcagatagcccagcgccg

SEQ ID NO: 40702 - DNA, 601 bp, Human
ttttaaaaattacactggaatttagtaaagacctggaagtcagaagtcctaggtttcagagacaattttatacaactagatctctcagccccagtcttttcagctgcaaaatgagcaggatattagtagatgatctgtaaaggccacttctagttctaggctaattttggtttcaatcatatttttgttcctatctaaggcttgaaatgaagcatctttgtgtctattataactttgggcttcatgtcaaataacttactaaggttctacttcagtaaacatctggaagatacacataaakatttcctttactgttagaagcagcagtcatcactacagtttcttaatttccattccaaattttctacacatagacttggctacaaaagccattctacctcctttcagttttataaaaatgtatattgtctatagccactatcagacatctctgttatgttagcagattcctcctattgggcagttaactctctgagaataagatggtattccattcaccgagtacctctcatagcacctgaaaagctaccttgtacttggtggcatctgacaaacatctgctgagtatcttttcatatat

SEQ ID NO: 40703 - DNA, 601 bp, Human
ccctgaacatcacccccataagcagttcaacaaggcaacggggagaagacagagtcctgaatggcttttcaatactttactcctacatctgtgaccttggggactcaggaagataaaggaaaggaatagcatgctaatgaagatctttaaggcagtgcaagacttcatgttgatattctccacatccacagagaatctggcttgaaaattttaaaaattacactggaatttagtaaagacctggaagtcagaagtcctaggtttcagagacaattttatacaactagatctctcagccccmgtcttttcagctgcaaaatgagcaggatattagtagatgatctgtaaaggccacttctagttctaggctaattttggtttcaatcatatttttgttcctatctaaggcttgaaatgaagcatctttgtgtctattataactttgggcttcatgtcaaataacttactaaggttctacttcagtaaacatctggaagatacacataaatatttcctttactgttagaagcagcagtcatcactacagtttcttaatttccattccaaattttctacacatagacttggctacaaaagccat

SEQ ID NO: 40704 - DNA, 601 bp, Human
gtcacagtagagcagagacctgcacagggacacacaactggcatcagggagacccagtaagaggcaactggacaaaagaacatatcagcagaaactaagggcaagaagaagtggggaaaccagataaggaggcaagcaccagaataaagaagaaagatacccttgtcgtagaggagccagggtgaaggttctaacaagaaaggactcggctgcagagaaatgagatgcacagggctatagagctggtgagggggtagtgctgaggcctagatgcaggtcttcctactcctggttcagtgcytcaacctggcagattccaaatggcttcaccatgaaaaacacactcctccaccatgaagcacaccaaaatgcaaagccctcaaggggaggatcctgtgtagatcgctgttgtatcacaagtgcctagaacaaagcctggcacatagtaggtgcttaataaatacttgaataaatgaacaaagaattactgattggcagttaaaaggaaacttaaggttccctccctccattacctgtgggctgttttcccaattgcccacactcaccttcctctctcaaaaaaattcctgctgtgggtatt

SEQ ID NO: 40705 - DNA, 601 bp, Human
gcagaagtgcaaagactgagaaagtgcaaacaggcagaacatattgtcacagtagagcagagacctgcacagggacacacaactggcatcagggagacccagtaagaggcaactggacaaaagaacatatcagcagaaactaagggcaagaagaagtggggaaaccagataaggaggcaagcaccagaataaagaagaaagatacccttgtcgtagaggagccagggtgaaggttctaacaagaaaggactcggctgcagagaaatgagatgcacagggctatagagctggtgagggggtrgtgctgaggcctagatgcaggtcttcctactcctggttcagtgcttcaacctggcagattccaaatggcttcaccatgaaaaacacactcctccaccatgaagcacaccaaaatgcaaagccctcaaggggaggatcctgtgtagatcgctgttgtatcacaagtgcctagaacaaagcctggcacatagtaggtgcttaataaatacttgaataaatgaacaaagaattactgattggcagttaaaaggaaacttaaggttccctccctccattacctgtgggctgttttcccaattgc

SEQ ID NO: 40706 - DNA, 601 bp, Human
aggagcagaagtgcaaagactgagaaagtgcaaacaggcagaacatattgtcacagtagagcagagacctgcacagggacacacaactggcatcagggagacccagtaagaggcaactggacaaaagaacatatcagcagaaactaagggcaagaagaagtggggaaaccagataaggaggcaagcaccagaataaagaagaaagatacccttgtcgtagaggagccagggtgaaggttctaacaagaaaggactcggctgcagagaaatgagatgcacagggctatagagctggtgaggrggtagtgctgaggcctagatgcaggtcttcctactcctggttcagtgcttcaacctggcagattccaaatggcttcaccatgaaaaacacactcctccaccatgaagcacaccaaaatgcaaagccctcaaggggaggatcctgtgtagatcgctgttgtatcacaagtgcctagaacaaagcctggcacatagtaggtgcttaataaatacttgaataaatgaacaaagaattactgattggcagttaaaaggaaacttaaggttccctccctccattacctgtgggctgttttcccaa

SEQ ID NO: 40707 - DNA, 601 bp, Human
taggagcagaagtgcaaagactgagaaagtgcaaacaggcagaacatattgtcacagtagagcagagacctgcacagggacacacaactggcatcagggagacccagtaagaggcaactggacaaaagaacatatcagcagaaactaagggcaagaagaagtggggaaaccagataaggaggcaagcaccagaataaagaagaaagatacccttgtcgtagaggagccagggtgaaggttctaacaagaaaggactcggctgcagagaaatgagatgcacagggctatagagctggtgagkgggtagtgctgaggcctagatgcaggtcttcctactcctggttcagtgcttcaacctggcagattccaaatggcttcaccatgaaaaacacactcctccaccatgaagcacaccaaaatgcaaagccctcaaggggaggatcctgtgtagatcgctgttgtatcacaagtgcctagaacaaagcctggcacatagtaggtgcttaataaatacttgaataaatgaacaaagaattactgattggcagttaaaaggaaacttaaggttccctccctccattacctgtgggctgttttccca

SEQ ID NO: 40708 - DNA, 601 bp, Human
aatggtgctcaataaatactgctgaatgagtgaatcaacatgcagcaagtcctgattccagacatagccaggggtggaactctccctggtgtggataagcctatgggtgggatccaggatatggagctagacctgctcagtggggttgggtaggagcagaagtgcaaagactgagaaagtgcaaacaggcagaacatattgtcacagtagagcagagacctgcacagggacacacaactggcatcagggagacccagtaagaggcaactggacaaaagaacatatcagcagaaactaaggscaagaagaagtggggaaaccagataaggaggcaagcaccagaataaagaagaaagatacccttgtcgtagaggagccagggtgaaggttctaacaagaaaggactcggctgcagagaaatgagatgcacagggctatagagctggtgagggggtagtgctgaggcctagatgcaggtcttcctactcctggttcagtgcttcaacctggcagattccaaatggcttcaccatgaaaaacacactcctccaccatgaagcacaccaaaatgcaaagccctcaaggggaggatcctgtgtag

SEQ ID NO: 40709 - DNA, 601 bp, Human
atactcaggccggctcccacattgtggaatgtacttttattttcaataaaacccttcattccttccttgctttgtacgtgtgttttgtccaattatttgttcaagacaccaagaacctggagaccttctactggtaacaccatcaccaagcttccttttcctttgctgcagagacattaaagatctgtttagatgggatggcagcacaacaaagagtaggcaacctaaacccctactgccactcactatccaggctctactcagactttgtgtgagcaagaaacattcttttgttttgctwaattgatcagattccaggacttgttatggcaacacactctagctagccaatcctaacaaatgcaaacacattttacgacaaggaaataagatttataaaggttgacacttgtccaaggtcacttgcccaaggtcacataatctaatactatgagagggaaaagattcaaattcaggctcttctgactctagtaaataagctctcaatcctatctatataacatcattttatcattatcatccctgaacattggctctctgtacctaagtgctaattctacaaacacagttttgtagctga

SEQ ID NO: 40710 - DNA, 601 bp, Human
ctattggtccccatggtggcatgatttgcgcatgaataatctagatttagagtaaagtgctgtcaagcgtcgcattacatattcagagacagggagccaagccacactgtgaaatctcttctggaggaaaatgaatttcccactggcagccatcctgggaggaagtaatccagagatgttgtttgtttgtttgtttgtttgtttgttttttaagcctagaaatagggcaaaccatttgggtctaggtgctcaagcatgcacaggcttgatttattccctatggcagggaaaagatggaacygagctaagaactagcagaaaaggagactctgaagtttaggtgtagatctgaggttgtgagtccaaacccacctggtatcaggtgtaagctgttccttgggtttggctggctttatcctcaagactttaatatgttctcatcaactcagccttatcgtgtcctgaaaagaactagggagagcattggccaccaatgggggacagataggcacaacaaagaagtcctctcaaaacatcagagttagcctggggcaagatgaagggactagaatggggaaacctaaaagatctctttgaaaat

SEQ ID NO: 40711 - DNA, 601 bp, Human
tttacttaataatggttccaaaatgcaagagtagtgatggtggcaactcagatatgccaaagagaagccataaagtgctttctttcagtgaatagatgagagttctcagcttaaaaaggatagaaaaaaaaacatatgctgaggttactaagatctacagtaagaccaatttcattggtgaaaacgtgaagaaggaaaaataaattcgttctagatttactgttgcacctcaaattgcaaaaattatggccacagtctatgacaagtgcttagttaagatggaaaaggcattaaatttgtsggtggaagagacaaacagaaatgtgctacaattgatgggaatcaagtttggttcaattcacagtttcaggcatctactggggggctttccaaggggggatactgtatctatttaacgatggaattggctgcactaacagaactgtatgtgcagagataggggtgtttcttgtttttgttttggaggtttttttggtttggtttggttcccaaagcttaaattaaaattgatcaatgcttgacattctggattgttctggagagactgtgcttaagttgtccaggcatctgcttttgggtg

SEQ ID NO: 40712 - DNA, 601 bp, Human
caagttttcaattatgcatcactatgactagcatgataaaatttcacactgtcctgctccattctgctcaggcagtgaatcctccctttgtccacggtatccatgctgtcagtgctacctgtccctcagtcactcagtagtgggctcaattatcagatcaactaccacaatatcccagtgcttgtgttcaagtaacccttgttttacttaataatggttccaaaatgcaagagtagtgatggtggcaactcagatatgccaaagagaagccataaagtgctttctttcagtgaatagatgmgagttctcagcttaaaaaggatagaaaaaaaaacatatgctgaggttactaagatctacagtaagaccaatttcattggtgaaaacgtgaagaaggaaaaataaattcgttctagatttactgttgcacctcaaattgcaaaaattatggccacagtctatgacaagtgcttagttaagatggaaaaggcattaaatttgtcggtggaagagacaaacagaaatgtgctacaattgatgggaatcaagtttggttcaattcacagtttcaggcatctactggggggctttccaagggggg

SEQ ID NO: 40713 - DNA, 601 bp, Human
atggaaaaatcaaatatctattctttaataacgatctcccataaacagttcctgggtagagtcggatttatagtgtaccttcttccaaacaggaaaagagataaactcacactgttctcatatgccaaaggcatttctttggctcagaggttgttcccaaactgatgactgccatccctccttccacccccaacccccacccacctacttccattccaattctgtcagctctggcagtggttggtgcgctgttacatccaaaaggataaaaaaaaaataaaggaagaaacagaacttcaamatccttcctaggtagggccccttctgcaataggaaaagaagcagagaacctcaaatttgctctgggcagaaacagagccttaattaaagaagtgccagtgatctagcctgggacccactgctatggccagatgtacacaagaatgcccacagtagctcccgtcactcccactcactcccacagccacaagagaccttaatatgcagacccatgtgcacccgtaagtcatttccaagtcagagacaggtttggacccacataatgaaattaatacccatgcttaaaacacacacttatgag

SEQ ID NO: 40714 - DNA, 601 bp, Human
taggatcacagaggttatggtttcagtggaaagatttcattggaatgcatggtgtggtgctctaagagcatctgtgtctgaacgataagatgaaacaaaccacaggtgctgaatctgcacagaaaccagctcgccaaacatgaccacctgtacccaaatatctatttgaatcactgagaatgacagtacctcatgggcacagaggttgaatctagttaagataattctctcaacaaatttgtatgctcactccaatttcatgaatgtgcaacagtgggtgatctggaaaagcatggtcaayagtcaacaagaatatcatctcttgattctagcaatgctgaaaaccataggggctgctttctagtaatgaagctctcagtgcttttacatctataaatacaatgtaaaaaaaaattcttacttaaaaaaattcctgtcaaaaatgtatattagccttatggatagctggagaaaagttatgagtacacagcacgtccttagtgcctgactcctagtttctccaaaccaatggaaaaatcaaatatctattctttaataacgatctcccataaacagttcctgggtagagtcggatttatag

SEQ ID NO: 40715 - DNA, 601 bp, Human
gaggaaaaataacgactagacctcgagatcctagcggcttcctatgggacctcatgcagggcctctctgggaactccagccctggcttacttgctaatttcccatgggtcttccttagatagcctttctccaatgggaagaacaaaactcatttgccctgcacacaacatagtcagaatggccaatgacagagtaactataaaagggtttagcgaatgtaaaaagtgctacacgcatgtgtacactagatcctcccagcagcttttattccccagactgcccagagaaagttgtttttggtccctgtttttcttatttgtcaatagagcatatgagagtgatcatccactttccagtttatttttgccacttgcagaatcgaaatggcagtcaagaaaaggttgaacctgaggtctgtctctgctaagtgagaactactgttggttgaactattcccactggtgttgcccagtgattccgctccaccatgtctttgaaggttggtaggggaaaaggtgaagcatctcatggcaacaaagactatcaacctcactctgttggaataaagctagtcaacctaccactgtatttcacaacaatt

SEQ ID NO: 40716 - DNA, 601 bp, Human
gtgtaatctgccaaagaggaaaaataacgactagacctcgagatcctagcggcttcctatgggacctcatgcagggcctctctgggaactccagccctggcttacttgctaatttcccatgggtcttccttagatagcctttctccaatgggaagaacaaaactcatttgccctgcacacaacatagtcagaatggccaatgacagagtaactataaaagggtttagcgaatgtaaaaagtgctacacgcatgtgtacactagatcctcccagcagcttttattccccagactgcccagaraaagttgtttttggtccctgtttttcttatttgtcaatagagcatatgagagtgatcatccactttccagtttatttttgccacttgcagaatcgaaatggcagtcaagaaaaggttgaacctgaggtctgtctctgctaagtgagaactactgttggttgaactattcccactggtgttgcccagtgattccgctccaccatgtctttgaaggttggtaggggaaaaggtgaagcatctcatggcaacaaagactatcaacctcactctgttggaataaagctagtcaacctaccactg

SEQ ID NO: 40717 - DNA, 601 bp, Human
aagatgtgtttataaactttaagcattaaccactgagaccaacctgactttgtccattcaaattccagctcccagagaaaacttcctcttgtacagttttgggcttggaaaatatccttcaaactatctagccctgtcttatgtgaacacttttttagaaattcacagagaagatgaggttcccccccccctttccttttcatatccgatttactagatactcattgtaaagtctgccagacttccattgtctattttctttgatacaattttgaaagtatccatcatcagccaaaccagwacacgcaggtctggtttcatcctaactgttcatgcccataaccataaaaaagaagacacagattcatccctcatccctcaggtctcgttgatttgtgccaaatgagggcaattactagacatatggacacctcctctacctaatgaaaagctgactccctcattcagtcatgttttttatccaaatatgttttaagtgaaccagcaaaaccatgcagagccacttcacagagtatgcagtttgtggactgaaaatagagggatcaggagctgaaatccagcccatgctcagcactctgag

SEQ ID NO: 40718 - DNA, 601 bp, Human
taaacattgaaatacttagttccctatgctgggtctgtgcatactcactaaatggtattagttttacttcaaagcattcaaatatgcctcatttcaccaaaaaaaaaaaaaaaaaaaaaatacatacaaattttcaaagcagaaacatgagataactatttgtattagaaaagattcttgatttacaagaaatactcatggaaggagaactttcaacagcaagtttccctggaatacaaagaaacattatttgcagaaattgaatctgcattctattcataatataaaggcaaatctgttycatgcatttaaggaattaataaaagtaactaacatcttactgtcataaaatacaaacacaagcaaaaaccttgatgataatggactttagtcccttcgttttattaaaaaaaaaaaaagttaagtttaagcaggtgacatgaaagctcatctctgatagacttcggaatggaacccagaacctcttacttgagcccaaggcatttcctatcaacccaaattacatctcctgtttccctacatattatttagatactgtattttgaaatgcctctaaacattagctgtcagtttttaagaa

SEQ ID NO: 40719 - DNA, 601 bp, Human
taaaatcataaacattgaaatacttagttccctatgctgggtctgtgcatactcactaaatggtattagttttacttcaaagcattcaaatatgcctcatttcaccaaaaaaaaaaaaaaaaaaaaaatacatacaaattttcaaagcagaaacatgagataactatttgtattagaaaagattcttgatttacaagaaatactcatggaaggagaactttcaacagcaagtttccctggaatacaaagaaacattatttgcagaaattgaatctgcattctattcataatataaaggcawatctgttccatgcatttaaggaattaataaaagtaactaacatcttactgtcataaaatacaaacacaagcaaaaaccttgatgataatggactttagtcccttcgttttattaaaaaaaaaaaaagttaagtttaagcaggtgacatgaaagctcatctctgatagacttcggaatggaacccagaacctcttacttgagcccaaggcatttcctatcaacccaaattacatctcctgtttccctacatattatttagatactgtattttgaaatgcctctaaacattagctgtcagtt

SEQ ID NO: 40720 - DNA, 601 bp, Human
tttgtcaatcaagaccttgttgcaggccctcaacattagatacagaaccatgattaaattaatcagaggtcatacagatcacagtaagagataagcagtctattcagtttttctttttcatatctaccctcatatcactaatgactgtggctttaaataataatctttgttatctcttataagccagattgaatcaaagtttgggcaatctttgaactaactcttaaaaatcaagtctggtgggttccgaaaaattggacggaaaactattaaagctaaacgtgattggacagcacgaaayatgacagtgttttaaaatcataaacattgaaatacttagttccctatgctgggtctgtgcatactcactaaatggtattagttttacttcaaagcattcaaatatgcctcatttcaccaaaaaaaaaaaaaaaaaaaaaatacatacaaattttcaaagcagaaacatgagataactatttgtattagaaaagattcttgatttacaagaaatactcatggaaggagaactttcaacagcaagtttccctggaatacaaagaaacattatttgcagaaattgaatctgcattctattcat

SEQ ID NO: 40721 - DNA, 601 bp, Human
atgtaggggttctggagccaaataaacctgaatttcagacatggctcaacctcttaccgtgtgacagtgggcaaattatttagctcctctatggcttattttgcaaaggcaaaatgggattaatagcagaccttacctcttcacgttgctgtgaagaataaatgagagaatgcactaaagtgctcagcaatcaataaatttaacttctaaaatgggcagctgaaagagacaacacttacaaccttttaatacgagaaggtcaaacaaccaccccacaaattgcatcctgtttgtcctaagygaaataacatctaggaaaaatactgaaagtaacgggaacttgaaattgaccatatgggatcttctgtgggttacaaaaatagcataatttaatcagaaacccctagcttccaagaagcctgaatgagtatgaagagaaaatagattttgtcaatcaagaccttgttgcaggccctcaacattagatacagaaccatgattaaattaatcagaggtcatacagatcacagtaagagataagcagtctattcagtttttctttttcatatctaccctcatatcactaatgactgtggcttta

SEQ ID NO: 40722 - DNA, 601 bp, Human
caggaatctaggagtggctggtgacgtcatttccaagatgaagattttaaaagacttcagtttctgacgtgtgtgctcttcgtcatatcttttagagtgcttccactggggagaaccagctgccttcttgttaagtggctctgcagagaggcccctgtgactagggacctatatccaccttcgaagcagattcttcaaacccaggtaagttttgagatgatggcagcccagccaacaaattgactgctacctcaagagaaaccttgagccagagaccccgagctcagctactcctatattyctgacccacaaatctgtgagataataaatattatttctagccactaagctttagggcaatttccaatgcagcaacagagaatgaattcacaatgagagaccttgcagtcattctgtagatttttagaaatccagacttctgtgactcatgacctttaaagtgcctggcacagagtgcgtgatcaataaatatttgtcaactactccctctcctttacacatcaccgctgatcatgatggcttgtcaatttgcccttctatataattgaaaaatcttctgcatccctattaccattaccct

SEQ ID NO: 40723 - DNA, 601 bp, Human
gacctttcctaagcatcgtacatgaaacatttaccctcttccaaaccgtcttcattcactctgcttcttctgtgttttccaaagggcttataattctctagattattgtatttttgcctacagatttattatttgtctccttccacgtaaacataagcttcatgagaacaagaattttatctgttttgcttattgttctttccccagtatgtaggcacatactaggtactaaaaatatttgttgaactaacagtgcttgccacatagcacagatctaacaaatggcagcttttatcattayggcatcatcgtcatcttcttcttcatcatcattatgtgccttagcaccaccatacgtagtaaacctctcactctgaaagaaaccctagaacaaaccctttcctcttcaaatcaggcccatatgtgtattctgacagcaatgacactatcttgactcacatttctccttgcattcttgcccttgcctgaccttgatttctggaactagttgttcctcataatgtttgatttctcggcttcctaaatctggcctcgccactgaatagacataaccacaggtcttctgtttgaagcttggccc

SEQ ID NO: 40724 - DNA, 601 bp, Human
tcccagatggctctaaggctcaggtagtcttgtcccacacttcaggtcaggaaactacccagaaataagggcatctgctttgtgcccaaaagtctcctagcaaagagactccaaggatattcctatatttaagaaataaatgtgacaatctataaaaactaaataactctttgatttgtaaagaaatttataaaaagaacacagactttttcaataaaattcctacttcttcacttccaagttgtgcttccggggagcacagtcctcactttcatccctggatccactataatttgacctytaccctctcatgccatagaaaccacactccacaaagtcattattaaccttctaatggccaaaaacaatggatatgtttcagttcttataagagtgaggtctgtatcttactctgtctttttcttgaaattttcttggccttcaagacatgattatctcctgggcctctactaactttttcaaacactccttcatctccttaatggttccatgttcactactaaaatcaggggtggaaaagaggattcatcttgctcgttgacactgatcaaacgcagtggtttctaccaacactgtgttg

SEQ ID NO: 40725 - DNA, 601 bp, Human
aaatgcaaaagagaggaatatttggacaaaaactaatttttctccatcccctctgtagggctctatttacataatgacaagagcagatgaaagaagtaggggaagaacccgaatgactaaaatcagaatgtttacaaatttgtgaacttctcaaactgttcatcaaacattcaaatgactacattttttcttaagtttttctcccagatgttcaccatcacatcaagagccttgagccttaggaataaaataatttgaaaccatgagaaaaactccatgtaatttttcatagcagaagctkaaaacagaccattttgcttgtggtccgaattaagaatctaagaaattttgctatgattaagctcttctttatcaacttctttcaagatcttcaagacaaataatccatcggagcagaattaaaaacaaagaaagtggaaccagcttggagacaatcatcacaagactacctataattgtgtgaacaaaatttagtgaataaaaaatttacagaagtttggagtgagaaacaaagaaaaaaatgttgaaatgacaaaattctaaaaattgtctagtgaaaaatggcaaaagttattcttga

SEQ ID NO: 40726 - DNA, 601 bp, Human
aaaaagtcttgagtccttataataatttgccaggtgggatttttggtaatatcccccatacactatttcaaagccccatatttattaccttcatatttaattttgccctgggatttattattatggcttaaatttttattgtttcagaagtgtttcaatggaaaggtaattataaattagtatcacgcttcctttattcctatttggttaatcacttaattgtcactgcattatcaagtctccatgatgtatttttaacatattattattttaacaggtaatgcatacaaatttaaaaatsagacaagacaaaaaagcttttttactatcgtctcctaatcctctaccctagaggcagccctgttacaaaattttatgtatctttccagaactatgttacgtgtttacaagtgtaaatatgtgtgtgtatgaatagacttacataaaacaaatcataggatacctttttgcataacaacctatcttggcaaccattaccagtccataaagactcacatcctactttttaactgctgtattatatcccatggtttggacatcctgtaattcgggaattaatttatcagttgtgcaaattcag

SEQ ID NO: 40727 - DNA, 601 bp, Human
aagctccacctcccgggttcacaccattctcctgcctcagccccccgagtggctgggaccacaggcgcctgccatcgcgcctggctaatttttttgtatttttagtagagaccgggtttcaccgtgttagccaggatggtctcgatctcctgaccttgtgatctgcccgcctcggcctcccaaagtgctgggattacaggtgtgagccaccgcgcccggccgaaaaagtcttgagtccttataataatttgccaggtgggatttttggtaatatcccccatacactatttcaaagccccayatttattaccttcatatttaattttgccctgggatttattattatggcttaaatttttattgtttcagaagtgtttcaatggaaaggtaattataaattagtatcacgcttcctttattcctatttggttaatcacttaattgtcactgcattatcaagtctccatgatgtatttttaacatattattattttaacaggtaatgcatacaaatttaaaaatgagacaagacaaaaaagcttttttactatcgtctcctaatcctctaccctagaggcagccctgttacaaaattttatgt

SEQ ID NO: 40728 - DNA, 601 bp, Human
tctttttttttttttttttttttttttgagacagagtctcgctctttcgcccaggctggactgcagtggtgcgatctcggctcactgcaagctccacctcccgggttcacaccattctcctgcctcagccccccgagtggctgggaccacaggcgcctgccatcgcgcctggctaatttttttgtatttttagtagagaccgggtttcaccgtgttagccaggatggtctcgatctcctgaccttgtgatctgcccgcctcggcctcccaaagtgctgggattacaggtgtgagccaccgygcccggccgaaaaagtcttgagtccttataataatttgccaggtgggatttttggtaatatcccccatacactatttcaaagccccatatttattaccttcatatttaattttgccctgggatttattattatggcttaaatttttattgtttcagaagtgtttcaatggaaaggtaattataaattagtatcacgcttcctttattcctatttggttaatcacttaattgtcactgcattatcaagtctccatgatgtatttttaacatattattattttaacaggtaatgcatacaaa

SEQ ID NO: 40729 - DNA, 601 bp, Human
agaactagattttctgtatccactgattatctcatacccacctttaatagatgactctgaaatgtaaacagggtataaagctggagttcatgtcgaacgtgtcctaaaatgtttcacagtctacctaggagtctctgaagtcaaacattctctgtgtctgaggtgtatgctgccagaatcccttgatggaattacagccacaaagggcagtgaggggcatgttctgcttcaagtcccctccacagcaggaatctttgcagcagccaagaattagttgcaactgtctcaacttttttaggartatcttttaaaaccagatgattttctcggttagccttgccgcatttggtcaacagatcagagaatttagaagtaatatatctccacgtccccctggaacacaaacctatcattttctaggcagaatcatcagagttttccagcagagttttgctcctccataggcccccaagcagaatgatattgaagaagggattcacaaatgaagtactcgacgggattcatctgaggctggttgggaaggcagtgtcactcttcagcaccacgctgcccaaactttattgctatcagaatcacctgg

SEQ ID NO: 40730 - DNA, 601 bp, Human
ctcaccagtaaccttactctctccttccagatgggcttttatcttttcttatggaactcatcctattctacttgtactatatggtaaacttgcttttctgacccttctgattggattacagaagacagagactctgtcttactttgggccacgaagtgaccagcacatagaaggtggccaatagtactggttaatgtgaataaaactgcataaagaaatgttgccctgtacacaggaaaatgtcaaaagagtggctttcttcagtgtactggttcagagctggtgggatgtgggagggccyattatttagtcgtgagaagaaatggcacagacacgccttttttggctctcaagaaggaaaaggaagaggaaaaattgcatattttttttctttgtgacttacaagaaattagaactctatttaaagtgagtaattggcattttggctacaaggaacagttctcaggaaaatgaaaaaagaaataaaatctaagagtaagtaagcacattgtaagtgatattaacattttagaagatgctatggagcttcttgcagggcataaacatatgtctgtctgtccgtttacaactgaaagcaggt

SEQ ID NO: 40731 - DNA, 601 bp, Human
cctttacctctctctgctcctatttaaacatttcacagtacgatagctagcctattcctttgcctctccttctgtgaaaaacaaataacaaccagctctaccttctggcctaagaaaatttttccacccatgttttttactccattcctacctgactcttacagaacttgatatcaacatccttttactcaccagtaaccttactctctccttccagatgggcttttatcttttcttatggaactcatcctattctacttgtactatatggtaaacttgcttttctgacccttctgattgsattacagaagacagagactctgtcttactttgggccacgaagtgaccagcacatagaaggtggccaatagtactggttaatgtgaataaaactgcataaagaaatgttgccctgtacacaggaaaatgtcaaaagagtggctttcttcagtgtactggttcagagctggtgggatgtgggagggcccattatttagtcgtgagaagaaatggcacagacacgccttttttggctctcaagaaggaaaaggaagaggaaaaattgcatattttttttctttgtgacttacaagaaattaga

SEQ ID NO: 40732 - DNA, 601 bp, Human
gactgctgaacacatgcagggtgtgttgaaagactgaaagataaaccaagagcaaacatgtcatcactgaccaagaaaggttctctcctcaagtcccaaatttcatctccactcccaccttctgtgcaaaataccttctgtccgaattccccaagatcaaggtaggcacctcctttacctctctctgctcctatttaaacatttcacagtacgatagctagcctattcctttgcctctccttctgtgaaaaacaaataacaaccagctctaccttctggcctaagaaaatttttccacccrtgttttttactccattcctacctgactcttacagaacttgatatcaacatccttttactcaccagtaaccttactctctccttccagatgggcttttatcttttcttatggaactcatcctattctacttgtactatatggtaaacttgcttttctgacccttctgattggattacagaagacagagactctgtcttactttgggccacgaagtgaccagcacatagaaggtggccaatagtactggttaatgtgaataaaactgcataaagaaatgttgccctgtacacaggaaaatgt

SEQ ID NO: 40733 - DNA, 601 bp, Human
tggagtcttgtagaatcactattaaagtcccagcttcacttagggcaatactatggcatatgcctaaaagaataagcaagtatgagcacacacagcagtgccctgtagcatgcaaatgaacaaagggtgtgcaaagcaacagggaaaagcatgtataactcagaaatactctgtgctccctgatgactaaccagacaaccttgatagaagcccaaacctattatattagtggtattgtctcagaaagggagtgaattctgcttggaagagagaagtagggaagtcttcacagaggaggagytcagcctgagaagaactttaccagataaacaatcaggttcaaagtgtgctgtcaagaggggaaagcagagcgaagccccagggctgtgacggtgaatgccttgtgctggttacaaaaagtcacccactagggccagaatgtaaggagtaggaaggaaagaaacaaggcatgaaggtggatggctgagagcaagagtttgaagctctgaatgacctaggaaggaggtcacagacaaaagggaatcacccaatgcttttgtgtaagagattgcattcacaatctggtctctgcaaaatcttt

SEQ ID NO: 40734 - DNA, 601 bp, Human
aacatgaaatccattatcttcaacctagatgttgggtttccctactcaccacctccctgtcgtccttcatgcaagggtgtccctcatgaatccacatatgtggtctttccaccaggaaaagtaatcgctcatttctatgccttcgtaagtatgaatccttccacctgaaatggctttgtccttagcttctaggcattcatattgttatcctccatccctccttcctaatcagaaaacagaaacaaaaataaccgccataaaaaggactacactgaatcttctctgtggtttcccataatayaatcacccctctctgtttactgctcttttctacatcttgctttttggtgaaaagcagagagaagcctaagaccagtggtctggtttttgagaatctgatctaaatggtacgggtagaaactaggcttcaatatttggaaaacctccctcggtgattcaaatgtgcagccagggctaaagccacagtgagatcaactcttctcagtccactgtataagtcaccagccaagcttgggaaataccttaattatcatccccagacctacaaaattagaagctctgaagcctagacatttgtatt

SEQ ID NO: 40735 - DNA, 601 bp, Human
ggtgggatgtaacatttgtgatttggcctaattttagcctatctatatgtttctaccttaaccacagggaaatcacaaaatattatcagatacattgctgaaatttagacacaagttgtctatggaattttccaaagctatcactataataaccccatccaataaatgaaatgagacacataatacacatttatttttaaggaactcatgctagctctttatgaccactattttcttttctaattctacataaaacatctgtttaattactgttaggataattttgtagaggttgccattracttattaagctgtaagttaacctacccaattttttttaatttttattttagagacagggtctctttttgtcactcaagctggagtgcagtggtgcaatcatagctcactgcagcctcaaattcctaggctcaagcaatgctcccacctcggtgcctcaagtagctaggactacaggcatacatcaccatctctgacttatctatttatttgtagatatgggatctcactatgttgcccaggttggtctcaaactcctggcctcaacttatcctcccacctcagcctcccaaagcactga

SEQ ID NO: 40736 - DNA, 601 bp, Human
aaaaaaggtaaatctaacatgtttattagagattcaaaaaaagaacagagagaattgaagagagaattgggtacagacaatatttaaagacatattagaaagtcattaaaacccaaacaaaaggaaagctgtgttcataccatggaagactcaatattttgaagatgtcaattctccctgaatgatttatggatccatacaatttcaatcaaaagtcccacaggcttttgagggaacttgacaagctaattctaaaatttataaggaagaacaaagaacaaaaggagttaagactccctasgaaaaagatttggaagtagggaaggcattagcagatatcaagacctgttataatccattaacaattaatacagtgtggtattaagacagaaataaacaaactgaccaatgaaacaaagacagtcagaaacagaccaaaaaatacatagaaacttgatttatgacagaactggcattacagaataatgagaaaagatacactttacaacaaatgttcccacaataattgcttatccttatagaaaaattaaataaaattgtatttatacctcgaagcatatatacatttgatcccaggtag

SEQ ID NO: 40737 - DNA, 601 bp, Human
actaaatagagaactactggcattgtaaagtggaaagtggactggacagaaaaccagattcaacgcattaactttatgactctgggcaggtcacttcgctgctccaacccttcttttcctcaactgtaaaagagaagactacattttacaggaaatatgagactataaactactttatataataaaaatatttgtttttaaagcttcagtgtacttgatatgataaaataatgaacatctactcttaagcagagatggatttattatgaaactaaggaagcttaaatttcagggcctcttkctcttatgggccactgggtactgggagtcacagagtttcgtgtgtagggagaggagagaggatacagtcagcatacagtcaacagtatacatacatttatatgtaaacacttctggcatattgtctaaagtgatgtcagcaaaaatgaaagactaaatctgaaagattccactcatcttaaagactacaagaaaaatgttcgtcttgaatactggcactaagtgatggaaggaaaaacatctttccaacatatctgaccacacactagcccttacatgccttcgttctctaggttatcca

SEQ ID NO: 40738 - DNA, 601 bp, Human
ttcttatttctctgatattcaatgtgatcatgaaattaaatatggaacatgcagtaaagatataaccctgagagagggtcaggaggaaaacaataaaacacttaaaagcatctttatttatgagcccacaaaacaatcatttggaaactcatctttttaagctaatttttattgcattcctactaggcaccaagcatgctagtctattaaaactcaggtctatgctaattttaatagtggaatcaccacccagattagcaaatattcagaaatatttatcttttttaaagataatttaaargataatttaaagataaatatttaaatatttatcttttttaaagatcctggctactatattgccaggatcaaggtttgtttataccacaatttatcaatgcccccttacagggcctttttacccaaagatacaaaccactggggtctcctcttttctgtaacttttgatgtatttccttttccttgttctctaggtacattaaaatagctacacagatgaaatatgcagaccaccaagggaaaatatgaagtttggcctttagttccagttaaaacaaaatgttaggtcttataccacagt

SEQ ID NO: 40739 - DNA, 601 bp, Human
aaggcatccttcatactaatggatggtttcttcagaaaatatggagaccagaaagaaggcagtgagacgatatgttatatgtgctgaaaggaaataaaaacagtaactgtcaaccaagaattttatatccagcatgactatcaatcaaaaatgaagaaagaaattctatgtggatgcttcacaaaagaaagataaatatgcccaataagcccagaaaaaaatgctcaatactttagctatctgggtaatgtaaagtaaatccaaaatgaaatgtgatttcatttcactaaaataaaaagayagagaacactaaatgttggcaagaatgtggaacaacaagaactctcatatattgttgctggaagaataaaatagtaaatcactttgacaactattagacagtttttaatgcacttaaacataaatatgcaatatgacccagaaatttcactcctagatataaaaaattatatataaatattcatagcagctttattcatattagtaaagaaaaagaaaacaattcaactgtccagcaataggagaatggattaaagaaactatggtatatttataaagtgaaatactactcaggaataaa

SEQ ID NO: 40740 - DNA, 601 bp, Human
ctcctccacaaaagcagtaaaaacaacggcaataatgggcaaaatcattttcctcagaactcttgagattatttttcaagaaatcctgcaacaatctgagaagcatttggtcacgaaaaataactaaacctcaataagaacagtgatttttgtggcattttaagttgccctatccccatccttatctctcagctccatagtagcactgaaaaccaacagctccttgatcccagtaaaaaccagcagcctagcagccactggaaagggcaaaatacatttggagcttcccaaaaaactatgytcagacaactgtcgtaatgtgccatgtctgacattctctgaaaacccccattccatggcttgtttttcttcaacctggctcagactccactcagcactttcaccagcggcatttgttgaaaacaatcagttatgaatttttaacaccatagtggcctaagatgatgataacaactggggcaaataagaaactaagcaaaaatcttaaaaggaaaaactggaattaagctgtacacatatgttgtttcagaaagcttcaacgtattcctaaaaatttagaagaccatgcacaggtggaaga

SEQ ID NO: 40741 - DNA, 601 bp, Human
aatttcccctacctcactagcaactaactcatcattaactagactctaatacttcacatgtatcctgcaggcctacttgcagaaaaaaaaaattgatgaggaaaaaaaaagtcctcagtctgataaagaatacatatgaaaaatctataagtaacatcatacataatggtacagaactgagtatcatctccctaacattcaaacaaatctgggagtctgccctcaccacttttattcaacattgtaatggaagttctagccagtgtaaaaagagagggaaaataaagttaataataataaaaaaggcatacatattgggaaggaaaaagtaaaattatcttcatttgcaaatgtcatgattacttgaaattccaactaatctgcaaaaatcaactcattctacagaatgagtaagtttggagtcatagtgtacagacactatatacaaaagtcaactgtatttctgtatatatgcaaccacaaattaaaaaataaaaatttaaaaatactgttaacaatagcactaaaaaacatgcattattaaaggacagatacaataaaatatttgtaagaccttacactgaaaactataaaacatcac

SEQ ID NO: 40742 - DNA, 601 bp, Human
atagatataatgggatgtctgtggtgacaggcaaagacctaactacctacttcgatgtcaggcctaggcacaatggttaagcctacaaagaccccagagcacacctatgtgttgaggagacacactgccagggtgtatcagtgccagttgtatcagtgaggtgaaggtcctggaaggaaacagaagtcatcccagatgattcaggtgaagatactttagcaaaataattacttaaaagtagagctggggaacacagcattacctgatctcaagacctgcaatatagctaaagaaaccaagrgcgtgtggttttggagaaaagggatgtgaaggtacccagagacagatgaatggttgtcttggtgcagtgaactgaaagtagtatcaaaaaatttaaatctcagcctttttcatagcagataaaggaagtctagccttatcaatctcttctcacatttcttatttttcaaattttaaaatcacttttgcaactctaccaaattctttctgataccaacctggctctcagctatatcttttagtgctaggtaaaaaataaagtgccatggcagagcgcagtggcttatgcctgtaatcccag

SEQ ID NO: 40743 - DNA, 601 bp, Human
tcttgtgtcagagacaatacctcggaaggggctcagatgtggaccagcagcagccaacactcccagcagcggtgaaatgagtaccttggttctgagaagccctgtgggcagcaaaccacagcacacctcaaatatgcatagcaagtttatgaaatggatcgttttgctatgcccattttatgaatgggacgattgatattagaaagtttaagtaatttaggtaagccatacagtgaatcagtgataaaaccaagactggagcccagatgtctggctccaaaggctctctcactctgtattygctctgaaaggaagggagagagaagggccacacaatagaaaggaagggaaggatccacaagatggtataataccagggcatgcaatggactaaatgctgtccatgaaatgctatcttagtctgtttgggctgctctaacaaagcaccataaactgggaggcttatgaacaacagacatttatttctcacagttctggaggttggagaacccaagatcaaggtgccagcagattcaatgtccggtgagggtctacttcctggtcatagaaggtgtcatttcactggatcttcacatggagg

SEQ ID NO: 40744 - DNA, 601 bp, Human
aattaatggttatgtagtcagatagcttgatgtcttttagcctcagtttccttatacgtaaaataaaaatagcgcctaactcagagaatagtggaaaaaaattgggcaggatgcttggcacagagtaagcacaatcgatagttgctgctattattgttcgtacacacatcagcgggcccccacagcaccagccaaagctaggtacatggtaaatctctgaataaatatgtgctttttgattgctctcaaaacagtctaagttccctggacacttctgttcattcaacaaacatttgacaarcttccaccacgtgtcaggcagttcaaaggggttattcaaacagaagatttcctcttctagtcagtaaataattccacggttgccaaaggaatcattcttcttccctgcctaacccatcttcctaatacaaaatcagaaagcaccgcacactttcctcagacagatttaccatcatattaaacacatgcaaatgtgcaatccaaatgccattggaagtatttattatattcatgtaaataaatgcaatgcccaaaagacttttttttttttttttttttttttttttttttgcttaatgtg

SEQ ID NO: 40745 - DNA, 601 bp, Human
catatactcttcataaatagaaatttaaaaatttatggaaggccgggcacggtggctcacgcctgtaatcccagcactttgggaggccgaggcgggcagatcacaaggtcaggagattgagaccatcctggctaacacggtgaaaccccatctctactaaaaatacaaaaaattagccgggcgaggtggcgggcgcctgtagtcccagctacttaggaggctgaggaaagagaatggcatgaaccccagggggcggagcctgcagtgagcggagatcgtgccactgcactccagcctgggygacagcgagactccgtctcaaaaaaaaaaaaaaaaaatttatggaaaacatgcaaataagccagagatacccttttctaattacccactttgcaaatttctctcaatttcctctggttccagtttcagtctgattgtaggtttatgtggctcccgttttctatctatcctcatcttgccagctccctctctgggtgatgctgcacgtgagaacagaatcaggattcttcttgcagagcagaaaagcaccagagaatcaggaagtctcttacccagaacacctcctaaagattgacacatt

SEQ ID NO: 40746 - DNA, 601 bp, Human
ataagaaaatagttttattatatctcagacctcaaatataagttagcgaaagttatttttctatttgaatttatcttgctggtagatgacgaatttaagagtctagtagaacttggtgtgtggttgggagtgggatgagggggcagtagttttatgctgcaatttgctcctattaaaaaaaaatcaatggggtttcaacttgttctttccttctgctcagaatcctctcaagcccacggtcagcaaaaccatgaaatgccaatgattctttctattaatttcacaacaacgcttcataggrgatggctataatcacaaatgcttctttgaaaagaactgtgatattaactgtgaaatagatatgaaaagaaaatatcctataatgcagtttcaataatacaacatcacagttaatatcaattacctgaaagacctctaatatatttaaaatataaaagccattatacattttaagtagcatcatattattttcttcacttcattcaataagactataaactcctaaaggacagggctcaatccatctactaatcttaattacattccagccctggggtagacacagtctatattcaagaaa

SEQ ID NO: 40747 - DNA, 601 bp, Human
attcctatacaggaagtcccagatatagggggtaggtcttcagtagttagaagcgatcacatcgagcttgctggtagcctactttcaaaagctcccactgggtaacagacaatttacttgctttatataatccccgaaagggtcattatgaagatggaggcctttaatgatgacacaatattctcgttcctcactttcaccaaggcaaataattagcaacatcaattttggcccctcaccccaaagcatattccatatcatcgagcaataagaaagtaacagtggaagaatcttatacagkgatctttcatctcaaaacagttttcctccacctatgttgaaggaacttctttagcatttttattaggattttctctggctttgaagggctctgtatggggactctgagctacagttttcctcataagaaaatcagatctctgaagagtcagaatacacaggttctacatttgattccttaacagtcaccacaacctaaattaagtgtccttacaaaaaataccaaaccacacccaagtgcaaactcttagaatggctgaagaatttctaaatcttggtttaatgagaaaaacacagatct

SEQ ID NO: 40748 - DNA, 601 bp, Human
aatttaaaagctttcttgaaccctgaagggcaggtaatcttttcatcctgctcagcgacctctgcaaactccctccaaaaaataatttgtaaagttgagcaagatgaacagtagcccccaagcctgaggaaacactgagtagaagccagtaagaatccaggattgtgcaaccattaatcaattaccaagtatgtcagagagctcagcaagtgtctagacctttgggtttttttttttttttttttttttttttttttttttaagtctcttgtattcctatacaggaagtcccagatatagkgggtaggtcttcagtagttagaagcgatcacatcgagcttgctggtagcctactttcaaaagctcccactgggtaacagacaatttacttgctttatataatccccgaaagggtcattatgaagatggaggcctttaatgatgacacaatattctcgttcctcactttcaccaaggcaaataattagcaacatcaattttggcccctcaccccaaagcatattccatatcatcgagcaataagaaagtaacagtggaagaatcttatacagtgatctttcatctcaaaacagttttcctc

SEQ ID NO: 40749 - DNA, 601 bp, Human
gactaaaagcaagaaaaatgggctcatgaggtctcctactgaaattcctccattttccagcaaagcattctccaagctggttacagctgaaagttcactgttattttgctttcctctcgagaatatcatcctttccctatcctccttacccctgcagaggactacatgagtttgaggttctaaatgggaaaagactgctttgcatctgccaagaaattgcacattcaataacttaccaagacccacagtaagataaagcctaaaaacactaattagattttagatttgttgagtggaacayaacagaattcacgtcagaaaggagggtatgaattgggagaggttgagatagtcagccctgatcttggtctgcaaagaaatgaaacaagaggggctactttagcaaagcaaatatgatcattgctgagcaaagggaagggaagaacggttagagcatagtggtgagaataagaacagcaagaagaagaaaaaaaaagcagagatcacctagggagatctgtgggatcatcaggaaccgtggaagttcaatttctgaatggcctcccaaaaaatgtctcacaagggtctagagcttaaacat

SEQ ID NO: 40750 - DNA, 601 bp, Human
gtaacaatatctccaccaagggagaagctgtagttcaagcacatccagtcttttgccaggcacttcataaatgtgggcagcatttacattggtatgcatccaagatgtaaaataaggatattaataagtgtgtgctgagaggagaggaagaaatgctataatacagaggatatcaaatcatggcatgggttacctttcccccaccccacctttctctttcatatggagaaaaagaacatggattatcccttctattcagactcaactaaaagtgctaaacaaggttcatcatcagggaagsctggcagaacttcagggaagcccttctctcccttgataccttttcctcatattgcttcaggaagggacaaagcctttgggtctacagttagaaacagttactcggccaagaactcgactcactgaagactctcaataaatgtgtttaatcaactaaagagtttcagactataatcttcaagtcaagttaatagtttttgtgagtgtgttatggttaaaatgttaacatcagctcatatacccaacctactgatgccagacccatctgcctttggttaagggaggaaggaaaagcaataga

SEQ ID NO: 40751 - DNA, 601 bp, Human
tgcagcctcccaccactggccaaaaataccattttgatgaaatattagagtacatacctctctataggaatcagaaaataataccttgtgccaagctctggctcaggcaggacacttcttttaaaaagcattttctgataactatttccaacatcaaatgggaatggaatgtccttttgttgcattccagtgacgtcctcatttccctgtattttcgtgttgatttcctttctgcccacaggattctaagacccttgaaggcagaaaccgtatcttcttcacctcagaatcccaagtaaccaatatagattctagtacaaagcaggaactcaacaaatgtttgatgaattaatgaattcatcaattactttaacaaataaatctgctggctgcacagtttacaaaaaaaactttttcacttattgtcacattcgatcctaacaatgtccatgaaatagggccatgattatccccatctacagatgaggacgttgaagctgaaagaaatcagtgacttacctaatgtcacacaaaagggcagagaagggatttaatgaatgttcgcctctaaatgattaaactacccctggaatgtctcacc

SEQ ID NO: 40752 - DNA, 601 bp, Human
agagcagagagaatttccacccaagagtcaagtggggaaagggaacaacaggaccctcgtcgtccctgctggaccccatctgccactgtggtcaagaccttcagaagcacaacttagcactattggggccctctaccttatcaaaggcaagagactggagttccccctaccttttttataagctcctgccaccttcctttttatttgaaagaatcaaagaggctccaacccttttcattgctcaataaatagtaatactgaattaaataaagattgctcatttccatacattgagtccagmagagtagactaatggtagaagatgagggaatcaaacaagagagtggaggagagggaatggcacagagaggtgactgtttttgcaccttaaacagaacaaagaaatccctggctggctccttgaacagaagagcatactaaagtaatacaagtaatctagttttagccaaagaaaaagtcactgaaatatttttaacaatcggctttttcctcttttctgaaacaaatgctttacacgattgtaataaatgagtgtagtgtgttggtcacggtttgctttctgtttgctgacaccaaaatc

SEQ ID NO: 40753 - DNA, 601 bp, Human
cttctcctcaaagccttttgccaaagtatatttaggaaatacttgtgtcccttcagatgactttggcacataggctagtgtcagaacacggcccttttgggattccacaataagtagaaacttggggactaagatcctaactccaggttcactctgactttgcaacttcagacacaccatgaacgttttttttaatctttttccttacagatgaaggaagaagaatagagtaacagaagccagagaatcatagtagtagacgcctttgagatgacccccattgattcccctgagccaaagygttacagagcagagagaatttccacccaagagtcaagtggggaaagggaacaacaggaccctcgtcgtccctgctggaccccatctgccactgtggtcaagaccttcagaagcacaacttagcactattggggccctctaccttatcaaaggcaagagactggagttccccctaccttttttataagctcctgccaccttcctttttatttgaaagaatcaaagaggctccaacccttttcattgctcaataaatagtaatactgaattaaataaagattgctcatttccatacattgag

SEQ ID NO: 40754 - DNA, 601 bp, Human
attatctgtggaacagacatgcttctaaatggactaattcactctaaactgggaacttggaatccatcccaggagatgagaatattttttccttcttaggcattacttccttcctttctagtaatttaacttgttttaccccaactggcttggctgacaggcatcatccagtgtcagagggggcagctgctgcaggctgtcactgtggaagtgaaaagatgatgtccttgtgaagagtaggaaggccaaagtactgtgtgcgccttaaaatctaacacaatgcattgaattaggaaggaartttaaagacagttacttgggattaaaacggcataaatccatttatttttcaagcagactttggagtcatgcctaccaagcctttcaggaactagagattatctgagtgcctgtcaactcccagcgaaatatccccttctcactgattgagcagaaaaactgtaatcaattcatcccctgacatcagtaaccaagcagctactaggtctatgatgctgcactctccactgtgaagagaaaacaagcagaaaacattgcccctccttttaagcagcctgaaatctgacagccacaaataaga

SEQ ID NO: 40755 - DNA, 601 bp, Human
caattacttactatacgctggacagtgcatctaatttcggagtcttgttttcttctgctctgaactctgacaccctctccgatttatttaacgttagtataaatttagtttccgccaaaagagagccatgattgtgcctctcccttgttcagaatgcttagatgtttccctatttataaaataaaatccaaattcaacctggcatactagactccaataacagcatcaatcactcttttatccttgtcactcttttatccttgtcactctttttgtttgtgtttgtttgtttgtttgtttttttttgagacagggccttgctctgttgcccaggctggactgcaatggcatcaccacagctcactgcagcctcaaactgctggattcaagcaatcctcccacctcagcctcctgagtagctgcattacaggcatatgccaacacactgggctccctgtcactcttcttgaaacatacctcgcatttccctttttggtgccacgtttttgttcattctactgtccctacctggaaacatctttctctcttctctacacatgcatctcgaaataccatctcaaatagtatacaactcaaagag

SEQ ID NO: 40756 - DNA, 601 bp, Human
tgactacccagccaaccacctggaatagtcttggtctatgacataggtgagacactctcttgtattaagccattatacatttgagtctttcatttgctgcagagcctcatttaccccagcaaatgcaggcctcttccctttgcttttatttttgtctaggtttcttttcattatctgaatatacccccaattacttactatacgctggacagtgcatctaatttcggagtcttgttttcttctgctctgaactctgacaccctctccgatttatttaacgttagtataaatttagtttccsccaaaagagagccatgattgtgcctctcccttgttcagaatgcttagatgtttccctatttataaaataaaatccaaattcaacctggcatactagactccaataacagcatcaatcactcttttatccttgtcactcttttatccttgtcactctttttgtttgtgtttgtttgtttgtttgtttgtttttgagacagggccttgctctgttgcccaggctggactgcaatggcatcaccacagctcactgcagcctcaaactgctggattcaagcaatcctcccacctcagcctcctg

SEQ ID NO: 40757 - DNA, 601 bp, Human
gctagaggctattgtcaaccaaatgggcagtcaacgctgtctacaggaccaacccccacttaaaactctggacatcaaggttcgaatgagcttccctgcttggctctatgccatgtatattatagcacatggttgctgggagaagttagctagtgaaccatgattctacgtggaaaggactgtaataaaccacaaatgtgagtattaacagctttcagggagttctatgagtgtttctagtgagttactgaagctgagtgtggtcttgggggtcccgaacttgcaactgatgtcagaagasagggtagtcttggggactcttgaatcctgcataaagttgtctagcctgggtggcattagcacaagaatgcagtagacaaatgaactatttttgttttcttcctacaattctcaggaacccgtctccagctccatattaatcaatgtgagctttggagtcagacttattgcccaatagttgtatgactcagggcccttctcactttcctagaccctattttactcatcagtcacataaaaatcactgtacctcccttacaggactacaatgatgtttaaacataaaaatgcataaagccca

SEQ ID NO: 40758 - DNA, 601 bp, Human
ctactgataaagcaatgagctttcagctccaagaaagtaatctctaagcccatggaaagtcctgcctgataaaagtgtttttgtttgtctggcggccttgggccataaggtatcagcttgacccccagaggggctagaggctattgtcaaccaaatgggcagtcaacgctgtctacaggaccaacccccacttaaaactctggacatcaaggttcgaatgagcttccctgcttggctctatgccatgtatattatagcacatggttgctgggagaagttagctagtgaaccatgattctaygtggaaaggactgtaataaaccacaaatgtgagtattaacagctttcagggagttctatgagtgtttctagtgagttactgaagctgagtgtggtcttgggggtcccgaacttgcaactgatgtcagaagacagggtagtcttggggactcttgaatcctgcataaagttgtctagcctgggtggcattagcacaagaatgcagtagacaaatgaactatttttgttttcttcctacaattctcaggaacccgtctccagctccatattaatcaatgtgagctttggagtcagacttatt

SEQ ID NO: 40759 - DNA, 601 bp, Human
tgaagtccaaaatgtagcagtgggtaaaatgtcaaaacctactgataaagcaatgagctttcagctccaagaaagtaatctctaagcccatggaaagtcctgcctgataaaagtgtttttgtttgtctggcggccttgggccataaggtatcagcttgacccccagaggggctagaggctattgtcaaccaaatgggcagtcaacgctgtctacaggaccaacccccacttaaaactctggacatcaaggttcgaatgagcttccctgcttggctctatgccatgtatattatagcacatkgttgctgggagaagttagctagtgaaccatgattctacgtggaaaggactgtaataaaccacaaatgtgagtattaacagctttcagggagttctatgagtgtttctagtgagttactgaagctgagtgtggtcttgggggtcccgaacttgcaactgatgtcagaagacagggtagtcttggggactcttgaatcctgcataaagttgtctagcctgggtggcattagcacaagaatgcagtagacaaatgaactatttttgttttcttcctacaattctcaggaacccgtctccagct

SEQ ID NO: 40760 - DNA, 601 bp, Human
gaaagtgaagtccaaaatgtagcagtgggtaaaatgtcaaaacctactgataaagcaatgagctttcagctccaagaaagtaatctctaagcccatggaaagtcctgcctgataaaagtgtttttgtttgtctggcggccttgggccataaggtatcagcttgacccccagaggggctagaggctattgtcaaccaaatgggcagtcaacgctgtctacaggaccaacccccacttaaaactctggacatcaaggttcgaatgagcttccctgcttggctctatgccatgtatattatagyacatggttgctgggagaagttagctagtgaaccatgattctacgtggaaaggactgtaataaaccacaaatgtgagtattaacagctttcagggagttctatgagtgtttctagtgagttactgaagctgagtgtggtcttgggggtcccgaacttgcaactgatgtcagaagacagggtagtcttggggactcttgaatcctgcataaagttgtctagcctgggtggcattagcacaagaatgcagtagacaaatgaactatttttgttttcttcctacaattctcaggaacccgtctc

SEQ ID NO: 40761 - DNA, 601 bp, Human
cacttcttcgcaaggtatcctgaagacatcaatccacacaacctaaaatattctactactgggaacttttctccaactctaagttataaccatttatacagaataatgccttttcattttgttattctttaatttattcaacaattctttattcgataacactggtgccaggcactgagattctgtgttaatcaatggagaaaaatctaccagagaagatggaactagatgcataataacagcagccaatatgagggaaaccacagcaaaatcccactaactactttagaaagtgaagtcyaaaatgtagcagtgggtaaaatgtcaaaacctactgataaagcaatgagctttcagctccaagaaagtaatctctaagcccatggaaagtcctgcctgataaaagtgtttttgtttgtctggcggccttgggccataaggtatcagcttgacccccagaggggctagaggctattgtcaaccaaatgggcagtcaacgctgtctacaggaccaacccccacttaaaactctggacatcaaggttcgaatgagcttccctgcttggctctatgccatgtatattatagcacatggttgctg

SEQ ID NO: 40762 - DNA, 601 bp, Human
tccatattccttcttatgggactctatcttggaaattatagatttatatattaattgtatattttgctcatttgcttaaaaggagctctgagctgttagggaaagtattgtattagattaaccataaagaaacaagactaagtctccatggcttacaggaaaattactcttgtttttattttattcatcagatgtacatgggcatgtaattattttttatgggggatactatggactaaactgtgtctcctcaaaaatcatatgttggccagacacggtggctcacacctgtaatcccagyactttgggaggccgaggtgggcagaacacttgaagtcaggagtttgagaccagcctggccaacatggtgaaacctcatctcaactaaaaaaatacaaaaattagctgggtgtggtggtgggcgcctgttaatcccagctattcaggaggctgaggcaggagaatcacttgaacctgggaggtggaggctgcagtgagccaagatcatgccactgcactccagcctgggcgacagagtgagactccatctcaaaaaaaaaaaaaaaaaaaaaaattccaatgttgaatccctcaccctcaa

SEQ ID NO: 40763 - DNA, 601 bp, Human
aaatacaaaaatcagctgggtgtggtgacttgcacctgtaaccccagctactcaggaggctgaggcaggagaatttcttgaacccgggaggcggaggttgcagtgagccgagatcacaccactgcactccagcctgggcagccgagcaagactacatccaaaaaaaaaaaaaaaaaaatcggagactctcaagtccaactccaagcatactgaatcagcatttggagcaaagagggaaacaggagtgtgcattgttaggtttcccaggtaatgtttgtttattgttataaagttagagtcrgtggattctacctctatgacttttccatttctaacaacagatagcaagtcacttctcttttcttcaaattaactcttcaaatactggaagacatctctctgccttcgctcctaatactcagctgtagcccatgtaacctaacatttctttacaacaagcttccatcccctaaaccaacttgggcaccccactctgggtcctctgctgcttgccaatgtctctctcaaaatgggatgcccagagatgacatgcgcctcacagtgcgaggtggggagagagactgagaggattttcagtgct

SEQ ID NO: 40764 - DNA, 601 bp, Human
actgcaaacagagcatttaaactaaagactcgcctggagatctctgtgacctcttgcccaaagcagctgagagtccccaactacagcatcctttaaacatggccacccacgttatccacaaacacacatcccaccagtcaatctctccaggcaccttgttcgcttgctgggaagctcaggctgacaaagttctttcttatcatacggtatttctcaaagttaggtttgcgacccatctgcatcagaattatttgaggtgctcgttaaaatcacagactcccagccaggtgtggtagctcgygcctgtaatcccagcaatttgggaggccgaggcgggtggatcccctgaggtcaggagtttgagaccagcctggtcaacctggtgaaaccccgtctctactaaaaatacaaaaatcagctgggtgtggtgacttgcacctgtaaccccagctactcaggaggctgaggcaggagaatttcttgaacccgggaggcggaggttgcagtgagccgagatcacaccactgcactccagcctgggcagccgagcaagactacatccaaaaaaaaaaaaaaaaaaatcggagactctcaagtccaa

SEQ ID NO: 40765 - DNA, 601 bp, Human
aactgcaaacagagcatttaaactaaagactcgcctggagatctctgtgacctcttgcccaaagcagctgagagtccccaactacagcatcctttaaacatggccacccacgttatccacaaacacacatcccaccagtcaatctctccaggcaccttgttcgcttgctgggaagctcaggctgacaaagttctttcttatcatacggtatttctcaaagttaggtttgcgacccatctgcatcagaattatttgaggtgctcgttaaaatcacagactcccagccaggtgtggtagctcrcgcctgtaatcccagcaatttgggaggccgaggcgggtggatcccctgaggtcaggagtttgagaccagcctggtcaacctggtgaaaccccgtctctactaaaaatacaaaaatcagctgggtgtggtgacttgcacctgtaaccccagctactcaggaggctgaggcaggagaatttcttgaacccgggaggcggaggttgcagtgagccgagatcacaccactgcactccagcctgggcagccgagcaagactacatccaaaaaaaaaaaaaaaaaaatcggagactctcaagtcca

SEQ ID NO: 40766 - DNA, 601 bp, Human
atcgtagatgatggattcactcctcccctgagcactctgcctgtactttgtttaggagcctgcaggtagtacctggttatggtaatttagtcccagccccaacaggtaggctttcttcaaaggtggttcattaaaagaaattagaatataaatacatgatctgcttatgcatacttttttcccaaaaaagactgttgttctaagaaaactgcaaacagagcatttaaactaaagactcgcctggagatctctgtgacctcttgcccaaagcagctgagagtccccaactacagcatccttkaaacatggccacccacgttatccacaaacacacatcccaccagtcaatctctccaggcaccttgttcgcttgctgggaagctcaggctgacaaagttctttcttatcatacggtatttctcaaagttaggtttgcgacccatctgcatcagaattatttgaggtgctcgttaaaatcacagactcccagccaggtgtggtagctcgcgcctgtaatcccagcaatttgggaggccgaggcgggtggatcccctgaggtcaggagtttgagaccagcctggtcaacctggtgaaaccccgt

SEQ ID NO: 40767 - DNA, 601 bp, Human
ctctgttccctgcagctcccagcttctgacaccaacctgcctgtctgctcacttacacctcaaccacataccactcaacctaaacactcaagcctgctgtagacgcacctgtgtgcatacgtgtcagtgagcctatgtaactgcggtatctgcatggctagataaggtaactcgacttatagaatggctactatattaggttcctagcactgccctaagaaagcaaagaagccataaagctctggatagtgagtaagcctctctgactcttctttatctttaggtagaagtgaacagcccratatgaccaccccaaaaggttgttgttatggatcagagatgatgagtatgagtcctaggaaaactgcaaacattgtgtgagcatttctcaaacacttttccactgaatactaagatcccactcaatggcaatgggtgttctgtggggaacccaaactgggtagcttaaaacaacagaaatgtattctctcacactcctagaggctagaagtctgaaatcaaggtttcaacaaggttgaacacccttttgaaggcttggagggagaatgaatttcatgcctgtctcttagcttctgaggag

SEQ ID NO: 40768 - DNA, 601 bp, Human
actttccatgagtcatcttgattcattagatcctcaatatcctaatggtgaaaaaggcccctggcagagaatggctggcacccaaacaactcagagagcgggctttgcctcctgggctttattgccacacacgtggttccctctgacagcctgcacccagctcagccaaactgccatctggggtgcagatcatgagtctgctgtgccagacaactggcatttgaggctgacagagcaggagcaacatgcaggcagatcttggtgcattctaagtccaatgctggtgctccatgttacacamcagctagacctgaatacgcagatggccagaaagtccccagtaatgcatgtcgggctctgattgcctcatcttctcacccacacacacagatgcatgggaaccagcattttcacaagctgctgcctggtgctcattcttcctgagatgaaacagacaaggtgtaactgggctcaaaatcattttcatttttaaacagcagaaagctgaaagtttccttcaaatagggcagaaagctatgacccttgtactcttcttgaaagtttcttccaagaatctaaggacatgaccagcattcctgtg

SEQ ID NO: 40769 - DNA, 601 bp, Human
ttccagccaatctagtccaggaagacccacagacatctcagtcattgtttactcaacactgtacctccagttggtaatgttttcactgacacatacacacccgcccatttcattttttaatgaggacatcatacccacagagatttgccaggaggctagctgtgtaatatacacattacccacactgtaaacagagctcacttctgccatgccaagtaggtacgacttacccagctaagggaactgagaccctatgagactgtgcaacttgcccaagaaagactagctaagagtggaagtstttctaacccaaagccatctctatgtgttacagcttactgttttcctcttttctttgctagtggtaacctgggggaccaagactgatgaggatagataagaaatatgatatttaacgtgattgcttcatatgatctgttctcatgagatccctaggggaactgactaatgacaaccacacatgaccccctgtgccaagatggcaaaaagcagtctctgttctccacgagaatgaaataaaatgcactgcaaaaggcatggcactggctaaacagggcataaaaccttacacaagtcagct

SEQ ID NO: 40770 - DNA, 601 bp, Human
ctttttcccaaataacttatatgagccagtgcttacttctctacgaaaggtgataaattaaaccaagaaaagtcacttaaaagcattcagtaggggccgggagcagtggctcatgcctgtaatcccagcactctgggaggctgaggcgggcggatcacaaggtcaggagatcgagaccatcctggctaacacagtgaaagctcgtctctactaaaaatacaaaaaaattagccaggcatggtggtgggcacctgtagtcccagctactcaggaggctgaggcaggagaacggcgtgaaccygggaggcagagcttgcagtgagccgagatcgcgccactgcactccagcctgggcgacagagcgagactccatctcaaaaaagaagcattcagtaggttacctcttattccttacattgggacacagttgttatagaacctagcacaaaaacataatttaaacaaatattgcctagaacatgaaacatgtttaaaaattaaaattatttaaaaaacaataatttgctctcatcaatgaatttaaaggccagttgagcttactgccttaaatatcaaacagcacctaagcacccttactaag

SEQ ID NO: 40771 - DNA, 601 bp, Human; identical to SEQ ID NO: 30973

SEQ ID NO: 40772 - DNA, 601 bp, Human; identical to SEQ ID NO: 30974

SEQ ID NO: 40773 - DNA, 601 bp, Human; identical to SEQ ID NO: 30975

SEQ ID NO: 40774 - DNA, 601 bp, Human; identical to SEQ ID NO: 30976

SEQ ID NO: 40775 - DNA, 601 bp, Human; identical to SEQ ID NO: 30977

SEQ ID NO: 40776 - DNA, 601 bp, Human; identical to SEQ ID NO: 30978

SEQ ID NO: 40777 - DNA, 601 bp, Human; identical to SEQ ID NO: 30979

SEQ ID NO: 40778 - DNA, 601 bp, Human; identical to SEQ ID NO: 30980

SEQ ID NO: 40779 - DNA, 601 bp, Human; identical to SEQ ID NO: 30981

SEQ ID NO: 40780 - DNA, 601 bp, Human
gaataagaaggtacaacactactgatgaaaattatgtatagcaccaatgtttggagtgaattttcattacttaatctgtaaatggaaatagagccatagctttcctgtccagggtggaagctggaatccaaggaagggtaatttattatgtggcaaggagacaatcccacccatcccataattgtttgagtcttgaagaattcatggagaagctgcattataaacacaagagatgactataatagtgcaatatttttgaaacatgatgtgacaagctggatcactgacttccccactgacracggacgtgcagcgagctgtgctcatggcatgatggctggctgagaacactggcaggaaaggacacacagcaactcagggtggaggaagcccagttcttcctgttcagttgaccatgccaacaagaggccagaagagagtgcaatatggcactagggaacacttgtctcaaagtataaaatgtttattgattttcttttaataaaatccctcccactccattatggcttacattattgaggtggtgccagctactgggctccagtgaagatatttttccaaagtgaaggacctattcatc

SEQ ID NO: 40781 - DNA, 601 bp, Human
tatctcatctgatctctgttaaatgccacacacactcagccaaacacatatttaaggcaagagaaaatcagtccaaacatcattttattgtttattttaaaagcagaaatggaaaccacaaacactctttaaccataaacacttcctaaaaaatctgtaaagtttgcaagccatcagttggaaaaaaaaaaaaaagttttgctaagtgaagcaattattcttcactccatcccaatgagtaaattatggaatagtgtgtgtgtgtgtgtgtgtgtgtgtgtgtgtgtgtgtgtgtgtgtggatgggggatggagtgaggtttaaaagtctatgaatatgggccgggcgcggtggctcatgcctataatcctagcactttgggaggccgagacgggcggatcacgaggtcaggagatcgagaccatcttggctaacacggtgaaaccctgtttctactaaaaatacaaaaaattagccgggcgtgttggcgggcgcctgtagtcccagctacttgggaggctgaggcaggagaatggcatgaacctgggaggcggagcttgcagtgagtggagatcgcgccactgcactccaacctgggaga

SEQ ID NO: 40782 - DNA, 601 bp, Human
tttaaatattctcctcattaaactctcatcaaattacataatttgaacttgagcattttggctcttttctgccttgaccctgactcttatgtaatcaaggactatgaatgacaatgaaaaaccacagaagggttataaacctagtagcctgaggcattcggctaacgttaaaggaactgagcaattaaatcatgagttatctcatctgatctctgttaaatgccacacacactcagccaaacacatatttaaggcaagagaaaatcagtccaaacatcattttattgtttattttaaaagyagaaatggaaaccacaaacactctttaaccataaacacttcctaaaaaatctgtaaagtttgcaagccatcagttggaaaaaaaaaaaaaagttttgctaagtgaagcaattattcttcactccatcccaatgagtaaattatggaatagtgtgtgtgtgtgtgtgtgtgtgtgtgtgtgtgtgtgtgtgtgtgtgtatgggggatggagtgaggtttaaaagtctatgaatatgggccgggcgcggtggctcatgcctataatcctagcactttgggaggccgagacgggcggatcacg

SEQ ID NO: 40783 - DNA, 601 bp, Human
gtgctagatcaattccatctgcctctcaagttttactctccatccttctctactcaatgactcattgtaaagagttggcttttatggattgcatcaaacaatcccttgtgctatggtttctgttgggtttggccactagaacatgaagatatgtggagctgggtatctactgggtatctatttctccaggctctaggtcaccacaggctggctgagtcttgtgactgaaagttgcagctcctgggaaggggtcctctccatctcctcacctcttcaggcttagcttgaccacagctctctracattagtcacagtgttctccattttttcttgtggttccacccaccatcccccatgcttttcacacattttaaatattctcctcattaaactctcatcaaattacataatttgaacttgagcattttggctcttttctgccttgaccctgactcttatgtaatcaaggactatgaatgacaatgaaaaaccacagaagggttataaacctagtagcctgaggcattcggctaacgttaaaggaactgagcaattaaatcatgagttatctcatctgatctctgttaaatgccacacacac

SEQ ID NO: 40784 - DNA, 601 bp, Human
gaatgaaggcaatgtgtagatctagtgaagatcagagacatgtttacagcaaaagtatgcattctgcctccaaccattgattgactacaggtttgcattaaacaatatgtgctagatcaattccatctgcctctcaagttttactctccatccttctctactcaatgactcattgtaaagagttggcttttatggattgcatcaaacaatcccttgtgctatggtttctgttgggtttggccactagaacatgaagatatgtggagctgggtatctactgggtatctatttctccaggctstaggtcaccacaggctggctgagtcttgtgactgaaagttgcagctcctgggaaggggtcctctccatctcctcacctcttcaggcttagcttgaccacagctctctgacattagtcacagtgttctccattttttcttgtggttccacccaccatcccccatgcttttcacacattttaaatattctcctcattaaactctcatcaaattacataatttgaacttgagcattttggctcttttctgccttgaccctgactcttatgtaatcaaggactatgaatgacaatgaaaaacca

SEQ ID NO: 40785 - DNA, 601 bp, Human
tcagtgtttcataaattttgactgaatgaaggcaatgtgtagatctagtgaagatcagagacatgtttacagcaaaagtatgcattctgcctccaaccattgattgactacaggtttgcattaaacaatatgtgctagatcaattccatctgcctctcaagttttactctccatccttctctactcaatgactcattgtaaagagttggcttttatggattgcatcaaacaatcccttgtgctatggtttctgttgggtttggccactagaacatgaagatatgtggagctgggtatctactgggtatctatttctccaggctctaggtcaccacaggctggctgagtcttgtgactgaaagttgcagctcctgggaaggggtcctctccatctcctcacctcttcaggcttagcttgaccacagctctctgacattagtcacagtgttctccattttttcttgtggttccacccaccatcccccatgcttttcacacattttaaatattctcctcattaaactctcatcaaattacataatttgaacttgagcattttggctcttttctgccttgaccctgactcttatgtaatcaagga

SEQ ID NO: 40786 - DNA, 601 bp, Human
gttagggaactgatatggtttggctgtgtccccacccaaatctcatcttgaattgtaactcccacaattcctacatgtcatgggaggaacccggtggcaggtgattgaattatgggggcgggtctttcctgcactgttcttgtgatagtgaatgagtctcatgagctatgatggttttaaaaatgggagtttccctgcacaagctctctctttgcctgtcaccatccacataagatgtgacttgctcctccttgccttccaccatgattgtgaagcctccccagccacgtggaactgtaartccaataaacccctttcttttgtaaattgcccagtctcgggtatgtgtttataaacagcacgaaaacagcctaatacaggaactgaacagtataaaaaatgtagacaaagtttaactatgtattacaggttgaacatccctaatctgaaaatcaaaaatccaaaatgcttcaaaacccaaaaccttttgagtgccaacatgatgccacaagtggaaaatttcacacctgacctcatgtgatagctcgtagtaaaaacgttgtttcatgcacaagattatttaaaatattgtataaaatta

SEQ ID NO: 40787 - DNA, 601 bp, Human
ggacttaacaggaagctcttaaactttaagctactgctgcacccagttactttggaatttttgtgttaagagactagcaggcacagaaaggagccagcatcctgacaggagtaattgatcctgatcattaggcacagatctagctgttacctgacaacagaagctggaagaatacatctggtaaccaggaaatccgctgggacaggctttgtaatgctatgaacaattttaataataaatagacaactgcagcagccaagaccagggaatcagactgcagagagataacggtcttggtccscctaccaggtaggtcacctagaccagaggcactagttgagagtgaggtgaatccaggataagtggttgaggagagagatgatgaatatcagtagcagatgtaagaccagctgcaaccatgggggctatagtttatcccatatccttcctcttctatgtttcccaggaaatgtgaccaatcagaaccctgaaagagctgctctaaaaatgtacgatacaaaacaaggtactctgagtagcaccaggaatggacagtattgaatactgtggctttccacccagataactctgcttcaggcct

SEQ ID NO: 40788 - DNA, 601 bp, Human
tgatcatttcatggtgctgtgtctccatgacaaaatacagaaatacagaaaccagtgagagaaagtaacagtggctatgcctactgtggcccactttgggagtttgtgcttctggtccccagagctccgggctttgagggtctaaatcccatgacggtgaatttcttcgtcatgggacttaacaggaagctcttaaactttaagctactgctgcacccagttactttggaatttttgtgttaagagactagcaggcacagaaaggagccagcatcctgacaggagtaattgatcctgatcrttaggcacagatctagctgttacctgacaacagaagctggaagaatacatctggtaaccaggaaatccgctgggacaggctttgtaatgctatgaacaattttaataataaatagacaactgcagcagccaagaccagggaatcagactgcagagagataacggtcttggtccgcctaccaggtaggtcacctagaccagaggcactagttgagagtgaggtgaatccaggataagtggttgaggagagagatgatgaatatcagtagcagatgtaagaccagctgcaaccatgggggct

SEQ ID NO: 40789 - DNA, 601 bp, Human
ccatgagatccactggactatcacggcctacaccatccagaagatgaaggcctgacagagagatggaataatcttttgaaaatataacactggcttcagctttgagaaaatatcctatgagcaccatccaccagactcagtatgtttactcactaaatctatgatcatttcatggtgctgtgtctccatgacaaaatacagaaatacagaaaccagtgagagaaagtaacagtggctatgcctactgtggcccactttgggagtttgtgcttctggtccccagagctccgggctttgaggrtctaaatcccatgacggtgaatttcttcgtcatgggacttaacaggaagctcttaaactttaagctactgctgcacccagttactttggaatttttgtgttaagagactagcaggcacagaaaggagccagcatcctgacaggagtaattgatcctgatcattaggcacagatctagctgttacctgacaacagaagctggaagaatacatctggtaaccaggaaatccgctgggacaggctttgtaatgctatgaacaattttaataataaatagacaactgcagcagccaagaccagg

SEQ ID NO: 40790 - DNA, 601 bp, Human
aacataggatcctgcacaacattgtgtcagaccagggaaattattttatggcatagaggtgcagaagcggccatgtgaccatgagatccactggactatcacggcctacaccatccagaagatgaaggcctgacagagagatggaataatcttttgaaaatataacactggcttcagctttgagaaaatatcctatgagcaccatccaccagactcagtatgtttactcactaaatctatgatcatttcatggtgctgtgtctccatgacaaaatacagaaatacagaaaccagtgagagraagtaacagtggctatgcctactgtggcccactttgggagtttgtgcttctggtccccagagctccgggctttgagggtctaaatcccatgacggtgaatttcttcgtcatgggacttaacaggaagctcttaaactttaagctactgctgcacccagttactttggaatttttgtgttaagagactagcaggcacagaaaggagccagcatcctgacaggagtaattgatcctgatcattaggcacagatctagctgttacctgacaacagaagctggaagaatacatctggtaaccag

SEQ ID NO: 40791 - DNA, 601 bp, Human
cgaacataggatcctgcacaacattgtgtcagaccagggaaattattttatggcatagaggtgcagaagcggccatgtgaccatgagatccactggactatcacggcctacaccatccagaagatgaaggcctgacagagagatggaataatcttttgaaaatataacactggcttcagctttgagaaaatatcctatgagcaccatccaccagactcagtatgtttactcactaaatctatgatcatttcatggtgctgtgtctccatgacaaaatacagaaatacagaaaccagtgagwgaaagtaacagtggctatgcctactgtggcccactttgggagtttgtgcttctggtccccagagctccgggctttgagggtctaaatcccatgacggtgaatttcttcgtcatgggacttaacaggaagctcttaaactttaagctactgctgcacccagttactttggaatttttgtgttaagagactagcaggcacagaaaggagccagcatcctgacaggagtaattgatcctgatcattaggcacagatctagctgttacctgacaacagaagctggaagaatacatctggtaacc

SEQ ID NO: 40792 - DNA, 601 bp, Human
ggcttacgaaatgtgtgacccacgaacataggatcctgcacaacattgtgtcagaccagggaaattattttatggcatagaggtgcagaagcggccatgtgaccatgagatccactggactatcacggcctacaccatccagaagatgaaggcctgacagagagatggaataatcttttgaaaatataacactggcttcagctttgagaaaatatcctatgagcaccatccaccagactcagtatgtttactcactaaatctatgatcatttcatggtgctgtgtctccatgacaaaatayagaaatacagaaaccagtgagagaaagtaacagtggctatgcctactgtggcccactttgggagtttgtgcttctggtccccagagctccgggctttgagggtctaaatcccatgacggtgaatttcttcgtcatgggacttaacaggaagctcttaaactttaagctactgctgcacccagttactttggaatttttgtgttaagagactagcaggcacagaaaggagccagcatcctgacaggagtaattgatcctgatcattaggcacagatctagctgttacctgacaacagaagc

SEQ ID NO: 40793 - DNA, 601 bp, Human
gcatgaaacagtgctgcagcaggtccagcctgcaatgaaagaatccctgtcactccatgtgattagaaatttagagaaggagaaaagatgccctgtgatgcttataacaagcaccaataggaaaatcaacacagactctaggattctgaaacaaggttgtgctatctgcaagagggaactatacacctttcaaaaatattttctggcaggttactgtactctggtggagaaatacctgtccatgaatcatcaggtgtcatgagctgagttctgtcagatcactacatcataaggttgagtsagcccagccttaatccattgttatagtaagtgggaccatctgagatctggaacaagcagtaccagggatgcatgagtaggtggctcagatcacccacattatccactattattacagtaccaggtctctcattcaactcacctctggaaaaatgggagtactgaatgacgagctcaaagaggaggaaaatgctgagattggttcatgcatggatcaacttggtatatacgtccaggccaaaagtaaactactgctgcactgaagcctactcaggagtgggtcctagagacaggaataata

SEQ ID NO: 40794 - DNA, 601 bp, Human
gttctggaggcagcacattctacatttaggaatgtgatccatttattggatgacattaaatgctgccagcttagaatggggcccagagcatgaaacagtgctgcagcaggtccagcctgcaatgaaagaatccctgtcactccatgtgattagaaatttagagaaggagaaaagatgccctgtgatgcttataacaagcaccaataggaaaatcaacacagactctaggattctgaaacaaggttgtgctatctgcaagagggaactatacacctttcaaaaatattttctggcaggttaytgtactctggtggagaaatacctgtccatgaatcatcaggtgtcatgagctgagttctgtcagatcactacatcataaggttgagtgagcccagccttaatccattgttatagtaagtgggaccatctgagatctggaacaagcagtaccagggatgcatgagtaggtggctcagatcacccacattatccactattattacagtaccaggtctctcattcaactcacctctggaaaaatgggagtactgaatgacgagctcaaagaggaggaaaatgctgagattggttcatgcatgga

SEQ ID NO: 40795 - DNA, 601 bp, Human
gtcagtagtccaaggtatgctagaatatcctctccaatctaaagaaaaaattattgcatttcataatttaaaccactaagaatgaaacacagcactttatttggcctttctgggttctggaggcagcacattctacatttaggaatgtgatccatttattggatgacattaaatgctgccagcttagaatggggcccagagcatgaaacagtgctgcagcaggtccagcctgcaatgaaagaatccctgtcactccatgtgattagaaatttagagaaggagaaaagatgccctgtgatgyttataacaagcaccaataggaaaatcaacacagactctaggattctgaaacaaggttgtgctatctgcaagagggaactatacacctttcaaaaatattttctggcaggttactgtactctggtggagaaatacctgtccatgaatcatcaggtgtcatgagctgagttctgtcagatcactacatcataaggttgagtgagcccagccttaatccattgttatagtaagtgggaccatctgagatctggaacaagcagtaccagggatgcatgagtaggtggctcagatcacccacatt

SEQ ID NO: 40796 - DNA, 601 bp, Human
gggtttatttacccatagaaaacctaagttttctaaatttcctaaattttctatacaaattttactagtcttaaaattgttataaatattcaagatcttcaaaatgtaaacatatatattcatctatattggattatagtaaacaagatctttataatttctgacagtgttgcaaattagctgaatctagatagttactttattagaatcatctttgaaaaatctaaatgcatgtctcttggatttaattacaatatcttttatggcattaataaaagactctgaaagtttttcagtgccyttactgtctataatattttcccgttccagaggaatcaaggatttatgtccatagattgacatttttttacccctctgtattctaaattcctccattctaatattgttggtaatcacaatatattattaatcaaagccaatcacccccatcatcctgagaaaggttttgctttttccattcatttatctgaaggctcctgctgcaagctatagatcattcagtcttctggggaaaaacatcaaaaatttaaggcacaagattctcagtacaacttaacaactcttaccacaaatgtgtcat

SEQ ID NO: 40797 - DNA, 601 bp, Human
cttcctcgtggtttttttatgtctatagaatttaacattggtgtcgaagagtttcaatagaagagtttaattgttcggtattacacaaattagttacgtggctacagcaaggttattacgggcccaggtggtattggctcaaaagtcagaaagctcttaaccactgctgcattgtccccacaagctcaccatacctcagcttttaaatagactatggttcattggttaacttacttgatggctttgaagcccactaaagaaaagactactaaaatttttaaaacatctgattcagcaagggtggctacagaaagatagtgaggcagtgtggcataccaataagagcttgttttttggaatcaaaattcctgggtccaagtcccatctcaaactatttaataactatatgaccctgggtaatttatttgacttctctgtgcctcacaatcctcagatatagagtaagaataacaggatacctgctcataggatactatgatgataaaataagatactgaatgtaaaatactgaaaactttcctaacacatataaatgttagctcttcttactattattattactacattgtcctgaatcata

SEQ ID NO: 40798 - DNA, 601 bp, Human
tattaaaaacacacacccttacactcgaagtggttctgtatttcttctgtgggtgcatttccatgcatgtaaacgcacagtaaaaactctgcatatatcataggaagagacagcggagatgcttatcattttaaatgctggtgaaaggagactctcttatctgagatgtttaatttttacagggagcatatttatatattactcatgttactacaaacgaaacaataaaagattgagcactatcattctttcaaagaaaccagcttgttcccactcagtactatgaagtcacaacaggctrtattaaggaaagagaatggaggatccattttatattctttttagaagataggagcagcccagtgagattcatgagaaagttacaaaaaagtgacagtttggaaaatttaggggaccaagtacaaaatattttttcaaatgatgtcatctcatgatacataagttttgtaaaagctttcccaactgtggtcttctacaacttgaccccacagaaaattcacgtaagtctcaatccctcagctccaagtatatgcactggtatttgaccatctttaacttgcctgtccaatcaaaatattgt

SEQ ID NO: 40799 - DNA, 601 bp, Human
ctacatataataacagacttttccccaagaatctttttttactaagaaaggcaagttttaaagcattatgtgaagaattatttattaaaaacacacacccttacactcgaagtggttctgtatttcttctgtgggtgcatttccatgcatgtaaacgcacagtaaaaactctgcatatatcataggaagagacagcggagatgcttatcattttaaatgctggtgaaaggagactctcttatctgagatgtttaatttttacagggagcatatttatatattactcatgttactacaaacraaacaataaaagattgagcactatcattctttcaaagaaaccagcttgttcccactcagtactatgaagtcacaacaggctgtattaaggaaagagaatggaggatccattttatattctttttagaagataggagcagcccagtgagattcatgagaaagttacaaaaaagtgacagtttggaaaatttaggggaccaagtacaaaatattttttcaaatgatgtcatctcatgatacataagttttgtaaaagctttcccaactgtggtcttctacaacttgaccccacagaaaattc

SEQ ID NO: 40800 - DNA, 601 bp, Human
agccacagacagaaatcagtcgagtgcttcagagtaagcgactgactctccaccacacggagaggcagggagtaagaaccccagaggctctcatggactcacataacaacacatgttatacctgccaaccctcccagtaaaaatggaagaatcccaaattctctgaggggctccagtctcccgcccaaccaggttcgtctcccgcccaaccaagttcaagttcatctcctcgtatggagatcacctatgtggaaatgtaaaaaaggaggccatttttcatgtttttatttttcttttttgktttttttttcttagtttactcttttggtaatgatcttttctagtaatagtcataaagtgactcttgaccctactcgaaatttatgatccaactgtcctatcagttgtctgacatgtaaaatgcaaagataatactcaccttaaatcactatgagagtgggatggaagtcattgttctttctttctctgtctaaagacctaatggtttaaaaagttttccctcccctggtagccttgatttttttcttcttataaaagtgcctcaaacttgttgaaatacagtgacccccaaatttacttt

SEQ ID NO: 40801 - DNA, 601 bp, Human; identical to SEQ ID NO: 30982

SEQ ID NO: 40802 - DNA, 601 bp, Human; identical to SEQ ID NO: 30983

SEQ ID NO: 40803 - DNA, 601 bp, Human
agtacataattctttttctctagttctgataaatcagctttactatcttgcaggctccctcattaaagagctaagcaaattttttgacatgtattcattctatatttgtacgagtcatgtttctcaaaaatactagatcatttgtttattgaacactacttcatataaaacccagaactaagcaatcaaaataaagagataaatgagctaggctgtgacagataaggtagaaagattgctctccaggagttcacagtaacacaaagatggacataccgatgctttttttttttttttttttgagatggagtctcaatcggtcgtccaggctggagtgcagcggcaagatctccgctcactgcaagctccacctcctgggttcacgccattctcctgcctcagcctcccaagtagccgggactacaggcgtatgccaccacgccgggcgaattttttgtatttttagtagagacggggtttcaccgtgttagccaggatggtctcaatctcctgaccttgtgatctgcccacctcggcctcccaaagtgctgggattacaggcgtgagccaccgtgccaggcccataccgatgcctttctat

SEQ ID NO: 40804 - DNA, 601 bp, Human
atgctggctgcataaccttgactaaattatttaacctcactgagactcatttacttgattttcaaaatggggataataatacgtacctcacacgattgtttactaattaaactaaaatgtacataaagcacttaacatggtacatggcccatataagtacttattaaatggttgccctctatagtatcatcttggaaattgatagtgttttcctgaatatccctctattttccttaatgaaacattatgaaaacataattatggacagacctagtacctattataagtttaggcaggaaaytgatacttatatactagaatcatatccctgtttaatctttttctaagataaataatactttgggtttagtcttataactaattagaaaaattgaccaaaatttgaaatggcaaaaaggagtttgaatgtccttataatgtcatactaaaatagtgtttcgcaggcctaagaattgtgtaactgtaggttaacatagatttctgtcctatagagacacaaatgtcaagaagagatgattgctttaaagtttatagttttattctctcataggacgttgatcagttttgcatcaaatttaga

SEQ ID NO: 40805 - DNA, 601 bp, Human; identical to SEQ ID NO: 30984

SEQ ID NO: 40806 - DNA, 601 bp, Human; identical to SEQ ID NO: 30985

SEQ ID NO: 40807 - DNA, 601 bp, Human; identical to SEQ ID NO: 30986

SEQ ID NO: 40808 - DNA, 601 bp, Human; identical to SEQ ID NO: 30987

SEQ ID NO: 40809 - DNA, 601 bp, Human; identical to SEQ ID NO: 30988

SEQ ID NO: 40810 - DNA, 601 bp, Human; identical to SEQ ID NO: 30989

SEQ ID NO: 40811 - DNA, 601 bp, Human; identical to SEQ ID NO: 30990

SEQ ID NO: 40812 - DNA, 601 bp, Human; identical to SEQ ID NO: 30991

SEQ ID NO: 40813 - DNA, 601 bp, Human; identical to SEQ ID NO: 30992

SEQ ID NO: 40814 - DNA, 601 bp, Human; identical to SEQ ID NO: 30993

SEQ ID NO: 40815 - DNA, 601 bp, Human; identical to SEQ ID NO: 30994

SEQ ID NO: 40816 - DNA, 601 bp, Human
acttacactataaatttccttccttaatgcaagcaaacaaaattaaaatacaaggtgatctcaatattgtggcaactgagtatgcactaatatcacaataatgatgtctttgtatattcagatattttgtgataatggagatgatcattttactcataagtaagacggatatccacaagttgctactgtctcttttttacctaaacacaaaactcctcagtgaaccaaaaaagtataaaatgctatggcttctgtgccaatgctgggatgtttctatagtgtaatttttttttttttttttgagatgcagtttcactcgtcacccaggctggagtgcagtggcacaatttcagctcactgcaacctttgcctcctgtgttcaagcaattatcctgcatcagcctcccaagtagctggaattacaggcagcacatcatacccagctaatttttgtagttttagtagaggcaggtttcaccatgttggtcaggctcttctggaactcctgacctcagttgatccacccacctcggcctcccaaagtgctgggattacaggcatgagccactgcacccagcccagtgtaatgtttttaattagc

SEQ ID NO: 40817 - DNA, 601 bp, Human
ggctaaaacctgtttgaaaatatacttacactataaatttccttccttaatgcaagcaaacaaaattaaaatacaaggtgatctcaatattgtggcaactgagtatgcactaatatcacaataatgatgtctttgtatattcagatattttgtgataatggagatgatcattttactcataagtaagacggatatccacaagttgctactgtctcttttttacctaaacacaaaactcctcagtgaaccaaaaaagtataaaatgctatggcttctgtgccaatgctgggatgtttctatrgtgtaatttttttttttttttttgagatgcagtttcactcgtcacccaggctggagtgcagtggcacaatttcagctcactgcaacctttgcctcctgtgttcaagcaattatcctgcatcagcctcccaagtagctggaattacaggcagcacatcatacccagctaatttttgtagttttagtagaggcaggtttcaccatgttggtcaggctcttctggaactcctgacctcagttgatccacccacctcggcctcccaaagtgctgggattacaggcatgagccactgcacccagc

SEQ ID NO: 40818 - DNA, 601 bp, Human
attcttccctgcatatatccttcctaaacttaatcctatttgctcttggcttgtatcttcatttgcaataaacataaaaagctctggagataaggagctatattgtgttacaacgctggaaagtaagtcaaccccagtccaatcttttctaccatgacaactattttattctagagatgagttaacaagggccatcacaaaatcaggtgatgaagattcttgccataagcacaatagatttttctgttaaacttcactaatttgaggtagagttatttggaattcataagatgagtaaaaragagacctattttgatttgtttagaatgagaaatacaaccttctttcttttatgcataaggtacagcacaaatcatgtgccaaccaaaggtgacaagcagaagctttgtttttatttgcattacaaactcagtgtggcctgatttacacaagaaatgataagcataattttaactggtccgcacatcatttaataataagcaggaatgcatggctaaaacctgtttgaaaatatacttacactataaatttccttccttaatgcaagcaaacaaaattaaaatacaaggtgatctcaata

SEQ ID NO: 40819 - DNA, 601 bp, Human
tagatcagtgctgtgatgcactctatgatctggcccttacccacatctttagcaccacctgtgatcactctctcttttcacctacatttaaactacatgaaactacttatagttcccacaaagcactacaattcctcctacttccaaatgtttgtaaattttcctttttccagaatgccaagttccattcttcttctcctggtaaaattcagtcagtcacgtcacgcattgccaactgcatgccacaggctccctgttgtggactggccacccacagtggagtgatggatattcaccattwgctgccccagctgcctctccagccttccctgccctcttttctgctctgtgaggctgagctatttggactgcatcagtggctcccatgtcttctggcttccaatcagacttctccagatagacccaccagcagaagatctagaggtcaaggtgaagtgggcagtcgctgtatttatgtccctggcttgctctctgccaggtgagcacaggttgcttgcttcctctttgcaaatatcactcctatcacgtaaccctttccaagtagttctttttctggtactgtttttcctttttatcttct

SEQ ID NO: 40820 - DNA, 601 bp, Human
atttttacactgaaaccttcccatataaatatttatctttaaaaaaattttactaactcctcaagaatgctgaataaagtaaatgctcctagatcagtgctgtgatgcactctatgatctggcccttacccacatctttagcaccacctgtgatcactctctcttttcacctacatttaaactacatgaaactacttatagttcccacaaagcactacaattcctcctacttccaaatgtttgtaaattttcctttttccagaatgccaagttccattcttcttctcctggtaaaattcartcagtcacgtcacgcattgccaactgcatgccacaggctccctgttgtggactggccacccacagtggagtgatggatattcaccatttgctgccccagctgcctctccagccttccctgccctcttttctgctctgtgaggctgagctatttggactgcatcagtggctcccatgtcttctggcttccaatcagacttctccagatagacccaccagcagaagatctagaggtcaaggtgaagtgggcagtcgctgtatttatgtccctggcttgctctctgccaggtgagcacaggtt

SEQ ID NO: 40821 - DNA, 601 bp, Human
catatgatgtatatatgacatatattgtatatacgtaatgtctaggatttgctccagaataatataatggaagaggttgtaggtgggacaaatataagattgtccatgaattgaaaattataaaagctgagtgatgatacttgggagtttgttgtattattttgtctatttttacactgaaaccttcccatataaatatttatctttaaaaaaattttactaactcctcaagaatgctgaataaagtaaatgctcctagatcagtgctgtgatgcactctatgatctggcccttacccacrtctttagcaccacctgtgatcactctctcttttcacctacatttaaactacatgaaactacttatagttcccacaaagcactacaattcctcctacttccaaatgtttgtaaattttcctttttccagaatgccaagttccattcttcttctcctggtaaaattcagtcagtcacgtcacgcattgccaactgcatgccacaggctccctgttgtggactggccacccacagtggagtgatggatattcaccatttgctgccccagctgcctctccagccttccctgccctcttttctgc

SEQ ID NO: 40822 - DNA, 601 bp, Human
agaaagaagcacattttaataaatgcctcagggatcctatctgcaaaattcagactcagaaacttgacaggacaaatgaccagtttcttcaataaataaatgaggaagagttgaaggggaaactacggagagtttaaggtcatatcaaccaaccacaatgtgtaagttttatctggattccgactcaaagaaactgcataagaaaataaatgatatttgtgagacaactggaaattcaaactctgagtaaatatttagtgatattcaggtactattattttcatttttttaaataatatamtgttattgtggttgtgtttataaaagaaagtatcttttaaaagtccatttcgaattattgatggataaaatgatatatatgctatgcatatgatgtatatatgacatatattgtatatacgtaatgtctaggatttgctccagaataatataatggaagaggttgtaggtgggacaaatataagattgtccatgaattgaaaattataaaagctgagtgatgatacttgggagtttgttgtattattttgtctatttttacactgaaaccttcccatataaatatttatctttaaaaaaa

SEQ ID NO: 40823 - DNA, 601 bp, Human
aggagaaagaaagccagacattatatattcttttttagaaaaagaaaacactgcttacaaagtagatttgggggaaaatatatgtagtgtatgtagatccagctatcaagtacagaaaaaagaaagaagcacattttaataaatgcctcagggatcctatctgcaaaattcagactcagaaacttgacaggacaaatgaccagtttcttcaataaataaatgaggaagagttgaaggggaaactacggagagtttaaggtcatatcaaccaaccacaatgtgtaagttttatctggattcygactcaaagaaactgcataagaaaataaatgatatttgtgagacaactggaaattcaaactctgagtaaatatttagtgatattcaggtactattattttcatttttttaaataatatactgttattgtggttgtgtttataaaagaaagtatcttttaaaagtccatttcgaattattgatggataaaatgatatatatgctatgcatatgatgtatatatgacatatattgtatatacgtaatgtctaggatttgctccagaataatataatggaagaggttgtaggtgggacaaata

SEQ ID NO: 40824 - DNA, 601 bp, Human
cataagcaatgtacaaatatatttattagtgtattccatgattttaagtttatagcctttaattactacacacatataaatttctaagaaaaatagtttgtttctaaaaagcttgacctactggttatgtttttaattatatagcagctatattaaatatgcaaaaatatatacacatatacccaaataactatatttgtctgtttacataatcatcttaaacaaatgtttgagttttcaaataatttacttccttagaaatataagcaatatagtagttcaagaaatgtgaaattgaagwctgcaaattagattatttcatcctgaatgaaaaaaaaatacaatgctttactgctatatgagtagcaagtagtaagataaaatgtgtctaaaaagagagaaatatatgccagtatacatttagaggtcatagaatgttcaaaaccatacagtttaaactccatttaattttgcttttcttagatagcattctctttcttggaagcaattagagtcactggaatctgagattcaatcatgcatttgatgctagctgatgatgtatatggattaccttattcacatgatgaaaagagaaaaa

SEQ ID NO: 40825 - DNA, 601 bp, Human
aagaaaatataggagaatggcctcccaatctttctgggagtaatcaaagatttcttaggaagcacacaaaaagctctaatacaaattaagcctttttcataaaattggatgtttaaaacatgctcatcaaaacaaacactaaaaacacaaaaaggaaaagtataaacaaaaagaatttatttttaataaataaatctgtcagaagacttgtatccagaatatatctcttctatttcaacaataaatgataaacagcccattaaaatatgcaaaaaaacacatttgacttcttttaaaaaagacaaaatggtaacaataaaaataaacttatccttactctcaaatgttgttgtttgtaaggacataattgtctgttccagaattttatctgtataaaacatatataattcctttacttccttccagggatggaagtttattctcttccctgtttcatcaagtataatatttaaacatcatttatgtctgtatccattaacacattttcaacatctgttggatatttaaatcacttctctgagcacaagggcggtccctcgtgccacctggaatgcagctggctggccttcagcgaccccca

SEQ ID NO: 40826 - DNA, 601 bp, Human
tatggaggccagaagaaaacaaaacaactatttaaagagctaaagcaagacgaacaaaaacaaacctgtcagtccagaattcagaattctatatctacaaaaacataattcaaagaatgaggataaaataaagacattttcagaaaaataaaatttaaaactatttgttgccaacagaacttcactataagaaatgttagaggaaatcattgaaattaaagaaaaatgacgccagatggaaacttggatcaacaggaaggagtgaatagcactggaaagggagacaggtgggtaacaaagractttctatttgtctttcatctcttaatttctttaaaagtaacaattgttcaaagcaaatacattaatgctgatttgtggagctcatatggaatgtgaaagatgtatggaagtaagagtataaggtaatgctgggcacagtggctcacgcctgtaatcccaacactttgggaggccaaggtgggcagatcaccagaggtcaggagttcgagaccagcctggccaacatggtgaaacctcgcctctactaaaaatacaaaaattagccggcccttgtggcgggcacctataatcccagcta

SEQ ID NO: 40827 - DNA, 601 bp, Human
atttatccttctaggaaataaaagaaaaatcatacatttttgttgtataacatacatagagcacacaaattttattatacagtttaataaatattttatatacacatgtgaacctccatcgagaccaaagtttggaaaatgtataacacccagaaggttcctacgtgccccttcctagtctattacacacctcccgccaactgactggtgagcaagaaagcagaggagaatgatgtgagaagttactaaaattctttttgccttattatctgatatgattttactctttttattttgtagwcttgagtaggcctcatgacagataaaatgtaaaacctgcctggtaagaaggtattctgctgagtctaaccggactgaaaatggcttgaacaccttccaacctcttggtatttgaagtcatacacagtagtctagaccacttttaagccatcttctcagactcaaaaataaaacaacagcaaatattacaagcaggtagagttaataactgtcaatgccgcccctaccggcatttcacaatcaatccaagatggttgcacagagacaagaggaagtactgtaattagcttttcagggtaga

SEQ ID NO: 40828 - DNA, 601 bp, Human
acgcctgtaatcccagcactttgggaggctgaggcgggcagatcacttgagcccaggacttcgagaccagcctgagcaacatggggaaaccctgtctctaccaaaaatacatctgggcatggtagcgcacacctgttgtcccagctactcgtgaagctgaggcaggagaatcacttgaacccgggaggcggaggttgcagtgagccaagagggcaccatggcactccagcctggacaagaaagtgagcctctgtctcaataaataaacaaataaatataaataaataaattatccagcctyaggtatttctttacagcaatgcaaaaatggactaacacaggtgtatagaagtagaagcgactgagggaaccccagaggccaggaacaggacaaatgaatggatggtagtttcatgtgtacagctgtgaagggaataggctcactggatggtggggtagaaaagtcaaggaaataaagttaatgagtccagtttctagcatgtagtttgaggttactatgagacattaaggtaaaaatgtcaactaagatatttgggtatgagtcttcaatttttagaagaaaattctgggctgaagacac

SEQ ID NO: 40829 - DNA, 601 bp, Human
tagagaagatagaggagatgagagtcaaagacttgggaaataaacagaagatagagttcaaagaatgtagtagctaccctgatggatgctgatatggtttggatgtgtgtcccatccaaatctcatgttgaaatggaatccccgatgttgtatgtggggcctggtcagaggtgtttgggtcatgggggcagatccctcataaatacctggtgccctccttgaggtagtgagtgagttctcactctgagttcatgtgagaattagttgtttaaatgagtatggtgcctcccccgtctctcttgctctctctcccaccatatgatatgccagctccccattcaccttctgccctgactgtaaacttcctgaagcctcaccagaagcgaagcagatgctggtcctatgcttgtacaggctacagaactgtgagccaaataaaactcttttctttataaattatccagccttagctgggcacagtgactcacgcctgtaatcccagcactttgggaggctgaggcgggcagatcacttgagcccaggacttcgagaccagcctgagcaacatggggaaaccctgtctctaccaaaaatacatctg

SEQ ID NO: 40830 - DNA, 601 bp, Human
ggtagagaagatagaggagatgagagtcaaagacttgggaaataaacagaagatagagttcaaagaatgtagtagctaccctgatggatgctgatatggtttggatgtgtgtcccatccaaatctcatgttgaaatggaatccccgatgttgtatgtggggcctggtcagaggtgtttgggtcatgggggcagatccctcataaatacctggtgccctccttgaggtagtgagtgagttctcactctgagttcatgtgagaattagttgtttaaatgagtatggtgcctcccccgtctctcttgctctctctcccaccatatgatatgccagctccccattcaccttctgccctgactgtaaacttcctgaagcctcaccagaagcgaagcagatgctggtcctatgcttgtacaggctacagaactgtgagccaaataaaactcttttctttataaattatccagccttagctgggcacagtgactcacgcctgtaatcccagcactttgggaggctgaggcgggcagatcacttgagcccaggacttcgagaccagcctgagcaacatggggaaaccctgtctctaccaaaaatacatc

SEQ ID NO: 40831 - DNA, 601 bp, Human
agcaaaaactcctaaatatacataaaaatgcattttgctaactcagtgacagtttggggtcattgaacttttactgtaactatggatcttccaaaacagaaacacacacacacactcaaaactccacgcataatcttaaggtttcatccagaaattgagggctgcaggcacttcctcgagcttatctctgagccgtaagtaatgacatagtctaacggtattatgcacttcccataaaaaccaatgcttagcatggaattctatacaaccccaggcaaccatggaccctaaagtatctcayccaaaaattgaactgttaacttagaggatggaagcacatagaacatgaaaaacttcacagctccatttcaaatcaaagagggcaacagaaagcaattctggtgaggtggcttccttatctgacgaacagacctgtgaaggcaagggacacaggtagtccaaccctgaggagacgaggctggggagaaaatgtagaaacagaatggcactgtactcacatggtgaaggagccggggggagcagacactcgccgcaggtccgcagtttgcacctgatgaatactagaggcagcagggaatga

SEQ ID NO: 40832 - DNA, 601 bp, Human
aattaattaatatgtaaagtatctgtaacagtccctgaaacataataaatgctaggtaagcatatgtgatatggagaaaacaaaggacaaagcagagtacacagcacaaaataattctgagctgaaatgctaaaaaacatatttttttgttctcactagaaaaaaataataccctggactacattaagcaaaaactcctaaatatacataaaaatgcattttgctaactcagtgacagtttggggtcattgaacttttactgtaactatggatcttccaaaacagaaacacacacacacaatcaaaactccacgcataatcttaaggtttcatccagaaattgagggctgcaggcacttcctcgagcttatctctgagccgtaagtaatgacatagtctaacggtattatgcacttcccataaaaaccaatgcttagcatggaattctatacaaccccaggcaaccatggaccctaaagtatctcatccaaaaattgaactgttaacttagaggatggaagcacatagaacatgaaaaacttcacagctccatttcaaatcaaagagggcaacagaaagcaattctggtgaggtggcttcc

SEQ ID NO: 40833 - DNA, 601 bp, Human
ttggaaaggtaatcattcaagtgggccttgagaaatatacaggatcctgacagacgaaaggcagcagactatgaattgttaaaaacatgaactttgaagccagactgcctgagtctgaatcccactctatgatttattaactgtgtgaccttgggcaagttacttaacctctctgtctatcagattcctcatgcatagaagggagataattataccacatatggccaaaggttgttgggagagcaaattaattaatatgtaaagtatctgtaacagtccctgaaacataataaatgctagrtaagcatatgtgatatggagaaaacaaaggacaaagcagagtacacagcacaaaataattctgagctgaaatgctaaaaaacatatttttttgttctcactagaaaaaaataataccctggactacattaagcaaaaactcctaaatatacataaaaatgcattttgctaactcagtgacagtttggggtcattgaacttttactgtaactatggatcttccaaaacagaaacacacacacacactcaaaactccacgcataatcttaaggtttcatccagaaattgagggctgcaggca

SEQ ID NO: 40834 - DNA, 601 bp, Human
attccaccaagaaaaccaatcaatcattgtttggcttcagaatacttcatattaaaatctgtgaacatggctgggaacacaagattcatattaagatattgccaatcatctcaaatagcctaagtctactgtgtaaaatacacagacacagagttaatgtaattaacaccaaattaaaccttgagaactgcaacagatacatgaatgataaactccagtgagggtgtaattaactctgacagcaagaatcaaagaagaattctttggaaaggtaatcattcaagtgggccttgagaaatayacaggatcctgacagacgaaaggcagcagactatgaattgttaaaaacatgaactttgaagccagactgcctgagtctgaatcccactctatgatttattaactgtgtgaccttgggcaagttacttaacctctctgtctatcagattcctcatgcatagaagggagataattataccacatatggccaaaggttgttgggagagcaaattaattaatatgtaaagtatctgtaacagtccctgaaacataataaatgctaggtaagcatatgtgatatggagaaaacaaaggacaaagc

SEQ ID NO: 40835 - DNA, 601 bp, Human
cagtttggcaattgaatgtcattttcctattgattctttgactgctcaagtgtaagcttcaggaaggtagtgctctgtcatgcttaccactagacacagagcataaaatactgtctggcacagagcaagtgcaaaataaaggtttttgaataaatacatattttaaataataagtaaattagtatccataagatgagagttgaaagtagattatataactgaactttaggaattgctttgtcatacatatcaccagatgttagatattgtgcaattctatttagacatgtattcttttatkcactcattccaccaagaaaaccaatcaatcattgtttggcttcagaatacttcatattaaaatctgtgaacatggctgggaacacaagattcatattaagatattgccaatcatctcaaatagcctaagtctactgtgtaaaatacacagacacagagttaatgtaattaacaccaaattaaaccttgagaactgcaacagatacatgaatgataaactccagtgagggtgtaattaactctgacagcaagaatcaaagaagaattctttggaaaggtaatcattcaagtgggccttgag

SEQ ID NO: 40836 - DNA, 601 bp, Human
aagaagccatctacaatggactacacattgtatacttccatttatatagcattcctgaaaacacaaaactataatgattagtggttgccagaggttgggagatgggagggtttgactacagtggaatacatcatgaggcagctcttttggggtgactgactgatctatatcctgactatggtggtggttatatgaatctctatatgtcttaaactttatggaactgtacaccagaaaagtccgttttacagtatgttaactttaaatattaaaaataaaagcaaatataataaacattcartacaaagtcgttcatatggaagaacaaccagaacctctacttggatgcttgtcacatggcttcgtaattctgtcataggcaacacaactgaaaccttaatgttcttgtctctgcttctccaatatcccacagagcattgagtaactgaagtaaacactcaataatgtttgtttaaagatgaaagcaatgaataaattaggtgtaaatggaacacattatttcattttgatgggggaagagcaggagggaaacagaacctaatgagaggtagctactaaaggctaagagagttctagaaag

SEQ ID NO: 40837 - DNA, 601 bp, Human
gcttcccaaatgctaacagtaccaagtgctgataggggtgtggagcaactggaatgatcatatattgctggtagaaatgcaaaatggtgcgaccattctggaaaacagtttgtcagtttcttacgaaggtgaacatacacttaccatatgacccagcaatcccattcctacatgtttaacctagagacataaagcttattacataaaacctgttcatcaatgtttataggaactctactcattattgccccaaactggaagaataacccagatatccttcaatgggggagtgggtaaacawgctaaaacatccatacaatgaaatacagctgggcaataaaaaggaacaaataaatgatacatgcagcaacttggataaatcttaaaggtgtagtgttcagtcaaagaagccatctacaatggactacacattgtatacttccatttatatagcattcctgaaaacacaaaactataatgattagtggttgccagaggttgggagatgggagggtttgactacagtggaatacatcatgaggcagctcttttggggtgactgactgatctatatcctgactatggtggtggttatatgaat

SEQ ID NO: 40838 - DNA, 601 bp, Human
aagtttcctaccatttcttgttctctgtcttctcatctagggaatgagactagtagcaactgtgaccttagaagttagtagggtgttaaatttgatcacagagcaaggtgcttaggtacatattatgtctctgactaaatgtaaaaatccactttggttcttgctaacaggaaggtgagacatgaactatgcttaccaatgaagaacagggcccggcccccctgcccagtactcagaaccaaggacaacgctgtcttgtcccatagcaagtctcatccacctcatgttacagatttttggrgggcagattttcttatgattctaagatcatgctttgaattctaccataacagaacttcaaagctgataggaattcgaaggaccaactgcagtttttaaatatctgaaaaactgaaatgcaaaaggttaatacatggctgatgttacacagacaaatgcagggttcccccagatactcaaatcagaaggatgttaccataaggaaagaggggttgcagaataaggaggaagacgctctggctacagacccgtggactgcttccactgccccttttctttgtgtcactagacctctcagagt

SEQ ID NO: 40839 - DNA, 601 bp, Human
taacatcaagccaaatgacataatcacgtcccaattagaggacatagccacctttcttaagagcagtaaggtctaagtgattactttttcaaaataaatacaactataggtctttataatatattataagactgaaaggctttggccttttccttccatttgtgattcttccaatggtactttcattttattttatttatcttttttcttaatttttataatggcccaagatgaaaagtatttctatttcagtcaaatacctgagctataactttggaacttggtgaatcatgtatagaayttcattttctgacacaaaatgtgatgtgttctagggattaattaaatgtagcatcaacgagtactttctttttatgccttttaaaatgtactcttttcatttcatggaagtgtttcagggtgttatgagagaccagcaaaactcagtggaattggtataattaaattgaagccctcctacaaatgaaacgcacctcacacttcattaccacttcagcaaagtaatccaaaataattggattatttggattatttgtttggaacgctcaaaacgaacatctaggtttctttgttgatatgt

SEQ ID NO: 40840 - DNA, 601 bp, Human
agttttattaaaatatgaatttatagtgtgaattcacagtgtgaaaggctatgaattcacactatgaatctcttcctcctctttgcagctccagcagctagaacaatgcctggtccatgttgcttacaataaatgtttttgaacaaatgagtaaatgaatgcaaggaaatcaaattcctctgcaactgtacatggttctgatgctatagcacagcttggcattggagcatttctgagctgctttctagcagcttttccctttgtgaaaaagtcataactgatttggtcatccatttctgtyctttgacctctggatcaggaaataaatccatgttgaattatgttcccactttttatctccagtagaatctacacaaataaaaagacagaagaacctacaaatggtagatgtccccatcaaaaaagtaagtaaaccttttctgaactacctgttcttcaattaaataatgcctcggaaatctgaaacacattgtacagaagtttttgattcttaaaccaagcataaaccaaaatcacattagcagcaatcagtcatgcactcccactgcccaacatgttttcctggagaaagtaccttcag

SEQ ID NO: 40841 - DNA, 601 bp, Human
tgaagtgattttaaggtcacatagccactaagtagcagtgctaaacgcaaagccttggacccttcactcatcagtttcatgttctttctctgctcctctgaggagttcagactctcttgtcaatggataaataccaagaatcccatggatttgacggcaaaactataaagtctggattggcagagtctgatgatctctgtgtgctgctcagatttctttctttatcaataaacaatcatcaggcgggatatttatagatacagaccttcagttagtagaacagaccttgaatatactgaargtctttattcatttagagggaagtgtggctacaacatgctgtgaagtgaagaaaagtcatgaataattatatatggcataagctccttcatataaattgtggacttcaggagtttgcacatgcaagagaagtgcatggagacacgtccaacaagctgttgcaagttgttatctctgtgtggtgaaacctgggcattattttatatcaagtataatttttaaggaattaatatagttattttaaaagcacgtccatatgtaaataaacaataatgcaggacaagaataaaaataaggccta

SEQ ID NO: 40842 - DNA, 601 bp, Human
gaaagaagggaatactgtgtctacaatattaggacacccctctctaccttcacttcaaactcacacacacagagacacagacacacacccatttaatttcagtaaaactctggaagagggagtaaaaaaataatctcattctgttgtctaaagcctcattttagtgcaaagtatagtaactccctccatatggaatcccactttactcacccaaaatagcacatacatatcaaactatagatacatatgtgcacactcacacatggtgcattctctctctctttctctctctctctctcttacacacacacagacagagagagagatttaaactgtggctatttaaaagtgtagatatacatgcacaaattctaaagagagatggtaggcaggtaaaaatgtctgaggttcactggcttaaaaaaatcagtataaaactacagagatggatatttctgggggaaatttgaaaagacagattcaacagctataccgatccatcactcaaattgtgtttgttgggtatttactttgtattaccatagtgctggacatcaaaaaggtatggacaaataaagccgaagcatttaagttgtgattg

SEQ ID NO: 40843 - DNA, 601 bp, Human
cactaacgatactaggattttaccctatttattgatatattatgcattacatgttataaacatccagataatactgaattatactgagatcatgtatgtaaaagcattgtcaaacactgtatttgatatacaacaaatgttaattccctatccttatagactacatctgttttcaattggcttcaagctggtttctactgcttgtgttttaaaccctagatctgtgtaaattatcatggcaatttaaaagtgcagaataaactggtgctcaaactgaagtttaaccagtttgcatgggaayagagttaaatttgggggaatatcaagttatctcagatttttaaaaaatatatcatgtgtcagtgaatctcttctggggttagaaatacaacagatttttaaaaacagatcatcctttgcctagattatatgattataagctttattaaggacccacttgtatacttctgtttatgagagtgattttctgatatcattattacagatttgctttaatttttttaatatggccactttctctttatgttctacctcttaagttgaatagactgtcccctcttgcaaaccacaactattatct

SEQ ID NO: 40844 - DNA, 601 bp, Human
gggcaaaaagcctacttcacctctacagtattctttctaaaaacccataaatccagtgtaattatgagtaaaacaacagacaaagccagattggaagatattctacaggaagcagtattcccccaaaaccatcaaggtcataagaaaaagaaaagaaaagaaaagtaaagaaaagaaaagaaaaagaaagaaagaaagaaagaaaagaaaaagaaagaaagaaagaaagaaaagaaaaagaaagaaagaaagaaagaaagaaagaaagaaagaaagaaagaaagaaagaaagaaagagaaagaaagagaggaaagaaagagggagagagagagggcgggagggagggagaaagagagagaaagagagagaaagaaagaaagataaaaaaagaaagaacgctgagaaacggttacagatcagaagagactagggagctatgacaactcaatgcaatatggtatcctagatttgatcctgggatagaaattccaaaggtttagttaatagtaatgtagcaatatcagtttccttgacaaacgcaccatggtaatgtaaagtgtttaacaatgagaaaaactgggggaggaatgcacaggaatg

SEQ ID NO: 40845 - DNA, 601 bp, Human
atggggcaaaaagcctacttcacctctacagtattctttctaaaaacccataaatccagtgtaattatgagtaaaacaacagacaaagccagattggaagatattctacaggaagcagtattcccccaaaaccatcaaggtcataagaaaaagaaaagaaaagaaaagtaaagaaaagaaaagaaaaagaaagaaagaaagaaagaaaagaaaaagaaagaaagaaagaaagaaaagaaaaagaaagaaagaaagaaagaaagaaagaaagaaagaaagaaagaaagaaagaaagaaagagaaagaaagagaggaaagaaagagggagagagagagggcgggagggagggagaaagagagagaaagagagagaaagaaagaaagataaaaaaagaaagaacgctgagaaacggttacagatcagaagagactagggagctatgacaactcaatgcaatatggtatcctagatttgatcctgggatagaaattccaaaggtttagttaatagtaatgtagcaatatcagtttccttgacaaacgcaccatggtaatgtaaagtgtttaacaatgagaaaaactgggggaggaatgcacagga

SEQ ID NO: 40846 - DNA, 601 bp, Human
attattgaaagtatgaatgcatgaatggttgaatggctctaccattttggcatagttaacaaattcagttgagctcaaatatgcaaactggaaacaatttaaaaaatcttgatccacctcctctgatcattttgaaagtgggttagacttagtgacttattcctaaagaatagagtagggaaggggaaaaaattgtaagtctatggtgaaggaacttggcaaataccacctttaccaaatgatcaggttaacatcaccagggatgtcatgtgtatatcacataagtcttgacatgatgggrcaaaaagcctacttcacctctacagtattctttctaaaaacccataaatccagtgtaattatgagtaaaacaacagacaaagccagattggaagatattctacaggaagcagtattcccccaaaaccatcaaggtcataagaaaaagaaaagaaaagaaaagtaaagaaaagaaaagaaaaagaaagaaagaaagaaagaaaagaaaaagaaagaaagaaagaaagaaaagaaaaagaaagaaagaaagaaagaaagaaagaaagaaagaaagaaagaaagaaagaaagaaagagaaaga

SEQ ID NO: 40847 - DNA, 601 bp, Human
tcacttcttcagaaagtctcttgctgaccaccttatcaaaaacaggatcctctgtcactgttctgctttactttcctttatagcatcttgctccatattgtattatttattcaattgtctgtctctccactggaacataagttccgggcaagcacttttctgtatcttgaaatagtactagaaatacttgaaatagtactagaaataaggtaagcagtcaattaatatttgttgaatttatgaatggctgatttgaggttggaggaagatccaaaaacagaaacttgtccaacaaacctgrgtgtgataaactaagtcaaagtcagtttaaatgtaagaagacatttgaaatggaattgtgaaagactgacatgtaaatttttacttatgttattaaagacatttatatgaaaaataggaagtactacttggaggaagcagaaaacacagtgattaaataagtattcaaaatgtcagccccttagactgtctgagttttctgtgcctcaattgctttatatgtgaaatgggaataacagtactatctatcacactgagatgtcgggtgagttaaattacacaatatatgtaaaaaaggcat

SEQ ID NO: 40848 - DNA, 601 bp, Human
aggaacaagagtttttgagacaaaaggaaattatctcagaccacccttaggctctaaggaaccacagcatgaaaagaagaaaaggaaatgttcaggaattaggaaggtaggtaggtacagagtagagtagggtgaggctaagaccagaggtttgatttttatactaagaagttgagactttattctcaaaaggatgggtagatactaataggtttccaacagaaggtgaaggttccagatgtatactgaccaaaacagccttcatgtttcccttagcatgatggaactttagacaggtttcttttttttttttttttttttttttttgagacggagtctcactctgttgcccaggctggagtgcagtggcacaatcttggctcactgcaagctctgccttcccggttactcctttctcctgcctcagcctcctgcgtagctgggactacaggcacccaccaccatgtccagctaattttttgtatttttagtagagacagggtttcaccgtgttagccaggatggtcttgatctcctgacctcgtgatctgtccacctcggcctcccaaagtgctgggattacaggcttgagccaccatgc

SEQ ID NO: 40849 - DNA, 601 bp, Human
tgaaaaatagtcttagttaaaaagaaacagaaaaatcaagagaaaaagaaaagaaaaagaaactgttctgagttttctacagacagatactttgtctataggaaatataatatgggaggatgtaaagacaagtgggatctttctttttacctcattagttccaaatgtgccaaggttatcatggaactacaattcttacttgatggctgataagaattagatagaatcagtttgcaatatggtatttcaatccagtttttccctgctgtgggtcacaggtccattttacaaccacctggtyatcattaatttcccactgctcacctggaaccaatggggagcaacgaatgggcatattagcattcaaaaggaaacataacatcccaagaactttataccttgccatgccatgtctgggacctgtcagcagtttcacaactcctagtccttacgattaaaagtaattatagagtttggattccctagcttgagctaaaccaggtcctgtctatagtccattaaaaatgtcatccacaagataaaagtaaattatgtagttttcattggattctattcaaggataagatttctgagtgctttc

SEQ ID NO: 40850 - DNA, 601 bp, Human
tggaaataaagagctgagagctcagcatttttttaaaaagatttaattatgtgacattgctgttacagtgcaattactgttaaaatagaattgcagccatatgaagccattgacctattcaaagcacaaacaaactatcttcaataggatcattataagaacgtgtgataccttagagaaaagcttctcagaaaccactgtgtttgcaaagactgggctttaagttttaaatatatatatgaattgtggaggctttttaaaaaaggttatcaccttctgaaaagaacaataaatataatcmcagaattaaaaagtcagaaaataggaaaggtattgaacaatatggtaaaccatcaaaatatagtcatcttagaataagcttgttaacactatgtatatacacattttaaaaacttgacatttccttaagcatcaattttagatttactaacataatcaatagagtttatgcaagtacttggtatcatttaatcaacctatgcatagtattaagaaaccaatagccttttaaaaaaaacccattccctagaaaataacatagaaataacataggagaaaagctagataagcttggtatggc

SEQ ID NO: 40851 - DNA, 601 bp, Human
caagtgaattatttgttgaagaaagccaaaagacccttgtagaccgactctgaggttaaactgccctacccagggatgtctaaagcaaatttcattctggcacaacctttagcacagcatctttgtgctgaattgcgtagaggccaatgaaaattcacaacagatggaactctgaggttaacacacatgccaactacatgagctcccagatgctgaattgagctaggatcacttttcctgggcacagctgcttggagcctgatatggtttggctctgtgaccccacccaaatctcatcttrtagctcccataattcccacatgttgtgggagggacctggtgggagatgaatgaatcatgggggcaggtctttcccatgctgttctcatgatagtgaatgggtctcacaagatctgatggttttaaaaatgggagtttgcctgcacaagccctctcttagcctgtcgccattcacataagatgtgacttgctcccccttgccttcccccatgattgtgaggctttccagccatgtggaactgttggttctccattaaacctctttcctttgtaaattccccagtctcaggtatgtctttga

SEQ ID NO: 40852 - DNA, 601 bp, Human
cagttatcaggctctcagactggaagatataccaccagctcccctggttctcaggtctttgggcttgcactgatttacaccactggctttcctggtcctccaactttcagatggtatcctgtgggacttcttggccactataattgcatgagccaattcccataatagatgtcctgttacatatctacatatccagttggttctatttctctagagaacctggactaacacacacaaatttgaggatatagcaagaaggcagccgtctgtaagcaagaaagagagcccacaccagacccawccatgccggcatcctgagcttggacttcctgcctccagatcttttagaaataaatgtctgttatttaagccatccaatgtatagtattttgttacggcagccagagcagactaaaacaacgaggaagctttgacaaattcaggtaataggaactacactgtggaatttactggtgatattaagccctgagaaaattatactacaaattacccctttccagccaaaatataagtcctgccctagcacccttctatggcttcaacctgacctccattaaccctctttccctatttcctgttg

SEQ ID NO: 40853 - DNA, 601 bp, Human
tggaatggaaatttccaagaaatggaaaaattataatattaaatgatacaaagaatatgaaggaaaacaaagaggaacctcattcagagaataaaagagtacaaaaccctttgaaaataaaaatttgataaaataaatagagacctcattagaaaagttaaaagataaagttgagaaaatctctaaaaaagtagagcaaaaataaaaagagatagaaagtaggagagaaaaactaaaaaaattagaaacctagtccaggaggtcccaataagaggagtttcaaaaaacatccccataatasgagtctcaaaaaacaaaagaaaatagagaataaatataaaaaacaaaatgaagaatatttcctaaaacattagtttccaaactgaaatgattcatcaaatgccaagcacaataactacagaacaatataacatcatcttgttttgaaattgaagagtactggggacaaaaggaagaatctacaagcttatagaaaggaaaaaccagattatatacaaaggattaaaatttggaatgtttttgaacttctcaaaggcaaccatacagtaaggaagacaatgaaacaagaccttcaaagttc

SEQ ID NO: 40854 - DNA, 601 bp, Human
caaacagaattagcacttgacccagcaatctcactattgggtatatacctaaaggaacataaatcactctaacataaagacacatgcacgtgtatgttcactgtagcactagtcacaatagcaaagacatggaatcaatctaaatgcccatcaagggtagagaggataaagaaaatgtgggacatatacaccatgcaatactacatagccattaaaaaaaaatgcgatcatgtcctttgcagcaacatggatggagctggaggccattaccctcagcgaactaattcaggaacagaaatckatttaataagtatcacatattctcacttataagtaggacacaaatattccccacctttgtgtacccatggacacaaagaagggaacactagacaccagggcctccttgatggtagagagaaggaacgtgacaatcaaaaaattgcctatctggtactatgcttactacttaggtggtgaaataatctgcacactaaacacctgtgacacaaaatttacctgtataataaacctgcacatatacccctgaatctaaaagtttttttaaaaatagaaaatgaacttgcgcaaagaaaaacac

SEQ ID NO: 40855 - DNA, 601 bp, Human; identical to SEQ ID NO: 30995

SEQ ID NO: 40856 - DNA, 601 bp, Human; identical to SEQ ID NO: 30996

SEQ ID NO: 40857 - DNA, 601 bp, Human; identical to SEQ ID NO: 30997

SEQ ID NO: 40858 - DNA, 601 bp, Human; identical to SEQ ID NO: 30998

SEQ ID NO: 40859 - DNA, 601 bp, Human; identical to SEQ ID NO: 30999

SEQ ID NO: 40860 - DNA, 601 bp, Human; identical to SEQ ID NO: 31000

SEQ ID NO: 40861 - DNA, 601 bp, Human; identical to SEQ ID NO: 31001

SEQ ID NO: 40862 - DNA, 601 bp, Human; identical to SEQ ID NO: 31002

SEQ ID NO: 40863 - DNA, 601 bp, Human; identical to SEQ ID NO: 31003

SEQ ID NO: 40864 - DNA, 601 bp, Human; identical to SEQ ID NO: 31004

SEQ ID NO: 40865 - DNA, 601 bp, Human; identical to SEQ ID NO: 31005

SEQ ID NO: 40866 - DNA, 601 bp, Human; identical to SEQ ID NO: 31006

SEQ ID NO: 40867 - DNA, 601 bp, Human; identical to SEQ ID NO: 31007

SEQ ID NO: 40868 - DNA, 601 bp, Human; identical to SEQ ID NO: 31008

SEQ ID NO: 40869 - DNA, 601 bp, Human; identical to SEQ ID NO: 31009

SEQ ID NO: 40870 - DNA, 601 bp, Human; identical to SEQ ID NO: 31010

SEQ ID NO: 40871 - DNA, 601 bp, Human; identical to SEQ ID NO: 31011

SEQ ID NO: 40872 - DNA, 601 bp, Human; identical to SEQ ID NO: 31012

SEQ ID NO: 40873 - DNA, 601 bp, Human; identical to SEQ ID NO: 31013

SEQ ID NO: 40874 - DNA, 601 bp, Human
agtgtgagccatgaccaaatgggatgagaaatccaccttgatctggactttttgcttatgtgaaccaagagaccctttccttgctaagctagtttcagctgagttttctggtatttgttactgaaagcactcaattttataatcttttctaaatgatctaggagaaaatccacagtctaaatttgtgctagactaggctggtccaaaatcaggaaaatgcaaaagaatcagaataccattttcactagattcttagaatgaactctatccctagggaagatgtgaactctaaatcaaaatragacattaattgaaagatggacttcatttggccagaaggtaagaaacaaggagagtcaattatttgttacctggtaatgaactctctgggagccagaagaaactgactgtaggtcctaatgagaaaatgaaaaaaaaaatccataccttaaaattagtttgaacaagctgccccacaactcaatctcaactgaactcccaatttaatattactatgctcatctggaaagtatcgaacacacccaaattcataaaggttaaataaagaaggtaatgccagaaataataaaatcaaaccaag

SEQ ID NO: 40875 - DNA, 601 bp, Human
gtatacccaactgcctactcaccaacccccttggatctaacaggcatatcaaaactaatacggctaacacagaactctatttcctatgcctccaactcattcctcctttgatgatcttggccaaacatgaaagtttatctctcccagcttcgtgcttcaaccagttctccttgccctgctcaggaaattcctcattagcttctccctgtgctctggccacgttagttctaacacagtctctttttctttcctgtttaatgagcaaattctgggcttcttggatcttttttgttccaaccaytccttcatgctcaaagtcccctgatttttatcactcttcttgcgccttccttgtcctaaggaaggatatgggaaaaggtgacacctctgacactcatccctgatcactgcattcgttatcctagatgttcagcacacaaaaccttttgatgtggcatttataatgcagcagttttgacaccaagatttgacttgactgtaagtaaacaaaataatgcagcaatattttgacatagaaaaatatcattaatccttctgagtgttattaccaaacaatacatgcaatacataactcactcat

SEQ ID NO: 40876 - DNA, 601 bp, Human
taaatttcctgccagtcactttctacataaaaattaatagcacctatatcccatgtgttttataatacacacacctagaaaaaaatacggaaatcaatccatatcttttcagcctctcaatggcatttgacactgtccattactccttcctctctgaaatacatttcactcttggctttcgtgataccaccttctccttgatttccagcttccctgctgcttatctcagtttccatgattcttcttgaccagttgctgtcttgaacctgcactcttcttgactcatgaataaacatagatrgaacagtgggccctcctctttaactgaactcctccctaagtgatctcctccggccttgtagttttaagcaccattcatccatttgctgatgactccaaaatttctatctctgggcctgaattttttaatgaggtttaatattcgtatacccaactgcctactcaccaacccccttggatctaacaggcatatcaaaactaatacggctaacacagaactctatttcctatgcctccaactcattcctcctttgatgatcttggccaaacatgaaagtttatctctcccagcttcgtgctt

SEQ ID NO: 40877 - DNA, 601 bp, Human
ctagttctctctttattctaccctactacatctataaatgcctccttctgttctccatccctaccttttcttttgttcctcttctctctttctcctttccatttcctcatctaggtcttatacctatctggggttctcatttatgtactgagaaccgtcagagtgactcagggttcctcaagctctacactattgacatttggggctggataattcttcatggtaggaggcttctctgtgcacgctaagatgtttaacagcatccttggcctttatccaacagatttcaaagtcttcagaycttgccaaatgtcccctacagggagcaaattcttcccagctggaaatcactagaatggcacatctgcctctattccttagtacctttgtgatttggggttaagaagggatatcatgatttcgagggaggaagcagagaaggaattatctcaaagtaggtggcctcagaaaggacccttatcaaataagcaggtagagtccaattcttatgttaattcttgttcatttggcaacctcaagaatatcctaaatctgcaagtgcaatgcattttgcttgtaaaacatattagttacaggttac

SEQ ID NO: 40878 - DNA, 601 bp, Human
attcaggggcatcctctagtctctgcagaagggtgaaaagcagtgcaatgtggaccgtgaattagacttggaaggaaataggaagtaagaaaaactaatggctcctggaaagggggtgaatattggttccaggacagaccttagcttcatggaagctctaggttggacctggcgatgttctcatcactacacaagaacacaaatggtcagagtgtgtttgatttgtgaatgctgcacattaaataaatgtacagtgacctattttccaatagagagaaaaaacacaatcttaaaaatatgygtctttcaaaagcatctgacagtagatactgaagcaataggattgtatgaatgcagctatatttccctgagctgtgcctctaaccatcatatccaaagctttcaatggtaatttagggcctctagtctccccagtcctctcaaattgcatgatcaaatcaatgattcatcaaagagataagatacttgacttgcccattttggatctgtgacttttcttcatataaatggtgtgatttagatgaatgcaactgtcattgctctgtaatgtaggccaaatgacataaccttagatatacca

SEQ ID NO: 40879 - DNA, 601 bp, Human
caaactgctgggctcaagcgatctgcccatgatggcctcccaaagtgctgagatcacaggcatgagccactgcgcccagctacatttgtatttttaaacaacaatccccacatatgtattcatgtatgtctatgtgcgtaactttgtataaatgtaggaaaacaaaaatgcgcaccataaaggtctacattgggtggagagttaaaaaccaaacagaagtctagaattacgtacaatatcaaaactgaggtaaaccaagattataaaacctggcagattgcagaacacacatagcttatawaagtcaagagatataccatgaggaccttgatatcagagagaaatgcatattgtatgggttaaaaatggagcaggaataaagagaagcagaatatcagacaggaattcacaatttaccgcgatagtccataaactttttatgctcgcacattcttaacctaccatgaccacacagatgaatgggtttcttccgtacgcagggtacaaataattcctgcatcacgtctatctatacacctttctcttgtacttcaaaaaaataataataattggagtgtaagtgagtgatagtgatgttaat

SEQ ID NO: 40880 - DNA, 601 bp, Human
aaatatagccaatcttaatatgtttttagcatgttgcatggttttcatttctgttatgattttatttttgaagtaccataaagtttattggaattttgcaaacattggcaacaatactacacaacctaaaaatgccatccatagaaacagcattaaatatataccatggaatagagtgataatttttaaagactgaattagagtttcacctattagcaagatgaatttccatggtacattactgttaaaaataaattgtggtataatatgtatagtgtgcacatgcaaattgtaaacacakttttatttttagtgtaatttttatttttttttgagacagggtctcaccctgtcacccaggcgggagtgcagtggtgcaatctcagctcactgcatcctctgcctcctggactcaaacaatcctcccacctcagctgcccaagtagctgggactacaggcacatgctacagcgcccggctaattttggggttgtttttttgtacagacggggtttcaccatgttacccagactggtctcaaactgctgggctcaagcgatctgcccatgatggcctcccaaagtgctgagatcacaggcat

SEQ ID NO: 40881 - DNA, 601 bp, Human
aagaatcagagcttggtaattaaaaaaaaaaatagaagacagcagaataaattcattgttggcaaaccaaatggaaggctcaattcacatttaagaaagccctttcctttcaaagtctcaaatttggggctaaaaacctttgttctggagcagtagttttcaaatagtcctggtgctgacgtacggccaagaagtgccagcagatacaatcctgagtcatccaaccccgttacatagaggccagctgtcacgatgtcaagtagaacaggtagctcttgactctggctctcgttcattcctycctactcttagtcttccacctacagcttctgccctgactcatctccactgtctggcagtgaaggataagaaacactaatccggacaagctgtcaaaaaatcactgaaccacattttggtgatggtaattttcctttttttttctttttacggtgtgctcattttttgcttctgagaatttcccataaacatggctctacttctgtattaatggtggctatagattaaataaagcttagactattccattttttatttcatctactgaataatttatacttgataaaatttcactcagcca

SEQ ID NO: 40882 - DNA, 601 bp, Human
caacaagcatacatttcggaacattttattttactgatgtctcccttccccattcaatagtaactgcctacttgctatttccttagtttcaccaaaattaacgtgtcacttgctaatttgtcagttgtcacaaaactatacattattctttttcctgtgatacaactgtgatcaacctttttaatgtgtatttattaaagccaatgaaatgcaaggcatgtgacggaaggtcacaaaaaacgaagcatggaccatgtcgttaaagggtggccactacactaggaaccagtctaggtgctcygcatgcttctttctggctccaattcttggagttactgtaagtctgatttaccaagtttcaacttcttttcccaatggatgactattttaattacgatttcaatttatttcctggctactgccaacagccaccaattttggaaaaaggattttgagccagctgccaaaagaatcagagcttggtaattaaaaaaaaaaatagaagacagcagaataaattcattgttggcaaaccaaatggaaggctcaattcacatttaagaaagccctttcctttcaaagtctcaaatttggggctaaa

SEQ ID NO: 40883 - DNA, 601 bp, Human
ggctgaatgtcttctatcaccaacaagcatacatttcggaacattttattttactgatgtctcccttccccattcaatagtaactgcctacttgctatttccttagtttcaccaaaattaacgtgtcacttgctaatttgtcagttgtcacaaaactatacattattctttttcctgtgatacaactgtgatcaacctttttaatgtgtatttattaaagccaatgaaatgcaaggcatgtgacggaaggtcacaaaaaacgaagcatggaccatgtcgttaaagggtggccactacactrggaaccagtctaggtgctctgcatgcttctttctggctccaattcttggagttactgtaagtctgatttaccaagtttcaacttcttttcccaatggatgactattttaattacgatttcaatttatttcctggctactgccaacagccaccaattttggaaaaaggattttgagccagctgccaaaagaatcagagcttggtaattaaaaaaaaaaatagaagacagcagaataaattcattgttggcaaaccaaatggaaggctcaattcacatttaagaaagccctttcctttcaaa

SEQ ID NO: 40884 - DNA, 601 bp, Human
aaactaggtcaatttttacatggaaagactcaactttttgcttatttccatccatagtctctcccaagtgtttgttttcagtgccttaagttcttctacttatgttcatttttataaacaaagggaaaaaatgtatttatatttaccattgtatggtattaataattgaagttaaacaatacatcattacttaaaggcacaggaatctgattttaacaattggatactttcctggtgacctgacaattaaacttcaattttgggagttgttagaaaagcaaaagtagagttctaacttctstgaaatgcttccctgaaatacatttgcatcctcttccaacttttgtgaagctctttccaccttgttcctttaagaagaagtgagttcttaaagaaacagctactcacataataggtcctacgttaaaagtcatttgaattccaatgaaaaactgtaattactatctgggcagattcataatgcaactaaactacttatttaaaaattctacatatataaaatgtacaaaagcatcaagtctcaaaaaaaattgcccttgaatctattccatgtacatatctaagcagatgaaaatgcttc

SEQ ID NO: 40885 - DNA, 601 bp, Human
caacaaaagctctctgagcttgtggctattctcctaggagcagactgaaactaggtcaatttttacatggaaagactcaactttttgcttatttccatccatagtctctcccaagtgtttgttttcagtgccttaagttcttctacttatgttcatttttataaacaaagggaaaaaatgtatttatatttaccattgtatggtattaataattgaagttaaacaatacatcattacttaaaggcacaggaatctgattttaacaattggatactttcctggtgacctgacaattaaactkcaattttgggagttgttagaaaagcaaaagtagagttctaacttctgtgaaatgcttccctgaaatacatttgcatcctcttccaacttttgtgaagctctttccaccttgttcctttaagaagaagtgagttcttaaagaaacagctactcacataataggtcctacgttaaaagtcatttgaattccaatgaaaaactgtaattactatctgggcagattcataatgcaactaaactacttatttaaaaattctacatatataaaatgtacaaaagcatcaagtctcaaaaaaaattg

SEQ ID NO: 40886 - DNA, 601 bp, Human
tgggacaaacgagggaggccaggtctctgtggggaagacactgggagtctggcccttaatagggatttgaaatgttcaaatgtagggagcagcactggggtgcggctgtgcaggcagcaataaagacttggcagctgaagccgcaggtgtggatgatcttgtgtgtacagaggggacaggagaagaaaacaggaataacatagaagaagtaataaggacccaatcagaggttgtactgactttcctgggagttaatcaacactccctgctgccctacttgatcctcaaataaagcctgggmttaaatcacttgttctcaaagtgtgcatcagctagaaacttgtcagaaacacaaatttccagggcccatcccaggtctacagaagcactatgggtggaacccagcaatgtgttttaacaagcctttcagataggtctgaggatgtatgtgaaagaacctaaagttaccgaacaaaaggatgcatcttagtaaactagaaacctggagtgtatggagttttactctaaatgaattctgtgaattaaataattgatagaggaaaaaatggtctcattcaggaatgctaccaaaatctatatt

SEQ ID NO: 40887 - DNA, 601 bp, Human
ttacttccttatgggaatttctttctttccctttgtgaagccaaggaatgagtgacagctggctgtcattgacacataggtctaaggcgctggcacagaatgggaatgaatcaaacgttatctactggccacacgggacatacggtacgtgagaaaaagcagcagccatccatacacagggactgttcatctacatggaaacaaagaaaatcaacctcgcatactgaggtcatctctaacctcagccttctccactgaacctaattacagaggagtagacaaggaagaaaagtagtgccasgttaactcatgacaaaatcactctgtccaacactcatccagacagcaatgtgctcattcacctgagcattttctaggcgtctcatttctatgacctcccaatttcccctctcctatttaacatcaagtctgcctgacataactaccatcattctttcctctgggttcggataaaaatagttctcttctctccaaagtcaatcacttaatttagactctggactatctttctttctcctttgaactttatttctgtagcattattaaaatccactcattaattcttctgctctcaatagtt

SEQ ID NO: 40888 - DNA, 601 bp, Human; identical to SEQ ID NO: 31014

SEQ ID NO: 40889 - DNA, 601 bp, Human; identical to SEQ ID NO: 31015

SEQ ID NO: 40890 - DNA, 601 bp, Human; identical to SEQ ID NO: 31016

SEQ ID NO: 40891 - DNA, 601 bp, Human; identical to SEQ ID NO: 31017

SEQ ID NO: 40892 - DNA, 601 bp, Human; identical to SEQ ID NO: 31018

SEQ ID NO: 40893 - DNA, 601 bp, Human; identical to SEQ ID NO: 31019

SEQ ID NO: 40894 - DNA, 601 bp, Human; identical to SEQ ID NO: 31020

SEQ ID NO: 40895 - DNA, 601 bp, Human; identical to SEQ ID NO: 31021

SEQ ID NO: 40896 - DNA, 601 bp, Human; identical to SEQ ID NO: 31022

SEQ ID NO: 40897 - DNA, 601 bp, Human; identical to SEQ ID NO: 31023

SEQ ID NO: 40898 - DNA, 601 bp, Human; identical to SEQ ID NO: 31024

SEQ ID NO: 40899 - DNA, 601 bp, Human; identical to SEQ ID NO: 31025

SEQ ID NO: 40900 - DNA, 601 bp, Human; identical to SEQ ID NO: 31026

SEQ ID NO: 40901 - DNA, 601 bp, Human
aacaaacccacgtggcaatattgggtacagcacacatgcacaggctcaggactgaggaccactgaaacagcaagataatgtgttcacaaatgaaaaaccacgtgtcactttcaagctactcatgatcactctcatgcatgtctttatgatgtggcaaacagggacgtgtgataaacactaaactccagtaaagaagacactggtgaggtttaaagtatgtggaggtccacgtgcaaggggctcaaggtggctcaggagcaaaagaaatggaaggtggagttccatgaacggtttggggtasataaatatgagcaaggtgcatggaatgaaaacacagagtagcacctgcatgagacagcctgagcgccattgaaaagagaatcctgaccactggggcacagcccacagtacatcctctcccagcaatcacagtggcacagaggaaaagaacagcaagagaactcttactgtagcacgcgggagtggctgagatctttcagatctgagtcctcataatagggagctatcatccccagcccactgtcactcagcatgcgtttccgcagggcaggattccaccagtctgagatcctgagagaaa

SEQ ID NO: 40902 - DNA, 601 bp, Human
cctgaaattaaagagtaggtgcgcatgagtgtatctgtcaccagaggagatgatagggaggtggattcaccgagcacaaaggtatcgacactgctgtgaaacttcagcatgcatcctacactctcaccatgatcagacctcagaagaaagcacacatactgttctgatctacaaacaaatgctgtactgcttacccacagagactgcaaccacaacatgggcagcacccagctttagccaacaaacccacgtggcaatattgggtacagcacacatgcacaggctcaggactgaggaccamtgaaacagcaagataatgtgttcacaaatgaaaaaccacgtgtcactttcaagctactcatgatcactctcatgcatgtctttatgatgtggcaaacagggacgtgtgataaacactaaactccagtaaagaagacactggtgaggtttaaagtatgtggaggtccacgtgcaaggggctcaaggtggctcaggagcaaaagaaatggaaggtggagttccatgaacggtttggggtagataaatatgagcaaggtgcatggaatgaaaacacagagtagcacctgcatgagacagcctg

SEQ ID NO: 40903 - DNA, 601 bp, Human
aaagactaagactgtgtggttacaaggccattgtcattatttgattaagaccccaggtaaactggaaaccagcctaatttcatgaacacactggatttgcataacctctgagatggattgattggcctgaaattaaagagtaggtgcgcatgagtgtatctgtcaccagaggagatgatagggaggtggattcaccgagcacaaaggtatcgacactgctgtgaaacttcagcatgcatcctacactctcaccatgatcagacctcagaagaaagcacacatactgttctgatctacaaayaaatgctgtactgcttacccacagagactgcaaccacaacatgggcagcacccagctttagccaacaaacccacgtggcaatattgggtacagcacacatgcacaggctcaggactgaggaccactgaaacagcaagataatgtgttcacaaatgaaaaaccacgtgtcactttcaagctactcatgatcactctcatgcatgtctttatgatgtggcaaacagggacgtgtgataaacactaaactccagtaaagaagacactggtgaggtttaaagtatgtggaggtccacgtgcaag

SEQ ID NO: 40904 - DNA, 601 bp, Human
ctggtctttctccagaaacaaagcacttcctttgcctctttagttaaccctaggattcgaagaatcttcagttatcttgttattctgtcaaaagactaagactgtgtggttacaaggccattgtcattatttgattaagaccccaggtaaactggaaaccagcctaatttcatgaacacactggatttgcataacctctgagatggattgattggcctgaaattaaagagtaggtgcgcatgagtgtatctgtcaccagaggagatgatagggaggtggattcaccgagcacaaaggtatsgacactgctgtgaaacttcagcatgcatcctacactctcaccatgatcagacctcagaagaaagcacacatactgttctgatctacaaacaaatgctgtactgcttacccacagagactgcaaccacaacatgggcagcacccagctttagccaacaaacccacgtggcaatattgggtacagcacacatgcacaggctcaggactgaggaccactgaaacagcaagataatgtgttcacaaatgaaaaaccacgtgtcactttcaagctactcatgatcactctcatgcatgtctttat

SEQ ID NO: 40905 - DNA, 601 bp, Human
actgcaaaaacttatagctgtaaattgaagatcaaccaaaaattaagagacatccctaaaaagatagtttaacgcaaacagacagaaagagttcattttgacatctggttttaagaacctggctattatataaagtggtaaatttatttgtcattcttgggaagaatatttactatcttatatacaattattttatttattatgatacgtacatcagtatgttatatatagaaaaatcaggacctagaaaactagattgagctcatattctgctttgtggaaacagattatatatatatayacaactaaaatactcattggtttactgagtttttactcagtaaacaaatactggtttgtccaggcttaatttctatttctgtagctaattaaaacactaattttccaataagtctgccaacagataaatggccacttttttagccattcgtgggtggctgactcaccctgattcacaagcctcaattctgtataaaaaggaaatggaaaacatcctgaattataagcaatcaaaatgccatcagaaactaacaacacagtttaattaaaaagaaaaatccatagtaattcattgttgttc

SEQ ID NO: 40906 - DNA, 601 bp, Human
aagtttaccaccattatattttgtttcaatctcttcttttaaagaaaaaaatgcttaaaaattaattctcagccatatttacttctgggtaagtttgcagttgtatatttaatgtgcatgcatagtacccctatattgtaggacttttcactgtacaaatgtaaaaaagaaatagaaaccaaagtaaacttctgtggctctggtacgctgactttgtatggtccctttgggaagatagtgtaggacaatggaaaaagcatggagtcagaagccaaaccgacctcaggtcaaactacacttkccatttgaagtgacctaagataaatattttaccctctaggagcctcagtttacttatctgttaagcaacagctaaatttaaaaattgttgaatgaagatcatttaattatgatacaaagcaagtgggaagtagtccatcaatagtagttattattaacattattagatatttccacaactgcaattatacctatttgtatcagagatgatgtctgaaggaaataaaaagatattctaagaaataaatggacataataattttaaaagttaaagaattaattaaaaagttgaggtaaggca

SEQ ID NO: 40907 - DNA, 601 bp, Human
ggaccagaagtgcctcagattttttattttcttaggattttggaatatttgcattatacttaccagttgagcatcccaaatccaaatatctgaaatccaaaatgttccaataagcacttcctttgagcatcaggtcagcactttaaaagttttggattttggagcatttcagattacagattttccaattagagatactccaacttgtacaatacaaaacaaaaccataaaacaatattttttacactactctgtgttgtttatggcttgaaagaaagatataatgcaaatatagaaaaayaatgacataataaatcaaggtggttggtacatgatggccttctatataatttttacgcttattttgattagaacatagtttatatatatttagcaattttaaactgaagtttaccaccattatattttgtttcaatctcttcttttaaagaaaaaaatgcttaaaaattaattctcagccatatttacttctgggtaagtttgcagttgtatatttaatgtgcatgcatagtacccctatattgtaggacttttcactgtacaaatgtaaaaaagaaatagaaaccaaagtaaacttctg

SEQ ID NO: 40908 - DNA, 601 bp, Human
gcattttaaaaaataatagaatattagaaatcactatcgaaatagagaaacaatttatagcatatgtatgatgcaatattctatatcaaaaattattaaaaacccacatatatcaatatgaatgaatttcaaaaacacaatgctgagtgaaatggcaagttccaaaatatatgcattatataacacaggcaaaaacaaaaatacaagttgagtatcccttatccaaaatgcttgggaccagaagtgcctcagattttttattttcttaggattttggaatatttgcattatacttaccagwtgagcatcccaaatccaaatatctgaaatccaaaatgttccaataagcacttcctttgagcatcaggtcagcactttaaaagttttggattttggagcatttcagattacagattttccaattagagatactccaacttgtacaatacaaaacaaaaccataaaacaatattttttacactactctgtgttgtttatggcttgaaagaaagatataatgcaaatatagaaaaacaatgacataataaatcaaggtggttggtacatgatggccttctatataatttttacgcttattttg

SEQ ID NO: 40909 - DNA, 601 bp, Human
cttttgatttctgtttatatagtgagttatttagcactgtcaacaggatgctaaattgaacctttcctatcccccaagttgactggggctttaaagtgtaaagcaacagatgctgatcatacctagattattacaataagtgttcagggccttttcagttactgattcatcagtactctaactgggaaggtaaattttgcattatcgagtaagctgaaactgcatatatattctgcaacacagaagggcacaggatgtttgctgcattttaaaaaataatagaatattagaaatcactatmgaaatagagaaacaatttatagcatatgtatgatgcaatattctatatcaaaaattattaaaaacccacatatatcaatatgaatgaatttcaaaaacacaatgctgagtgaaatggcaagttccaaaatatatgcattatataacacaggcaaaaacaaaaatacaagttgagtatcccttatccaaaatgcttgggaccagaagtgcctcagattttttattttcttaggattttggaatatttgcattatacttaccagttgagcatcccaaatccaaatatctgaaatccaaaatg

SEQ ID NO: 40910 - DNA, 601 bp, Human
gaagaatgatatggggaaagccttgcaggtatatttctttctgttttcagtacttttttcttttaaatcagacttctcagaattttgttttatttatcttttcaacgaattttttaaattttttttttttttttttttttgagatggagtctcgctgttgcccaggctggagtgcagtggcacggtcttggctcactgcaagctccgcctcccgggttcacgccattctcctgcctcagcctcccgagtagctgggactacgggcgcccgccaccacgcccggctaattttttgtattttyagtagagacggggtttcaccatgttagccaggatggtcttgatctcctgacctcgtgatccacccgcctcagcctcccaaagtgctaggattacaggcgtgagccactgagcccggccaaaaattttattttctgttcatcatctgtctgttttattctccttgtcattgatttctctcattatctttatcatttttctcccctctcatttctttacactgggattctttttccaatttatcaaattgaatgctttgcttatttgcacacaatcatttttcccttgataaatgaatctgc

SEQ ID NO: 40911 - DNA, 601 bp, Human
ggaggaagaatgatatggggaaagccttgcaggtatatttctttctgttttcagtacttttttcttttaaatcagacttctcagaattttgttttatttatcttttcaacgaattttttaaattttttttttttttttttttttgagatggagtctcgctgttgcccaggctggagtgcagtggcacggtcttggctcactgcaagctccgcctcccgggttcacgccattctcctgcctcagcctcccgagtagctgggactacgggcgcccgccaccacgcccggctaattttttgtawttttagtagagacggggtttcaccatgttagccaggatggtcttgatctcctgacctcgtgatccacccgcctcagcctcccaaagtgctaggattacaggcgtgagccactgagcccggccaaaaattttattttctgttcatcatctgtctgttttattctccttgtcattgatttctctcattatctttatcatttttctcccctctcatttctttacactgggattctttttccaatttatcaaattgaatgctttgcttatttgcacacaatcatttttcccttgataaatgaat

SEQ ID NO: 40912 - DNA, 601 bp, Human
agaaaaagtacaactctttcagtcatttgggggtttcttacgaactacaaaatctaagaaccggaaaaaggttactctgattcagaaacaaaagcagtgtctcctagaccctttacctgcctgctcttaacccacctgactcagaggtgagtcagtccttttctcaaagaaaacttaagaagaatatatcagagttttcattccatgcctattttcttttctcatagatcctcaagtggcaaaattcttccttacaactcaaatagatttggtctgctaaaatttaagtaaattccctctytattaatcttctgccaaatgaaatatagtcttgtcactaatcgtggtggtacaattaatgataagagcaaatacatttccagaatcatgtcattttaaatagaacttccttggacactgaaaaaaaatttttttaacttaaagaaaaaatcattatggtcccagcagtaataatgtcagtcaaccacttctcaccaattcatttcaaaattggttcttaaatatttgttattatgttcacaggttttgcagacactatacacattgcgtatcctactttggaattacagtctttcctata

SEQ ID NO: 40913 - DNA, 601 bp, Human
tccattttagttctttcaggactaggacttggggacattgagaaaaagtacaactctttcagtcatttgggggtttcttacgaactacaaaatctaagaaccggaaaaaggttactctgattcagaaacaaaagcagtgtctcctagaccctttacctgcctgctcttaacccacctgactcagaggtgagtcagtccttttctcaaagaaaacttaagaagaatatatcagagttttcattccatgcctattttcttttctcatagatcctcaagtggcaaaattcttccttacaactcraatagatttggtctgctaaaatttaagtaaattccctctctattaatcttctgccaaatgaaatatagtcttgtcactaatcgtggtggtacaattaatgataagagcaaatacatttccagaatcatgtcattttaaatagaacttccttggacactgaaaaaaaatttttttaacttaaagaaaaaatcattatggtcccagcagtaataatgtcagtcaaccacttctcaccaattcatttcaaaattggttcttaaatatttgttattatgttcacaggttttgcagacactatac

SEQ ID NO: 40914 - DNA, 601 bp, Human
caaatagagtaattcaccaagtcatttcaaactcaaggtaagtcaagaagaaaaagaagaaggaagacatatgtcagctatcctgtatttttccagctggaatgagtatccggggtgagcaagattgagcccagtcaaaggtaagcagggatgtcaaaggtaggtagaaacgggacccaactatctcagtgaaacagatgccaggagccatctttatcctgacagcactgatttcatctctaagatatatttcagcaaaacctgcatcccactaagaagattaattttctcccgcttatcwgattgtgaagctgaaagaatatttccaaaatcaaaatcgctgtccaacagtctgtcttcctgttgagaacctgaaactttcacaataagcacaattaccctttttattaggttcaggccataacctaatgttcccagaagaaactgaataaagaaaatagttgaggaccagaggggaatgatgttgtttctcccataatcagcttagaacatctgagttttcagaacacaggaggtctccgggctttatcttctcgatatagtgattcagaattgcaattgcagactatactaaaaaggc

SEQ ID NO: 40915 - DNA, 601 bp, Human
cattcaggtgtgtctttattattttgatctgtgaattccctggatccagcatacttatattcaaatttgaaatatataaatggaacccacagcctaacaaaaatggtcaacattttacatattattttgttatcactattattttgttataatttgataagtactgggtttagtatagcaatataaatagacacgtatttattttggtttgacaaagcaccttttctatcaagggatgttctatgaatggaacatccttctattcatcccaaaagcctgccttgttggatgcctaccattytaggtatggtgcaaagtgctatggagacagagggagaaatgcacagtttggtcatccaaggaactcacatgctttaaagagggatccaatcaatactgcctcacattcacagtattcctgaagtgtgaataaatatggctgccagcttttacaaatgtaaaaagagagccacttaacactaatatttcctcatactctaatcattggcaaaacttggaactcatggcaatgaagggcgagaatttcctgggattatttcaaataaaatggatgtttaacattaaagtaagtttgtttgtt

SEQ ID NO: 40916 - DNA, 601 bp, Human
agtgctagcatggtgtggagatatctcttgttctgatcttcttagagtagggggttcagagggccccagaagtaccgcagagaagtcccatgcccgatatgactccccagccaccaccatttccagtgataatatgacatccctctcacattcctcaactccacactgaacatggtaagtgattactgctccacatcccagcaacttgagatttgcaagcgaatttttttgaaaatatttcaaaatgatcactctttcacactttagatctgtttaatcaaattattcacctaagacagayacactgagaaaacaagagtgttggtggaagttggagaatgcagccggggaccaacagtttattttggaggtgaatgcctgggaaacaattcttccttgccactctacctaccactgtgctcaccaacagtgcctacaacttcctataccgaccatacttaccttttactttctcgcttgtgaaataccaacatttctccaagtcaggcattcaggtgtgtctttattattttgatctgtgaattccctggatccagcatacttatattcaaatttgaaatatataaatggaacccacagc

SEQ ID NO: 40917 - DNA, 601 bp, Human
agcacactacaaataagtacaccactccttattgtgaagttcttgttggggaacaaagcagcacacgtatgtccacacactgaaaacaactcactatatgcgtattttattcaatttccctttcatgcctgtctttcctctttactgtctagctttggggatgagaaccacagcaaaaagaccactttctataaacatcaggtgatgatccatcctacttaggaagggaaagagaagctcttaatgtcagctctgaatgttctttctctgtcgtttcagtcatttacttgtatttcttttyccctctcctgaccacagccctgagagtttcctggactttctcatttacctttgtcacagttgggtggaatccagtctttcctggatagaacagcctcccatcatgtgctcacacctttttcctatggtgaacatgtaagaatgttcatgcctggtcagcattccccaggttccactttcctccctgcttcttgagccatgatgcttgtcctctgttacactcctacgtagtcccgaatgaaaaccgatttcccagttgggcattctctccaggcacatttcaacggtctgcatcacaact

SEQ ID NO: 40918 - DNA, 601 bp, Human
ggatagattagataaatattggggatgcctctatatgggactcttactttctgtaaagaaacatctacaaatgaatgtctatctctattccgtgtccccaacacatataccttctactcagcactgctaaaccatcacctggtggggagttggccaagggatggggccaccacatagagatgggcttaagataaacatgcaggacaggtgtgacagcagagtttaaataggcacaagagcatagattcatattctgaaaacactcagcagtgggattccccaggaccacagactatggatsgagtagaagaggtgggagacactcatccaattcacgggcctgactgaaatagccaaggccccttcattttctggctaccatcctgcaataagaaaaggaaacaaagcgggaatgctgggcaagctagacaccgtgctccttctacaccctacacagcacactacaaataagtacaccactccttattgtgaagttcttgttggggaacaaagcagcacacgtatgtccacacactgaaaacaactcactatatgcgtattttattcaatttccctttcatgcctgtctttcctctttact

SEQ ID NO: 40919 - DNA, 601 bp, Human
tgtctctaaaataaagacaacttttcaaactagcatacacagagaaacttggaaaaaaagggaagctcttggaaaacaaaatgctattttagatagaatattatgtaatttaactggtaaaaattaaaatattttcatactgaaaccagcacagtcatattatgtatccaaaagcaaaagtcccttgaatttttaaagtcacaaacttcgaaaacaaacaaacaaacaaaaaataaaacaggacaaaacagatatctgtgtttgaggcagtcagcttcagacaagtctccaggttcccaagaagtaagtttgttcctctggaacggagtgttgtcatggcagtctgaatatatgaaattacccaactaaacacagctataatatcttggaatgaatcattttattagattaatatatagagatatcacaaatcagggaacaagacattcagcacatattggctagtggctgctgcattacagacagcactctatctaaactcaagcatctctaagaaactcaaagatactttttttagattgccttcaatccacaaattttccttcaaagccttttatctttctagtagatcgattacaag

SEQ ID NO: 40920 - DNA, 601 bp, Human
aggcagaatagcaataggcgtgtgaaaaggagtacagatatgaaattgcatagaatcctaccagatatacaagtaactcagtattgctagaatgtaaaggagtaacaaaagcaaggacttgagaaataagtggcaagggccatttcatacatggcgtgtggggccccggtgaagtacttgcaatttaccttctaagctaaatggagcaagcttgtgaggcagagaagtcacacattctgcaatgagcaggcagtggagagtgaaccataaaataacaagaagacaaattaaaaggcagagstcaagttaaagactatgactgaaaaacttccatgttagtaacacagaaaaaaaattcctctgcccttcaatttttttgaaacccatggaaaatgacagggaggatgagaaatggtaaaggaaataccctctttgattaaactaggtatttataagcccaaaccatcatacatgaagaagagctaccaagtacagtaaaaatagagctaagttttagggaaacagataattttgattttagtcagctaaagagatataaactatttcatacacaacaaaatctatggcagaaagccttcca

SEQ ID NO: 40921 - DNA, 601 bp, Human
taagcctaaatcattattattcaggtttgactctctccatttatgttgattcaatttattacttgagaccctattattaccaggccatgtgccaagggaaggaaacacaaagaacaatttcagggaactcataatctagtgaaaaagaaaaatatgtaaataaatgattataatgtaaaaaatatataatgatcaaaatatatatgaggcaaagaggtagcacagagaacagggagattgattcagtatgaaaagtgtgaaagaaggcttagaaaaacaagaatcatctgaacttggcttygaagaataaagaggagcttattaggtaagttaggaaggagaagaactccaggcagaatagcaataggcgtgtgaaaaggagtacagatatgaaattgcatagaatcctaccagatatacaagtaactcagtattgctagaatgtaaaggagtaacaaaagcaaggacttgagaaataagtggcaagggccatttcatacatggcgtgtggggccccggtgaagtacttgcaatttaccttctaagctaaatggagcaagcttgtgaggcagagaagtcacacattctgcaatgagcaggc

SEQ ID NO: 40922 - DNA, 601 bp, Human
ttgatatgactttatctactggttagtaagattactgtttattatgtgagtgaacagtaaagaataaagacacagtggtaaaggagaaaaggccttgaacctcaatgagtggcaaagtatcaatttatttcaactgtgcaaatctcttaaagtagactttttcatgaaaactacagagtcccaagatttggtggaaagaaaattggcttctgggagatggacatgggggtggtgagcggaaacctgccacaatccctagtcaacactgcctgagaagcaccatttggcctccctgggtagrgttgatttatcctcccactggattcccttattttttatcatccacataccagcctttctcactgggttgtaacccccttgaaaactaaggctgtatcttatttagaacagatgagcccttaattaaaatgtgttgaattgaattaatctcagttccatcacactgatattcagactgacacattctggagcttcccaaaaagtcatcatgttactgtaaaaccatccttaagacaagcttgcctgctcctaggccagctgcaaggaaaagtcctagagacttgaaagtgcctgaagctcc

SEQ ID NO: 40923 - DNA, 601 bp, Human
atggttgaaaataatttttagctactttgggatgcttgatatgactttatctactggttagtaagattactgtttattatgtgagtgaacagtaaagaataaagacacagtggtaaaggagaaaaggccttgaacctcaatgagtggcaaagtatcaatttatttcaactgtgcaaatctcttaaagtagactttttcatgaaaactacagagtcccaagatttggtggaaagaaaattggcttctgggagatggacatgggggtggtgagcggaaacctgccacaatccctagtcaacaytgcctgagaagcaccatttggcctccctgggtagggttgatttatcctcccactggattcccttattttttatcatccacataccagcctttctcactgggttgtaacccccttgaaaactaaggctgtatcttatttagaacagatgagcccttaattaaaatgtgttgaattgaattaatctcagttccatcacactgatattcagactgacacattctggagcttcccaaaaagtcatcatgttactgtaaaaccatccttaagacaagcttgcctgctcctaggccagctgcaagg

SEQ ID NO: 40924 - DNA, 601 bp, Human
ccccccagttgactactagttgaaatactttgagtagtatagacctaagtttggagatgaattcacctccagcttgaagactacggctttgactcacacttattcttttctgaggagaaagagagagacatataacattatattcagagttgttgaaatttcgaagggaaagacaagacatcacatacttcccctattttgaaggagtcctcttctctgaatgattggctcactcaaatccatagcagggaaatggccaaagataaactcaggagtttggcaatagagctgccaattactrtaactaatatttatgagacatgaagataaacctcaggacaagaatcattcagtcaatacaaaaatggttgaaaataatttttagctactttgggatgcttgatatgactttatctactggttagtaagattactgtttattatgtgagtgaacagtaaagaataaagacacagtggtaaaggagaaaaggccttgaacctcaatgagtggcaaagtatcaatttatttcaactgtgcaaatctcttaaagtagactttttcatgaaaactacagagtcccaagatttggtggaaagaaaa

SEQ ID NO: 40925 - DNA, 601 bp, Human
acagcatgaggccagaaggcaatcactgaggttcctcagaactttatcaacaacttttgcaaactatatgtgagttctgctttaattatgataatcagatctcaaatgaaaaatcatatcaaccctaaaaggcttgcttccccccagttgactactagttgaaatactttgagtagtatagacctaagtttggagatgaattcacctccagcttgaagactacggctttgactcacacttattcttttctgaggagaaagagagagacatataacattatattcagagttgttgaaatttygaagggaaagacaagacatcacatacttcccctattttgaaggagtcctcttctctgaatgattggctcactcaaatccatagcagggaaatggccaaagataaactcaggagtttggcaatagagctgccaattactataactaatatttatgagacatgaagataaacctcaggacaagaatcattcagtcaatacaaaaatggttgaaaataatttttagctactttgggatgcttgatatgactttatctactggttagtaagattactgtttattatgtgagtgaacagtaaaga

SEQ ID NO: 40926 - DNA, 601 bp, Human
ccaaaaccacaaaaccacaaaaagtttctgctgatgggactgaaatcaggcagaataaattaaggcttcacaatattcgtcaaccagacgggttggaacagatttgaaagatatcaaattcagctagggtgatttaagtttttaaaagtgtttgacatttcacattcaaaaaccacaaagccaatatcttagagacatttgcttaaacaattatttgctctgacaatgaactgcaaagaccaggggtcaagtttcaatcctgaattggtataaataagacagatgattcttaccatgatcytctgaagagactggtgacctaaaaggaaataataagcatgatcaatattttatatgataattataatgataatcaagaataatttcatagtaattttaccctcaaattgaattaaatggaaagtcaatatagtagacagtgtaattaatgtgttgattgcatggtatatttcaatcaacaattcccaactcttacctggattggttggatgttacaggttactaaaatatcagtctatgcatggtgtcctaggactgcaacaaacttagctaagtctagatttaccacacaaaaaaagag

SEQ ID NO: 40927 - DNA, 601 bp, Human
cataactgatcattgtagacacttaacacttttgtgactgattggataaatgaacaactccaaaggtgagatggaacaaaatgagatattttctcttttgagtgaattagctgtctcttaaaatgcaaacaattcatctcaactgggtaacaacaaataccactgactgcttgccttcctttcagatttagagtgctcttcacaaatgagtgattggaacatgatcccaatgtccattctggaagggactgtagggaatatctaccacaaactaccacaaaaatttttatcattttaaggwtaaaaatctgagtcataaaaagcacaggactagtccaaaaccacaaaaccacaaaaagtttctgctgatgggactgaaatcaggcagaataaattaaggcttcacaatattcgtcaaccagacgggttggaacagatttgaaagatatcaaattcagctagggtgatttaagtttttaaaagtgtttgacatttcacattcaaaaaccacaaagccaatatcttagagacatttgcttaaacaattatttgctctgacaatgaactgcaaagaccaggggtcaagtttcaatcctgaatt

SEQ ID NO: 40928 - DNA, 601 bp, Human
atttgtaaaacataactacatagcataactgatcattgtagacacttaacacttttgtgactgattggataaatgaacaactccaaaggtgagatggaacaaaatgagatattttctcttttgagtgaattagctgtctcttaaaatgcaaacaattcatctcaactgggtaacaacaaataccactgactgcttgccttcctttcagatttagagtgctcttcacaaatgagtgattggaacatgatcccaatgtccattctggaagggactgtagggaatatctaccacaaactaccayaaaaatttttatcattttaaggataaaaatctgagtcataaaaagcacaggactagtccaaaaccacaaaaccacaaaaagtttctgctgatgggactgaaatcaggcagaataaattaaggcttcacaatattcgtcaaccagacgggttggaacagatttgaaagatatcaaattcagctagggtgatttaagtttttaaaagtgtttgacatttcacattcaaaaaccacaaagccaatatcttagagacatttgcttaaacaattatttgctctgacaatgaactgcaaagaccag

SEQ ID NO: 40929 - DNA, 601 bp, Human
aggtatggataccaattatgagagaatttccaaagtccaagtaagatacaaaggggccccaaaccaaagttccatatagcatatttgtaaaacataactacatagcataactgatcattgtagacacttaacacttttgtgactgattggataaatgaacaactccaaaggtgagatggaacaaaatgagatattttctcttttgagtgaattagctgtctcttaaaatgcaaacaattcatctcaactgggtaacaacaaataccactgactgcttgccttcctttcagatttagagtgytcttcacaaatgagtgattggaacatgatcccaatgtccattctggaagggactgtagggaatatctaccacaaactaccacaaaaatttttatcattttaaggataaaaatctgagtcataaaaagcacaggactagtccaaaaccacaaaaccacaaaaagtttctgctgatgggactgaaatcaggcagaataaattaaggcttcacaatattcgtcaaccagacgggttggaacagatttgaaagatatcaaattcagctagggtgatttaagtttttaaaagtgtttgacatttc

SEQ ID NO: 40930 - DNA, 601 bp, Human
agacaaagattccatcatttagtgcttactagtccatgctaaaatacaatattgaaaagctgaacacaattattggtcggctggaaagatttcattctagaggccatcggagcagatttttactatggaacgatcattttggtgctagcccggtatacagtgtactagggaaaagaaatatagaggtatggataccaattatgagagaatttccaaagtccaagtaagatacaaaggggccccaaaccaaagttccatatagcatatttgtaaaacataactacatagcataactgatcaytgtagacacttaacacttttgtgactgattggataaatgaacaactccaaaggtgagatggaacaaaatgagatattttctcttttgagtgaattagctgtctcttaaaatgcaaacaattcatctcaactgggtaacaacaaataccactgactgcttgccttcctttcagatttagagtgctcttcacaaatgagtgattggaacatgatcccaatgtccattctggaagggactgtagggaatatctaccacaaactaccacaaaaatttttatcattttaaggataaaaatctgag

SEQ ID NO: 40931 - DNA, 601 bp, Human
gcctggatgctagcgaataatactatgtttggggtgcttttaacaaatcagaaagtgggccgggcacggtggctcatgcctgtaatcccagtactttgggaggccgaggtgggcgaatcgagaggtcaggagatcgagaccatcctggctaacacggtgaaaccccgtctctactaaaaaatacaaaaaattagccgggcatggtggcggccgcctgtagtcccagctacttgggaggctgaggcaggagaatggtgtgaacccgggaagcagagcttgcagtgagccgagatcgtgccaytgcactccagcctgggcgacagagtgagactccgtctcaaaaaaaaaaaaaaaaaaaaaaatcagaaagtgatttcacaaatgatttctcaattgaacttgctacaatcccatgaggtacgcagtttatgattagctccattttacagacaaggaaaagaaaacaaacaagataaggtaaaggacaaagccactgtatttaagctctctatgcaagagtaccatgggaatgaaaaataccagggttattggacgttgcaaaattagatttttccaagaataagttcttgtcttagagcca

SEQ ID NO: 40932 - DNA, 601 bp, Human
caatacagaggaaatgcagaggacagtgcaatcaatcactgccaagcttatcttctaacaaggagtagggctccagtttccagatgtaacattaaaacttaatgtttccactggggtttagcatggcaggtttccctgaaacttcagtttcactcagttaactaattatgagaaaatgtgacattggtatttcctttttctacagggacaaatcattaccagcaggagggagaagttgttatttttgttctgctctgttttgtcattaaaaagaaattaacttacacagtagtaaatataytcttgttagaggagggaagaattatctccatagttctatccattcaatcatgtctttggttttccagggacatggccgataaaagagagttaagagtttgattgttagaattgggtctgaaaattaactctctcacctactagctatgtgaccttaagcaagttatttaagcactctgagcctgcttttgcagctgtgaaactgggggtgatacattgactacagagtgttatttgtgaaagatgaaaggacataaggcagttggagcatgcgagcacagtgcttctgcataataagcac

SEQ ID NO: 40933 - DNA, 601 bp, Human
atgttccagtggggcatgcagcagattgctggcactttctttgagaagccactaatgccttttattttgtaaatgaacagacattagttggaagatgacctgccctgagtgtgctggcacaggtagcagcagtaagtgaagcagcggtaagcgcagcattccaaggagcctgtaaaataagcaggctaaggtgacagaaaggaagatgagttctcagagccagggaagcagcctgggcccaggagatggctccaggagcaatttaaatgacgaagtgataggcattcaatacagaggaaaygcagaggacagtgcaatcaatcactgccaagcttatcttctaacaaggagtagggctccagtttccagatgtaacattaaaacttaatgtttccactggggtttagcatggcaggtttccctgaaacttcagtttcactcagttaactaattatgagaaaatgtgacattggtatttcctttttctacagggacaaatcattaccagcaggagggagaagttgttatttttgttctgctctgttttgtcattaaaaagaaattaacttacacagtagtaaatatactcttgttagaggag

SEQ ID NO: 40934 - DNA, 601 bp, Human
agatgttccagtggggcatgcagcagattgctggcactttctttgagaagccactaatgccttttattttgtaaatgaacagacattagttggaagatgacctgccctgagtgtgctggcacaggtagcagcagtaagtgaagcagcggtaagcgcagcattccaaggagcctgtaaaataagcaggctaaggtgacagaaaggaagatgagttctcagagccagggaagcagcctgggcccaggagatggctccaggagcaatttaaatgacgaagtgataggcattcaatacagaggamatgcagaggacagtgcaatcaatcactgccaagcttatcttctaacaaggagtagggctccagtttccagatgtaacattaaaacttaatgtttccactggggtttagcatggcaggtttccctgaaacttcagtttcactcagttaactaattatgagaaaatgtgacattggtatttcctttttctacagggacaaatcattaccagcaggagggagaagttgttatttttgttctgctctgttttgtcattaaaaagaaattaacttacacagtagtaaatatactcttgttagagg

SEQ ID NO: 40935 - DNA, 601 bp, Human
ctctcaagatgaagaaaagagtattaaataaaattcaacatctgttgaatttaacaaattagagcgaaggaaaagatccttataagaaatatccacaaaacaagtactgtcacctgcatcatgaccacctggcagtgaacttcttacttaattgtgacttgtggatggcactcactttgggatcaggaacaagtcaatgatgctgactatctctgttactagtcaatactgcactgaaggttttaaccagtgcagaaagcaccagaaatatgtatacaaagcataatgattggaaaggacraaacaaaattctttgtagatgagattgcctatatagaattctcttcccacaaaaagacgcttcagataagatttatgaatttaaaactttagcaggaatattgataaagaaacaagattttaaaattcaactgcatttcaatatgccagcaaagactacttagaaaacataattttaaaaatacaacatacaaattgtcactaaaaatataaagtacctaggaatatatttaacacaaaaatgaccaaatccttcatgaaggaaattataaaactctattcatagccatttgaaaaagcc

SEQ ID NO: 40936 - DNA, 601 bp, Human
actaatcacacttatgaacatggatgtaaatatctaaacaaaatattagcaaatcaaatctagcaatgtataaaggcggtaaatataagaaccaatctgagttcttctcataaatacgatattgatttctatttaaaaatcaattagtaaaatgcaccatattaacagaccaaggggaaaaaaattgtcatctctcaagatgaagaaaagagtattaaataaaattcaacatctgttgaatttaacaaattagagcgaaggaaaagatccttataagaaatatccacaaaacaagtactgycacctgcatcatgaccacctggcagtgaacttcttacttaattgtgacttgtggatggcactcactttgggatcaggaacaagtcaatgatgctgactatctctgttactagtcaatactgcactgaaggttttaaccagtgcagaaagcaccagaaatatgtatacaaagcataatgattggaaaggacgaaacaaaattctttgtagatgagattgcctatatagaattctcttcccacaaaaagacgcttcagataagatttatgaatttaaaactttagcaggaatattgataaag

SEQ ID NO: 40937 - DNA, 601 bp, Human
atcctagttctaccttttactcaataggcatgttttctcatctgtaaaatgaaaataatagtagtatatacaagatattccagaaataggtagctcaagtattgtacaaagccttccagagattataaaagaggaaacccttcctaattcattttaagctatgaatatcatatacatactacataatagaaagcaaaattaaagactaatcacacttatgaacatggatgtaaatatctaaacaaaatattagcaaatcaaatctagcaatgtataaaggcggtaaatataagaaccaatytgagttcttctcataaatacgatattgatttctatttaaaaatcaattagtaaaatgcaccatattaacagaccaaggggaaaaaaattgtcatctctcaagatgaagaaaagagtattaaataaaattcaacatctgttgaatttaacaaattagagcgaaggaaaagatccttataagaaatatccacaaaacaagtactgtcacctgcatcatgaccacctggcagtgaacttcttacttaattgtgacttgtggatggcactcactttgggatcaggaacaagtcaatgatgctga

SEQ ID NO: 40938 - DNA, 601 bp, Human
gttgcagtgagctgagatcatgccactgcactacagcttgggtggcacagtgaaactccatctcaaaaaaaaaaaaaaaagtaaactaggacttggacaccagctctcttcctttttctaactccttttttcccgttacttttttattttacaatgtgttaatattttaacttaaatattctataaccccaaaagcaacccaatgcaatgctgtaggtaaattttaataaagagtattcccgcagctgggcatggtggctcatgcctgtaatcccagcactttgggaggccaaggcaggcrgattgcctgaggtcaggagtttgagaccaggctgaccaacatggtgaaaccctgtctccactaaaaagacaaaatattacctgggcgtggtggtgcacgcctgtaatcccagctactcggaaggctgagacaggagaattgcttgaacctgggagacggaggttgcagtgagccgagattgtgccactgcactccagcctgggtgacagagcaagacttcatctcaaaacaaaacaaaaacaaacaaaaaagagtattccctcatcttctccagccacttacaatcaaccttcaaaagac

SEQ ID NO: 40939 - DNA, 601 bp, Human
tttcaggatgaagaaattgaggtttaatgacattaagtaatttgctgaagacctcatggctaatatggaataaaaccagcatgtagaaccaggatgtgaaatatttatgagatatgagaaagcctgtctctttagcagggtactaccttgcctgctcatctggttgtatagactgtcaaacaatactatggggtcattaggtagtaatacaaggtccttccttcccaatatttccctggtaaggccaaagggatgtagttttagtggtctccatatcccatactcttgtggctctgatgarggaagttgtagaaaatcaagttgctctgctgggtgaaggaaaggcttcagcaatgaacttctggaaagtattatgtgaagttgtgcttgcttgggaatggatgttacaggatgctaagaaagtcacaccctaagatttagggcacccaaaatgaacccagaaattgaggattgacataacaagtctggcaaaacaaggaagcatttagttgacttaattagcttgtaagatggctggactggtgaatattttaacagctttatccaggacagtccagacctaagcagctataattgacag

SEQ ID NO: 40940 - DNA, 601 bp, Human
tctcttgcacacttcatctcttcctgtctctttcttttgttgatgtttgtaagcaaactgtatgctaggtctttgcctatattacctaatttaatcctcacaataagcctattagatatatactcttattattatcatcctcattttcaggatgaagaaattgaggtttaatgacattaagtaatttgctgaagacctcatggctaatatggaataaaaccagcatgtagaaccaggatgtgaaatatttatgagatatgagaaagcctgtctctttagcagggtactaccttgcctgctyatctggttgtatagactgtcaaacaatactatggggtcattaggtagtaatacaaggtccttccttcccaatatttccctggtaaggccaaagggatgtagttttagtggtctccatatcccatactcttgtggctctgatgagggaagttgtagaaaatcaagttgctctgctgggtgaaggaaaggcttcagcaatgaacttctggaaagtattatgtgaagttgtgcttgcttgggaatggatgttacaggatgctaagaaagtcacaccctaagatttagggcacccaaaatgaac

SEQ ID NO: 40941 - DNA, 601 bp, Human
cgcattggtagaaaagctgggggtacagatttctatagagaacagtcagcttagcagaatgaaggaagacataagaagcacttccatttgataacagggacctctaaaatagggtcagggaggagtgtgtcaggagtagcgggaaaatgagatgctgagagaaccccattcaggactcagaggggagtgtgaggccaaagactctccctcctctccccgaactcccacccctataacatcaacaaaaaatcactcggagacttcattcagactatatcctcacacaagtctaccaccctcytccccaaagagaactagaagtttaaatatatagcagaaagacagctgggaaatcagatgcttgaagaatggctttgggtagaccatgctttttgacaacaggaaaaagcccacaggatagctaaagaagattgggtgactagagaggcacacagtcagagaaacaaagcaaacagttaacagacatagtcatggtttaaatcactttcttgcaatcttataaaataccttttttttttttttctcaatggctgaaacaattgtcttcactagcgagggtgacaggatggaaatgtaacca

SEQ ID NO: 40942 - DNA, 601 bp, Human
aataataaaataaaaaataattttaaaaaaagaaaaagaatatctagaaacttaatatgtatatacttatacatccaaatgtagtccctgattgctaaagaaatagagtgatgtagagaatgatttcctagagaaggtaaaagaaattttccaaaaacgaagattcgcattggtagaaaagctgggggtacagatttctatagagaacagtcagcttagcagaatgaaggaagacataagaagcacttccatttgataacagggacctctaaaatagggtcagggaggagtgtgtcaggartagcgggaaaatgagatgctgagagaaccccattcaggactcagaggggagtgtgaggccaaagactctccctcctctccccgaactcccacccctataacatcaacaaaaaatcactcggagacttcattcagactatatcctcacacaagtctaccaccctcttccccaaagagaactagaagtttaaatatatagcagaaagacagctgggaaatcagatgcttgaagaatggctttgggtagaccatgctttttgacaacaggaaaaagcccacaggatagctaaagaagattggg

SEQ ID NO: 40943 - DNA, 601 bp, Human
gttaagtatgtactagagctcaaaaagattataagcttataagtcatccagtcatcaggatacacattacatttcttctcagtgactagcagcaaactgaccactctgtaatataaaggctttttaaaccaaaaagaagaacagccaaacacccctcactggaacaaaagtaaagtcaggaaggagttaatttagcaaaggtcatgttcagagacataccagcaaaatgcacatacggcaaaagtgtacaattaaaaaataaataaaatgtcaagagcataccctcacttattattgtaamtatagattatttgcattatttatttatcaattttttattatactttaagttctgggatacacgtgcagaatgtgcagctttacataggtatacacttgccgtggtggtttgctgcacccaccaacccatcatctactttaggtatttctcctaatgctatccctcccctagacccacccctactgggttataataaaacattaattttgaatcttccccatataagcatatgacagttattacttggaagaatataaaaattaagcattttatttcagaaaagtaaaaataaatcttaac

SEQ ID NO: 40944 - DNA, 601 bp, Human
ttactggttttaccaaacatcaagactgtttggaaaatgatgtttaaggtcagaagccaagtacagttaagtatgtactagagctcaaaaagattataagcttataagtcatccagtcatcaggatacacattacatttcttctcagtgactagcagcaaactgaccactctgtaatataaaggctttttaaaccaaaaagaagaacagccaaacacccctcactggaacaaaagtaaagtcaggaaggagttaatttagcaaaggtcatgttcagagacataccagcaaaatgcacatasggcaaaagtgtacaattaaaaaataaataaaatgtcaagagcataccctcacttattattgtaaatatagattatttgcattatttatttatcaattttttattatactttaagttctgggatacacgtgcagaatgtgcagctttacataggtatacacttgccgtggtggtttgctgcacccaccaacccatcatctactttaggtatttctcctaatgctatccctcccctagacccacccctactgggttataataaaacattaattttgaatcttccccatataagcatatgaca

SEQ ID NO: 40945 - DNA, 601 bp, Human
atagaatcctatttacggttttgttaggcaaacattaagctttcaaaaaaaaccagggaggagttttcatatttgtaaagcattttctttttcttttctttttttttttttttttttttttttttgagatggagtcttgcactctcacccagactggagtgcagtggcgccatctcagctcactgcaagctctgcctcccgggttcacgcaattctcctgcctcagcctctcgagtagctgggactacaggcgcccgccaccacacccggctaattttttgtatttttagtagagacgggktttaaccatgttagccaggatggtctcgatctcctgacctagtgatccacccgcctcagcctcccaaagtgctgggattacaggcgtgagccaccgcgcccacccttgtaaagcattttcatcatgaacctaaaataattacagtacactgtaacattcttttccccttcttaacatttgaatgaaataatatgtgtgttggaaactgatgtagcaatgcaagagattttttttaagaagttctagtactctgaaggtccttcatccctataatgttgagagagtttaatttagattgtc

SEQ ID NO: 40946 - DNA, 601 bp, Human
agggagtggaagaaagctcaccttactggcccctgctacaccttgcaatcaattttggagacacagatatcttcaaatctctttgtaaatctcatggtgtttgttagttgcatctagtaaacacagcaaaacaccactgcaactatctcatgagatcagaaatgtttatgagtcaactcagagctgtatatcagcaatgatacttgttacttcctagaacattgatagtaacgcttagataagtgttaaagcaaacttcgtgggtgaattaatttgctttgagcactgggttagtgaaaamaagctcatgggttacagggccaatagactcacactcttccagaatcacagcatgtcactttcaacctgctgtgtaacatacatgacgccagtcacaaaggaccagcaaagggtcttaaaataccttctggaaaatctctataactcaatatcaattctttctctagcaataaattaatatcgtcacctttggatgtaatgggaaaacatatttttatatagtaccaccatctaaagtaatatacagctattcccttaaaactagaaaaatataaattcatttctaacatcaatattatag

SEQ ID NO: 40947 - DNA, 601 bp, Human
gccaacagagacaaaatccatcgcaaatgtgacacaaataattctcttgatcttatcatgactgaagtcttcatagtttgcctttattcaatccgttacttcttgcgtggctaccagataacttataccatagctgcccaatagctcactctctgagatacatatttctgcatagcctttgctgtatttaccttatcagaaacattctgtccaatttttctattttgtgagcagccagccatggtacatgagcaacaaactgtgaaggcttagctcgcaaaaaaatgaaatttagtataaycatcaaacacagcaaaggtaatctaacacgaattcacaggtatggatgaccgctgtgaattatgctaatgaggcataaatgggaagcagctcaagaaaaatgactgtaattaatattattctacataggcatactgaataagtccaagatgaggtgagaaaaagaatgaattatataaatttctaaagacctctgcatttttatctaggcctagaggactttttcacaatcagtaaaaagacatgtgacaaattatttgttataataaaagttaaactactgaaggtttttaacatatta

SEQ ID NO: 40948 - DNA, 601 bp, Human
ataaaaagtatacagaacttggcaaagccatatatatatgtttgtgattctcaataaagcaactgaaataactacattgttacatgcaaaatagaatcacaactctgaacacttatgtctattttttaaaagtttgatctttcatattcagttatttttttagttttaaaaataatatcctattaccacattgttgtctgcccatagtagcagtcagctaactctttttttccaaaattatagaagaaaaaaataaaagtaaatataaaaactgctaaacaaagaatggcttgaaaagacrtagggaaaaacatcagttgattcactgggaatcataaatgcatctagctttgccaagttctgtgaacttttactcctaaatattttcatgtgcaaagcaagagtcacaaccctaaactatttcttgaggagtaataatactctactttctagcgtgtatttggtcttagtctaacctttcatttcatagatgaggaaagtagggcttgagatctgaactgacctttgcaggatcacacagattacttagcaatccagctgagagacaaaggactcttgtttcatttacttgcctcccccc

SEQ ID NO: 40949 - DNA, 601 bp, Human
aataaaaagtatacagaacttggcaaagccatatatatatgtttgtgattctcaataaagcaactgaaataactacattgttacatgcaaaatagaatcacaactctgaacacttatgtctattttttaaaagtttgatctttcatattcagttatttttttagttttaaaaataatatcctattaccacattgttgtctgcccatagtagcagtcagctaactctttttttccaaaattatagaagaaaaaaataaaagtaaatataaaaactgctaaacaaagaatggcttgaaaagayatagggaaaaacatcagttgattcactgggaatcataaatgcatctagctttgccaagttctgtgaacttttactcctaaatattttcatgtgcaaagcaagagtcacaaccctaaactatttcttgaggagtaataatactctactttctagcgtgtatttggtcttagtctaacctttcatttcatagatgaggaaagtagggcttgagatctgaactgacctttgcaggatcacacagattacttagcaatccagctgagagacaaaggactcttgtttcatttacttgcctccccc

SEQ ID NO: 40950 - DNA, 601 bp, Human
ggggaataaaaagtatacagaacttggcaaagccatatatatatgtttgtgattctcaataaagcaactgaaataactacattgttacatgcaaaatagaatcacaactctgaacacttatgtctattttttaaaagtttgatctttcatattcagttatttttttagttttaaaaataatatcctattaccacattgttgtctgcccatagtagcagtcagctaactctttttttccaaaattatagaagaaaaaaataaaagtaaatataaaaactgctaaacaaagaatggcttgaaragacatagggaaaaacatcagttgattcactgggaatcataaatgcatctagctttgccaagttctgtgaacttttactcctaaatattttcatgtgcaaagcaagagtcacaaccctaaactatttcttgaggagtaataatactctactttctagcgtgtatttggtcttagtctaacctttcatttcatagatgaggaaagtagggcttgagatctgaactgacctttgcaggatcacacagattacttagcaatccagctgagagacaaaggactcttgtttcatttacttgcctc

SEQ ID NO: 40951 - DNA, 601 bp, Human
gccccatcacacagaaaaagaattattttagactaaggtagaatttggcatatgactacttctgaagggatggcttaaggttgtaattattgctgtacagaagacaatattggggaataaaaagtatacagaacttggcaaagccatatatatatgtttgtgattctcaataaagcaactgaaataactacattgttacatgcaaaatagaatcacaactctgaacacttatgtctattttttaaaagtttgatctttcatattcagttatttttttagttttaaaaataatatcctattrccacattgttgtctgcccatagtagcagtcagctaactctttttttccaaaattatagaagaaaaaaataaaagtaaatataaaaactgctaaacaaagaatggcttgaaaagacatagggaaaaacatcagttgattcactgggaatcataaatgcatctagctttgccaagttctgtgaacttttactcctaaatattttcatgtgcaaagcaagagtcacaaccctaaactatttcttgaggagtaataatactctactttctagcgtgtatttggtcttagtctaacctttcattt

SEQ ID NO: 40952 - DNA, 601 bp, Human
cagcagggagaactgatgtttttagccccatcacacagaaaaagaattattttagactaaggtagaatttggcatatgactacttctgaagggatggcttaaggttgtaattattgctgtacagaagacaatattggggaataaaaagtatacagaacttggcaaagccatatatatatgtttgtgattctcaataaagcaactgaaataactacattgttacatgcaaaatagaatcacaactctgaacacttatgtctattttttaaaagtttgatctttcatattcagttatttttttagttttaaaaataatatcctattaccacattgttgtctgcccatagtagcagtcagctaactctttttttccaaaattatagaagaaaaaaataaaagtaaatataaaaactgctaaacaaagaatggcttgaaaagacatagggaaaaacatcagttgattcactgggaatcataaatgcatctagctttgccaagttctgtgaacttttactcctaaatattttcatgtgcaaagcaagagtcacaaccctaaactatttcttgaggagtaataatactctactttctagcgtgtatt

SEQ ID NO: 40953 - DNA, 601 bp, Human
aatctggcttattattaggaagggatatgccataattgagtctacattcagacctcctgggtttaagtcctgtgagtatcactaactgctatgaccttgggcaagttagtttaccaagctccagttctatcagtggaaaaattaaaaaagcagttcttttgaggctctgccttgcaaataagctcaaggtacagagaacctaaccattaaggtacctggacatctgtggagagcagcagggagaactgatgtttttagccccatcacacagaaaaagaattattttagactaaggtagaakttggcatatgactacttctgaagggatggcttaaggttgtaattattgctgtacagaagacaatattggggaataaaaagtatacagaacttggcaaagccatatatatatgtttgtgattctcaataaagcaactgaaataactacattgttacatgcaaaatagaatcacaactctgaacacttatgtctattttttaaaagtttgatctttcatattcagttatttttttagttttaaaaataatatcctattaccacattgttgtctgcccatagtagcagtcagctaactctttt

SEQ ID NO: 40954 - DNA, 601 bp, Human
acaaaacaaaatctggcttattattaggaagggatatgccataattgagtctacattcagacctcctgggtttaagtcctgtgagtatcactaactgctatgaccttgggcaagttagtttaccaagctccagttctatcagtggaaaaattaaaaaagcagttcttttgaggctctgccttgcaaataagctcaaggtacagagaacctaaccattaaggtacctggacatctgtggagagcagcagggagaactgatgtttttagccccatcacacagaaaaagaattattttagactraggtagaatttggcatatgactacttctgaagggatggcttaaggttgtaattattgctgtacagaagacaatattggggaataaaaagtatacagaacttggcaaagccatatatatatgtttgtgattctcaataaagcaactgaaataactacattgttacatgcaaaatagaatcacaactctgaacacttatgtctattttttaaaagtttgatctttcatattcagttatttttttagttttaaaaataatatcctattaccacattgttgtctgcccatagtagcagtcagct

SEQ ID NO: 40955 - DNA, 601 bp, Human
atgtacaaaacaaatgtcatcatggagttacattttggcaagaagtacaaaacaaaatctggcttattattaggaagggatatgccataattgagtctacattcagacctcctgggtttaagtcctgtgagtatcactaactgctatgaccttgggcaagttagtttaccaagctccagttctatcagtggaaaaattaaaaaagcagttcttttgaggctctgccttgcaaataagctcaaggtacagagaacctaaccattaaggtacctggacatctgtggagagcagcagggagaaytgatgtttttagccccatcacacagaaaaagaattattttagactaaggtagaatttggcatatgactacttctgaagggatggcttaaggttgtaattattgctgtacagaagacaatattggggaataaaaagtatacagaacttggcaaagccatatatatatgtttgtgattctcaataaagcaactgaaataactacattgttacatgcaaaatagaatcacaactctgaacacttatgtctattttttaaaagtttgatctttcatattcagttatttttttagttttaaaaat

SEQ ID NO: 40956 - DNA, 601 bp, Human
gaaggaaatcagtgcccttctaaaagagccttgagaaagctgcctgtcctttctatcttttccaccatgtgaggacacagttttcatttctttttgctttcccattatgtgaggatgcagcaagagctttccatctttgaagcagagagtaatttgctagcaccttgatcttggtcttcccagaatccagaaccatgagcaataaatttctattacttaaacatgatccagtctaagatattttgtcctagcagcaggaacagactaagatccccacctgttcccaccatgccaggccccrtttgaggcagtaagaaggcagcaatgtacaaaacaaatgtcatcatggagttacattttggcaagaagtacaaaacaaaatctggcttattattaggaagggatatgccataattgagtctacattcagacctcctgggtttaagtcctgtgagtatcactaactgctatgaccttgggcaagttagtttaccaagctccagttctatcagtggaaaaattaaaaaagcagttcttttgaggctctgccttgcaaataagctcaaggtacagagaacctaaccattaaggtacctggaca

SEQ ID NO: 40957 - DNA, 601 bp, Human
tataaaccctccaaaattcatgttgaaacttaatccccagtgtggtattaagaggtggggccttttaggaagtgattaagtcacgaaggctccaccctcatgaaggaaatcagtgcccttctaaaagagccttgagaaagctgcctgtcctttctatcttttccaccatgtgaggacacagttttcatttctttttgctttcccattatgtgaggatgcagcaagagctttccatctttgaagcagagagtaatttgctagcaccttgatcttggtcttcccagaatccagaaccatgagmaataaatttctattacttaaacatgatccagtctaagatattttgtcctagcagcaggaacagactaagatccccacctgttcccaccatgccaggccccgtttgaggcagtaagaaggcagcaatgtacaaaacaaatgtcatcatggagttacattttggcaagaagtacaaaacaaaatctggcttattattaggaagggatatgccataattgagtctacattcagacctcctgggtttaagtcctgtgagtatcactaactgctatgaccttgggcaagttagtttaccaagctc

SEQ ID NO: 40958 - DNA, 601 bp, Human
aataaaaaaatataaaaaattggccaggtgtggtggtgggcgcccgtaatcccagctactcaggaggctgaggcagagaactgcttgaacccttgggaggcagaggttgcagtgagccgagatcatgccactgcactccagcctgagccacagagcgagactctgtctcaaaaccaaccaacaaacaaaaaaacaacaacaaaatagcctatgttctcaagactgtattgaaacatttctcagaatttaaaagttaataaaaagggagagagagaaacagataaagaaaggagaaaggagmcagaaaaggaaagaaaaatgaattaactaactgaaagcatttatgtaataaaattaggtacatgtaagcaataaagcaagatgatgaaaaaactccccaggacaaaggctatttaaggatcactaaatatataagttaataaaaataggacagtctgggtaaaactcttgactaggtgtggagttcatagaaggcttcctgaagcaggtgaagtttaagctgactcttcaatgatacatagattaattaacaaagaagctttgaaaaatcctcgcaagatgaaggaaggatgtgaacaaa

SEQ ID NO: 40959 - DNA, 601 bp, Human
ttttttggctttcaaaaaatagattttaaggctttaaagtcacaaagttttagaagaaaaataatttaaatgtattttgcaaagtgatattttattcctatttgagtagtctctcatacagagttagccaaaagtgctgtatcatgcattaaattacatagagtccccagctgtcactgagcaaaacccccaaagcttttatattgagtatgtatgagtcctgggtgagcagatgcaaaggaccataagaatgttaaacttactcactgcccctgggctgagtgccttccctttgaccaaygctgaagccttggaaatttatagaaatgatgagggctacttgaacatcagaggaaaaagaaggtaggaagaagagaagaatggagaaaaatggagagaagaaaagtgcctcgccataacaagctataagcagcatcctctttgcattcccctgtgaaccctagcataatgctttgcacattgtaggtgcacaccaattaattgttgaactgactgaaaagaaaacagaaaaagagaagaaaagagagatgaaaataagagaaagggaattaacaaagtgttatgtgtaaaaaaaaaaaaa

SEQ ID NO: 40960 - DNA, 601 bp, Human
ggtgggtggatcatttgaggtcaggagttcaagaccagcttggccaacatggtgagaccccgtctctaccaaaaatacagaaattagccagagtggtggcacacctgtaatcccagctactcgggaggctgaggcaggagaattgcttgaattcgagaggtggagttgcagtgagcggagatcgcgccactgccctcctgcccaggcgacagagtgagactccatctcaaaaaaaaaaaaaaaaaaaaattcatttttattttagattcaggggatgcatgtgcaggtttgttacaaggayatattgcatgacgctgaggtttgagcttctattgatcctgtcacccagacagtgaacatagtactcaacaagaggtttttcagcctttgtccccctccctgtctccttctagagttcccagtgtctattgttcccatctttgtgtccatgagtacccaagatttagctcccacttacaagtaagaagatgcaatatttggttttctgtttctgcattaattcacttaggataatggtcttcagctgcacccatgttgttacaaaggacatgatttcattcttttttatgactgtgtagta

SEQ ID NO: 40961 - DNA, 601 bp, Human; identical to SEQ ID NO: 31027

SEQ ID NO: 40962 - DNA, 601 bp, Human; identical to SEQ ID NO: 31028

SEQ ID NO: 40963 - DNA, 601 bp, Human; identical to SEQ ID NO: 31029

SEQ ID NO: 40964 - DNA, 601 bp, Human; identical to SEQ ID NO: 31030

SEQ ID NO: 40965 - DNA, 601 bp, Human; identical to SEQ ID NO: 31031

SEQ ID NO: 40966 - DNA, 601 bp, Human; identical to SEQ ID NO: 31032

SEQ ID NO: 40967 - DNA, 601 bp, Human; identical to SEQ ID NO: 31033

SEQ ID NO: 40968 - DNA, 601 bp, Human; identical to SEQ ID NO: 31034

SEQ ID NO: 40969 - DNA, 601 bp, Human
tcaaaaaaaggagctgactgcagcctcctaaatgagaccaagtgagacggtggatacagagaggatcctaggactaggggaggaaatactgcttctccaggaaaggtgaaaagatgggtgggggggtgtggagagagagattcctggattgtgttgtcactcaaatagatggccagtgtctcacctaactccagagagagggtaggtgggcaccaaatggcttaaggtatccaagcaagcattcaatctcttgggtaaagggtaaactaaagagagtagattggaagtgatcaagaagacagcaaataggagaactttaaacctgagctaaacaaaaataaagtgacagtatacatctaaccctcacctgagctttgtgcagtagaaatcctgagatattagtgtggcttcactcttgcccagaaaggaacgcttttaactgcaagagactgaatagccagggaaataggagatggaatgatacaagccccagacttagcaccaaaaatacatcctatctacctaggctttccagggcagacaggtttgggattatccaacccagcctacaaggagtaaagaaatgctgtcatcgcagccc

SEQ ID NO: 40970 - DNA, 601 bp, Human
agagagaaaaaaataaagactagtcaggcacggtggttcacgtctgtaatcccagcactttgggacagccaggtgggaggactgtttgagcccaggaattcaagagcagcctgggtaacatagcaagaccccaactctacaaaaaaaaaaaaattagctgggcgtggtggtacatgcctgtagtcccagctactagggaggctaaggagggaagattgcttgagcccaggagatcaaagttacagtgagccatgactgcactctagcctgggtgacagagtgagattctgtctcaaaaaaataaaaataaagataattgaattccttcaacatatatgaatgggtaacatttgagtttggggcttgttttatatacacatacgttctgattgcagacactatgccatctcccctaaggaatttcgagggagatcatcaaattgtcagcagagaattcactgttgtttcctcaatagaaaaggaaatctcaggtctctgtctcttccagggtttactgaaatgtccacccttcatcctttggctgacctgaaccagaaaaaatactataaaatccctattgaggagatatgggtgcagattt

SEQ ID NO: 40971 - DNA, 601 bp, Human
ttttaaaagcacaggtacattttctaatcatttttggcctgctttaggataactgtttgcataatgctagcaaggaaggagttacagagagtggatgccaggagaagcctaagacaaggctgttcttctccttatttgaacctgcactgcccaatggggagctatgctttaactgtacaatgtggagtttaactgtaccctgtgacttttagtgtagaaacaataacacctgtgatttttgaaaagttaatttgagtctcactaataaaggaaacgagacaaaaggagaaaaacaagagakaaaaaaataaagactagtcaggcacggtggttcacgtctgtaatcccagcactttgggacagccaggtgggaggactgtttgagcccaggaattcaagagcagcctgggtaacatagcaagaccccaactctacaaaaaaaaaaaaattagctgggcgtggtggtacatgcctgtagtcccagctactagggaggctaaggagggaagattgcttgagcccaggagatcaaagttacagtgagccatgactgcactctagcctgggtgacagagtgagattctgtctcaaaaaaataaaa

SEQ ID NO: 40972 - DNA, 601 bp, Human
cagcaaggggcttaagtacccaatggtcctcttaaagagtgcctgtcaccttcagtgaacattctaagccactccttttggaagaaattccatgaacatgagcagcctacactcattagtagctctgttcccattggtactgctaattgcacaactatttaggcaacaggggccttgtttacttttctccttcattcagctctgtcattcggtgttctcagagccatgccacggtgagtccacagttatccagggtctaagcctctatgcaagtgaggggatcctcaaggcttttaattgrgctagcacagcaataatttgacaatatgaaggtggggacaaggaagaaagctgttcttcacaatttctgaccagagtcactacccagaattattccagagctgattatccagtctgtgagtcaggcatgcccgcggctacccatcactctccttccctccacgccctttcatcctctgcagctgacagaggtgagaggcagaggcactaataacaaggcaagaaacttttgctcataattaatatctaaaaaaaaaatgcccattaaaaggtttggggaatggctctgaaataatcaatt

SEQ ID NO: 40973 - DNA, 601 bp, Human
caagttgggaccaccccaggcaaggggggatatatgatcatgatactgatcatgacacgtaacaaaccgttttaaaataacctactgatttatctctccctataactagactccagaaaaccccttaaagttttggcccatgctttgtctagcattgtgtcattccttggtgtctagtgtagagcctggagataagtagatgcttaaacatttgattgaatggatgaataaatatgcttgtaagtgccaaacacagttcaaggtactgagtatttttgtctttagaaagacgatcctgggratttgctctctttattggtggatatcattattattaaaaattaacttattgtgcatagtaagaaggggtggaagaggttatcactcttaccatgaaagtcattggccaaggacaacataacagagatgttatgggatttcataattctcctggtcatccaaatcatcttgacctcttctctttcacacctgctattcactgggaccaggtgaatcttctcttgcaaagtctctcctatttgtcttttctgcttgtcctatttgacaaatagacttcctaaccagtatctgcctggaacat

SEQ ID NO: 40974 - DNA, 601 bp, Human
tggaatagaataactgaaaaataattaagtggctaactagggagaaaggggaagattaggtgggctttaggaatcagggcaatttctcattctcaaacgagttgcttgggatggcgtcttatgaagcaaaatattaaggctgtaagatactatacgtatcatctagggtacaattccagtttttataaaatttcccttctcagaccagaaagaaatactatgcatatacatcaaatgactatagatgcatccttaggaatggaaatattctgtgaattttccctttcacaatgttttgtgyattcatgaattaatccattcaatctacaaacactgcttggaatgtcttcctttctagctctgtaccactgcttctctccctgccatctcttgccctcttcagcctatgggtatccaatgagactttttttccccataaagcccttcatgatcccacttcaagcagcttattaaacacctgcctatacaatccctcactttatgtactgaccctatttcctatagttgaatgggtaatgggatttatcatccaagttgggaccaccccaggcaaggggggatatatgatcatgatactgat

SEQ ID NO: 40975 - DNA, 601 bp, Human; identical to SEQ ID NO: 31035

SEQ ID NO: 40976 - DNA, 601 bp, Human; identical to SEQ ID NO: 31036

SEQ ID NO: 40977 - DNA, 601 bp, Human; identical to SEQ ID NO: 31037

SEQ ID NO: 40978 - DNA, 601 bp, Human; identical to SEQ ID NO: 31038

SEQ ID NO: 40979 - DNA, 601 bp, Human; identical to SEQ ID NO: 31039

SEQ ID NO: 40980 - DNA, 601 bp, Human; identical to SEQ ID NO: 31040

SEQ ID NO: 40981 - DNA, 601 bp, Human; identical to SEQ ID NO: 31041

SEQ ID NO: 40982 - DNA, 601 bp, Human; identical to SEQ ID NO: 31042

SEQ ID NO: 40983 - DNA, 601 bp, Human; identical to SEQ ID NO: 31043

SEQ ID NO: 40984 - DNA, 601 bp, Human; identical to SEQ ID NO: 31044

SEQ ID NO: 40985 - DNA, 601 bp, Human; identical to SEQ ID NO: 31045

SEQ ID NO: 40986 - DNA, 601 bp, Human; identical to SEQ ID NO: 31046

SEQ ID NO: 40987 - DNA, 601 bp, Human; identical to SEQ ID NO: 31047

SEQ ID NO: 40988 - DNA, 601 bp, Human; identical to SEQ ID NO: 31048

SEQ ID NO: 40989 - DNA, 601 bp, Human; identical to SEQ ID NO: 31049

SEQ ID NO: 40990 - DNA, 601 bp, Human; identical to SEQ ID NO: 31050

SEQ ID NO: 40991 - DNA, 601 bp, Human; identical to SEQ ID NO: 31051

SEQ ID NO: 40992 - DNA, 601 bp, Human; identical to SEQ ID NO: 31052

SEQ ID NO: 40993 - DNA, 601 bp, Human; identical to SEQ ID NO: 31053

SEQ ID NO: 40994 - DNA, 601 bp, Human
ttcttttctcatccaacattatgtttatgcgaaccacccattttatcgttgcaagcagttgtagtttgtttattccccttgtgaatatcccacagtttatccatcttactattgttgagcatttggttagtttctaatttttgattatgaagaataatccaatgggcattcttgtacctttatcctggtagagcaagtcccttcatcttgtccttcttatggagtgtcttggctattcttggtccaatgcccttctccataaattttggaatcagctttccaagttacacacatatacaaccacacacacacacacacacacacacacacagagagagagagggagagagagagagagaacttttgggattttgatggaaattacattcaatctgtaaatcagtcaatttgaggagagttgccatctttgtgacattgagtcttccctaaacacggtatatcactccatatattcagactttttcatgttgagtgaagttttataatttaatctataaaaggtttgcatgccattgtaagatttttttggcttattttttgttgctatcttaaacagtacctttttagaaaattaaatttt

SEQ ID NO: 40995 - DNA, 601 bp, Human
cgaaccacccattttatcgttgcaagcagttgtagtttgtttattccccttgtgaatatcccacagtttatccatcttactattgttgagcatttggttagtttctaatttttgattatgaagaataatccaatgggcattcttgtacctttatcctggtagagcaagtcccttcatcttgtccttcttatggagtgtcttggctattcttggtccaatgcccttctccataaattttggaatcagctttccaagttacacacatatacaaacacacacacacacacacacacacacacasagagagagagagggagagagagagagagaacttttgggattttgatggaaattacattcaatctgtaaatcagtcaatttgaggagagttgccatctttgtgacattgagtcttccctaaacacggtatatcactccatatattcagactttttcatgttgagtgaagttttataatttaatctataaaaggtttgcatgccattgtaagatttttttggcttattttttgttgctatcttaaacagtacctttttagaaaattaaattttatagcagtatgttgctaatgtatacaact

SEQ ID NO: 40996 - DNA, 601 bp, Human
gattttgttgatttttttctaatgttttcctagtctctgttttattattttcacctctaatccttattatatccttcttctgtttcctttaggttcccatatttgtgaatttcccaaagttctctctgttattaattttttattttactccattatgattggagaacatactttatatgatttccattcttccaaatttattgaagcttcttttatggcctagaatattgtctctcttggagcatgtttgatgtacactttggaaaaatgtatagtctgctgtttggagatggagtgtttkacagatgtttgttattactactttgtgttgaagtcctctatttccctgttgttgatcttctatgtagttgttctatccattattgaaagagtggtcttgaagtttccaactattgtcagtggattgtctatttctcccttcaattctgccagttttgcttcatgtatttggcagctctgttgtttaggcatatacgtttatacttgtgatatattcattatggattgacccttttgtcattattgaatgtccctatatatctctagtaatgtttttgaacatccattttgtctcatatta

SEQ ID NO: 40997 - DNA, 601 bp, Human
attttttaaaaattattttccaaaccgtatgccttttatttccttttattgccttattgcagtggttagaacttctagtactatgtcaaaagagtggagaaggtggaaatccttacattagtcctgatgttagggggaaagcatttagtctttcacttttaagtataatgttggtgatagtttttgtttgctttatagaagtttcttatcaagttgaacttaaacaaatttacaagaaaaaaacaaccctattaaaaagtgggcaaaggacatgaacagacacttttcaaaagaagacacrcatacagccaacaagcatatgaaaaaatgctcaacatcactgatcattagggaaatgcaaatcaaagccacagtgagataccatctcacaccagtcagaatggctatcataaaaaagtcaaaaaataacagatactggtgagattgcagaagaaagtgaatgtttatacactgctggtgggaatgtaaattagctcaaccatgtggaaagcagtgtagtgattcatcaaagagctaaaaacagaactaccattcaacccagcaatcccattactgggtatatacccaaggggatataaat

SEQ ID NO: 40998 - DNA, 601 bp, Human
atactgttgataccttcttcatttctttaaacatacaaccaatgcttatttcacagtataaatcagataattccaattatagcttttgcaattctgattctttggtttgtttctgtggattcttattcatacaggtttttcgtgtgtgtgtgtgtgtgtgtgtgtgtgtgtgtgtgtgtgtgtgtgttggctttttttcttcctacacgggtaatgtacatcccagccccaaacccacataaatgcaggactgggctaggaaatctcaggaactgttcactcttttgtttccctccacgaytgagccaaggttgagacagtctcagttaggtgcttcttcttcacccgctgattacgtcacctttgtctggtccacactttagtcaggctctcagatccaacttcctactttgagcccaaagagttttgtttactatcttctatacgtgctatctcttaaagcccaagttttaagccagaaatgtgtcaatcctttgacaatggcccagagaagaaacattgttttttactttgccactcaataaacacacacgtttgtgtgtgtgtgtgtgtgtgtgtatgttaaatcaaaaaatatgct

SEQ ID NO: 40999 - DNA, 601 bp, Human
aggaaatctcaggaactgttcactcttttgtttccctccacgattgagccaaggttgagacagtctcagttaggtgcttcttcttcacccgctgattacgtcacctttgtctggtccacactttagtcaggctctcagatccaacttcctactttgagcccaaagagttttgtttactatcttctatacgtgctatctcttaaagcccaagttttaagccagaaatgtgtcaatcctttgacaatggcccagagaagaaacattgttttttactttgccactcaataaacacacacgtttgtgtgtgtgtgtgtgtgtgtgtatgttaaatcaaaaaatatgctttttatgatccactgtattattgtgtcaactactgtgtaataaattaacctcaaaacgtagtggcttaaaacagcaaacatctattttgtctgtttctgtgggtcagagatcagtgcacagctcagctgggtcctctggctcagtatctctaataaggctacaatcaaggtattggctgaagctttggtcatctcaaggttctactgggtaggagtgagtggatagggatccacttccaacttactcacaaggttgt

SEQ ID NO: 41000 - DNA, 601 bp, Human
tattattgtgtcaactactgtgtaataaattaacctcaaaacgtagtggcttaaaacagcaaacatctattttgtctgtttctgtgggtcagagatcagtgcacagctcagctgggtcctctggctcagtatctctaataaggctacaatcaaggtattggctgaagctttggtcatctcaaggttctactgggtaggagtgagtggatagggatccacttccaacttactcacaaggttgttggcaagattcagttcctcataacatattggaatgaggtccttagtttctcactagctsttgaccagagatcatcctcaacttcttgccatgtgggtctctccctagggaagctcacaacatgacagctggcttccaacagagcaagtcaatgagagagccaaagaggaccaacaaaatggacggccagtctttttgtgataaaatctcaggagtgatatcccatcacttttgccttattttatgggttaaaaacaagtcactagattcagcccacactcaaaagtaggtgactacacaatgtcatgaataacaagaggtatggatcattaagggtgatattgtatgctgcctattgca

SEQ ID NO: 41001 - DNA, 601 bp, Human
aaataagagttttatccacctgaagtgtctagataggaagggaaagcattcaggaagtgaatggctactacctaagtctgtcctgggagtaagcttttttattttttagctttttatttttaaataattttagatttacagaacaattgtagaattgctgtatacctttcattcagcttccaccaatgttatcactttacataagcatggtatatttgtcaaaactaataaattaacatgggtaagttactattaactaaactacataatttattcagacttcttcagttttttcactaaygtcctttatatgttccaggatccaatccagcataccacgttgggattaattgtcttatttccttagaatcatccaatctgtgacagcttttcagtctttccttgtttttcataactttgacaattttggtcaagtgttttgtgaaatgaccttcaatttgagattttctgatattttctcatgtttagactggggctgtgggttttaaggagaataccatagaggtgaggtatccttctcatcacatcacatcagagggaagatgatatcaacatgacttattgctgatgatattaacct

SEQ ID NO: 41002 - DNA, 601 bp, Human
tccatgacctcaaaacaatcctgtgagtaacatattatttttattgccattactattattgccataccaatattactacttttattagcattaccacttcttcaccatttcatagctgaggaaattaaggcccaaggagtgaagtgccttgtctaaaggcatatatccagttacagaaccaagatatgaacccaggtctatttgattctaagcctgatattcactgtgccaagtctaatgcatgattctactgattggaagagaaaagaatcccatgttagccctatagtctccttttctycattctttttgtctccttcttttccttgttaatctcaacatcctgtctctctgccccacttcactctatctctccccctcttccttcctctccccaatttttgtttctttttcccatttcttctttctgttcatctatgttctctttatctaattcactggtgaggagtttcccgatggtttaccatgtgcccaaactcctgctaggcagtggggatacaaaactggttgagactcacaccctgtccttgaggagttctgagtctagctgggatgtataagaatacctcatatcatctag

SEQ ID NO: 41003 - DNA, 601 bp, Human
ttaaatccaagctccttaccctgttgttcaaggccctccacaattggccccttccagcatctcaggcctcagctatagtggatgactcaccatcctccaaacatgctcttccttctgccaatgccatactcttgctcaagctgttcctctacctggaatgcctttgttcctgactcccgctgcccatatctgcctgtaaaaggtgcctaccctaaaaagcctggttcaagtggtgaaaccttctcagatcattccaagtacaattagtctttccttctctctcactgtcttccgtggcttmatattgtctttgtcagagcattgaacaaactctgtgggagctctccatttactggtttactcactgtcttacctgttggactgtgagtgccttaaaggccccatcatgaagatcgggctaatccctgagacccagagctcatatcctgattcacagagtaggagtcaaaaagtatttgttagatgagtgaatgaaatattaactctttggctgcttatcttctttctcctcctttccttccctcctctctagtttttcatcattgcaagtgggaaagtatggcctagagatttagattta

SEQ ID NO: 41004 - DNA, 601 bp, Human
gaggccctgggtgtcccctatgagcagtggaaggccctgaatgagattgatgcggtgagatgcatggggtgaatctcctgtgtgtgggggtgacttgagtctgggattatcccctgggttgcctctgctccagcccctatggggagcctaattaattcaacaaacttttttgacaactagccatgtgctagaccttattctatgtcttggggatccagtgaaggccagaatagacaaagtctctgccctcatcctaaagacagacagtaaataggacattacatctcagtgtgacaaaggrctatgagaggagaagtagaagggattatggaggatcagagggtaagggtgctcctgactcaacttggtgctggggaatttacaaggaaagcttcctggaggaagctagaggtgatataagaaggagatgaaatggtctggggagtggggaaataaatttaattcagagacagaaaataactcatgtgaagacccagagatgagaagagagcatggcaatttcaggggattgaaggaaagaatagcacagaggctgggacagcaatagtgagatctgaagaaaagggagatgaggctagaa

SEQ ID NO: 41005 - DNA, 601 bp, Human
cctgcatggaaagaccacatggacacattctcagatgcttagacaccctatacacacacatacacacacacacgcaagcacacaacatatgctgagacaaatacacaaacacaaggcataagtctttaaacataccacaagtacatatcataagcatgctgcacacagacttgtaaacacagccacaaatccttatgcccatatatttataaaaatacatacttatatgtataatgtacacctacagacctatctgtacaatcatagaaaaacatcatacactcagcctgaacacatctaytcacatacactcactgtcacatctacacagccacacacctcacacacacacacacacacacacgcacacacacacacacacacgcatacacacttatggacaacaggcacaaacccagagctgtgttcacagagacccaggtgctcatgtgctactgtttcacaatcatcgaagaattatggcaaagactctgtggaatttcatcttgtgaatactttcgcccccaaatactttttctcagggtgtctgtgaggagatgacctatgaagaaatccaggaacattaccctgaagaatttgc

SEQ ID NO: 41006 - DNA, 601 bp, Human
cacacacacgcaagcacacaacatatgctgagacaaatacacaaacacaaggcataagtctttaaacataccacaagtacatatcataagcatgctgcacacagacttgtaaacacagccacaaatccttatgcccatatatttataaaaatacatacttatatgtataatgtacacctacagacctatctgtacaatcatagaaaaacatcatacactcagcctgaacacatctactcacatacactcactgtcacatctacacagccacacacctcacacacacacacacacacacacrcacacacacacacacacacgcatacacacttatggacaacaggcacaaacccagagctgtgttcacagagacccaggtgctcatgtgctactgtttcacaatcatcgaagaattatggcaaagactctgtggaatttcatcttgtgaatactttcgcccccaaatactttttctcagggtgtctgtgaggagatgacctatgaagaaatccaggaacattaccctgaagaatttgcactgcgagaccaagataaatatcgctaccgctatcccaagggagaggtaaggtttgcggggtgg

SEQ ID NO: 41007 - DNA, 601 bp, Human
acacacgcaagcacacaacatatgctgagacaaatacacaaacacaaggcataagtctttaaacataccacaagtacatatcataagcatgctgcacacagacttgtaaacacagccacaaatccttatgcccatatatttataaaaatacatacttatatgtataatgtacacctacagacctatctgtacaatcatagaaaaacatcatacactcagcctgaacacatctactcacatacactcactgtcacatctacacagccacacacctcacacacacacacacacacacacgcagacacacacacacacacgcatacacacttatggacaacaggcacaaacccagagctgtgttcacagagacccaggtgctcatgtgctactgtttcacaatcatcgaagaattatggcaaagactctgtggaatttcatcttgtgaatactttcgcccccaaatactttttctcagggtgtctgtgaggagatgacctatgaagaaatccaggaacattaccctgaagaatttgcactgcgagaccaagataaatatcgctaccgctatcccaagggagaggtaaggtttgcggggtggcct

SEQ ID NO: 41008 - DNA, 601 bp, Human
gttctcaataatctggcttctatgtatctcttcggtctcacctttttgcatccctcctctcactatttcattcagtaatacattcattcatatactcattcacttacttataaatctgtcatcagtttatttatccattcatttaataaatgtttacttagcatctactgtgtgcttactcttatactggacaccagagacagagagataataagatgtttttgctcccatgcaactcccagtctgcttgtctttcaagccattttctccagaaagccataactcattttctcaggtggargttatcccttaatcttataataaggccacagttccttgatggcagtgcagttggtggcaggggttggggaggtccaggaatcaactccctctaccaatttcacatgcccacctgccccaccaggattgcccagtaaaaagccctgcattcttcaaatctttctggaccttagctttctcacttgtatagtaaagggatgaatcccatgatcactaacagccctgccagctctgacatgccataagcttatgattccaacagtaaaagcctgataaatatccatccctgtaaccacaagca

SEQ ID NO: 41009 - DNA, 601 bp, Human
caaagcaccagcctggggccggtcccttctctgcccagagcccctcccgggcctccatagtcagtaaaggcccctcctgactaaggctgggtctgctgctctcccgagctcctccaggccgccagaaggcttcctccgagtcactttctccctgagttcgaggcttgcgggtcccccagcgatccagcaccccttcccctgccctgtacccagttattcagggcgaaaacctaagcgtcgtccgtaagtcccatatgtgccagtggccaggcccgggtctggtctggcatctactccttgrgctccagaagcctgtggtttccctgcttcccttctgctcttaacctccccacccacacacagcaccacagtgggcttctcaagctgcagcaccgacctgccggggctgccccctctctcttctccaggaccctccccaactttgctcttcttcaaatcaaagcctccccaggtccccctccaccaccaggtgcctgtggggttcctgccctggtcgacactcggttctctctggcagcctttttccctacgtcattccctagactgggaacgctgtagacagaaagggtggcaagtgtgt

SEQ ID NO: 41010 - DNA, 601 bp, Human
cccagagcccctcccgggcctccatagtcagtaaaggcccctcctgactaaggctgggtctgctgctctcccgagctcctccaggccgccagaaggcttcctccgagtcactttctccctgagttcgaggcttgcgggtcccccagcgatccagcaccccttcccctgccctgtacccagttattcagggcgaaaacctaagcgtcgtccgtaagtcccatatgtgccagtggccaggcccgggtctggtctggcatctactccttgggctccagaagcctgtggtttccctgcttccctyctgctcttaacctccccacccacacacagcaccacagtgggcttctcaagctgcagcaccgacctgccggggctgccccctctctcttctccaggaccctccccaactttgctcttcttcaaatcaaagcctccccaggtccccctccaccaccaggtgcctgtggggttcctgccctggtcgacactcggttctctctggcagcctttttccctacgtcattccctagactgggaacgctgtagacagaaagggtggcaagtgtgtgggtgaccggcgtgaggacctgggcagccctgg

SEQ ID NO: 41011 - DNA, 601 bp, Human
aaggctgggtctgctgctctcccgagctcctccaggccgccagaaggcttcctccgagtcactttctccctgagttcgaggcttgcgggtcccccagcgatccagcaccccttcccctgccctgtacccagttattcagggcgaaaacctaagcgtcgtccgtaagtcccatatgtgccagtggccaggcccgggtctggtctggcatctactccttgggctccagaagcctgtggtttccctgcttcccttctgctcttaacctccccacccacacacagcaccacagtgggcttctcargctgcagcaccgacctgccggggctgccccctctctcttctccaggaccctccccaactttgctcttcttcaaatcaaagcctccccaggtccccctccaccaccaggtgcctgtggggttcctgccctggtcgacactcggttctctctggcagcctttttccctacgtcattccctagactgggaacgctgtagacagaaagggtggcaagtgtgtgggtgaccggcgtgaggacctgggcagccctggaacctgggactgactggaggctctgatgtggaagttccttggcacctgt

SEQ ID NO: 41012 - DNA, 601 bp, Human
gcctcggcctcccaaagtgctgggattacaggcatgagccaccacgcccggctggcccaaaacttttaagcagattttagatgtgcagagaaaagcataaggaacagaataccactgatgcttctcaccccctgagataaaatgtcaccagtaagtgcaggcagcatttcctacatccttctctgggccctgggtccgtctcccctctacccctccagcctgaatttgcagttcttcccatgtctgcttgctacttttcaactttgttttttgccccttttgaaatttggtcaaacgaagygagaatgaatcaaacattggtttacaacgaccccaagaaggaagggagacccagcagcagagaagtcgcctcccagctgccatgggtgtgatccgtcccagagccacagatcccctgcctctcccctatgcctccaggatcacccagcagcctccatagggcagagggtgtagaggagctgggaggggcttgagaggttggccctgaggggctccagccagagtgactctgagcttgtggcttggactcgtggctgtcatctcctttctggaactctgctgaggcccaggtggtggtcac

SEQ ID NO: 41013 - DNA, 601 bp, Human
cccggcgtttcctaggttattattgtagaacaaagattattataatattagaataaagagtaaagctacaaactaatgattaacgatattcatatataatcatatctataatctatttctagtataactattcttattctgtatatttatgatactggaacagcttgtgcccttggtgtcttgccttggcccctgggtggcttgctgcccacacctgccccagcctccacatttgaagccttttgtcagtttcacagtaaaagggatgtactcatccttgtgattccctttggctgcatcrtgctgactttagagctcccagcctgcttctcccagagctggcaggcaaggcgcgtgttttcctgctgggtgaggttggtgaggcagttttgtggccaggtcgcttgggacagccccatgcctggcacgctctagctgaatgttcacgtggccggcacagcagtgcagggaaaggcgatggcagctcagtgctggagcaggggacgccggggttatggggtggggggcatgggcctctgctgactctgtctccccaggcagctgcattcagcctcagcggaggacacgcctgtggtgcagt

SEQ ID NO: 41014 - DNA, 601 bp, Human
ctggcaggcaaggcgcgtgttttcctgctgggtgaggttggtgaggcagttttgtggccaggtcgcttgggacagccccatgcctggcacgctctagctgaatgttcacgtggccggcacagcagtgcagggaaaggcgatggcagctcagtgctggagcaggggacgccggggttatggggtggggggcatgggcctctgctgactctgtctccccaggcagctgcattcagcctcagcggaggacacgcctgtggtgcagttggcagccgagaccccaacagcagagagcaaggtaagsggtgcttgtgtgggtacctgtgctcctggcctggtcgtgtagaagagtagcaggcagtggaagcccccagcagccttgggtgacggggtgggatgtcccgctccctctcccccaagtctacttcaacaaggttgtggggaggcaaagccacaccccaagtaccttgactgcactgcacagggtgactctgccctttcctccaggagagagccttgaactctgccagcacctcgcttcccacaagctgtccaggcagtgagccagtgcccacccatcagcaggggcagcctgccttggagc

SEQ ID NO: 41015 - DNA, 601 bp, Human
ataaatacggtttgtccgtaagattggaggctgcagttaaataaatacggtttgtccgtaagattggaggctgcagttaaataaatacggtttgtccgtaagattggaggctgcagttgaatacggtttgtccgtaagattggaggctgcagttgaatacggtttgtccgtaagattggaggctgcagttaaataaatacagtttgtccgtaagattggaggctgcagttaaataaatacggtttgtccgtaagattggaaggtggaacggtccttaaattaaagtgcatttggtaggaaytgatggctgagttgttttaaaggacacacagccaggtgggtgtaagatctcaatttagagaactgaaaacccaggcacacagcagacacgaatggcatgtagggtttgtcgctgacaggatagttgtgggccgccaccatgtggggatatcagctcagctgggatgggcctgtcaccctcacgcaggatccctggaatcacacagcacggccttctgtgtccggcgtctccctcggggaggtgtgtttccgagtcctggccatgctggagcaggtgtgggtgctcctgtccttgccgtgg

SEQ ID NO: 41016 - DNA, 601 bp, Human
gacggcatgcacctgtagtctcagctacttgggaagccgaggcaggagaattgcttgaacccaggaggcggaggttgcagtgagctgagattgcgccactgcactccagcctgggcaacagagtgagactccatctcaaaaaaaaaaaaaaaaaaaaaaaccaaaaaatagaggtcagcaaactatcacctgtgggccagacttggccactgcctgtttgtgtaaagttttatcgtcacagagccatgcccgttcctttgcaaattgtggcaactttcacactacaaggccagaactgagyagtgtgacagaggctgtgtggccttcaaatcctaacacatggccgggcgcagtggctcacacctggaatcccagccctttgggaggctgaggcgggtggatcgcctgaggtcaggagtttgagaccagcctggccaacatagtgaacccccatctctactaaaaataacaaaaattagccgggtgaggcggcaggcgcctgtaatcccagctacttgggttgctgaagcaggagaatcgggtgagcctgggaggcaggggttgcagggagccgagatcatgccactgcactccaatctgg

SEQ ID NO: 41017 - DNA, 601 bp, Human
tggcccctgcatgtaacttatgttagaaatgcacaatgcttgttctctggtgccacaaagaaatagtgctcgaacattaattttctcagcaaggcagtttttactttctgcagaaagggtgcccctcgcagatggagcaatggcaagagcacacctgaacaagggaggggaaggggttcttattcctgacacaggtagccctactgctgtgttgttcccctgttggctaaggttggaccacacagtctaagccaattccaattggctattttaaagagggcagggtaagagtcagagtggyggggtgagtagtttgacgggaaggacggttaggaacaggtaactcaaggtgacttaggtcagagcaggtgaccgggatgagtcaggatggagcaggtgaccagggaacagatgtgaactactgattaggactggcaggaaaattgtttactgaaactagaagcaaggggcgaagagaaccaggaattttaaatggagaatcaaagaagagatctggccgggtgcagtgggtcacgcctgtaatcccagtactttgggaggccgaggtgggcggatcacgaggtcaagagatggagaccat

SEQ ID NO: 41018 - DNA, 601 bp, Human
ttccttgggctgtctctggcacccatcgtttcggttgcctcctcatcctgaacgtttgcttttcttttctcaagaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaaggtatgtctccgccaccctggtgtcctcacctcggaggctgatggactcatggtccaagccagcggrgctacaagctgctgtctttgcaccttggtccttggccaagcctccccttgccacgggggcatgggatgacctgtgaacgagacagggtgcaggagtcacagcatagctggtttgcgaggcagctgagggcggcaggaggcagagtgagcagggaggccatctgagccgtccgctgttgtgtgacagacgactcggctatgatcaggcatctgtgagatttgagacagcgctggtgcaccggggcctggggcacctcggaaaggtgtctgggctgtccgagcgcttgggtcccaagggttg

SEQ ID NO: 41019 - DNA, 601 bp, Human
caggagtcacagcatagctggtttgcgaggcagctgagggcggcaggaggcagagtgagcagggaggccatctgagccgtccgctgttgtgtgacagacgactcggctatgatcaggcatctgtgagatttgagacagcgctggtgcaccggggcctggggcacctcggaaaggtgtctgggctgtccgagcgcttgggtcccaagggttggggacccagggcatgcagtatccaaggcgggaggcccactgaaaggtggtcacggctgtgcaaggccaccctggtgtcctcctggccacrggactctgagcgccccccaccttctgtgctgggcaaggcccacatgcttgctggaaggagggatgtctgggccatccatctgcccagagcaggcctggaaggtgcctgcgaggccgccagagggttctgcccacagcagcaatgttggagcggaggtgctcaacgcctcctgtagaggagctggacctgcaggtgcagctggaagaggggctgtcactgttggtgcaagggggttggggacaccagatgggtcccctgggagtcagactaaactggaaaagcggcccttgcagggcctgc

SEQ ID NO: 41020 - DNA, 601 bp, Human
tgtctgggctgtccgagcgcttgggtcccaagggttggggacccagggcatgcagtatccaaggcgggaggcccactgaaaggtggtcacggctgtgcaaggccaccctggtgtcctcctggccacaggactctgagcgccccccaccttctgtgctgggcaaggcccacatgcttgctggaaggagggatgtctgggccatccatctgcccagagcaggcctggaaggtgcctgcgaggccgccagagggttctgcccacagcagcaatgttggagcggaggtgctcaacgcctcctgtrgaggagctggacctgcaggtgcagctggaagaggggctgtcactgttggtgcaagggggttggggacaccagatgggtcccctgggagtcagactaaactggaaaagcggcccttgcagggcctgctgagccacacctcatctgagtcctgaagtcaggtgggtgtcagtggctggggcccagctgcctaacagaagcaagcctgaatactctagggaagaaggtatcttatgctttaaattgctgctgcagttttaaattagtgtctggcacagaataaccaagtgtgaaaggaacagg

SEQ ID NO: 41021 - DNA, 601 bp, Human
cccttgcagggcctgctgagccacacctcatctgagtcctgaagtcaggtgggtgtcagtggctggggcccagctgcctaacagaagcaagcctgaatactctagggaagaaggtatcttatgctttaaattgctgctgcagttttaaattagtgtctggcacagaataaccaagtgtgaaaggaacaggaaacatgagtgaaaatcagacccgttattagagtgaggcatggtgatgtacacctgtggtcccagctactagggaggctgaggtgggaggatcatttgagcccgggaggtygaagctgcagtgagccatgattgtatcactgcacccccagcctgggcaatagaccaagacccccatctctaaaattaaaaaacaaaaacaaaaactgttgatagacccacaggagccccagacgctggagttggcaccggcaggtggtgcctcaggtctgcagggagcagatgggaagggccctgtggcagcagagtgcccaccggcagcagagtacagcagtctggcccagcacagacgcttggagaggcaggactcttcacacggtgctgctggcttgaggacacagcggctttgctg

SEQ ID NO: 41022 - DNA, 601 bp, Human
gcccaccggcagcagagtacagcagtctggcccagcacagacgcttggagaggcaggactcttcacacggtgctgctggcttgaggacacagcggctttgctgaccttccctcaggttgggctgtggtgtgagcagctgccttggcctcgcctctccccggggcaggcctgtgcctcagctcccactggccacctccctacttcctcatggaggctcctttgcacatctaatcccatcttggacgacccagtgcagactttaaagtaattgtcttctgtattcagaagagtattgcttcartagagaccttgaaactagaaaagaatccccttcgggagaccgagacgggtggatcacttgaggtcaggagttcgagaccagcctgggttacatgatgaaactccgtctcctaaaaatacaaaaattagctgggcagggtggcatttgcctgtagtcccagctactcaggaggctgaggtaggagaatcacttgaacccaggaagtagaggttgcagtgagccaagatcgtgccactgcactccagcctgggcgacagagtgagactccatctcaaaaaaaaaaaatacaaaaattaggca

SEQ ID NO: 41023 - DNA, 601 bp, Human
agccgatatggcaccattgcactccagcctgggcgacagagcgagactctctcagaaaacaaaaaatacagaaaaactaggccggcttatgcctgtaatcccagcactttgggaggccaaggcgggaggatcatgaggtcaggagttcaagaccattctggccaacatggtgaaaccctttctgtactaaaaatacaaaaattagctgggcatggtggcaggcacctgtagtcccagctacttgggaggctgaggcaggagaatcaatcaggaggtggaggttgcaatgagccaagatcgygccatcacactatggcctggcgatagagcgagactccgtctcaaaaaaaaaaaaaaaaaagcctgggcacagtggctcacgcctgtaatcccagcactttgggaggccgaggcgggtggatcacgagatcaggagtttgagaccagcctgaccaacatggtgaaaccctgtctcttctaaagatacaaaaattagccgggcatggtggcacgcacctgtagtcccagctacttgtgaggctgaggcaggagaatcgcttgaatccgggaggcggaggttgcagtgagccgagatcatgcc

SEQ ID NO: 41024 - DNA, 601 bp, Human
ggtggcaggcacctgtagtcccagctacttgggaggctgaggcaggagaatcaatcaggaggtggaggttgcaatgagccaagatcgtgccatcacactatggcctggcgatagagcgagactccgtctcaaaaaaaaaaaaaaaaaagcctgggcacagtggctcacgcctgtaatcccagcactttgggaggccgaggcgggtggatcacgagatcaggagtttgagaccagcctgaccaacatggtgaaaccctgtctcttctaaagatacaaaaattagccgggcatggtggcacgyacctgtagtcccagctacttgtgaggctgaggcaggagaatcgcttgaatccgggaggcggaggttgcagtgagccgagatcatgccacttcactccagcctgagtgacagagtgagtctccgtctaaaaaaaaaaacaaaacagaaactagaaaagaaccaaatggaaatttctaacaggtacacagttaacaacattaacaattcaaagggtacaggtcagatgagggaagcagaggctgagttgggaaccagtgtgtggacggcagcccccagagccagagggagagacgccgctgt

SEQ ID NO: 41025 - DNA, 601 bp, Human
cgggaggcttgacctgtgcacacgtgagagcttccagatgctgcctcccggacagacgctgttgggaattttccacagcagagaaacacagtgctgtgggtttaagggaggcgtgacctccgcaggacatcaggggctgcatgctgggtaggggctcagggagaggctgcagtgctgagggtgcttctgggatacagggctgcgacagaggagtgaggatggctgggctgtgaggccgctgggggcactgcaggaagaaggcaggtaggctgagccttcccaagcagaggccactcggggrcccaggaacccctcagttagggcttctcagtcactgagcggaaggtgcccccagagggggcagcagcctgtgaggagcaggcgtgtctgggtaaccatgtggctcctgctggcctcccctgcctgtccccaaagcacagggctcagctccagagggagacgggctgggctgtcagtggtcccaggtgcatcccactttccagcagcacttggtgccagcagaggctgcaggtgtggcaggagggggcccagccgtgagggcaccaggttcaggcccggcatctcagggtggagagccagg

SEQ ID NO: 41026 - DNA, 601 bp, Human
gaattttccacagcagagaaacacagtgctgtgggtttaagggaggcgtgacctccgcaggacatcaggggctgcatgctgggtaggggctcagggagaggctgcagtgctgagggtgcttctgggatacagggctgcgacagaggagtgaggatggctgggctgtgaggccgctgggggcactgcaggaagaaggcaggtaggctgagccttcccaagcagaggccactcggggacccaggaacccctcagttagggcttctcagtcactgagcggaaggtgcccccagagggggcagcmgcctgtgaggagcaggcgtgtctgggtaaccatgtggctcctgctggcctcccctgcctgtccccaaagcacagggctcagctccagagggagacgggctgggctgtcagtggtcccaggtgcatcccactttccagcagcacttggtgccagcagaggctgcaggtgtggcaggagggggcccagccgtgagggcaccaggttcaggcccggcatctcagggtggagagccagggctgtcctgaacctccagagggggtgagctgggaacttgtgtgaaggggctttttccaaaaggaa

SEQ ID NO: 41027 - DNA, 601 bp, Human
gagcaggcgtgtctgggtaaccatgtggctcctgctggcctcccctgcctgtccccaaagcacagggctcagctccagagggagacgggctgggctgtcagtggtcccaggtgcatcccactttccagcagcacttggtgccagcagaggctgcaggtgtggcaggagggggcccagccgtgagggcaccaggttcaggcccggcatctcagggtggagagccagggctgtcctgaacctccagagggggtgagctgggaacttgtgtgaaggggctttttccaaaaggaaaacgggagctactggctcacggctgatgccccagacagcctcgaggatctgcaggtccccagacaccaagcctgggtgctctccagcagacggcgtggtacccacagctaattcctgccccttcctagaacgaagagtcactgaagaagtgcgtggaggattacctggcaaggatcacccaggagggccagaggtaccaagccctgaaggcccacgcggaggagaagctgcagctgtgagtgctgggcgaggccccaccctggagggagaatctgagcacctgggccccagctcagcctctgccccgccc

SEQ ID NO: 41028 - DNA, 601 bp, Human; identical to SEQ ID NO: 33393

SEQ ID NO: 41029 - DNA, 601 bp, Human; identical to SEQ ID NO: 33394

SEQ ID NO: 41030 - DNA, 601 bp, Human; identical to SEQ ID NO: 33395

SEQ ID NO: 41031 - DNA, 601 bp, Human; identical to SEQ ID NO: 33396

SEQ ID NO: 41032 - DNA, 601 bp, Human; identical to SEQ ID NO: 33397

SEQ ID NO: 41033 - DNA, 601 bp, Human; identical to SEQ ID NO: 33398

SEQ ID NO: 41034 - DNA, 601 bp, Human; identical to SEQ ID NO: 33399

SEQ ID NO: 41035 - DNA, 601 bp, Human; identical to SEQ ID NO: 33400

SEQ ID NO: 41036 - DNA, 601 bp, Human; identical to SEQ ID NO: 33401

SEQ ID NO: 41037 - DNA, 601 bp, Human; identical to SEQ ID NO: 33402

SEQ ID NO: 41038 - DNA, 601 bp, Human; identical to SEQ ID NO: 33403

SEQ ID NO: 41039 - DNA, 601 bp, Human; identical to SEQ ID NO: 33404

SEQ ID NO: 41040 - DNA, 601 bp, Human; identical to SEQ ID NO: 33405

SEQ ID NO: 41041 - DNA, 601 bp, Human; identical to SEQ ID NO: 33406

SEQ ID NO: 41042 - DNA, 601 bp, Human; identical to SEQ ID NO: 33407

SEQ ID NO: 41043 - DNA, 601 bp, Human; identical to SEQ ID NO: 33408

SEQ ID NO: 41044 - DNA, 601 bp, Human; identical to SEQ ID NO: 33409

SEQ ID NO: 41045 - DNA, 601 bp, Human; identical to SEQ ID NO: 33410

SEQ ID NO: 41046 - DNA, 601 bp, Human; identical to SEQ ID NO: 33411

SEQ ID NO: 41047 - DNA, 601 bp, Human; identical to SEQ ID NO: 33412

SEQ ID NO: 41048 - DNA, 601 bp, Human; identical to SEQ ID NO: 33413

SEQ ID NO: 41049 - DNA, 601 bp, Human; identical to SEQ ID NO: 33414

SEQ ID NO: 41050 - DNA, 601 bp, Human; identical to SEQ ID NO: 33415

SEQ ID NO: 41051 - DNA, 601 bp, Human; identical to SEQ ID NO: 33416

SEQ ID NO: 41052 - DNA, 601 bp, Human; identical to SEQ ID NO: 33417

SEQ ID NO: 41053 - DNA, 601 bp, Human; identical to SEQ ID NO: 33418

SEQ ID NO: 41054 - DNA, 601 bp, Human; identical to SEQ ID NO: 33419

SEQ ID NO: 41055 - DNA, 601 bp, Human; identical to SEQ ID NO: 33420

SEQ ID NO: 41056 - DNA, 601 bp, Human; identical to SEQ ID NO: 33421

SEQ ID NO: 41057 - DNA, 601 bp, Human; identical to SEQ ID NO: 33422

SEQ ID NO: 41058 - DNA, 601 bp, Human; identical to SEQ ID NO: 33423

SEQ ID NO: 41059 - DNA, 601 bp, Human; identical to SEQ ID NO: 33424

SEQ ID NO: 41060 - DNA, 601 bp, Human; identical to SEQ ID NO: 33425

SEQ ID NO: 41061 - DNA, 601 bp, Human; identical to SEQ ID NO: 33426

SEQ ID NO: 41062 - DNA, 601 bp, Human; identical to SEQ ID NO: 33427

SEQ ID NO: 41063 - DNA, 601 bp, Human; identical to SEQ ID NO: 33428

SEQ ID NO: 41064 - DNA, 601 bp, Human; identical to SEQ ID NO: 33429

SEQ ID NO: 41065 - DNA, 601 bp, Human; identical to SEQ ID NO: 33430

SEQ ID NO: 41066 - DNA, 601 bp, Human; identical to SEQ ID NO: 33431

SEQ ID NO: 41067 - DNA, 601 bp, Human; identical to SEQ ID NO: 33432

SEQ ID NO: 41068 - DNA, 601 bp, Human; identical to SEQ ID NO: 33433

SEQ ID NO: 41069 - DNA, 601 bp, Human; identical to SEQ ID NO: 33434

SEQ ID NO: 41070 - DNA, 601 bp, Human; identical to SEQ ID NO: 33435

SEQ ID NO: 41071 - DNA, 601 bp, Human; identical to SEQ ID NO: 33436

SEQ ID NO: 41072 - DNA, 601 bp, Human; identical to SEQ ID NO: 33437

SEQ ID NO: 41073 - DNA, 601 bp, Human; identical to SEQ ID NO: 33438

SEQ ID NO: 41074 - DNA, 601 bp, Human; identical to SEQ ID NO: 33439

SEQ ID NO: 41075 - DNA, 601 bp, Human; identical to SEQ ID NO: 33440

SEQ ID NO: 41076 - DNA, 601 bp, Human; identical to SEQ ID NO: 33441

SEQ ID NO: 41077 - DNA, 601 bp, Human; identical to SEQ ID NO: 33442

SEQ ID NO: 41078 - DNA, 601 bp, Human; identical to SEQ ID NO: 33443

SEQ ID NO: 41079 - DNA, 601 bp, Human; identical to SEQ ID NO: 33444

SEQ ID NO: 41080 - DNA, 601 bp, Human; identical to SEQ ID NO: 33445

SEQ ID NO: 41081 - DNA, 601 bp, Human; identical to SEQ ID NO: 33446

SEQ ID NO: 41082 - DNA, 601 bp, Human; identical to SEQ ID NO: 33447

SEQ ID NO: 41083 - DNA, 601 bp, Human; identical to SEQ ID NO: 33448

SEQ ID NO: 41084 - DNA, 601 bp, Human; identical to SEQ ID NO: 33449

SEQ ID NO: 41085 - DNA, 601 bp, Human; identical to SEQ ID NO: 33450

SEQ ID NO: 41086 - DNA, 601 bp, Human; identical to SEQ ID NO: 33451

SEQ ID NO: 41087 - DNA, 601 bp, Human; identical to SEQ ID NO: 33452

SEQ ID NO: 41088 - DNA, 601 bp, Human; identical to SEQ ID NO: 33453

SEQ ID NO: 41089 - DNA, 601 bp, Human; identical to SEQ ID NO: 33454

SEQ ID NO: 41090 - DNA, 601 bp, Human; identical to SEQ ID NO: 33455

SEQ ID NO: 41091 - DNA, 601 bp, Human; identical to SEQ ID NO: 33456

SEQ ID NO: 41092 - DNA, 601 bp, Human; identical to SEQ ID NO: 33457

SEQ ID NO: 41093 - DNA, 601 bp, Human; identical to SEQ ID NO: 33458

SEQ ID NO: 41094 - DNA, 601 bp, Human; identical to SEQ ID NO: 33459

SEQ ID NO: 41095 - DNA, 601 bp, Human; identical to SEQ ID NO: 29140

SEQ ID NO: 41096 - DNA, 601 bp, Human; identical to SEQ ID NO: 29141

SEQ ID NO: 41097 - DNA, 601 bp, Human; identical to SEQ ID NO: 29142

SEQ ID NO: 41098 - DNA, 601 bp, Human; identical to SEQ ID NO: 29143

SEQ ID NO: 41099 - DNA, 601 bp, Human; identical to SEQ ID NO: 29144

SEQ ID NO: 41100 - DNA, 601 bp, Human; identical to SEQ ID NO: 29145

SEQ ID NO: 41101 - DNA, 601 bp, Human; identical to SEQ ID NO: 29146

SEQ ID NO: 41102 - DNA, 601 bp, Human; identical to SEQ ID NO: 29147

SEQ ID NO: 41103 - DNA, 601 bp, Human; identical to SEQ ID NO: 29148

SEQ ID NO: 41104 - DNA, 601 bp, Human; identical to SEQ ID NO: 29149

SEQ ID NO: 41105 - DNA, 601 bp, Human; identical to SEQ ID NO: 29150

SEQ ID NO: 41106 - DNA, 601 bp, Human; identical to SEQ ID NO: 29151

SEQ ID NO: 41107 - DNA, 601 bp, Human; identical to SEQ ID NO: 29152

SEQ ID NO: 41108 - DNA, 601 bp, Human; identical to SEQ ID NO: 29153

SEQ ID NO: 41109 - DNA, 601 bp, Human; identical to SEQ ID NO: 29154

SEQ ID NO: 41110 - DNA, 601 bp, Human; identical to SEQ ID NO: 29155

SEQ ID NO: 41111 - DNA, 601 bp, Human; identical to SEQ ID NO: 29156

SEQ ID NO: 41112 - DNA, 601 bp, Human; identical to SEQ ID NO: 29157

SEQ ID NO: 41113 - DNA, 601 bp, Human; identical to SEQ ID NO: 29158

SEQ ID NO: 41114 - DNA, 601 bp, Human; identical to SEQ ID NO: 29159

SEQ ID NO: 41115 - DNA, 601 bp, Human; identical to SEQ ID NO: 29160

SEQ ID NO: 41116 - DNA, 601 bp, Human; identical to SEQ ID NO: 29161

SEQ ID NO: 41117 - DNA, 601 bp, Human; identical to SEQ ID NO: 29162

SEQ ID NO: 41118 - DNA, 601 bp, Human; identical to SEQ ID NO: 36502

SEQ ID NO: 41119 - DNA, 601 bp, Human; identical to SEQ ID NO: 36501

SEQ ID NO: 41120 - DNA, 601 bp, Human; identical to SEQ ID NO: 36500

SEQ ID NO: 41121 - DNA, 601 bp, Human; identical to SEQ ID NO: 36499

SEQ ID NO: 41122 - DNA, 601 bp, Human
gcagctcaacctgcctagttttctagtctaattcctctaataaacacctaattccacaatactcatagtggttctgtttccctgtctgaaccctgaatttctgctacaggaagtggttaaaagaagtccttaaagatatgaacctgaagttgcttctctgatttgattgaaggtattaatgaccagtttccaatggtaaaggggctactagtagtccacagcatgcagtggcaaaatatttaaaatcatcatctgcagacaaggacctacagaagacaaagccttgggtaactaactagtkgatgccatagaagattttagtaaaaataagttgtataatgggttaattagttgtttctaggtacactggataattcttttctcaggaaaagaaaatgatgagctcggagttttaaaagcactactcaaatctgggtaagggggccagaaatctataactgccttcatagaaagccttatatcatgtggctacagggctgagacttctacaaagtatatcctgcaggtggctcagttacaatgcaaattgaattcacactcttgcaggacatcttatgttaaagttaggaccttgactggc

SEQ ID NO: 41123 - DNA, 601 bp, Human
cctggctgcaaaaacaaagccacaaaagaggcaatagccttccatgacttatgtaacagcctccctctgaaccctactccagcagctcaacctgcctagttttctagtctaattcctctaataaacacctaattccacaatactcatagtggttctgtttccctgtctgaaccctgaatttctgctacaggaagtggttaaaagaagtccttaaagatatgaacctgaagttgcttctctgatttgattgaaggtattaatgaccagtttccaatggtaaaggggctactagtagtccacrgcatgcagtggcaaaatatttaaaatcatcatctgcagacaaggacctacagaagacaaagccttgggtaactaactagtggatgccatagaagattttagtaaaaataagttgtataatgggttaattagttgtttctaggtacactggataattcttttctcaggaaaagaaaatgatgagctcggagttttaaaagcactactcaaatctgggtaagggggccagaaatctataactgccttcatagaaagccttatatcatgtggctacagggctgagacttctacaaagtatatc

SEQ ID NO: 41124 - DNA, 601 bp, Human
taggccgggcgcggtagcttacgcctgcaatcccagcactttgggaggctgagacgggcggatcacaaggtcagcagatcgagaccatcctggctaacacagtgaaaccccgtctctactaaaaatacaaaaaattatccaggtgtggtggcgggtgcctgtagtcccagctactcaggaggctgaggcaggagaatggcgtgaacctgggaggcaaaggttgcagtgagccgagatcatgccattgcactccagcctgggcgacagagcaagactccgtctcaaaaaaaaaaaaaaaacraacaaacaagcattatctagaaattccacttgtaggtatctactccagaaaaagtctcactgtgtacataaacattatgtgcagtatcatttgtaataggtaaaatgtgggaacaacttatatctaccaatgggagaatggataaatagaattactgtatattcacatattggaattccatatagtagtgaaagtaaataaagtagaagtacatgtaacaagccagtaaatcttaaaaatgtattaattataaacactgcaggctgggtgtggtggctcaggcctataatcccagtactt

SEQ ID NO: 41125 - DNA, 601 bp, Human
ttaggccgggcgcggtagcttacgcctgcaatcccagcactttgggaggctgagacgggcggatcacaaggtcagcagatcgagaccatcctggctaacacagtgaaaccccgtctctactaaaaatacaaaaaattatccaggtgtggtggcgggtgcctgtagtcccagctactcaggaggctgaggcaggagaatggcgtgaacctgggaggcaaaggttgcagtgagccgagatcatgccattgcactccagcctgggcgacagagcaagactccgtctcaaaaaaaaaaaaaaaamgaacaaacaagcattatctagaaattccacttgtaggtatctactccagaaaaagtctcactgtgtacataaacattatgtgcagtatcatttgtaataggtaaaatgtgggaacaacttatatctaccaatgggagaatggataaatagaattactgtatattcacatattggaattccatatagtagtgaaagtaaataaagtagaagtacatgtaacaagccagtaaatcttaaaaatgtattaattataaacactgcaggctgggtgtggtggctcaggcctataatcccagtact

SEQ ID NO: 41126 - DNA, 601 bp, Human
ccattatacacctatcagaatagctaaaattaaaaacaaaaataaaaacgacaatacaaagtgctggccagaatgcagagcaaactgctgctctcatacagtgatggcgggaatgattacaaatattttagaaaaatgggttggtagtttcttacaaagttaaacataccatacctacatatggcccagcaatcccactcccaggcatttatccaaaagaaataaaaatgtatgttcatccaaaaatcaaaacatgaatgtttatagcaatgttgtttataatcaccaaaaactggtaacragccaaatatccttcaactggcaaacagataaacagaggtacatccattcaatggaatacgacgacaaaataaaaataaactactgatacaaacaataatatggatgaatctcacatgcattatgctaagtaactgaaaagaaactcaaaaaaggcttcatacagtatgatatcattcatatgacttcctggaaaaggcaaatttataaggacagaaaggagatagattgccaggggctgagggaggcaaggagaaacagatgataaagagacacgggggaactttttgaggagatggaa

SEQ ID NO: 41127 - DNA, 601 bp, Human
tgtggataatgatatatttgggtctatatctaccaggtcattataagatttatgtttgtcctatttgatctatgtttctcttcctctttttttccccttcttttggtttgattttttagcttttttttttcttttcgcacaattagtttggaagagaaaaataattaatttttaaaaaaatcaatgaaacagaaagctggttctatgacaagatcaataaagtttataaatccctagacaagcttcctagaaataaaagagagaaaatacaatttaccaatatcagaatgaaggaagagayaccactaaggattctgcagacattaaaagaatggaggaatattatgaagagctttatgccaagttcaacaatttaactgaaattccttgaaagatacaaactaccagagtacactcaagaagacaaataacctgaatggcatcatatatacattttttaaatgaagttaattaaccccgaaaagccttcccactaagaagacagctgcaatagtgaactctaacaaacatttaaggagatcacaagaaaaaggtcaatatataaaagttcatttaattctagagactaccaataaacaat

SEQ ID NO: 41128 - DNA, 601 bp, Human
tgcttcataaattcgagctttcctggctcccaacctccattcgttttctcaactctgagagagaactaggcctgtaatctgtttctgggccatgatctagtacaatcctagggctgacctagtttcccttcttcagatcacagtcctgggatgcctattatccaatatctgaaaactgttatgtcataaattttgtttgattttctaggtatttatagtagcagggtaaatccagtccatttactttatcatggctgtaaacaaaacagaaaaatgttcttactatcaaaataaatggcawtttatctagttattctttttttattaatttccaacactatcccattgtaaataaagaacacagtctatatgatttcaatcctttgaaatgtgttgtgtcttgctttatggctcaatatacaatcaactttttgtaaatgatctttgtgctcttcatttacatttaatgtggataatgatatatttgggtctatatctaccaggtcattataagatttatgtttgtcctatttgatctatgtttctcttcctctttttttccccttcttttggtttgattttttagcttttttttttcttt

SEQ ID NO: 41129 - DNA, 601 bp, Human
taatttatgttttttggttactagtgagaacgactatctaaagacgtttagatcctttatattggttatttgatgaattatcacttgtttctttttaaaagttctttatatattacagatgctagcctttgatgtatttgttgtaaatattttatttcagtgcacgttatcttttactttttagttttatccatttttatgaaaattttgatgcactcaaatctatcagtattatcttttgtaacttcttcctttgctttatcagataaggatggctttcacatgatgaaaacttcattttagaaaagaatgctttaagatattatattcttttaaattcctattggctttcttatggtcaaaaaatgaaatcaacagaaagcaaacagcaaatatataagtatctcatcctagattttgaccatttacatacctgcttgtgacaattatcacatcctcagagatggtagccatttctttgatggtaaggtagcacattctcctcaatgtttgctgaaaaatcatttataaaaggtaacagattattgattaggaaatggttttttaaattatttgaagtgaggaccccaagtagatatat

SEQ ID NO: 41130 - DNA, 601 bp, Human
tagattgactccaacccccatttagcactttatgaagacttatttatatcagatgtttcaaaaatatctccaaattttaaaatattttataatatgatgatatggttaattaaataattttatcaatggtagacacgtaagttgtttgtccttttttctactgtaaatggtgttgcaacaaacatcaatatatataagtttttctgtgttatgtctgattattttccaaggatagttccacagatgtggccttactaggtcaaagggataaagcctttcaattattcaataaatgttgctmaattactttctagaaaaattgaatcaatttattactctgtctcctttgtacaagagtatgtctcccttacacaagtactgaatgctgcctgtttgcttttttgccattttgatgagtaaaaaatattatacctcattcttgaatttttaatttatgttttttggttactagtgagaacgactatctaaagacgtttagatcctttatattggttatttgatgaattatcacttgtttctttttaaaagttctttatatattacagatgctagcctttgatgtatttgttgtaaatatttt

SEQ ID NO: 41131 - DNA, 601 bp, Human
tatttttttttttttttttttttttttttttttgagacggagtctcgctctgtcccccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggygtgagccaccgcgcccggccaatttttttgtatttttagtagagaaggagtttcaccatgttggccaggttggtcttgtcctgacctcagatgatccacctgcgtcggcctcccaaagtgctgggattacaggcatgagccaccatgtctggcacataaaatgttctttaaagtgagactatatggaatacgtagattgactccaacccccatttagcactttatgaagacttatttatatcagatgtttcaaaaatatctccaaattttaaaatattttataatatgatgatatggtta

SEQ ID NO: 41132 - DNA, 601 bp, Human
gaggcaagtattgacagcgctaaaagaaacaaacaaaaaactctcagtcaacaactaatttattttaaaattttcaaaatattagtgaatctagcaatctaactgaaggttttctgggtttttttgttcatttgtttgtttttttacttgtggtagacaccattagttaactaatccgacatccattttcaaccccttctcccttttctgtccctaatacttgggctataaaatactaaatactcactttcctggcttcctaaggatagtcatataacacagttgtgccaagtgaaatctwaaaattgccttgggaaaagatattagattcctgatgaaagaggcagatggtgtggccttccctggcttccttcccaggacccctctagccttgaatatggtacattgccagtaatttgggcatctattttgcaacaatggagaatgtccaaagaattcaagagacactaccctgacactgctgaatgactgagccaacaccagctactccaagcctctagacttacgattatatgagaaaaaataaactcccatcttgtttatgtcactgtttacatctgcttttctgttattttcagct

SEQ ID NO: 41133 - DNA, 601 bp, Human
tattttggtattgtcaagcttttttgttgtaaccattctagtgggtatgctgtacctcattaagatttttttttttttttttcgagacgaagtctcactcggtcgcccaggctggagtgcagtggcatgatctcggctcaccacaacctccgcctcccgggttcaagcaattctcctgcctcagcctcctgagtagctgggactacagatgcctgccaccacgcccagctaattttttgtatttttagtagagacagggtttcaccgtgttagccaggacggtctcgatctcctgacctcrtgatccacccacctcggcctcccaaagtgctgggattacacgcgtgagccaccgtgcccagcctatctcactaagattttaatttgcatttccctgatgactaataatgttaagaacattgtgcttattggccatttgcatatattcttttgtgaagtatgtgccttcagatttttttaatctccatggtttcttgccaagccaacaaattttctatgcatacagaaaggtcatctataatattagttttctattcctgctgtaacaaattaccacaattagtggcttaaaacaacatga

SEQ ID NO: 41134 - DNA, 601 bp, Human
cttcagcacagttgccttctactacattgttagatctcaggtatagacatctgccctccaggaccgactccatgggctccacccgtcggtgtccatggggtggagcccatgggcgaagatgatgtctttctccaaccggaccactgcctcgagactgccaaaatccacaggcactagaggctccaggggctcaatcacctcaatcatgatccggccactgccttggaggtgaagccccggcacccacccagccacatcccccacgctcacccatttttccattattaactgaagaaacatrggtgctctttagagatttttttcaagattaggaagcaaaagaaagaagccagataagaactctaaggtggatgcctacggacactcttgcaaaattgcccttgtttgatgagacaaatgaacagacacactgtcacggtggagaaggactctctggtgaagctttcccaagtgtttttctactaaagctttggccaactttctctaaatactctcataataagctattatcattacttggccctccagaaagtgaacaagcaaaatccctcaagcatctccaaaaactgttgccctgttt

SEQ ID NO: 41135 - DNA, 601 bp, Human
ggcgcagtggctcacgcctgtaatcccagcattttgggaggccgaggcaggcagatcacctgaggtcacaagttcgagaccaacctggccaatatggtgaaaccccttctctactaaaaatacaaaaattagccgggtgtggtggcaggtgcctgtaatcccagctactcaggaggctgaggcaggagaatcgcttgaacccaggaggcagagattgcagcgagatgagatcacaccattgcactccagcctgggggacaagagcgagacttcatcccaaaaacaaaaaaaaaaaaaaaaagaaaagaaatgcttaagcatccattttttcaggtgactggaaaaagcaggaaaattagtgttcacagtaagaaaatatggtcctcatgcttccacgtattcagagagtaccccctttccagaatgagctactcggctgtgtgagaaaggctcttgttcatccagctttggcaaagagatattacctggggggccacaaaatactccttcacgacgcaatgggagttttgtagtaattcttcagcacagttgccttctactacattgttagatctcaggtatagacatctgccctccagga

SEQ ID NO: 41136 - DNA, 601 bp, Human
ccatctaccatttaagtagatgtaaaagttcactttcatgcagttggtatagtcctttggcgagagttaaagggggataaatagtgtcttccatactgaacaggcctgttaagtgaataccttggaagctatttccttggaagctgacttttgctttccttttacttcagttagcatcaggaactcattgccttgttggtgccagatatttcccaattctgtcttcagaagagtctgctattaagaaatgctggccgggcgcagtggctcacgcctgtaatcccagcattttgggaggccraggcaggcagatcacctgaggtcacaagttcgagaccaacctggccaatatggtgaaaccccttctctactaaaaatacaaaaattagccgggtgtggtggcaggtgcctgtaatcccagctactcaggaggctgaggcaggagaatcgcttgaacccaggaggcagagattgcagcgagatgagatcacaccattgcactccagcctgggggacaagagcgagacttcatcccaaaaacaaaaaaaaaaaaaaaaagaaaagaaatgcttaagcatccattttttcaggtgactggaaa

SEQ ID NO: 41137 - DNA, 601 bp, Human
aaaaactccacaatcttggactcacgtcaatctaataatcattttgggggtggaaagggctactttgtcccaggcccatggctacttttaggataagttctcttttcagaaagagaaacactaggtatgactagtatcccttttgcatctaatcactttgtgggatggcagatggttctaggttaggagttcccaagctctagtctactttgaacactcttcagaccatagtagaaagttagcccttttctaggaacaaagtgggtacctaggaacaaattcaggtatgtccggtgaagayagggctgctcaaatcaattcaaatagcaactaaaaatgacaaccaaggttgtcacatagtgatcaaggtgctccatctaccatttaagtagatgtaaaagttcactttcatgcagttggtatagtcctttggcgagagttaaagggggataaatagtgtcttccatactgaacaggcctgttaagtgaataccttggaagctatttccttggaagctgacttttgctttccttttacttcagttagcatcaggaactcattgccttgttggtgccagatatttcccaattctgtcttcag

SEQ ID NO: 41138 - DNA, 601 bp, Human
cctgtaagcccagcactttgggaggccaagacgggcagatcacttgaggtcaggagtttgagaccagcccggccaacatggtgaaaccacatctctactaaaaatacaaaaattagctgggcgtggtggcacacagctgtaatcccagctacttggaaggcttaagcctgggaggcggaggctgcagtgagccaagggcacaccattccactccagcctgtgtgacagaacaagactccgtctcaaaacaaaaacaaaaactataggccgggcgcggtggctcccagcactttgggaggcygaggcgggcggatcatgaggtcaggagatcgagaccatcctggctaacatggtgaaaccccgtctctactaaaaatacaaatattagccaggcgtggtggcgggcacctgtagtcccagctactcgggaggctgaggcagtaggatggcatgaacccgggaggcggagcttgcactgagccaagatcgcgccactgcactccagcctgggcgacagagcgagactgtgtctcaaaaaaaaaaaaacccacaaaaactataaattttatttatcgacatagctccatcaagttcaagacac

SEQ ID NO: 41139 - DNA, 601 bp, Human
agtttagggctatcacaaatacgaggggacttcaaaaaatctgtggaaaaatggaattaaaaaataaacctaacggctgagcacagtagctcacgcctgtaagcccagcactttgggaggccaagacgggcagatcacttgaggtcaggagtttgagaccagcccggccaacatggtgaaaccacatctctactaaaaatacaaaaattagctgggcgtggtggcacacagctgtaatcccagctacttggaaggcttaagcctgggaggcggaggctgcagtgagccaagggcacaccaktccactccagcctgtgtgacagaacaagactccgtctcaaaacaaaaacaaaaactataggccgggcgcggtggctcccagcactttgggaggccgaggcgggcggatcatgaggtcaggagatcgagaccatcctggctaacatggtgaaaccccgtctctactaaaaatacaaatattagccaggcgtggtggcgggcacctgtagtcccagctactcgggaggctgaggcagtaggatggcatgaacccgggaggcggagcttgcactgagccaagatcgcgccactgcactccagc

SEQ ID NO: 41140 - DNA, 601 bp, Human
ccccagaaagttccctcatgcccatttccaatcaatttcctctaacccagtagacttctgacttctatcaccacagatgagtttgggggctgttcttggagtttatacgaagagaatcatccagcatatattcttttgtgtctgttttctttccaacataaatgttttagaagtttatccatgttgttgcctgaatcagcaattttttccttttattgctgagtaatagtctattgcatgaatataccacaatttgttccttcttctttgatgagcatttgggatgtttccagtttagggytatcacaaatacgaggggacttcaaaaaatctgtggaaaaatggaattaaaaaataaacctaacggctgagcacagtagctcacgcctgtaagcccagcactttgggaggccaagacgggcagatcacttgaggtcaggagtttgagaccagcccggccaacatggtgaaaccacatctctactaaaaatacaaaaattagctgggcgtggtggcacacagctgtaatcccagctacttggaaggcttaagcctgggaggcggaggctgcagtgagccaagggcacaccattccactcca

SEQ ID NO: 41141 - DNA, 601 bp, Human
cggtgtctgcccaaacggccgcccagttttgtccttgaaacccagggccctggtggcgtaggcaccagagggaatctcctggtctgcaggtttgaagaccatgggaaaagcgtagtatctgggctgaagtgcaccattcctcaaggtgcagtcccttatagcttcccttggctaggggagggagttccccaaccccttgcacttccctggtgaggcaatgccccatcctgcttcaacttgccctccaggggctgcacccactgtctaaccagtcccagtgagaagagccgggtacctcggytggaaatgcagaaatcacccgccttccacgttgatctcgctgggagctggagaccagagctgttcctattcggccatcttgccagccacacctccacgtctgagctaatgaatctttttactttacatattatagtctgtcatttctagaattttcatttggttttgtatatatagctcactgctgagaattcctctttccattgatttcaagagtgtctgcctttatagtacatggttgcagtagctgctttaaagtatttaagaatccctacaactgggtcattttgggggtatctat

SEQ ID NO: 41142 - DNA, 601 bp, Human
tccctttattttaagcctatgtgtgtctctgcatgtgagatcagtctcctgaatacagtacaccaatggatcttgactccttatccaatttgccagtctgtgtctttccactggggcatttagccagtttacatttaaggttgatattgttatatgtgaatttgatcctttcattatgatgctagctggctattttgcccattagttgatgcagtttcttcatagtgtcaatggtctttaccatttggtatgtttttgcagtggctgacacttgtttttcctttccatatttagtgctccyttcaggagctcttgaaaggcaggcctggtggtgacataatctctcaggatttgcttctctgtaaaggattttatttctccttcacttatgaaggttagtttgtctggatataaaattccgggctgaaaattcttttctttaagaatgttgaatattggcccccactctcttctggcttgtagggtttctgcagagagatccactgttagtctgatgggcttccctttgtgagtaacccgacctttctctctggctgcccttaacattttttccttcatttcaacgttggtgaatctgaca

SEQ ID NO: 41143 - DNA, 601 bp, Human
taaaaggtatttactgcaatgagtttttctttgatcactcctttaattcaccatatagatttaataatttatttttaactgacacataataattgtatatactgatggggtacacagtgatgttttgatacatagaatgcatagttatcacatcagggtaattagcacatccatctcctcaaacatttatcatttcttttactgggaacattcaaaatcctctctgagctatttgaaaatacataataaataactgttaactacagtcatcttgcagtgctatatagtctatagattctgrtatgtagttatgtagtgatttgccttttttcccccaaattcagcatgaccataaatcacaaatgacatctccaaccagaaacattccaaccataaaataaacccctccctgaccagagacatgccagccccgagacaacttcccctcgggccagagagatgtcagcctcccgagtgcctgccaccacaccaggctaattttttttttttttttttttctattttttagtagagacaggatttcactttgttagccaggctggtctcgaacacctgacctcatgatccacccaactcggcc

SEQ ID NO: 41144 - DNA, 601 bp, Human
ttttttttttaccaacttagcttacgggtttatttatattgttaattttttcaaaaataggattttgatttaataattagatatgtttttctattttttcctcattaatttctgtttttatctatactaattcctatcatatgctttcttttgaattactttgttgttctttacctagtttttttgagctaagaatttaattcactttttattccttccttttcattgataaaaggtatttactgcaatgagtttttctttgatcactcctttaattcaccatatagatttaataatttayttttaactgacacataataattgtatatactgatggggtacacagtgatgttttgatacatagaatgcatagttatcacatcagggtaattagcacatccatctcctcaaacatttatcatttcttttactgggaacattcaaaatcctctctgagctatttgaaaatacataataaataactgttaactacagtcatcttgcagtgctatatagtctatagattctgatatgtagttatgtagtgatttgccttttttcccccaaattcagcatgaccataaatcacaaatgacatctc

SEQ ID NO: 41145 - DNA, 601 bp, Human
acatccttgctgtggttcctgatcttagtggaaatgcctctagtgtttccccattaaaaaaaaaagggggtcatttttgacaagctgtatttgcctaaaaaattatccattaaatctaggtttcaaatttatttcaaagactacaaatttgtcttttgatttttacatttcttctgtttctcccttgtcatttattttgcatatttatgctttctccgtttttttttttaccaacttagcttacgggtttatttatattgttaattttttcaaaaataggattttgatttaataattagayatgtttttctattttttcctcattaatttctgtttttatctatactaattcctatcatatgctttcttttgaattactttgttgttctttacctagtttttttgagctaagaatttaattcactttttattccttccttttcattgataaaaggtatttactgcaatgagtttttctttgatcactcctttaattcaccatatagatttaataatttatttttaactgacacataataattgtatatactgatggggtacacagtgatgttttgatacatagaatgcatagttatcacat

SEQ ID NO: 41146 - DNA, 601 bp, Human
cctggctgaacgttaaccccagagtattaattcccccatacttctggggagtatacacgtgagctgcaagtgaatctgagtaggcaaaaaacactcagtgcatacctgaagtaaggcagtaacaatgccagtgagctgagccccaaaagacttgctcatgatgccacagctggaatcacagataaggcctgagaccatgtgaagtggctcaaaagaggtgtccaatacagtctaccctttccatccctcaaatttgttcatgtcctccattaagtctaatctatcatggaggcttcaagayggtagcaatcactatttctacaaaagactaaataaaggaaggtgagtggaacatagttcaatccttgctgctacaactaattccaaggccataattgatattcatcatctccttcctaaaaccacccattctacatttccttccccactggccagcactttacctggttttggctacttctccaatagttgactcaaacctttatcccaaaggatgtaagccctgtgttgggtgcaccctgattgaaccactgattgttctctacccctaccaccactgtcagaggcaagaaagcaccaa

SEQ ID NO: 41147 - DNA, 601 bp, Human
catacattctgacagggaacaatctagtaaatatttcaggctttgcaggctatatgactaccccataaccacttgatttggttgctgtaacataaaaacagccatacacaatacatacacaaccctctggcccatagagtggagctgggtgccacagggactattcccaacccttgaaacctaaaagtttacctgattaaatttaaaaattgtctggtgctagtgactcttttctttcctctcattgtctccctttctgaatgggaatgtatataattgttattctatgcctgtcccaccrcagtattttagcagcacataacttgtttgctagtttcacaggtccatagataaagaggaattctgtcttgggatgaatcatacccagaaactcacctatactggagttagatgattagattatgagatttgggacttttgagttataatatttaacgagattttagacctgagttaatgcaatgggtttagattttggaagatttttacaatatggtgaatgtgttttgcatgtaggatggatgtaaatctttagggaccagacagaagcctgtggtaagctaaacaacagcccccaaag

SEQ ID NO: 41148 - DNA, 601 bp, Human
gttccatcattcagcatagtagccacaagctaaatgtgtctaatgagcacttgaaatatagctagtgtgactaatgaactgaattttcaattttacaaaagttcaattaatgttcactataatagccatatgtatctaatggctatcttattggacaatacagatgtaagagtgtcttttgttttcctaagtgaatgtgttttctctctgaaatatgggagatttacattctagttctttttgtcgctgccataaaactttagataaaagagttaagctatgaaagcaaaaaaattaatgyacgtaagctttctcctctctcatctgccctcccgtgtatctccaaatttttgttagtattattctttttgtattatcatggattataacatttacattctatctttaatcataatttctacagtagtttaaccctacttctataattgaatacattcaatgctcactggtaattcatttcctgtagcccctctattacagaattcactcttttgatttaatataacttcaatgcttaattttatttttcaagaaaagctcacaggtgttatggtccctgaattctttccagtgtggaagt

SEQ ID NO: 41149 - DNA, 601 bp, Human
ggccaggtgtggtggctcatgtctgtaatcccagcactttgggaggtcaaggtgggaggattacttgagctcaggagtgcaagaccagcctgggaaacatgactaaaccccatctctacagataatacaaaaattagactggtgttgtggggtgtgcctgtagtctcagctacttgggaggttgaggtgggaggactgcttgaacccaggaggcagaggttgcagtgagctgagatggcaccactgtactccaacctgggtgacagagtgagaccctgtctcaaaaaaaaaaaaaaaaaaaaaaaaaagactttttttggaagtgtcctgcaccaaaaaattttgtagcgtgggcatttttccctgatgcactctttctggctctgtcagatgcaagcttggttttccggatttccaagaggatctatgaactagattctactgccagcaatggggagccctgaacaatacactcgttcagtaatttaagtgccaaggactatgaattttcctctgaccatagctttagttgaactcataggttttcatcattagattttaaaaatattctgtaatttcaatttttacttatatactgtcc

SEQ ID NO: 41150 - DNA, 601 bp, Human
tgcctggctaatttttgtattttcttctgatagagatggggttttgtcatgttgcccaggcttgtcttgaactcctgagctcaagcgattcacctgcctcagcctcccaaagtgctaggattacagccatgagccaccgcacccagcccctttcattcattttggaaaattctcatccattgatatggtttgcctgtgtccccacccaaatctcatcttgaatttccatgtgttatgggagggaccaagtgggaggtaattgaatcatgggggcaagtgtttcccatgctgttctcatgamagtaagtctcatgagatctgatggttttaaaaatgggagtttccctgcacaagcgctctctctctttgcctgctgccatccattcaagacgtgacttgttcctccttgccttccaccatgattgtgaggcttccccagccacgtggaattgtaagtccattaaacttcttccttttgtaaattgcccagtctcgggtatgtctttatcagcagcatgaaaatggactaacatatccattatctcttcaaagatttattctattccattctgtttcctttccttctgagactcattacaca

SEQ ID NO: 41151 - DNA, 601 bp, Human
tagttcagttggtcagccagtgatttttgcagagtttaaaattcattttgagactcattccttttatggctccctcttttccaggttttccactctaagttttcagttactcttccaacctcaaactgttttgaccactctgtccagaaatactgtagctttctgtcatcctacactgaggaattacagaatgccctcaggagaatagcaaaaaaaccccacaaatttcacccagtatagcttttgtctttcaggcatcaactgcttccctccagtttttgcttgcttttcaccactcccyaatattttcatactgttgtgggttatcttcattttgggaaggtatagctttgtactaatgtcaattattatttgcaggaggattaagctggccaagctacaccattattggaaggaggaagctcaactgaatatttttaaatattccattttatcttctctgttgacatttaagatctatatgttttacaaagatttttttgttagttataatattcatcctcaagagattacaatattcatccttatcacagtgtatcatcaaataatatactactgcatgatacaaaaactttacaaa

SEQ ID NO: 41152 - DNA, 601 bp, Human
agtttctattgattgctttttctcttggctactagtcacattttccaaattctttgtacttctggcaatttttaccatctattaaacattgtaatgatatactgtaaagactctagaactcatggagtttctttagcaagaagcttggctgggatcaaactccaaactttatttcctccatagtgagttgcagctgaattctccattcaattcttttatcttacaactactgcttttggcaggtctcctagagtattctcctgtatatatgtagttcagttggtcagccagtgatttttgyagagtttaaaattcattttgagactcattccttttatggctccctcttttccaggttttccactctaagttttcagttactcttccaacctcaaactgttttgaccactctgtccagaaatactgtagctttctgtcatcctacactgaggaattacagaatgccctcaggagaatagcaaaaaaaccccacaaatttcacccagtatagcttttgtctttcaggcatcaactgcttccctccagtttttgcttgcttttcaccactccccaatattttcatactgttgtgggttatctt

SEQ ID NO: 41153 - DNA, 601 bp, Human
ttcactttagccccatgaggcctgtgtcagacttctaatctacagatctgagataataaatggatcttgttgtaagccattacatttaatggtaatttgttatggcaacaataaaaaaaactaacagattttggtacctgtaagtgaagtgttactgcgacaaatacctcaaattgtagaactgactggaattaggcactgggtggaagcttggaagaattttgaggagcatgatggaggaagcctagttttgaagagacttataagaaatctgatcttaaatgatccacccacctcagcytcccaaagtgctgggatgcctatagttccagctactcaagaggctgaggcatatgaatggcttgaacccaggaagcggaggttgtagtgagctgagactgtgccactgtactccagcctgggcagcagagcaagactttaaaataaataaaaaaaagaaagagagagagagagagagaaagaaagagaaagagaaagaaaaagaaagagagagagaaagaaaagaaagaaagagaaaagaaagagaaagaaggaaggaagaaggaaggaaggaaggagaaagaaagatcaatcgatctgg

SEQ ID NO: 41154 - DNA, 601 bp, Human
tgaacaaaagctataagcaaaaacaagggtgaaatcttagaagaaaatactaaatgaacaaaacaagatgcaactctcttgagtacccccacactcccttgagtgtgcactttttgctttgaaataaaatctctgtactttcactattttctgactcatccttgaattccttctcatgatggtgtcaagagtctggacaccggctggcgctgaggtcccatcggcatttggggaccccccccctccagcctaccagtatcatctttatggccatccagcccagagcatcatcagccacatyagaaccaccagcagttggtaagtcccattggggccttaattggagtcttctcgttctctggagttactgctactttcttccttgttcctacagcctgactcccctcagccgtagtgcctctgcttcctccagctggaaaacgcagttcgccctgacagtgacaaatggaggtgggaaggctttgacctacacctgagctctgaggtgccatgggcctcctgggcaagaggctaatgagggtgagtagggtaaaatcccatgtcccagtggctggacagctgccaaggagcattatgactt

SEQ ID NO: 41155 - DNA, 601 bp, Human
cttacagaaaagtaagggaggaagattttctctagcatacatctacactaacataaagaaagctattataataaggtggagtgttgctggcacataaacagaaataaaaagcagtggtgaatatgagtccagaaatagaccaatccacataaagacacctgatttataacaaagctaatattgcacagtagtgggtatagacacatatttcaactaatggtgctgagattattgggttttcatatggagaagaaagaaattaaattgctaccttatactatatccaaaaaagaaaaaaaaatgaaacaattccaggtagattacaaacctaaaatatgaaagttgaagctataatgcttatggaaaatagtacagaggatatatttgtgaatttggggtaagaaaatgtttcttatgcaagacaccaaacacattatttctaaagtaaaagactgataaatgtgactaccttacacttacggagctctgttcatcaaaagacaccaagaaagggaagagacaagctagagtatgggaaaagctacttgcaacacatacaatcaacatcggactcacatttagaagacataaagaactccta

SEQ ID NO: 41156 - DNA, 601 bp, Human
tttctaccaatttatattctcagcaatgtggtatgagaatacccatgttctagccaacactagatactacaaaacattttaaatttgttcaacctgatagatgaaaaaataatgtcaccttgttttagtctgcatttctctaatcaatagtgaggtgatgcttatttttgtttattggcaggtgcatttcctcatctggagctgcgcgttaatcccaaatttctccatcaggatatcttttctcctgatttgtaagagttctttatatatttggatactagttctccatgagtagcaaatrtatgtgtagcaaatatttttctcccagtctatttttgtctaactttatgtattttttaatcgtaaaagacgttaaatttttgttgtaaaaactatcaatattttatttttcctatcaaaagattgtatttttcttatgtttagttttaactagatgaaaatttgaggttctgtttatttaagcctttaccccatctataacctatttttatgaatgtaagagtccaaatttctctacttctttaaatgttcaggagagctctccctctccctctccctctccccacggtctctctctccc

SEQ ID NO: 41157 - DNA, 601 bp, Human
aaattaccttacaaagtatttctaccaatttatattctcagcaatgtggtatgagaatacccatgttctagccaacactagatactacaaaacattttaaatttgttcaacctgatagatgaaaaaataatgtcaccttgttttagtctgcatttctctaatcaatagtgaggtgatgcttatttttgtttattggcaggtgcatttcctcatctggagctgcgcgttaatcccaaatttctccatcaggatatcttttctcctgatttgtaagagttctttatatatttggatactagtyctccatgagtagcaaatgtatgtgtagcaaatatttttctcccagtctatttttgtctaactttatgtattttttaatcgtaaaagacgttaaatttttgttgtaaaaactatcaatattttatttttcctatcaaaagattgtatttttcttatgtttagttttaactagatgaaaatttgaggttctgtttatttaagcctttaccccatctataacctatttttatgaatgtaagagtccaaatttctctacttctttaaatgttcaggagagctctccctctccctctccctctcc

SEQ ID NO: 41158 - DNA, 601 bp, Human
acatggagacagtcctctttgacaatcttccccaatgcagtcctcttctcccagctccctaaagataatgactataatgagaatttgttatttatctttcccaatataaaaaaatatttaccccccgccacacacatatacacacaaggagaaactatattcagtgtgtagttttttcttttacagaaatggcattggctgtatatttacttcacacagttttttttttcatgaaacaataattaattcctgattaaacattttataacatcccataatacaactaaacattttgtccaatcgttaattcaaaggatgttaaagacatctctcaatattttgatattacaagtaatactggaattgaaatatttgtatatgtttccttgtgaaagtgtacaagtgtttctctgcagcagatatgcaagggagaaactgctggattccaaacactgtacaggtttactttttttttttttaagagtcgggtctcactgtgtcacctaggctacagtgcagtagcaatttacaggtgtgatcacagctcaatgcaaccttgaaggccttctgtgatcctcccaccttagcctcccaagtagct

SEQ ID NO: 41159 - DNA, 601 bp, Human
agccataaaaaatgatgagttcatgttctttgtagggacatggatgaaattggaaatcatcattctcagcaaaatatcacaaggacaaaaaaccaaacaccgcatgttcttgctcataggtgggaattgaacaatgagaacacatggacacaggaaggggatcatcacacactgaggactgttgtggggcagggggagggggaagggatagcattaggagatatatctaatgctaaatgacaagttaatgggtgcagcacaccagcatggcacatgtatacatatgtaacaaacctgcacrttgtgcacatgtaccctaaaacttaaagtataataataaaaaaaaagcttagaacatggagacagtcctctttgacaatcttccccaatgcagtcctcttctcccagctccctaaagataatgactataatgagaatttgttatttatctttcccaatataaaaaaatatttaccccccgccacacacatatacacacaaggagaaactatattcagtgtgtagttttttcttttacagaaatggcattggctgtatatttacttcacacagttttttttttcatgaaacaataattaat

SEQ ID NO: 41160 - DNA, 601 bp, Human
gaaaatgtggcccatatacaccatggaatactatgcagccataaaaaatgatgagttcatgttctttgtagggacatggatgaaattggaaatcatcattctcagcaaaatatcacaaggacaaaaaaccaaacaccgcatgttcttgctcataggtgggaattgaacaatgagaacacatggacacaggaaggggatcatcacacactgaggactgttgtggggcagggggagggggaagggatagcattaggagatatatctaatgctaaatgacaagttaatgggtgcagcacaccarcatggcacatgtatacatatgtaacaaacctgcacgttgtgcacatgtaccctaaaacttaaagtataataataaaaaaaaagcttagaacatggagacagtcctctttgacaatcttccccaatgcagtcctcttctcccagctccctaaagataatgactataatgagaatttgttatttatctttcccaatataaaaaaatatttaccccccgccacacacatatacacacaaggagaaactatattcagtgtgtagttttttcttttacagaaatggcattggctgtatatttact

SEQ ID NO: 41161 - DNA, 601 bp, Human
gctggaaaaatacaactctcctagcttaaatcaggaagaattagatcccctgaacagaccaataacaagcagcgagattgaaatggtaatttaaaaattaccaacaaaaaaaagtccagaatgattgagaaggaggagccaagatggccgaataggaacagctcccgtctacagctcccagtgtgagcgacgcagaagaccggtgatttctgcatttccatctgaggtactgggttcatctcactagggagtgccagacagtgggcgcaggtcagtgggtgcacgcaccgtgcgcaagccraaccagggcgaggcattgcctcacttgggaagcgcaagggtcagggagttccctttccgagtcaaagaaaggggtgatggacgcacctggaaaatcgggtcactcccacccgaatattgagcttttccgaccggcttaaaaaacagcccaggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggc

SEQ ID NO: 41162 - DNA, 601 bp, Human
aacccaatccaataaagacagaaaaaggaataagaaaatatgaacaaagactccaagaagtctgggattatgttaaacgaccaaacctaagaataatcgatgttcctaaggaagaagagaaatctgaaagtttggaaaatgtatttgggggaataactaaggaaaatttccccggccttgcaagagacctagacatccaaatacaagaagcacaaagaacacctgggaaattcattgcaaaaggatcatcacttaggcacactgtcatcaggttacctaaagttaagacaaaggaaagaaycttaagagttgtgagacagacgcaccagataacctatcaaggaaaacttatcagattaacagcagatttctcagcagaaaccctacaagctagaagggattgggtcctatcttcagtctcctcaaacaagacaattaccagccaagaacttggtatccagcgaaactaagcatcatatataaaggaaagatacagtctttttcagacaaacaaatgctgagagaatttgccactaccaagccaccaccacaaggactactaaaaggagccctatatcctgaaacaaatcctggaaacaca

SEQ ID NO: 41163 - DNA, 601 bp, Human
aaatgcaaaatgctctggaaagtctcagcaatagaattgaacaagtagaagaaagaaattcagagctcaaagacaaggccttcaaattaacccaatccaataaagacagaaaaaggaataagaaaatatgaacaaagactccaagaagtctgggattatgttaaacgaccaaacctaagaataatcgatgttcctaaggaagaagagaaatctgaaagtttggaaaatgtatttgggggaataactaaggaaaatttccccggccttgcaagagacctagacatccaaatacaagaagcayaaagaacacctgggaaattcattgcaaaaggatcatcacttaggcacactgtcatcaggttacctaaagttaagacaaaggaaagaatcttaagagttgtgagacagacgcaccagataacctatcaaggaaaacttatcagattaacagcagatttctcagcagaaaccctacaagctagaagggattgggtcctatcttcagtctcctcaaacaagacaattaccagccaagaacttggtatccagcgaaactaagcatcatatataaaggaaagatacagtctttttcagacaaaca

SEQ ID NO: 41164 - DNA, 601 bp, Human
acatcacaggactctgcagacaatccctggtaccagcttggagctgggtagacttgctgggtggctagacccagaagagagacaacaatcactgcagtttggctcataggaagccacgtccataggaaaagggggagagtactacatccaagcaacaccccatgagacaaaagaatcagaacaacagacttccgcctagaccttccctctgacagagcctacccaaatgagaaggaaccagaaaaccaactctggtaatatgacaaaacaaggctctttaacacctcccccccaaaaaaaattacactagttcaccagcaatggatctaagccaagaagaaatccttgatttacctgtaaaagaattcaggaggttaggtattaagctaatcagagaggcaccagagaaaggcaaagcccaatgcaaggaaatccaaaaaatgatacaagaagtgaagggagaaatattcaaggaaatagattgcttaaagaaaaaaaacaatcaaaaattcaggaagcactggacacactcacagaaatgcaaaatgctctggaaagtctcagcaatagaattgaacaagtagaagaaagaaattcagag

SEQ ID NO: 41165 - DNA, 601 bp, Human
atgttggtgtggatatggtgaaaagggaacacttctacactgatggtgggaatgtgaactaggacaaccactatggaaaacagtgtggagattacttaaagaactaaaaagtagatctaccattatccagcaaacccactactgggtatctacccagaggaaaagaagtcattatatgaaaaaggcacttgcacactcatgtttatagcagcacaattcacaattgcagaaatatggaaccagcccaaatgcccatcaatcaataagtaaataaagaaaatgcgccctctctctctctctmtatatatatatacacaaacgcgcgcacacacacatatatacaccatggaatactactcagccattaaaaggaatgaaataatagcatttgcagcaaccagggtgcagttggagaccattattctaagtgaagtaactcaggaaaggaaacccaaacatcacatgttctcacttaaaggtgggagctaagctatgaggacgcaaaggcatgagaatgatacaatggattttggggacttggggggaagagagggaggggagtaagggataaaagactacacattgggtatagtgtacacta

SEQ ID NO: 41166 - DNA, 601 bp, Human
tttcaggttacaaaatcaatgtacacaaatcagtagcactgctatacagcaacagtgagccagcagagaatcaaatcaagaactcaaccccttttacaatagctgcaataaaataaaatacttaggaatatatctaaccaaggaggtgaaagatttctacaaggaaaactgcaaaacactgctgaaagaaatcatacacaaacaaatggaaacacctcccatgctcatggatgagtagaatcaatattgtgaaatgatcacactgccaaaagcaatctacaaattcaacataattcccatyaaaataccaccatcattcttcacagaaccacacacacacacaaatcttaaaattcatatggaaccaaaaaaagagcccacatagccaaagcaagactaagcaaaaagaacaaatctggaggcatcacattacctgacttcaaactatactataaggccacagtcaccaaaacagcatggcactggtataaaaataggcaaagagaccaatgtaacagaatagagaacccagaaataaacccaactacttatagccaactgatcttgaacaaagaaagcaaaacataaagcggggaaagga

SEQ ID NO: 41167 - DNA, 601 bp, Human
taggagttttcataggaaaagagagacacaaaggggaaaaagaacataagaagaaaccatggctgaaaacctcataagtttgatttagaaaaaacattaatttatgtacccaagaggctcaaaaagtctcaagcagaataaatacaaaaatattcaaatatatacacatcagagtgaaactgttgaaagcataaaaatagtcattctgactggtgtgaaattgtatctcattgtggtttcgatttgcatttctctaatgattagtgatgttgaccattttttcatatgcttggtaccatcytgtaccagtcagaatagctattattaaaaagtcaaaaagtaacagatgctggtgaggttgcagagaaaagggaatgcttacacactgctgttgggaatgcaaattagttcagccactgtggaaagcagtttggagatttctcaaagacctcagaactaccattcaatccagcaatcccattactaaatacgaacccgaaggaatatgaattgttcttcttaggttttgatgagaaggcgaggattaaagaaagactgagagagagttggcggctctacagcaatgcaggttttatgtcca

SEQ ID NO: 41168 - DNA, 601 bp, Human
tttgtccaaaaaaatcagtagtatttggttaatcttgcagctgccagaagcagcaattttagcaggggcaaacaagaggctggccaaaaaacttaaaaggaaaatttgagaaatgagatgtccttagggggctttgaaaatttctaaaatatttctggggatacagaaggtcatgtgcatgtgcagggctaagcaaacagccactaaagacctgacagagctccgctctctaacctttgcttgactctgaggctctgcacaaagcaggaagtgaaggctaaggcagagctgtgaactcccrgggcatggaaagcacgccccaacatacacagcacccgttggaaaatgatgggagacatactggtttaaagcatttaagaaaatctgtcaaattattatttgtgactcagctaatcaaacaaagacttcagtgtctatacaagatacagaataaagactacagaaatagtccaggaaggtcacaaacaacaacaaaaacaacaaaccccagggatagggaaagggaaggtctgattaccagtgttgtcacattataatatttaaaatataatgtttctgacaaaataattatgagacacac

SEQ ID NO: 41169 - DNA, 601 bp, Human
acttttgcagaactctaaaaaattaatcaaagatttgcaacaatcctgaacatctatttaagaaaagtagctgaatcttagtaaaaatggtgaagtttctggtgttttaacctactcattctcaatttccatgcacctcttcccagttccatagcagtcttggaaaccagcagcctcagaaccacagtaactgtgaatgccagcagcctagctacaaaagcagctctgggccaaaatctcatccccagagaactgtcactatgtgacctgtctggtgctcctagaaaagccctattcacargctaatctttacttcacctgactcaagagctcattcagcatgaaaagccctatgcccagggagtttgtccaaaaaaatcagtagtatttggttaatcttgcagctgccagaagcagcaattttagcaggggcaaacaagaggctggccaaaaaacttaaaaggaaaatttgagaaatgagatgtccttagggggctttgaaaatttctaaaatatttctggggatacagaaggtcatgtgcatgtgcagggctaagcaaacagccactaaagacctgacagagctccgctctctaacctt

SEQ ID NO: 41170 - DNA, 601 bp, Human
aaaggctatatatacacagagctagtgttcagaaaacattcttaatacctattctgtagacctatgaaacttaaagcaaaaacttaggaacataaaagccagccatcaaatataaaacaaacctgaaacagcaggtgccaactctcttgcagtgcagttaggaagatggatgatagctgaagcagcttcataaataaccatttcatgtttatttcgcaagcagctctcaatgaaatcaaacagtggactttcatggctgccaataaatatttataggccattatttagatatcaaatagasaggcaatatgcatagggattaaaagcacaggcagattgagaggcacttctggaatggtggatgagggatttctaaaaattcatttcatcacaaagcaattagaacactggcaaaattgtcaaaatcaacttttgcagaactctaaaaaattaatcaaagatttgcaacaatcctgaacatctatttaagaaaagtagctgaatcttagtaaaaatggtgaagtttctggtgttttaacctactcattctcaatttccatgcacctcttcccagttccatagcagtcttggaaaccagcag

SEQ ID NO: 41171 - DNA, 601 bp, Human; identical to SEQ ID NO: 36498

SEQ ID NO: 41172 - DNA, 601 bp, Human
actggattgacaaacagttcagtaacataatacaaagcccaaaaatatacctaaaatatatgggtatttgctttgtagacaaaggtgccaaagcactccaacagggaaaaggaagtctttccaacaaattatggtggaatacagtagatataggtatggaaaaaatactgaacttaccaaacaaacagtaattcaagttggatcattgcctaaaatgtaaaatctaaaaccataaagcatttagcctaaagcatgagaaaacaagtagataaaggtttcttagggaacagtaataactatraaagaaaaaaattgataaattagacttcataaaaatttaaaacttctgcttctcaaatgataccgttaagaaaataaataggcagccaacagactgggagaaaatatgatcatgtttaaactcttaccttgaactcatctgagatttcagacacaaaagaagatatctgcttcatgagccggtccacactgctctcacttcctgttttgaggagtgtagtaatggctaaggtagcaatgcttctgtttgagtctgtgattaagttttctaagtccagattgcaggcagtaacagcagagg

SEQ ID NO: 41173 - DNA, 601 bp, Human
tcctcccacctcagcctcccaagtaactgggattataggtgtgcaccaccatgtctgactaatttttgtatttttttgtagagacagggtctcactatgttgcccaggctggtcttgaactcctggactcaagcgatgcccctgccttggcctcccaaagtgctgggattaaaggtgtgagctaccacacctggctttaaatagaattttggggggcaactaactgtgtagtcaatggaaaaggataagattgaatctgtttatagcatatataataaaaaaattcaatggaccagagatmtaaatgtaaaatatgaaactataaatgtattagaagagaacatgagtgaattactctaaaatttgaagggaatataatttttaattatgaattcaaagtcaaataaaataaaaggttggcaaatatgactacctaaaaaaaataacacttttgcatgtccaaagacatcataagaaaagtcaaaagacaaatgacaaaccgggagaagatattcataacatctttcacagataaagagctaatatcctgaatatacaaaaaaattaaggaaacaaaagactaaaaatcctaaagaaaatg

SEQ ID NO: 41174 - DNA, 601 bp, Human
agatcccttccctctgtctcagacaaatgatcacatcaaagattttaaagtgaaccataaagataaaaagcttgaacagactgacttccatagaagaatagagaaagctatcaaggaactacttcacaaaatggtttctaggggaattttaccacaattttaaagaccagtgtcagccaggcacggtggctaatgcctgtaatcccagcactgtgggaggctaaggtgggtggatcaccaaaggtcaggagttcgagaccagcctgaccaatatggtgaaataccgtttctactaaaaaaatacaaatattagccaggtgtggtggcgtgggcctgcagtcccagctactcggagagcctgagacatgagaattggttgaacctgggaggcggaggttgcagtcagttgagatcgcaccactgcactccagcctgggtgacagagagagactctgtctcaaaaaataaataaaataaaataaaataaaaataaagaccagtgtcaagatgtgtgaagaacgtgagattttaccctgcttgtggctaacaagttaacctgtcacaatttcatggatgctggtagaaaacaagagactcctgg

SEQ ID NO: 41175 - DNA, 601 bp, Human; identical to SEQ ID NO: 36497

SEQ ID NO: 41176 - DNA, 601 bp, Human; identical to SEQ ID NO: 36496

SEQ ID NO: 41177 - DNA, 601 bp, Human; identical to SEQ ID NO: 36495

SEQ ID NO: 41178 - DNA, 601 bp, Human
aagtagagttccacccagggccagagggaacaatctgggattcagacacagcagtggtgccaacgtgaatctacctcgtgctagagtctgagtagcctagtctatcacccaacacagataagactggacaggggctcccaggaaccaacatctaagaagggagtttggagaggggctaaaagaaagcaggttaagccccaaatgtaactgaatgatgaccagggataactatttactagtgcttttatgatttattgtaactctgtaactttcccagtatttgttaattttttaacttctrtttctcctgtacttacgagcagtaaaagttgttcaaaacataaatgtgatgtgtgtgcttatttctgtgaaaactgggtaacagttacgaatattgtgcactgaacatgagaagagaagaaatcaaggaggaaaatgatgatggggggaatcaagtagaataaatacttgacattcaccttcccaagtctccaaataagtaaatactactattggcactagttggctgtcttttaggggctatttctccaccctgcaaagactgcatatgggtcaaggagggaattaaaagcccttctta

SEQ ID NO: 41179 - DNA, 601 bp, Human
gaagagctagtattctcaattggcaagggattgattcttcaatgggttcagcatttcacttccctctgaaattaagtggcaaagtaatagcatcccttaaaaaacaggacattggtgagaggtagaatagcaggaggaattttgaaacatggagggatggctactggaaaagaactgatgaagtgcagagtctctccagacaatggtagaaaccacaggactacattaagattgggcccaaatactagtttagaaaaaggtaaataaaactagctttacttaagagtacagccagcttaaytactggctagtggacatatttcagacaaatctaactggagagaaaaacagaccaggagagaaagcgaagttacaaggaaatggaactagagaaacctcacaaagggataaaggaggtaattaaaggttaaagccagatagcctcgagctcaaaggagaaatattggaggccagataggaaagtgccttcctactcagggggttatggatccagggtggctaaagaatagaagtagagttccacccagggccagagggaacaatctgggattcagacacagcagtggtgccaacgtgaatc

SEQ ID NO: 41180 - DNA, 601 bp, Human
ggcaagtcagtggtatgttcggtatcatggctgagtgtaggagcattttagggaatagaagttaaatcctagacgacaagcgagtggggtaacaacactttacctgtcatggtaactacttcattgaataggaaaacagaaaaagaagaaaccttatagagggtgatggtaaagcaaccccaactgatatggaaggcagtgttggcaatcactgaaggtcaggattttgaaagcaaacaattaacaatgtaaaatttgcaagtgtgggggttggacataggttactatgtgtttaatgtgrtctccaacaaaattagcagagccaaaatgagaaggaagtattactctgtttaacaagattgaaattaaggggacagtatacagtttaaaccactttgggatttaggaatgtcagagttggtagggtgggtattgttgccccttgatccacagtatggaataatggcaaagaggaaaactatatagaaagaacttgtcattagggaatttggtggcttccttaaagctccttgagggaaacacttgatgaatgcttagagtcaggagaataaacggtcccatatagagataggtttatgaa

SEQ ID NO: 41181 - DNA, 601 bp, Human
gagcaggttatggaggccagcagcttacagaggtgagcttgttgagaggatcagggaatgtactgcagcaagggaggcatgccaagagcaagagtgtgggtgtgaacgtagagaatcctcctttttgcccaaaaggggcgaagtgtttgatgcaggtcatggaggagaaagcatggtgtgggtaagacacggaaggaatgaaggagaggtgagatgaggccacagaaacagggtgtagaggtgttggcaccttggaaacattgaggaccgtgtgtcaataaagggcatggcgagacgatgraaggccagaggacacaacagagagaggaaaccactgttccttagaggcagaactgagaatacaggacggttaggggtgaactgagacagcagatggactcagtacagcaggttgaggacatggaagctggcagtggtgtcatcagtggggggcagggcaggaaggggtcagagttcaggaaagattcctgagtctgtggattgacttggaggtggcagggcatgcaggactggatgttgaagatgaaaaggagtttctggaagatgacagtgggaggcaacactgtgtgtagactgtgca

SEQ ID NO: 41182 - DNA, 601 bp, Human
caggtgggacagtaccgtgctatgcagtagaggaggaaagcaggagaaacgaccaacctgggcccaggagctgggagctgggagagcagagggtgagtttgcagcatatgggagagcaggacagaggagaggtgttccccaatgggcaagaagaatgagttggagcaggttatggaggccagcagcttacagaggtgagcttgttgagaggatcagggaatgtactgcagcaagggaggcatgccaagagcaagagtgtgggtgtgaacgtagagaatcctcctttttgcccaaaaggggygaagtgtttgatgcaggtcatggaggagaaagcatggtgtgggtaagacacggaaggaatgaaggagaggtgagatgaggccacagaaacagggtgtagaggtgttggcaccttggaaacattgaggaccgtgtgtcaataaagggcatggcgagacgatgaaaggccagaggacacaacagagagaggaaaccactgttccttagaggcagaactgagaatacaggacggttaggggtgaactgagacagcagatggactcagtacagcaggttgaggacatggaagctggcagtggtg

SEQ ID NO: 41183 - DNA, 601 bp, Human
actctggtgacaggaagaaggtaggagattcagaggcagaggctccccagagtgtttttccacagtgtgaaagaaaggatgagaaaagaatcaggaaggtttaggggagtcagggttgtggggccctggaaaggactcatagcctgggccactgggacgtgagcttggacagcagagcgtgtggattcagtgcagtacgtgtgacacagagaggactgcatctggtggagcagtgggtgcggggccaggtcaagaagggaggacacacctgagaacacgaattaggccagtggcagaatcrcaggtggtgctgagagaacgcagcatggtgcaggtgggacagtaccgtgctatgcagtagaggaggaaagcaggagaaacgaccaacctgggcccaggagctgggagctgggagagcagagggtgagtttgcagcatatgggagagcaggacagaggagaggtgttccccaatgggcaagaagaatgagttggagcaggttatggaggccagcagcttacagaggtgagcttgttgagaggatcagggaatgtactgcagcaagggaggcatgccaagagcaagagtgtgggtgtgaacg

SEQ ID NO: 41184 - DNA, 601 bp, Human
acggggagggaaggtgcaaagggaaatggagacagtgtggaaggagagcgtcttgaagacatgggccttaaggaggagggaggaggtgggaggagggtgggactgacaggagcacccaggaggagcagaggagctgggtctcaggcagggcaggagagtcaggttgagactgggtgcattcgtaccggggggacgaggatgggcagaaagtgggacacgaatgagtgacaaagacaaaactactctggtgacaggaagaaggtaggagattcagaggcagaggctccccagagtgtttttmcacagtgtgaaagaaaggatgagaaaagaatcaggaaggtttaggggagtcagggttgtggggccctggaaaggactcatagcctgggccactgggacgtgagcttggacagcagagcgtgtggattcagtgcagtacgtgtgacacagagaggactgcatctggtggagcagtgggtgcggggccaggtcaagaagggaggacacacctgagaacacgaattaggccagtggcagaatcacaggtggtgctgagagaacgcagcatggtgcaggtgggacagtaccgtgctatgcagta

SEQ ID NO: 41185 - DNA, 601 bp, Human
gcaggggatctgttgtcacggggagggaaggtgcaaagggaaatggagacagtgtggaaggagagcgtcttgaagacatgggccttaaggaggagggaggaggtgggaggagggtgggactgacaggagcacccaggaggagcagaggagctgggtctcaggcagggcaggagagtcaggttgagactgggtgcattcgtaccggggggacgaggatgggcagaaagtgggacacgaatgagtgacaaagacaaaactactctggtgacaggaagaaggtaggagattcagaggcagaggytccccagagtgtttttccacagtgtgaaagaaaggatgagaaaagaatcaggaaggtttaggggagtcagggttgtggggccctggaaaggactcatagcctgggccactgggacgtgagcttggacagcagagcgtgtggattcagtgcagtacgtgtgacacagagaggactgcatctggtggagcagtgggtgcggggccaggtcaagaagggaggacacacctgagaacacgaattaggccagtggcagaatcacaggtggtgctgagagaacgcagcatggtgcaggtgggacag

SEQ ID NO: 41186 - DNA, 601 bp, Human
gagcaggggatctgttgtcacggggagggaaggtgcaaagggaaatggagacagtgtggaaggagagcgtcttgaagacatgggccttaaggaggagggaggaggtgggaggagggtgggactgacaggagcacccaggaggagcagaggagctgggtctcaggcagggcaggagagtcaggttgagactgggtgcattcgtaccggggggacgaggatgggcagaaagtgggacacgaatgagtgacaaagacaaaactactctggtgacaggaagaaggtaggagattcagaggcagakgctccccagagtgtttttccacagtgtgaaagaaaggatgagaaaagaatcaggaaggtttaggggagtcagggttgtggggccctggaaaggactcatagcctgggccactgggacgtgagcttggacagcagagcgtgtggattcagtgcagtacgtgtgacacagagaggactgcatctggtggagcagtgggtgcggggccaggtcaagaagggaggacacacctgagaacacgaattaggccagtggcagaatcacaggtggtgctgagagaacgcagcatggtgcaggtgggac

SEQ ID NO: 41187 - DNA, 601 bp, Human
gagggctggggacatggacccccaggcaggcctatccaatcatcagaggggtgagcagtgttcagctcagaaaaagtaagggaaaaaaacaatctctaaaaggaacacagataatagcaaaagaagaaacccagcccaaaagatgcttctgataggcttcctcggggtcctgcatcctcgggtgagaatcactggtggacgcgggaggatggagagccggacagacatgtacaatgtgaggggaagatgcacgtgcagcggggctgatggaggcatcagggtcaagactgttaggtgtggraacacagttcccgacagaccaggacaaggatgacagcgagcaaatggatgtagccgaaaaggcaccgggaccatggtggtggagctgggatttccagcgcctcggtccgagactcgaggactcaggtggaggagtgaggccaagataggggcccagtgacacagaggaagtgggctgtgcgggtgagagcagagagcaggggatctgttgtcacggggagggaaggtgcaaagggaaatggagacagtgtggaaggagagcgtcttgaagacatgggccttaaggaggagggaggaggtg

SEQ ID NO: 41188 - DNA, 601 bp, Human
cacccgagggagggctggggacatggacccccaggcaggcctatccaatcatcagaggggtgagcagtgttcagctcagaaaaagtaagggaaaaaaacaatctctaaaaggaacacagataatagcaaaagaagaaacccagcccaaaagatgcttctgataggcttcctcggggtcctgcatcctcgggtgagaatcactggtggacgcgggaggatggagagccggacagacatgtacaatgtgaggggaagatgcacgtgcagcggggctgatggaggcatcagggtcaagactgtyaggtgtggaaacacagttcccgacagaccaggacaaggatgacagcgagcaaatggatgtagccgaaaaggcaccgggaccatggtggtggagctgggatttccagcgcctcggtccgagactcgaggactcaggtggaggagtgaggccaagataggggcccagtgacacagaggaagtgggctgtgcgggtgagagcagagagcaggggatctgttgtcacggggagggaaggtgcaaagggaaatggagacagtgtggaaggagagcgtcttgaagacatgggccttaaggaggagg

SEQ ID NO: 41189 - DNA, 601 bp, Human
aatgtagatctttaagagaaatccttttcaagagtcggagggcgagtgtggagtagagaaacgaggcatgggaagaatggggtggaaggatgccagaggaagaaaaggaaatgtgcagaagaaaaggaaatgtgcaaaagaaagtgcttccatgggaagactaccaggttagttagaatgcgaaaaacacaaaaaatgctaagtaagaagtataaaaagcacatgaaagaagtagtaaaaaaacgaacaaacaaaaacaggtataaaggggcattctggcccttcaaaacaatgatcttccacagtaaatgcaagcacaagaaggctccaggcttgggaggccaaggtgggtggatcgcttgaggtcaggagttcgagaccagcctggccaacatggcgaaaccctgtctctacttaaaaagaaaaaaatcagctgggcgtggtggtggatgcctgtaatcccagctacttgggaggctgaggcaggagaattgcttgaagtccagaggtgagggtgcagtgagccgagatcgcaccactgcactccagccttgggcgacagagtgaaactcttctctcaaaaaaaaaaaaaaaaaaaaaa

SEQ ID NO: 41190 - DNA, 601 bp, Human
acaacagaataaagggaaaaggcatttaaaatttaccttaggatgggaaaagtcatgcgaggatgacatactaaaaaataagatttgccactataatcgtatcatatggaacaaggaagaaaacaagtgatggacactaaataaaaagagcactgcatggatttggcaacatttcagagtaacttaagtaaacacagggcaaatcagcttcacaataaggaaacccagaaacaatgaggtcagaagaacaagagcataaattaagaaaagagttatatgattaaagatggaccaaagatayggaagggaaaaagggtgaggtagaaaagaagcaagtcagaagacaactatatgcatcagagtagaatattagaaaaaggcaaaaacaaaaaaggtggagaggcaccgtagattgagtagtatacttaaatgtgattccaaaaaggaggaaagaagttcagaaatgagtagaggaactgagctgagacaggggaaagggaaccaggaaatggaattgaagggtgcacatccacatctagaaagggctgctcactgcaccagaaagacagtggtaaacagattatagtggcacaggggcttc

SEQ ID NO: 41191 - DNA, 601 bp, Human
ttatttatattgaaaacattccattgttccttgcagtatagaaggcaaatgcaattatagtctttattatagtaggagaccattttgtattacacacaaacatgtctgctaatgaactgatgatatgttaaataattaggtcattatcctttaaaatggtgtatattatgaaaaatacttaaaagttttcttttatcatagtgttttagtgatgactgagaaaataggttgagtttttttaaagggagatggataagagctttttcaaatttaagataatgcaatgtaagtgtttgctacyaaaaattattattcaagcacacaggataatgaaaattgcttgtacttgaaaagtcgagtcaggaagaaaactgtgtaggcagttcttcaagggagaaagaaagggacaagataaaatgataactaaaaattggacataagagagacagtgtccaggaaagtacatttgcattaaaaagtgcaacggacagaaagattagcaacacattcagtgaagtggacataaaacaaggcaagtggcaggcatcctaccaaggaacaaacagagaactaaagcagttcagcacagtatgctggaaag

SEQ ID NO: 41192 - DNA, 601 bp, Human
tgagtaggtggaaaaacaataagacagatcaagtataaattaaagaaacagaactgtcagattgcagaagaaccgtatacagaatgagaaaagatcaggagtctgaaaaagaatagaagttggataggctggcacttgaagtcttagtgggaaatttatttcttaagtgactgcttgctagggaaggttagaaggagatgaattaagataaaccctgataagaagccattggtggaaaccttaaaaacatgaggattgacaggtatagatcgggattctttgtagaacaaatgaatgctaytggttgaggactggttgggaatcatgataaggttaacatccagagaataattcagcattcacttattatagagtcagtgggtaaatgatttgtagaatatttacgatatggcagggcagatattcaaagggagttacaaaaggacatagcagtaagtatgatgttaaattggccaagaagttaagaaataatgttaggattggctgaaagttaagcaactgagaagacctgtgtatataaaaaagaaaaaggaaaagggagaggagaagatgcttggttggaggaaaaaaatgtatgact

SEQ ID NO: 41193 - DNA, 601 bp, Human
aggctatacaggggaagcctccaaagggaaatctggaaaaatgttctgagagggacattaaggatgtactcagaaattaagaaaacatattaggacttgccaaaagtgagagaagcaactgaggagacttatatgcaaaaatcgcaaagaaggagagaacaaaagatggaggttggatgctaaatagggaaagagaacgtgtgaatgaggtagggggcagaacatgcagtgcagaaaaacaacagatatggaagggcattaaagagggctaaatgggaatattaggaaatgagagttgggratttgtcagagttgtgtattaacaaggagagagtaaggtaagaaggtggcaaagtaagagccagggcataaggttttgctgtcccaggaagctttgttggaaaaatgttagaagtaatgggtttggtcagtatggtgagaggtgagagaggctaaatgggatgggcataaagggcaggccagtggcaagaatcctatgaaagtgtaggcagatctgagagcacagacaaatacagtggagaatgtggcacagggcagagggcagtgggctgagcagcgagtgcccatggggaggggagta

SEQ ID NO: 41194 - DNA, 601 bp, Human
tacagatggtagatgaaattttactctatataattaagggagggcaaatcaccaaaggggagaaacaaatgaatatcatgtaagtgcggtattaaagttactcttagaagttactctgtcatgtgaagattttctacagatgagagacagacactagagagaatttggctaggaagtgccattcaggaggagacagagtccatctgaatgaaatatggacagcagctaaaagaagggaggctgaagataaggtagcgtacatctttagggcaagataggtaacaaggagaaaaggaatagragaaaacattaaagttgactccagatgaaaaggtcatttgaagaatggcaggactgactggagagacagtcccatatttgggccaaaagaaatgaagaggggttaaagctaaggggagcattaaataaactagataatgattctgaaaaggtggcgtggtaataagaaagaccacagcgccataaagatgcctggagaatcctgccagatctcagaatgggcccaactggccaaattcagtgggtgtaaggccagattgcagtgactagtatatgggagagaaggaaagacctgaatagg

SEQ ID NO: 41195 - DNA, 601 bp, Human
aacttctttgtttccaggtacagatggtagatgaaattttactctatataattaagggagggcaaatcaccaaaggggagaaacaaatgaatatcatgtaagtgcggtattaaagttactcttagaagttactctgtcatgtgaagattttctacagatgagagacagacactagagagaatttggctaggaagtgccattcaggaggagacagagtccatctgaatgaaatatggacagcagctaaaagaagggaggctgaagataaggtagcgtacatctttagggcaagataggtaayaaggagaaaaggaatagaagaaaacattaaagttgactccagatgaaaaggtcatttgaagaatggcaggactgactggagagacagtcccatatttgggccaaaagaaatgaagaggggttaaagctaaggggagcattaaataaactagataatgattctgaaaaggtggcgtggtaataagaaagaccacagcgccataaagatgcctggagaatcctgccagatctcagaatgggcccaactggccaaattcagtgggtgtaaggccagattgcagtgactagtatatgggagaga

SEQ ID NO: 41196 - DNA, 601 bp, Human
cttgtaaacccttaaaaaatgtgggtttattcagtcaaatgttggctcttaattgcagactttgaaaagcagtagatacaatggaagaagaacaagtgcttgaaaagtaatgcgaagcttttgtgagaagtttaatgagaaggattagaaggagatggattaagatgagccctaatagggcagcacttaaagacaccaggatagatctttgagtagtttgtagaatggatgactaatattggaagaggagtggctggagatcatgttggaaacccatctcaagggtgaaacttctttgttkccaggtacagatggtagatgaaattttactctatataattaagggagggcaaatcaccaaaggggagaaacaaatgaatatcatgtaagtgcggtattaaagttactcttagaagttactctgtcatgtgaagattttctacagatgagagacagacactagagagaatttggctaggaagtgccattcaggaggagacagagtccatctgaatgaaatatggacagcagctaaaagaagggaggctgaagataaggtagcgtacatctttagggcaagataggtaacaaggagaaaagg

SEQ ID NO: 41197 - DNA, 601 bp, Human
ccagaatgggaaatcttgtaaacccttaaaaaatgtgggtttattcagtcaaatgttggctcttaattgcagactttgaaaagcagtagatacaatggaagaagaacaagtgcttgaaaagtaatgcgaagcttttgtgagaagtttaatgagaaggattagaaggagatggattaagatgagccctaatagggcagcacttaaagacaccaggatagatctttgagtagtttgtagaatggatgactaatattggaagaggagtggctggagatcatgttggaaacccatctcaagggtraaacttctttgtttccaggtacagatggtagatgaaattttactctatataattaagggagggcaaatcaccaaaggggagaaacaaatgaatatcatgtaagtgcggtattaaagttactcttagaagttactctgtcatgtgaagattttctacagatgagagacagacactagagagaatttggctaggaagtgccattcaggaggagacagagtccatctgaatgaaatatggacagcagctaaaagaagggaggctgaagataaggtagcgtacatctttagggcaagataggta

SEQ ID NO: 41198 - DNA, 601 bp, Human
atcaggaaagaatgccctgaagatctgcattaaaactgttctctgaaattaagcttgtcttgtgaggattcactgaaaatgagagtcaaccactaaggagatttgtatgaaaagaacccagcgaattagagaaaagatagatgctggcagctaagacaggagagggacatgtgagttgggccagggtacagaaaatgcagtgtggcaaagggcagagtgggaaaggtgggagggagctgccaggtctcaaccacctgggggagaccatgacaaagtaagagacacttatgaggtatttccrgaaagctttgttagaataataattaaagaaaagggtatgtcactagggcaaaagattagaaagaaggcaaaagagatggatctgtacaggctaactgcagcagtctatgcaggtctggactgaactgagaagcaatgggtgcagcatagtgtgtaggacatcgaggaaagctgggcagtgagtgccaaaataagcaatacacacctacctggaaaatcgtgttgagtctgtgggaatgctgtacaaatggtgggagggagtttttctctaggacaaattcagaaagggaaggaggaatgg

SEQ ID NO: 41199 - DNA, 601 bp, Human
cagcctaaagtgagtaggtcagtaatgagtttctactattggtaaagtcagtgtcttaaatggaaaagcaagtgggcagttgtatgttttcacacaagtggtgttaagtaataagaaatggaggtgggggtacatttttggaaagtgaagtctttataaaaagtaaagacagtattttctgaaatgtttgaaggaggggatttagcaagcagggatgaagaaaaggcatttaggatcttgtctatggtctggaaaaagcttataggtacaaaaaatattagatattgggagagttaaaaarttatttgggggataggcaaggagaggaaagaacaggctcagatgtgaagaccatatacgacagattgggtaataagactttcatctgctcagtcttgactttaaattccatccattcatccatccacacatgtagtgactgtcaatacatgttgacattacacgtaaaggtataagcttatgtgccagacacttggataaaaagatgactgagacatgatctctgtctctaggagctgtctaggagttaaataagtgtgtgggctgtgtgtgtgtgtgatctatctatgactttacaact

SEQ ID NO: 41200 - DNA, 601 bp, Human
tgaagaaagcagcagagaggtacttttgggggctttttgccatgcctatcaaaggggcctaaatgttgaaaaataaatattttgagaaccactgctgtaggacctgaccaaaaaaaaaaacaaaaaaaaaacctgtggtaaagagcatacagatcatcagattaacattgaccaatctcatcagcatctcaatactatctttagattgtggactgatggcgggtccacagatcaccagagagaacttgctttatctgtcaaccttcagcctaaagtgagtaggtcagtaatgagtttctastattggtaaagtcagtgtcttaaatggaaaagcaagtgggcagttgtatgttttcacacaagtggtgttaagtaataagaaatggaggtgggggtacatttttggaaagtgaagtctttataaaaagtaaagacagtattttctgaaatgtttgaaggaggggatttagcaagcagggatgaagaaaaggcatttaggatcttgtctatggtctggaaaaagcttataggtacaaaaaatattagatattgggagagttaaaaaattatttgggggataggcaaggagaggaaagaacag

SEQ ID NO: 41201 - DNA, 601 bp, Human; identical to SEQ ID NO: 36494

SEQ ID NO: 41202 - DNA, 601 bp, Human; identical to SEQ ID NO: 36493

SEQ ID NO: 41203 - DNA, 601 bp, Human; identical to SEQ ID NO: 22997

SEQ ID NO: 41204 - DNA, 601 bp, Human; identical to SEQ ID NO: 22998

SEQ ID NO: 41205 - DNA, 601 bp, Human; identical to SEQ ID NO: 22999

SEQ ID NO: 41206 - DNA, 601 bp, Human; identical to SEQ ID NO: 23000

SEQ ID NO: 41207 - DNA, 601 bp, Human
tactccccacaaagggacactcacaaattgcactccaacaagaatgagattatcctctaaagtactgcgttaaagtgaggatcagggagaaatgaaataactctgagagacacttcctcctatacagaagcaagcaagaaactgagaaatgaagtccttccgaacagaaggggctgagaaaactcataacacattagccttcactcttaaagctttcagtcaccaaagaaatgcttgattccgaaatcgtttttgttttttttacagataagcctcaaaaacgattcttctggcacccatyaaaaaaaagcaaataaaagctgcacaacttttcactaaaagataatgcttatgcaagaaatcttagtcatgacgagaggatgcttcctttgtaaaacatccaatttcatgttcctaaaatacaacataaaaacttcacgtcttggtttttttgtttgtttaattttaacaaataccaatctccttctaaaccttcaaaatttcaaacctgtgtctgcccagggaaggcaggcatcagctcctccacaggcagtttccttccctccctttcctctaagcggggaatctcattcctagtttt

SEQ ID NO: 41208 - DNA, 601 bp, Human
ttgctactccactgccgattcgaatgtattaaaaagtagggtactggccaggcgcggtggctcacgcctgttaatcccagtactttgggaggccgagatgggcggatcacctgaggtcaggagtttgagaccagcctggccaacatggtaaaaccccatctctactaaaaacacaaaaagttagccgggcgtggtggcacgcgcctgtaatcctagctactcaggaggctgaggcaggagaatcacttgaaccctggaggcggagatggcagtgagcccagatcgtgccactgcactgccrcctgggttaacaagagggaaactccgtctcaaaaaaaaaaaaaaaaaaaagtggggtacttcggtataatgcagtatttggtagagctagtggaacttctccagaacattccaagtcttcacaggacaagaaaaaaaccagatcaccacccctccactttaaagtgccttaccttataccataatgacaaaaaagtgaggtaatatttaaattaattgaaagtgaaggagtaacattccaccttcttctgttgattgacttacagggatgaggtaggaagagcggtggattctactcctc

SEQ ID NO: 41209 - DNA, 601 bp, Human
tcaataatatgaaaaagcctgcgttgccagtcctaaattaacttcctacagccattttttacatagctcagtacctgaaatatacttagaaattgtctcttctctatggcatgtttcttatactctgctagaaccagacctgagaaagtatcatctgaaagtgtgtgagcatccatcaacggctcaaaacattaatgacattggaaaagtatatgtcggattctcacaagttgctactccactgccgattcgaatgtattaaaaagtagggtactggccaggcgcggtggctcacgcctgttaatcccagtactttgggaggccgagatgggcggatcacctgaggtcaggagtttgagaccagcctggccaacatggtaaaaccccatctctactaaaaacacaaaaagttagccgggcgtggtggcacgcgcctgtaatcctagctactcaggaggctgaggcaggagaatcacttgaaccctggaggcggagatggcagtgagcccagatcgtgccactgcactgccacctgggttaacaagagggaaactccgtctcaaaaaaaaaaaaaaaaaaaagtggggtacttcggtataat

SEQ ID NO: 41210 - DNA, 601 bp, Human
tgctaccacctcgtctgtgaacagctgctgcactccagcctgggcaacacagcaagattccatctcttaaaacaaaacaaaaacatgctctagtcacacttgtgtagagccagattaacagtatgaataagcccctcattatcataccctcaataaattctcacataatgatgctacaaaggtcgtgaactagttatttctaagctttagaaactatgacagttgaagtaacacaacaaaaatactcatctacaacacgctgcttgtagctccaattcctgcctaaaacctatcttgactyaaatacagtcagtgtcacatcaagaactgattctgataaagttagtgttttccaagatctagtgtcctgcctgtgggaataccttaggaagtaatgtaccatacaaagctacagtacaatcaacataatcaccaatatttaacacctagtcattaaatgtgtgcattactcacaacttccactaagtttaatgaagattcacaatatactccaagaacataccaacatacagctttaagtcagtaaaatatcacacaaagttctgtgatacatgcaatcaaaaggtaggtattaaaagaa

SEQ ID NO: 41211 - DNA, 601 bp, Human
aacctaagtgctctaagtcagaagatggcaaagagtgagccaactcaagatttgctttttactcgatattctctcttactcgattttttctcttaaagactccagactgtctttaagttaaaaacaagtctaatatggcataacgtattactttaaagaatgtataaaaatcaggctgggcgcagtggctcacgtctgtaatcccagaactatgggaggccgaggcgggcggatcataaggtcaggagatcaagacaatcctggctaacacaatgaaaccccatctctactaaaaataccaaaaaaaaaaaaaaaaattagccaggcgtggtggcgggcgcctgtagtcccagctactcaggaggctgaggcaggaaaatggcgtgaacccgggaggcggagcttgcagtgagcctagatcgcgccactgcactccagcctgggcgacagagcgagactccgtctcaaaaaataaataaataaataaataaaaataaaaataaaaataaaaatcaacgtaagagctcagtattccaaatgtccagtaaaactctatcttacaactacaacttaactccatctatagctactcaactcttaa

SEQ ID NO: 41212 - DNA, 601 bp, Human
atttgggatgttcaacctagagttgttactttaaaaagcaggggccagaaaaaaacaaaacaaaaaaaagtaggggccggccaggcacagtggctcatgcctataatcctggcattttgggaggccaaggcaggtggatcacctgaggtcaggagttcgagaccagcgtggccaacatggtgaaacccccgtctctactaaaaatacaaaaaattagccaggcgtggtggcgtgcggctgtaatcccagctactcgggaggctgatgcaggagaactgcttgaaccttggagacggaggtygcagtgagctgagatcatgccattgcactgtagcctgggcaacaagagtgaaactcagtctcaaaaaaaaaaaaaaaaactgcatagtggcagtttatgaggcccaggcacgaacatcgctcaagcccaggagttcaagagcagcctgggcaacatagcaaaaccccatctctattaaaaaaaaattagttgaatgtggtggcacaggcctgtagttccagctactcagggatctgaggtgggaggatcacttgagcccaggaggtggaggttgcagtgagctgtgatggagagcaacag

SEQ ID NO: 41213 - DNA, 601 bp, Human
aggttgaggatcccttatccaaaatgcttagaaccgggagtattttggattttgaatttctttcagattttggagtatttgcattatacttactagttcagcatcccaaatccaaatatccaaaatgctccaatgagctcttcctttgacgatcatgttggggctcaaaaactttcagattttggagcatttctgatttatggatttgggatgttcaacctagagttgttactttaaaaagcaggggccagaaaaaaacaaaacaaaaaaaagtaggggccggccaggcacagtggctcaygcctataatcctggcattttgggaggccaaggcaggtggatcacctgaggtcaggagttcgagaccagcgtggccaacatggtgaaacccccgtctctactaaaaatacaaaaaattagccaggcgtggtggcgtgcggctgtaatcccagctactcgggaggctgatgcaggagaactgcttgaaccttggagacggaggtcgcagtgagctgagatcatgccattgcactgtagcctgggcaacaagagtgaaactcagtctcaaaaaaaaaaaaaaaaactgcatagtggcagttta

SEQ ID NO: 41214 - DNA, 601 bp, Human
gagacgagggaaagaaaaacatcaagttggtagtgtaaatatggcaactttccacacaaaaccaactggaattcaccatcagccagccacttccaaattcaaacggcaagtaactaatttacttttaagcacagcaacagatgctatgtaagaaaatcaactgacataagtagaaagttagtgaacaatacctgtatattccaagtgacacattttatagtggttgaaataaaagtatttaaacagtttcctctacaatactatctaacaaataaacaaatattctaatttttgttttttrgaaacaaggctggcctgtatctcctgagctcaagagatcctcctaccttagcctcctgaatagctgggattacagacttacactgcagcatctagctcatttttatctatttatgtatttatttttgacacagggtctcactctgtcacccaggctgaagtgcagtggtgggatcatggctcactgtagccttgacctcctggggtcaagcaatcctgggcctcagcctcctgagtagctaggactacaggtgcacaccaccatgcccacctacattttttatctttgcagagtcagggt

SEQ ID NO: 41215 - DNA, 601 bp, Human
gtgagggagacgagggaaagaaaaacatcaagttggtagtgtaaatatggcaactttccacacaaaaccaactggaattcaccatcagccagccacttccaaattcaaacggcaagtaactaatttacttttaagcacagcaacagatgctatgtaagaaaatcaactgacataagtagaaagttagtgaacaatacctgtatattccaagtgacacattttatagtggttgaaataaaagtatttaaacagtttcctctacaatactatctaacaaataaacaaatattctaatttttgttttttggaaacaaggctggcctgtatctcctgagctcaagagatcctcctaccttagcctcctgaatagctgggattacagacttacactgcagcatctagctcatttttatctatttatgtatttatttttgacacagggtctcactctgtcacccaggctgaagtgcagtggtgggatcatggctcactgtagccttgacctcctggggtcaagcaatcctgggcctcagcctcctgagtagctaggactacaggtgcacaccaccatgcccacctacattttttatctttgcagagt

SEQ ID NO: 41216 - DNA, 601 bp, Human
ggccaacagagtgagaacctgcctctataaaaaactaaaataattagctgggtgaggtggcatgcacctatagttccagctacgtaagaggctgaggcaagaggctggcttgatcccaggagctatgtgcataccactgcactccaccctgggcaacagagcgaaactgtgcctcttaaaaaaaaggaaaccaggaagcgttaacatgttggaaacgtgacttgaacaccagagctgttgcaaaaggacagcaatgatttaacacttttcacttattaaactagcaaaaaaaaaaaaaaawttaattatcatacccggttgggtgcagtggttcacgcctgtaatcccagcactttgggaggccgaaatgagcaggtcgcttgaggtcaggagttcgagaccagcctggctaacatggtgaaaccccatctctactaaaaacacaaaaattagccaggcgtggtggtgagcgcctgtagacccagctactcaggaggctgaggcacgagaatcacttgaacccaggagatagaggttacagtgggccgaaatcgtgcccctgcattccagcctgggcaacagagtgagactccatctcaaa

SEQ ID NO: 41217 - DNA, 601 bp, Human
acctcttttaagacttaacttttgggcagggcgcggtggctcacgcctgtattcccagcactttgggaggccgaggcgggtggatcacgaggtcaggagatcaagaccatcctggctaacacgatgaaaccccatctctactaaaaatataaaaaattagccggccatggtggctggtgcctatcgtcccagctacttgggaggctgaggcaggagaatggcatgaacccaggaagcggagcttacagtgagccgagatcgcaccactgcactccagcctgggcgacagagcgagattccrtctcaaaaaaaaaaaaaaagacttaacttttggctgggcgtggtggctcacacctgtaatcctagcactttgggaggccaaggcgggcagatcacctgaggtcaggagttcaaggccagcctggccaacatggcgaaaccctgtctctactcaaaatacaagaattagccgggcgtggtggcacatgcctgtaatcccagctactcgggaggctgaggcaggagaatcacttgaacacgggaagcgaaggttgcagtgagccaagatcacaccattgcactccagcctgggcaacagaga

SEQ ID NO: 41218 - DNA, 601 bp, Human
aattatcaaaaaaggatgaaaaagacaaaggacagaccagtacaacaaagtgttgcaattattacaatactaaaacattctcagtgatgaatgtggttctaaaatttggttcaaggccaagagtgatggcacatgcctgcagtcccagctactcagaaggctgaggtgggcggacggcttaagccagggagtccaaggctacatacagtgagctatgactgcaccactgcactctagactctgtgacagaacaaaaccctgtctctaaacaaataaataaaaataaaatttagtccttatrataattgatgggaggccaaggtgggtggatcatctgaagtcaggagtttgagaccagcctggccaaaatggtgaaaccctgtctctaccaaaaatacaaaaaactagccgggcgtggtggtgcacacctgtagtcccagctactcagaaggctgaggtgggagaatcacttgaacacgggagaatgaggttgcagtgagccaagattgcgcactgcactccagccttggcgacagagtgagactccatctcaaaaaaacaaaaccaagaaaacacacaagtattaacgtaaagtattaat

SEQ ID NO: 41219 - DNA, 601 bp, Human
cctcttctctcttgccagcctgtctcttttgagacttaaatacaaaggaagatactctctttctcagcccccgctgcagctctgggtggttatgtaagccaaggtctagccaataacatgtaaagataaagggtggagctttctattttatgcttcaagaaagatttttccagatatgcttctggaaagattttcttagcctgctttgataagtattccctcactctgaatacagtcacattttttcacaactcaggggacagcaaagctaaggaccagaactcaacacactgagaagaasagaacagaaagacagagaaagtctaggtcttgacaatagtattcagcctctataccaaacttggaactatctaagacttactacatgagataatcacgtctgtcttgtttaagccagtactactaaagtgttgtacctcatgtaacagcatcactaccaccctgcagactgttagaactgaaaaatgttaggtctatcctagaccttctgaactctcaaggaatgggctgaagaacagttcaagcatgatggagaagcaaattaaacatttgtcctgagagggaaaaaaaaaaaacagtt

SEQ ID NO: 41220 - DNA, 601 bp, Human
tccttcttctgatggtcctgagcaatctgactggagttctctttgtcacttgatggagaatcacaggcaccatcagatttcttctcagtggcctcttcatccactttctccaaaggatgaatcttcacaatcttcaccttgagcattttctccttcccaacctataaaggaggtagtagagaaaatcagagataataaacacccagaaacctgaagatgtttagaacatatcatccaatatacatgcctcctcaactaacaaaaggtgattgaaacagtaaagtatccaagtacaatgaastgttttcaactttttttctcagacttctaggttgaaatatgacagcctaaaaaaatgaaataaatgatcacaatctaggttcatgattcatgtaaaatgccaatatacaaggccaaagggcaatcactgtaccagcctaaaatatgtgaatacagttcaagaatttacatttttgtatgtatttacttattattattttttttttgagacacagtctctctctgtcacccaggctgaagtgcagtggtatgatctcggctcactgcaacctccgcttcctgggttcaagccattctaacc

SEQ ID NO: 41221 - DNA, 601 bp, Human
ggcacccaccaccacaagccgctaatttttgtatttttagtagagacagggtttcaccatgttgaccaggctggtctcgaactcttgacctcagatgatccaccctcctcagcctcccaaagtgctgggattacaggcatgagccacggcacccagccctgcatagagctttctaagcaactagaggaaacgacttcccaatggtcttaattatttagggatattcaagtgtttcatgttgtggacattttagttgttctatgaatcataaatgaacaaaatcatgtctacataaaaaatmacacatttagttgctagagaaccctaaaagatgtgttcataataaaataaacaggatctcataaaacactaaggaaagctaatatcaaacatactaatactctctctccttccttcatcctctttcacaactgtctccttcttctgatggtcctgagcaatctgactggagttctctttgtcacttgatggagaatcacaggcaccatcagatttcttctcagtggcctcttcatccactttctccaaaggatgaatcttcacaatcttcaccttgagcattttctccttcccaacctat

SEQ ID NO: 41222 - DNA, 601 bp, Human
agcctgggtgacagagcaagaccttatctatgaaaagccaaaaaaggacactaggacaattagcactttactagagagatgaactagcatcacataaaatgactgaggtcacttcaacagcaacaggaggtcattaggaaatgattacagtagtatagtacgtactacagttcattttattgttattatttaatactgaatcttcatatttttcttgactgagaatggtgccaggtatggtctgtgtaagttttgataaattttaactttttataatagatttctgtatatattttatggyagcaaatgatagactagtatctacatgtattttatgcatttatgacatacctaactctttgttctttttttacaatatttctaggttactcagttcgtctctgagtttcttcaaactgtcacaagcctccaaagaattttccaatacattcattgaaaaaatattgagagatgggttaagtgccataaaaaaaagaaaaagttccattcatatgtggacctgtacagttcaaacctatgttgttcaagggtgagctgtacctaaaaccatcacattggcttataatgtgaagatcagggt

SEQ ID NO: 41223 - DNA, 601 bp, Human
tgaatctaaactgcataaaggaggggccaggcgtggtgactcacgcctgtaattccagcactttgggaggccaaggtgggcagatcacctgaggtccagagttcgagaccagcctggccagcatggtgaaaccccgtctctactaaaaatacaaaattagctggttgtggtagcgtgctcccatagtcccagttactggggaggctgaagcaggagaatcacttgaacccatgaggcgaaggttgcagtgagccaagatcgtgccactgcgctccagcctgggtgacagagcgagactccrtctcaaaaataaataaataaataaataaattgcatataggacaggcaagtaaagatcaagtctacagttaaaagtctgacccaggcttggaaatcaccaggctacaaacagttaagaattcaaactgtgccatgaatagcatataacattacactatgcaaactgaaaaacagaaggcaaagaatagaatcctatggaaaaagtcaaaggaatggcagggaaggaaggaagtaaagaaaccgaatagctggagcactaggagacagtggtatcaagctaagagatatgagtgaccaacag

SEQ ID NO: 41224 - DNA, 601 bp, Human
tgttaaaggtattttaacttttctgccttagacactaggtggatggacggtgagccaagtaaaagaatgagagaacaattcttgtttacctgccttgggatacaagaagagtgaagtcaattcagctttacacatgttgaatctaaactgcataaaggaggggccaggcgtggtgactcacgcctgtaattccagcactttgggaggccaaggtgggcagatcacctgaggtccagagttcgagaccagcctggccagcatggtgaaaccccgtctctactaaaaatacaaaattagctgsttgtggtagcgtgctcccatagtcccagttactggggaggctgaagcaggagaatcacttgaacccatgaggcgaaggttgcagtgagccaagatcgtgccactgcgctccagcctgggtgacagagcgagactccgtctcaaaaataaataaataaataaataaattgcatataggacaggcaagtaaagatcaagtctacagttaaaagtctgacccaggcttggaaatcaccaggctacaaacagttaagaattcaaactgtgccatgaatagcatataacattacactatgcaaac

SEQ ID NO: 41225 - DNA, 601 bp, Human
tggcagtagaggttaggaatcaacatatctaatcacctcccctggtgactatcacacacattaaaatctgagaacactgttttggaagaaaatttaatgacattacagatgtttagcacacaataaatgaaaaaattaagttataaaataatataaacagaatagttctacttttaaaagtcacttaatagcaggaaacagagaaggaaggaatacaaaaaaattttttttaaaaagtcacttaggagctacctaccattcactaaatctatattcaccaattatctctgagcatgacatyagatactatctctttcttatttgcattttctttcttcctgtaaccaatacttatatttgtgaacaaaatacttatactcatcaatatgaatacaagggatacttagggaagtggttaaaactaagcatttttttttttttttgagatggagtttcactcttgttgcccaggctggagagcaatggcgcaatctctgctcactgcaacctccgcctccctggttcaagctattctcctgcctcagcctccctagtagctgggattacaggcatgtgccaccacgcccggctaattttgtat

SEQ ID NO: 41226 - DNA, 601 bp, Human
cttttaaagtacttctgttctaacccctaactcacaaacttttttttttcctccacccaaaacagggtctcactctgtctgtcacacaggctggagtgcagtggcatgatcacagctcactgcaaccttgacctcctgggctcaagggatcaccctgcctccatctccaaagtagcttggactagaggcacacgccaccacacccagttaattttttgtgtatgtagaaacagggtctcgccatgttacccaggctggtctcaaactcatgggctcaagcaatcctcccacctcagccccycaaactgctgaaattacaagcaagagccactacgcccagccatacacaacaaacaaactttaagagcgagactttaaagaaaaatcaggccgggtgtggtggctcatgcctgtaatcccagcactttgggaggccgaggctggtggatcacaaggtccagggattgagaccatcctggccaacatggtgaaaccccatgtctaccaaaaatagaaaaattagccaggcatggtggtgggtgcctgtagtcccagctactcgggaggctgaggcaggagaatcgctggagcccaggaggca

SEQ ID NO: 41227 - DNA, 601 bp, Human
ttaaagtcatcctaaaatgaaatttatcgctaaaaaggagactaagtttcatttttagcattttaaataggtatgttttaatagggtctgttacaataactgggacacttctttatttactgattatagttctattttaaaagaaaaatcactcacattttacatgaggttctttaaacttcttccacttagaagcatagtagtatgaagaaatgatacaagaaaatggtgggatggcttagccatgagggtctagcaacccatttttattcgtaaggtgtgtttttgtgccaagccacamcatgtttttgtttgtttttttcttaaaaatgaaagaaatgaactcacccaaccccctcccaataggccggctccccacgtgagcagtccttcagtaactggatcatctcagcatggggcatgctgggcagtcacagccaaatgggagccggcatggctggactcagggggatctgaaaaagtataaaaccacttatgtgctaacagtgctccctatcccccactcagcacagttaatctaccagactagcagatggggagggagaagaaaggacacctggattaccagcagtataatttt

SEQ ID NO: 41228 - DNA, 601 bp, Human
ggtggcgggcgcctgtagtcccagttactcgggaagctgaggcaggagaatggcgtgaacccgggaggcggagctcgcagtgagccgagatcccgccactgcactctggcctgggagaaagagcgagactctgtctcaaaaaaacaaacaaacaaacaaaaagaaactggaatgtgttgttccccaatctccaataaccatccttagaatgggctgacaaagaggctttatagctttacaacatataaaccctatccatgactccgggattactttccctagatgcagaatttcctcattctagtttcccagaactgtatttcaaaatgctaggaagaataagccaagataacttatttaagactccaatctcttcatgcacagtaattactatcagtactccaaagagaatatggcagagaccatccaaattgcagagcaagacccattactaccctggcaggaaataagaacaaatgtgtgcccccaaaaagttaacaaccttcttcagtcagccttggaaaatcttcagagtacacacatacaggcggacattttttctaatgctcagaacaacagattatatatttaaagtcatcct

SEQ ID NO: 41229 - DNA, 601 bp, Human
gggtggctcacgcctgtaatcccagcactttggaaggctgaggcgggcagatcacgaggtcaagagatcgagaccatcctggctaacacagtgaaacaccatctctactaaaaatacaaaaaaaattagcctggcgcggtggcgggcgcctgtagtcccagttactcgggaagctgaggcaggagaatggcgtgaacccgggaggcggagctcgcagtgagccgagatcccgccactgcactctggcctgggagaaagagcgagactctgtctcaaaaaaacaaacaaacaaacaaaaagmaactggaatgtgttgttccccaatctccaataaccatccttagaatgggctgacaaagaggctttatagctttacaacatataaaccctatccatgactccgggattactttccctagatgcagaatttcctcattctagtttcccagaactgtatttcaaaatgctaggaagaataagccaagataacttatttaagactccaatctcttcatgcacagtaattactatcagtactccaaagagaatatggcagagaccatccaaattgcagagcaagacccattactaccctggcagg

SEQ ID NO: 41230 - DNA, 601 bp, Human
atccagacttaatactagacatttttgctatgtaactagttctgtttatgtatattaatgattcttaaatatttaaacaaaatctgtgaacccctccagcagaaatagtagacaaaaactatgcatacaatttcagagaatccatccatggaccccagattaaggatatctgatctacaaaatggcaatatctgaaaagtttaaaaagcactgttcttgaaacaagactgaattttcatcctttcactgttggttcctattcagggcattttatgcttttaagtagaaatgatactgtttraagtacttttgtcttaactctgaggtacattttcttatagaagcatcagtgagtgtaagaacaacatgaacactgctcatagataaagacacctcctgacctgggcctcaaactcccctttgtcctcacccaacacttttaagaactcattctggccaggcgcagtggctcacccctgcaatcccagaactttgggaggccgaggcaggcagatcacttgaggtcaggagttggagaccagcctggccaacatggtgaaaccccgtctctactaaaaatgcaaaaattagccaggcatgg

SEQ ID NO: 41231 - DNA, 601 bp, Human
ttccttccacaactctgcagacatctgctgtctggtctccatgtggtcttgcactgagtatgtcatgaggatccggtggcacagtgctgtcaagatctgtagcttctcctctgacgtcagctcaaaaaattcagaggtctccagcttttctaggaactcatcttgtacctcattatcctcaaatgcagctgaatctttattgtcatctgtgtctgagccctcgctttcctcctgaacatcagatctgcgcaagcagagccgcaccagctctgaaacagaatgcagagtcaaggggatttcygacagcttcattcccaattcaccatagtcttctgctatctcatcttgtaggagggtctgtaagaggatgaccaacaccctgttaaggtataaaaagccacccttatctgcactcaaggcttccataagggacacagcagtaataggatactgagcatctggtaaaagtagcccagaataacagctcaagaattccaccaccatggccacatccccaaacagcgtgttgggcagcccttcaggggtatccaccaatctgaatgctggaaggtttttgccagttaactcttggtcctcatac

SEQ ID NO: 41232 - DNA, 601 bp, Human
ggcatggtggctggcccggcatggtggctggccgggcacagtggctcacgcctgtaatcccagcactttgggagactgaggcgggtggatcaggagttcgaaaccagcctggccaacacggtgaaaccccatctctacaaaaacacaaaaattggccaggcatgatggcgcatgcctgtaatcccagctactcgggaggctgaggcaggagaatcgcttgaatccagaaggcggaggttgcagtgagccaagatcaaaccattgcactctagcctgggtgacagagcgagactccatctcaaaaaaaaaaaaaaaaaaatgttttagaactaaatagaggtggtctattttgtgactggcttctttcacttagcataatgttttcaagattcattcatgttgtagcatgtaaaacattatgctaagtgaaagtcacaacagactatttattatacaattccatttagagaaaatgcctagaatagcaaatctatagagacaaagtagactagtggttgctcagggctggggaggatgggcgaatggggtaatgacagttcatgggtagcaggtttctttgagatgataaaaatgttacaaa

SEQ ID NO: 41233 - DNA, 601 bp, Human
ctgacttcttttgcttagcatgttttctaggttcattcatgttgtagcacagaacagtacttcatttctttttgtggctaaataatattccactatttgaatatactaaattttgggggttttttgtttcattttgtatgagacagcatctcgctctctcacccaggccagagtgcaggggcatgatcttggctcaatgcaacctccgcctcctgggctcaagtgatcaactcagctcagcctcccaagtagctaagactacatacacaaaccaccacacccaagataatttttgttttgtttttttttttcagaaacggagtttccctatgttgcccaggctggtctcaaaactcctggatgcaagacactggcctgcctttacctctcaaagtgccgggattacaggtgtgagccaccgcacaaggcctggatatatactaacttttatttatccgttccatcagttgatagtcattgccgttgtttccaccttttggctcttctgaatattgatagaatacttctggacacccacccatctgggcctccatctgcaaagctgtctgacaaccatgaggctcacagcttggtgctggca

SEQ ID NO: 41234 - DNA, 601 bp, Human
ctttcttaatttgcctagacacatctgtattcagacaacacaattctgaatacagttttacttaatttacacattaagcagtgggctaacatcaatataatgtacctattgtccttcgcaaaagtctggcaatggtgtagagtatgtactgaatcatattttccttctctcttccatcaaacctaaattcaaccgtgaaattgagcacagagtcagcaatgagaggaggcattaagccaaaatcttgtcctggctttgatagaaataatgtctacaacaaatatggcagtcgcaaatttgrtgctactttgtagacagaacagggttttttgattctttttaattcatatgacatgaaattcaccaacttgaagcatgtacttcagttttttgttgtagaaccacacatgtaattccaaaacattttcatcaccccaagcaggaatctcttacctgttagcaatcatcactcctattctccccttcccctatcctctggcaaccactaatccactttctgtttgaaatagatttgcctattctaagatgtttcatttgaatggaatcatacaccacatggcctttgatgtctgacttcttt

SEQ ID NO: 41235 - DNA, 601 bp, Human
attaggaaaaatggcatgggggaatgcaaatgaaactgttcataaaaatcacaaaactataagagcacatatgttggctgggtgaggtggctcatgcctataatcctagcattttgagaggctgaggtaggaggatctcatgaagcctggagtttgagatcagccagggcaacatagtgagattttgtctctacaaaattttccatgtgtttgtgtgtcaaacagggtcttgctatgttgcccaggctggtctcgacctgctgggctcaagcaatcctcctgccttagcctcccaaagtgstgggattataggcgtgagccaacatgccccgtctctacaaaaaaattctaaaaatcagccaggcatggttgcttgtacctgcagtcccagctacctggaaacctgagatgggagaatcacttaagcccaggaatttgaggctgcagtgagcaatgactgtgccactgtacttcagcctgggtaacagaggggacttcatttctttaaaaagaaaaaaaagacaaaacatcatagtgcatgaggaatttgaaaagacccacaaatattaatatgtctagaattatgtggacttattgattt

SEQ ID NO: 41236 - DNA, 601 bp, Human
aagcgggtagatcacaaggtcaagagatcgagaccactctggccaacatggtgaaaccccgtctctactaaaaaatacaaaaattagctgggcgtggtggcacgcacctgtagtcccagctactcgggaggctgaggcaggagaatcgcttgaacctgggaggcggaggttgtagtgagctgagattgcaccactgcactccagcctggtgacagagcgagactccatctcaaaaaaaaaaaaacaaaaaaaagaaagtaaactctggtaaaggtgggaaggccacatccactgtgaccaycacccaatgaccaagaagcagggctgcactccacaggccagtgtgaaaaccacagaaggggtagaaagtgattaaaaaaaaaaaaaacacacacacacacaaaaacactcactcagggcacagtgcctatagcagctaaaatgcatagggttagattattttaaaaccaaatcaactcatctacggaatcataaactacaacttataacaacaaaatacctttgcttcctctaccattttcttctcttcatccacttcctcagtttttgctgaatcttcactttggagttttcttctctt

SEQ ID NO: 41237 - DNA, 601 bp, Human
cagcttacacaagagcaaaaccctgtatctaaaaattaaataaacaaattgttaatgtgtttaaaagtcaccaccacctttttaaaaaagaaagtaaactggtagaccaggagtggtggctcacgcctgtaatcccagcacattgggaggccgaagcgggtagatcacaaggtcaagagatcgagaccactctggccaacatggtgaaaccccgtctctactaaaaaatacaaaaattagctgggcgtggtggcacgcacctgtagtcccagctactcgggaggctgaggcaggagaatcrcttgaacctgggaggcggaggttgtagtgagctgagattgcaccactgcactccagcctggtgacagagcgagactccatctcaaaaaaaaaaaaacaaaaaaaagaaagtaaactctggtaaaggtgggaaggccacatccactgtgaccatcacccaatgaccaagaagcagggctgcactccacaggccagtgtgaaaaccacagaaggggtagaaagtgattaaaaaaaaaaaaaacacacacacacacaaaaacactcactcagggcacagtgcctatagcagctaaaatgcata

SEQ ID NO: 41238 - DNA, 601 bp, Human
agaccagccggccaacacagcaaggccccgtctctataaaaaatttaaaaattagctgggcatggtgacactcgcctataatcccaggtactcagggcaggctaaggtgggaggattgcctgagcccaggagtttgaggctgcagcgagccatgactgcaccactgcactccagcatggacagtagagacccgtttctaaagaaacgcaataaaatcagaaaagagcaaatatgacatcaggtagatctgtgtggactaacgggacggaggggacagatgtttagaatatactggtaagtragaaactgaagactgttgtgcacagtataagtttccacttttaataaatccaacaaatctttgtatatacataaaaaggacaccaaactattaaaaaagtgacatccttgggcagtgaaactagggtgggagttatatattttacttacctctcattttatttacttacaataataaagcatgctacatttaaaaataaaaagtgaggaaactgggtatctaatatgaaaaaaatgaagctgaagccttaccttctaccactgacaaaaattaactcaaatgatcaaagacctaaatgta

SEQ ID NO: 41239 - DNA, 601 bp, Human
ttcaagaccagccggccaacacagcaaggccccgtctctataaaaaatttaaaaattagctgggcatggtgacactcgcctataatcccaggtactcagggcaggctaaggtgggaggattgcctgagcccaggagtttgaggctgcagcgagccatgactgcaccactgcactccagcatggacagtagagacccgtttctaaagaaacgcaataaaatcagaaaagagcaaatatgacatcaggtagatctgtgtggactaacgggacggaggggacagatgtttagaatatactggtragtgagaaactgaagactgttgtgcacagtataagtttccacttttaataaatccaacaaatctttgtatatacataaaaaggacaccaaactattaaaaaagtgacatccttgggcagtgaaactagggtgggagttatatattttacttacctctcattttatttacttacaataataaagcatgctacatttaaaaataaaaagtgaggaaactgggtatctaatatgaaaaaaatgaagctgaagccttaccttctaccactgacaaaaattaactcaaatgatcaaagacctaaa

SEQ ID NO: 41240 - DNA, 601 bp, Human
tgagcccaagagtttgaggctgtagtgagccaagatcacaccactgcacccaccagcctgagtgacagagtgagaccctgttattcattcattcattcacaaataaaataaaataagcataggctgggcatggtggctcacgcctataatcccagcacttttggaggccaagatgggaggagcactggagcccaggagttcaagatcagcctgggcaatgtagggaaaccccttctctataaataaataaataaataaataaataaataaataaaaatttaaaaattagccaggaatggtrgcaggcacctgtagttccagctactcgggaaagtgaggtgggagatcacaagcctggagtctgaggctgcagagagcctgggcaacacagtgagaccccatcccaaaaagtaaagacatttttaaaaataaaagaaacacaggaaggtgaaaactaaatcccagcaagataatgacacaccacatagtaagtgtctcagcttaagtcatgaattaaatctttatctaaactgaattttctttctccaccctgcttacctcttatccaaaattatctcccccatatcacatatcatcctcg

SEQ ID NO: 41241 - DNA, 601 bp, Human
gacattcacatgtagtgcacacagtatggaagaaaacagtcatgggcagtcctgctttttactatttcctatgaattataaaatctgagcatccaatagctcatctgacctcattaaaactttttttaaatttgaaggtgttttgggaataggcttatttaacctcgtttttttaaaaaacagattttaaatagtatcatacaataataggtagcccttgtaactggcttctttcactgagcatgtttctaggttcattcgcaaagcatgtaacagtactttcatcagttttactgctgawcaatatctcattgaatagacattgcacatgctgtttatccattcatcagctgacagttacctgggctgcttccgtattttggttattcagaatcaccccatcttacgatgggtcaaacctatgacttcacaatggtgcaaaagtgatacacgttcggccgggcgtggtggctcacacctataatcccagcactttgggaggccgaggcgggcggatcacaaagtcaggagttcgagaccagcctggccaatatggtgaaacctggtctctactaaaaatacaaaaattaggcgggtgtgg

SEQ ID NO: 41242 - DNA, 601 bp, Human
gcagatgcaacctaaacagagaccaaaccaggccagcattactacactgaccaaagacactgagagagaactaggaacaggggacagtatgagagaattctgaggacacttgcctcctagaacttcactaatctaaaccatttattcttataaaaggctccaaagggggaaaaaaacttgccaaaggtcacacagagatgcagtggagtgggtggatgactggggacaagcatcttctagggaaatccacctaacaactcagtataatttaaaaataggatcacctgtatgctgtaaatgytataatgcaacaattttagacagctaataaaactccgatttaaaagataatcaataacctaccacaacaccaccaatccaataccacagctggatttcaatgccctgcccgaagcaaagaagtccttgtgaagtaatgaatctcctaaaggaaaacagccagttatcctggaaggtcatgggctttaaaatacaggtgccaaggaacaaagatagttgattctgttccgaagtggggtactaaacagactggggagagggatgaggggaacagggctgctttttctctttcctatagaaa

SEQ ID NO: 41243 - DNA, 601 bp, Human
gtttcttacatttgaaaaagtgttgtgctgagtcaacttaatatggtaatctctccttccaaccttcattctagagcgattgaacgctttacagcaactgaatgattttacgtagatcttttcatctctaacctaactcagaaaataactctagccactgaaaagccaatcagcaaggggcttctaaccatgaagttccttttgcacatatgagactgcatgccaccctctgtacccggactgcctcctgctgaaagcacatatcttacttcacagatgactaaagttctgagccaatcaraggatttaaaactaaactaactaaaatagttacaaggattaactaattttgttttctgtaaaaaatcagaagattgaagagatcaattgcttttatgttatgctctaaaccgaggaacaaagggcctgctctgattccctggcacgacatttcaaagactggcatgttacagacctgcaggagagtaaaatctataccacacttatattctgtgtacacaaaattcttttgggtagaaatgaagatcttgggaatagaaatcctactccctaatatacccacataagcaaatttgattta

SEQ ID NO: 41244 - DNA, 601 bp, Human
aaagcgcagtgaaattttagcgaagccatgggcagtttacccactgggaattctgggcagagaatgttcccagctgggagaaaggcacaagaggcaaggatgaacaacaaacggtctgtaacaagtacacaaatatgggatctaaagctaataaaaacccaagctggtattgtgtaagagtctcagaagtgaggccaggaattgggatgttattctagaggcaatgggaagactagaagtttgtgatcaggaatgtgagcagatctttgctttgtgtacagcattctggtgttgcaatagktgggtggataagaggggagaagacgtgatataagaaagaggagttgagaagccaccaaaggagcccaggtgacagatgtagaagggacaaatgatagcggagaccacggagaatggagagcaagaaactggatcatcaaacatctgggcattggattgatatcatggcaaattaatgggtttgtaggatgagggagagatgttcatttccaagttgacacccaagttctactcatgatagggaagaaaacattatgtatcggtaaggaaggtaatgagtgtgagatttttagcagtgggt

SEQ ID NO: 41245 - DNA, 601 bp, Human
aaaaccaagtttcaacagcatgcctcatgcctccttctgccaggccacagacagtttggacaagataccaaaggcaacagaaattaagaccaaaatgcaatcctacccttccccacacaaagcaatacaaaacactgtttcttttgtctcacaaaaagagccagataatgtaatacatcagttactaaaagctgtccccacctctgaggtagactgaaaagaataaacagagcccagacaggtgtgacttcaccttgatggcccccttccaggagctgaaacagcttgcagatgaccatartatcaaagcagtggtaatcccagctcggaacagctggtccaaagccccaccatttcagagcaacatgtctcatctctaagtgcagctgggatggagtgcaaaagaacctgctaatactgttaaggtggggtcaggatcaaacagctctgccccttagaaggaagcccaggccgggcaccgtggctcacgcctgtaatcccagcactttgggaggctgaggcaggcggatcacctaaggtcgggagttcgagactagcctgaccaacatggagaaaccccatctctactaaaaatacaaaa

SEQ ID NO: 41246 - DNA, 601 bp, Human
gcctttaccagcagtcctgctggaggtcggctgaagggggctactgtcaacaggacactagctctcagagaacaggtggacctggggttacagtgacaccatggaagggcatcaacaagccactgcagaaagcaaaacatgctatctgggccaacagcagccaattctgtgggggtggggtgcctctggtaagaaaagcaagaggtccaattcccttcctgggctcttccaccgtagacatgtgagggttaagtggctaaagagaaaaggggcggggcctccattccaggtagccataacaaaagctgtgattcacagcagaggccacagagcccaaggctgtggcaaaccgagcatcttctaatgccttatgatctcccaaatggcctgccttaagcccctaactccaatttgatctgtcaaaacaagcaccttttcaagagtttcttttttgttctttaaagctcaagtgagatctaaaaactactaaaattacattggttaaggagcagaggggagggtaatgtccctcccataacaactgtcgactcaacagtaagtgaggctccagcattgctgacattcccacaatgaagaccca

SEQ ID NO: 41247 - DNA, 601 bp, Human
tgcttcatgtcagtaagaaactcctgcacagagcggtagctcccacaggaacatttgttctgcactgtctgaaagtccatggggtgcgtgatcacatcatagtagtcctcggcctcatctctggtcacaggctccctgtggagaagaaccaaatggagaatctgcacagccttgacggcagtgcccctgccactgagacacgtcctgaaaagcaagggcttggctgagagcccctcaggggctctggaagcttttagaaccagccaggccactcctctcccctgcacctgagaacacagcrctcacctgaagggccagctgaagcggtacttcacgatcttgtggaggatctcttcacacttctgcagctccaggctttgcctccgggagctccgcttggtctgaagcacctggcaggaaagaaagaacaatgttattacagattcaagacaggaggaagaatggacagggcagaaaataagtgtatctgctcaaaaaaggaagagagttcaactatttccttggcgcagaggtgctgaaaccttctgatattcaagtcagggagcaccctcggcccaggtggcaggcatcttcccagtag

SEQ ID NO: 41248 - DNA, 601 bp, Human
tgattaccccgatcctgctatgtaacacagcaatccctcccctggagaccagaggggcttggcactgtggtggaagccagagcgagcaggcccttaggaaagaaggcaggaacaggaactggcttcaccagaaaagctagaccctcggactcctcctggaaactctcagaagggagggttatggccctctttgtcccttcatatttctggacaaagaccaccaacccaatatcaagccccataaagagcttttagaaaaacagcataagcttgggatgacaggcgtttctggactccctgygatctcttccaggttcttggtcttcctcgctcgcctccctcccaccctccctagctgtccccccacctcagctcccttaccacggccctgcctctctacttcttctgtcttcgtcccctggactgtccaacggcctctggctcactgtccccttcatcttcagcaagcctatcaggaaacttcttgcgcttcctgcggacatatgggtggccaggaaggtgtttatgcaacagagccactagacactgttctgtcttcaccatgcagcttagcacatggctgccacggcagttgtaaacc

SEQ ID NO: 41249 - DNA, 601 bp, Human
gtttcatgatgctggtgaatacacaattctgtatggcactcactgatactgtcacctgagaggaagacgggggaagagacagagtatgggcttaaagaaacaagactgtataataaatacagattaaaaaagaaaaatcgccaccatctcccctgttggcctgattaccccgatcctgctatgtaacacagcaatccctcccctggagaccagaggggcttggcactgtggtggaagccagagcgagcaggcccttaggaaagaaggcaggaacaggaactggcttcaccagaaaagctaraccctcggactcctcctggaaactctcagaagggagggttatggccctctttgtcccttcatatttctggacaaagaccaccaacccaatatcaagccccataaagagcttttagaaaaacagcataagcttgggatgacaggcgtttctggactccctgtgatctcttccaggttcttggtcttcctcgctcgcctccctcccaccctccctagctgtccccccacctcagctcccttaccacggccctgcctctctacttcttctgtcttcgtcccctggactgtccaacggcctctg

SEQ ID NO: 41250 - DNA, 601 bp, Human
tgtgccattgcactccagcctgcgcaacgagaacgaaactctaactcaaaaacaacaacaacaacaaaaaactcatgcccaggtcatacccataccaattaagttagtatatatagttgtggaagtcaaatatcagtagtatttaaagcagcctggcggggggacaagagcgagactttgtctcaaaaaaaaaaaagtgtcatggtcatgaaaaacaaggaacaaccgaggaaatgccacagattggggggcagtaaagtatgtagttaataatatgccaatgttcatttttaaattttgrtaattgtgttaagtaagatgttaacatcaggaaactgggagtaggagaactctaccatttttgcgattttctgtaagtctaaaagtatttcagagtaaaaggttgacatttttcatgaatgctatgatgttatatattattttctccttctcttttctctgaatttatacttgagatttgtctgtcaactgattccgtattggttctcttcccctggtgatgtgcattttaatttccatttccccatgactaatgatggtgagcctatttttatgtgccaattggctatgtttgtatttt

SEQ ID NO: 41251 - DNA, 601 bp, Human
agaggggctcatgagattcccaatttatatccagtcagttagaagcacaggtaaaacaacctgtggcttgtgattggcatcagaagtagggggcagtcttgtgggactgagccatcaacctgtgagatctgacgctttctccaggtagataatgtcagactcgaattggaggatacccacttggtgtctgctgcagaattgattgcttgtttgttggtggggagaaatcctcacacatttggtcacagaagtctaccttattgattgttgttgagtgaaagaatctttttttttttttttwaaatttatttttttattgataattcttgggtgtttctcacagagggggatttggcagggtcatgggacaatagtggagggaaggtcagcagataaacaagtgaacaaaggtctctggtttcctaggcagaggaccctgcggccttccgcagtgtttgtgtccctgattacttgagatcagggattggtgatgactcttaacgagcatgctgccttcaagcatctgtttaacaaagcacatcttacaccgcccttaatccatttaaccctgagtggacacagcacatgtttcagagagcac

SEQ ID NO: 41252 - DNA, 601 bp, Human
ctggccttgtattttctaaaatagttatttgtgtgtaaagtttaagtagtaagatttacttaaagtacttctcagaaattgtcaaggtgaaactttcccatcattgccattttgtaactggtttgttagctaagggccttttcttttccctttgttttttcttaattcatttctttattattttaaaacacagagacatggtctcactatgttgcccgggctggtcttgatgagttcctggcctcaagcaattttcccacttcagcgtcccaaagtgccaggattataggcgtgagccacygcacctggccttacaaaacagttttataatgattatttttgagatggggtctcactgtgttgcccatgttacctgtgaactcatgctcaagtgatcctcccacttgaggcttccaagtagctggaactatcggcatgtgccactgtgtctggctttatcttataatgatcatataattattattaaagattataaaattcaatggaaagattatactatcctcatgtatcaaaagactaaatcttactagtgctcaattctccccaaattgacgtatagattcattgcagtcccttccaa

SEQ ID NO: 41253 - DNA, 601 bp, Human
gtgaaactttcccatcattgccattttgtaactggtttgttagctaagggccttttcttttccctttgttttttcttaattcatttctttattattttaaaacacagagacatggtctcactatgttgcccgggctggtcttgatgagttcctggcctcaagcaattttcccacttcagcgtcccaaagtgccaggattataggcgtgagccactgcacctggccttacaaaacagttttataatgattatttttgagatggggtctcactgtgttgcccatgttacctgtgaactcatgmtcaagtgatcctcccacttgaggcttccaagtagctggaactatcggcatgtgccactgtgtctggctttatcttataatgatcatataattattattaaagattataaaattcaatggaaagattatactatcctcatgtatcaaaagactaaatcttactagtgctcaattctccccaaattgacgtatagattcattgcagtcccttccaaaatcccacagaaattgacaaactgattctaaaatttgtatggaaatgcaaagaatgtggagtagccaaacaactttgaaaaagaac

SEQ ID NO: 41254 - DNA, 601 bp, Human
actccgtctcaaaaaaaataaaaaataataaactatcttttaatcctcataacagctatatgaagtgcagtttgtagacaaggaaattgaagcttagagaattatgtaacttgtccaaagtcacatggtcagtaggttatgaagccaatatttgaaccctgcttgactgcagaatgttcttttaacaattatgctctacttcttatggccatacatggtggtttacacctgtaatcccatcactttgtgaggccaaggctgggggctggggaggtggggggcatatggggggggattgctygagtccaggagtttgagaccatccttggtgacatggtgaaaccccgtctctacaaaaaatacaaattagctgggcgtggtggcatctgcctgtagtcctagctacttgggaggccaaggtaggaggatcgcttgagctcaggaggcagagaatgccctgccaaaagacaggttttttttttttagtttttttttcttttttgaggtggagtgtcactcagctcactgcaacctccgcctcccgggttcaagtgattctcctgtctcagcctcctgagtagctgggattacaggtgtgcac

SEQ ID NO: 41255 - DNA, 601 bp, Human
agttgctcacttacagatgtatattgaatattatacaaaataaaatcaaagtttagttaatcgcttattacttatctaaatatattggcagtataattatgtgtacagacctataatatggtggagtctcctagtctttgttcatagggccgggcgcggtggctcacggctgtaatcccagcactttcggaggccgaggcaggcagatcacctgaggtcaggagttcaagagcaccccagccaacatggtgaaaccctgtctctactaaaaatacaaaaattagccaggcatggtggtggrtgcctataatcccagctacttgggaggctgaggcaggagaattgcttgaacctgggaggtggaggttgcggtgagccgagattgcgccattgcactccagcctgggcaacaagagcgaaattccgtctccaacaacaacaacaacaaataaataaataaataaataaagtctttgttctgagaataatttacttaatacttcctgatatatttattttcaaatattgaagttttacaaaaccaaataacaaccgtggtactaatgtacacatgaaaccttatttgaaaagttataaattg

SEQ ID NO: 41256 - DNA, 601 bp, Human
ccctcgccaacagttccgagtgagctgtgctttagctctcgtgggggtgggtcaagggaggatttgaagagtcattgccccactttacccttttggagaaatggcttgaaatttgctgtgacacgggcagcatgggaatagtccttcctgaaccctggaaaggagctcctgccagccttgcacacactttgtcctggtgaaaggcagccctggagcaggtgtttttttggaactccaaacctgcccacccaacttgcttctgaaagggactctaaagggtccctttccgctcctctctgasgccttccctcagccagaattcccttggagaggaggcaagaggaaagccatggacaggggtcgctgctaacaccgcaagttcctcagaccctggcacaaaggccttggctacaggcctccaagtagggaggagggggaggagtggctgcctggccacagtgtgaccttcagaggcccccagagaaggacacctggcccctgcctgcctagaaccgcccctcctgtgccccctggccttggaaggggtatgaaatttccgtcccctttcctccttggggcccaggaggagtggagggtcccg

SEQ ID NO: 41257 - DNA, 601 bp, Human
cccaggaagggctggcagaagcctttccttttgggtgctgtcaggtccgcatgtcttggcgtgttgaccttcacagcttctggcgaggggaggaatgatctgatgcgggtggggagggttagaggaggcctcaggcctaaggtggtgcagggggccccctaggggctgggcagtgccaaggcataaaagccttccctggtccctggtggcatttgaaggtgcccaggtgagaggggcttggcacctcctcaccctgggagggagaagaaaccagggaacaggtaggagtgggagacaggtsaggctttggaaatctattgaggctctggagagatttgtgtagagaggaaaatgtggttctcccccagggtctcctcctgggtttttaccctctaagcaacctgtgggcatgctgggttattcctaaggactagaagagcttggatgggggagggtggttggtgcccttcggtcctcggcacccccctccgtctccaacaccagctcaccctggtatttgtcatgtcagcaggagaaggtcaccatgttgtttttctcgcccctagtccttccttcctgccccagtccaaatttgtcctcc

SEQ ID NO: 41258 - DNA, 601 bp, Human
tcatcacgaaggtgagtccccctggctgttggatggggttccctgtcctctcaggggatgggtggatggcctaattcctttttcttcagaactgtggggaggaaggggaaggggcacaggaatataaggatcaagaaagaaagagctgggcaccacgaggttcaccctcagtttcgtgaggactctccgctgttcaggtctctgctagaagtaggacttgttgcctttttcttctgctctttccagtaaaattttatttggagaaggagtcgtgcgcacagagcaggaagacagtgttcasggatcctaggtgttgggggaagtgtcccttgtttcccctagctcccaggggagagtggacatttagtgtcatttcctatatagacatgtcccatttgtgggaactgtaacccttcctgtgtgagctggaggcacagagggctcagcctaatgggatctcccctcccttccctggtttgcattcctttgggggtggagaaaaccccacttgactatgttcgggtgctgtgaacttccctcccaggccagcagagggctggctgtagctcccaggcgccccgcccccctgcccaaccccgag

SEQ ID NO: 41259 - DNA, 601 bp, Human
aaggggcacaggaatataaggatcaagaaagaaagagctgggcaccacgaggttcaccctcagtttcgtgaggactctccgctgttcaggtctctgctagaagtaggacttgttgcctttttcttctgctctttccagtaaaattttatttggagaaggagtcgtgcgcacagagcaggaagacagtgttcagggatcctaggtgttgggggaagtgtcccttgtttcccctagctcccaggggagagtggacatttagtgtcatttcctatatagacatgtcccatttgtgggaactgtracccttcctgtgtgagctggaggcacagagggctcagcctaatgggatctcccctcccttccctggtttgcattcctttgggggtggagaaaaccccacttgactatgttcgggtgctgtgaacttccctcccaggccagcagagggctggctgtagctcccaggcgccccgcccccctgcccaaccccgagtccgcctgccttttgttccgttgtggtttggatcctcccatttctctggggacaccctggctctccccaccactgactgtggcctgtgctctccacctctggggaggg

SEQ ID NO: 41260 - DNA, 601 bp, Human
ttcaccctcagtttcgtgaggactctccgctgttcaggtctctgctagaagtaggacttgttgcctttttcttctgctctttccagtaaaattttatttggagaaggagtcgtgcgcacagagcaggaagacagtgttcagggatcctaggtgttgggggaagtgtcccttgtttcccctagctcccaggggagagtggacatttagtgtcatttcctatatagacatgtcccatttgtgggaactgtaacccttcctgtgtgagctggaggcacagagggctcagcctaatgggatctcycctcccttccctggtttgcattcctttgggggtggagaaaaccccacttgactatgttcgggtgctgtgaacttccctcccaggccagcagagggctggctgtagctcccaggcgccccgcccccctgcccaaccccgagtccgcctgccttttgttccgttgtggtttggatcctcccatttctctggggacaccctggctctccccaccactgactgtggcctgtgctctccacctctggggagggaaggccctggggtcttccttcccgcgagtttccctgacctaaatctggcgtg

SEQ ID NO: 41261 - DNA, 601 bp, Human
gaagtaggacttgttgcctttttcttctgctctttccagtaaaattttatttggagaaggagtcgtgcgcacagagcaggaagacagtgttcagggatcctaggtgttgggggaagtgtcccttgtttcccctagctcccaggggagagtggacatttagtgtcatttcctatatagacatgtcccatttgtgggaactgtaacccttcctgtgtgagctggaggcacagagggctcagcctaatgggatctcccctcccttccctggtttgcattcctttgggggtggagaaaaccccayttgactatgttcgggtgctgtgaacttccctcccaggccagcagagggctggctgtagctcccaggcgccccgcccccctgcccaaccccgagtccgcctgccttttgttccgttgtggtttggatcctcccatttctctggggacaccctggctctccccaccactgactgtggcctgtgctctccacctctggggagggaaggccctggggtcttccttcccgcgagtttccctgacctaaatctggcgtggctgggtagtggccagcagtggtgatgcccagcctgttctgcctcct

SEQ ID NO: 41262 - DNA, 601 bp, Human
gtaggaaactggagactagcttggcaaagctggctcttcctccttttagggaaagcttagagcatccccatggggtatacccatactcagactgtcctctggcatcgaggttggcccaggattcagttcagctgtcacagtgaggtggcgggatcagatgtggcaggccatgtcccttggaacttgagtacatcgtgtgatctctggaatgaaaacaggccttcaccagtgttgatggtggaaagcttagggaagtgcttcaaacacagtaggagggacttacgttagattttggaaggamttgcctgattcggaagctccaaagagtggcattacagagctgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcac

SEQ ID NO: 41263 - DNA, 601 bp, Human
agactagcttggcaaagctggctcttcctccttttagggaaagcttagagcatccccatggggtatacccatactcagactgtcctctggcatcgaggttggcccaggattcagttcagctgtcacagtgaggtggcgggatcagatgtggcaggccatgtcccttggaacttgagtacatcgtgtgatctctggaatgaaaacaggccttcaccagtgttgatggtggaaagcttagggaagtgcttcaaacacagtaggagggacttacgttagattttggaaggacttgcctgattcrgaagctccaaagagtggcattacagagctgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtggg

SEQ ID NO: 41264 - DNA, 601 bp, Human
gagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacytctgtgatctgcttccttcctttccagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttata

SEQ ID NO: 41265 - DNA, 601 bp, Human
ctgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtytggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgac

SEQ ID NO: 41266 - DNA, 601 bp, Human
gcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctcyagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggag

SEQ ID NO: 41267 - DNA, 601 bp, Human
cctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgagrggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactcc

SEQ ID NO: 41268 - DNA, 601 bp, Human
ccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgarggcacaaggcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaa

SEQ ID NO: 41269 - DNA, 601 bp, Human
caccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattcyggcccaacccatggcacccacagaggcctccttgcagggcagcctcttcctctgggtcggaggctgtggtgggccctgccctgggccctctggccaccagcggcctggcctggggacaccgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcaccctt

SEQ ID NO: 41270 - DNA, 601 bp, Human
gtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctcygggtcggaggctgtggtgggccctgccctgggccctctggccaccagcggcctggcctggggacaccgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctct

SEQ ID NO: 41271 - DNA, 601 bp, Human
gccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcasttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcag

SEQ ID NO: 41272 - DNA, 601 bp, Human
tacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgygttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagct

SEQ ID NO: 41273 - DNA, 601 bp, Human
tacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacastgggaggggacatggggaatggagatggtccctcaccttcctggggcctcctgctctacgctaccccctcgggagcctcctgtccccagggcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgt

SEQ ID NO: 41274 - DNA, 601 bp, Human
attgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcargccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaac

SEQ ID NO: 41275 - DNA, 601 bp, Human
gggtgagggctgctgatctgcatccaccaactccctctcttctgggacctccctaccactcagccccaagggactcacagcccactcaatgtctctaatcacaagactgttaaaatgcaaaccccaaaaccccctcaaaagtctaaggggaaaggaactcaaagtttccaccttttcagagtcatgttattgaaactttcatgcttcaggggtcaggctgctgagtgacacccccaaagaacaccctcctcctatacacaaactacaacacacacacacacacacacacacacacatacakacacacacacacacacacacacacacacacaacctgccttcaagcccagtctgaaagccaccttttctgaaaagccacctaagatcctcatgcccccagccctttctcaggggccgcttccttctgtgctcccctggcctttttgctctcctttctagtctggacactcccgacccttgcttagtaatagagatttcgattcaaatttacattcttcaccttcctcagggcgctattcagatgtcactggctccatgaggccttcccggaccaccctatttaacaatcatatcaactctc

SEQ ID NO: 41276 - DNA, 601 bp, Human
gtgagggtgagggctgctgatctgcatccaccaactccctctcttctgggacctccctaccactcagccccaagggactcacagcccactcaatgtctctaatcacaagactgttaaaatgcaaaccccaaaaccccctcaaaagtctaaggggaaaggaactcaaagtttccaccttttcagagtcatgttattgaaactttcatgcttcaggggtcaggctgctgagtgacacccccaaagaacaccctcctcctatacacaaactacaacacacacacacacacacacacacacacayacatacacacacacacacacacacacacacacacaacctgccttcaagcccagtctgaaagccaccttttctgaaaagccacctaagatcctcatgcccccagccctttctcaggggccgcttccttctgtgctcccctggcctttttgctctcctttctagtctggacactcccgacccttgcttagtaatagagatttcgattcaaatttacattcttcaccttcctcagggcgctattcagatgtcactggctccatgaggccttcccggaccaccctatttaacaatcatatcaac

SEQ ID NO: 41277 - DNA, 601 bp, Human
atgcccatgagaccccggccagctgccaggtgcaggggtgtgcacccgttcagcatgcgggcatctacctgggcaccagcctggagcaggaactgtaccaggccccgctcttgggtttccacagccaggtgcagcgctgtcttaccactggtgccctcctggggaggaataaggatgtcagccaaggccctcagaggcagtgtgctgggcctgggctctggataaggaagtgaatgccaccacttctgactgctgggcaggggacttggggatgtgtcaggtgggggcaggccctgggccrggcagtgctttgctggctgtctcacctgcacatcaatgtcagctccattccgaagcagcaattccatgagtggttggttcttctgaagggtggcaatgtggagacaagccagacctgggatggggtgagagtgagggtgagggctgctgatctgcatccaccaactccctctcttctgggacctccctaccactcagccccaagggactcacagcccactcaatgtctctaatcacaagactgttaaaatgcaaaccccaaaaccccctcaaaagtctaaggggaaaggaactcaaagtt

SEQ ID NO: 41278 - DNA, 601 bp, Human
aaaatacaaaaattagctgggcgtggtggcacgtgcccgtaatcccagctactcaggaggctaaggcaggagactcgcttgaacccaggaggtggaggttgcagtgagccaagatcacgccactgcactccagcctgggtgacagagtgagactccatcttaaagaaaagaaaaaaaaaaacaaacttattttgattacattaaaatgtatctttgtttgtttgtttgtgttttcagacaaggtcttgctctgttgcccaggctggagtgcaatggcaggatgatggctcactgaagcctygtcctcccgggctctagtgaacctccggcctcagcctctggagtacctggaaccacaggctcgagccaccatgcctggctaatttattttaattttttttgtagagatggggtctcactgtgttgcccaggctagtcttgaattcctgggctcaagtgatcctcccacctcggcctccaaaagtgctgagatttcaggcatgagccaccactcctggcctaaaatttatcttgattcatgagttttttggctcccccttacattttacacccctggcaagtgcctcactggcctctccct

SEQ ID NO: 41279 - DNA, 601 bp, Human
agtgggccgtggagcgtcggggccggtctgagcagcgggtgtgtaaatggaacagtcccgagatgaattttatgggagtctgcgcaggtccttaatgtgtggctgtaccctccagccccatgtaccccacacgatggacagacagccttggtgtggcagggcccaaagaggtcctatctaccgcaataacacgaccaggcggccctgggggcgcaggggctcggggtgggagcggcggagcgcgcggagtcgccgcggggtggcaggggtgggccgggggcggggccgcgggcgtcggggrggtggcagtgggcgcagggcggggcgagctcagcggagggcgggtttgaatgtgccccggcgggagagggaagctgcagcgagagcgcgcggatctcagcgcgggagcagtgcttctgcggcaggtgctgcccggggccggggactggggactggggactgccggggcggaagacgccgctgcccgcctgccacggagggcagggagggcgggcctgacggctccgcagcccggagaagggacgccgggtggggccccagtgcggagcgtgcggagccgcgcagcacgtggcgcgcacgg

SEQ ID NO: 41280 - DNA, 601 bp, Human
tccttcctgcgcacgtcttcatttactgatttactgtgagggtatatgagagggtgaagacacacagtcctcggctttgcttaccaggagagagcagtcgtaggtcaaggctggctccaaccctgccctcacacctctaggggtctctctgcagccctgtggtagtccctttgcctactcctctcggtggcctccagaccctccaactttcctcctgcttgtgtaagctccccatgccaggatgtgtgtgatggggcggggctgagctgcctgacactcaagtcaggctgggaatgatctyggtctccacctcatttttccctttagttgaatcagagttccccccacctcccagtctacagggctaactgagaagcagcttttatacctctctccattccaaaaggagcttgaacatttaatatggattctagctcctccactcaccagctctgtgacttcaggcaagtgactcaacccctctgaacctcagctggccccatctattcagtgctagtactagcttatgggtggttgtgaagaaaagacaagagatctgcaggtagtggctagccccatatgaaatcctgggagtggagaa

SEQ ID NO: 41281 - DNA, 601 bp, Human
ggcagggctcagtggctcatgcctgtaatcccagcactttgggaagccaaggtgggtgggtcacctgaggtcgggagttcgaaaccagcctggtcaacatggtgaaaccctgtctctactaaaaatacagaaatcagccgggggtggtggcaggagcctgtattcccagcttcttgggaggctgaggcaggagaatcacttgaacctgggaggcagaatttgcagtgagccgagatcatgccattgcactccagcctgggcaacaggagcaaaaactccgtctcaaaaaaaaaaaaaaaaagaaaaaatctgagacctgaggctttcccccacccccactccagtaatgccctcttgccttcatctctctagaaaatgtaaatatgattattcacccctcgtgcctaggacagtgcctggctagcatgcacaggtcctcagtaaatatttgtcgaaggcctgaatggaggaatccttctgcctctatctggaggtgtggggctgaggggctgaggaggacctctgagagcttggagtttccctggggagggttgagaggaactacagggaggtgggagagcccgtggaaggtctcatggtg

SEQ ID NO: 41282 - DNA, 601 bp, Human
atcacgtctgccctacccaccccatctccctcctgtgccaaaggctatgaaactaggccacttttgcctgtgggggctttgagcatgtagcttaatctctctgggactgtttttccacctgtaaaataagctaaaagtatctacttcccaggaagtggatctagaagtaagggaatttaaggaggcatggcaataagtccaggccccaggttgcttccctgcctcctgtgctccattcccaggctgcctgcccattctgtccccacctccgctctcctgtgggcagttccctgaaggcctygccggctccatttgccttattgcacagctcagtcatttcccagcgtactccccccaaccccgatcctctgtcctatgtgactttgggagtttttccttctgctctgggcctccgaaccaagcctttagcttctccaagggaagcatgtatgtgagggggttgggggggctgcagttgcattaactcggacctgctcacgtggtgtgctcaccacgccatccctgtatgaggcctgccagcggtccaggctcctgcactctggccaggcctgtcttctcactgccttgggctttatccctg

SEQ ID NO: 41283 - DNA, 601 bp, Human
tgggctttatccctgccatctctgaagagagctggtgttggctctggggagggtgtgcaaacccaactggagatctacatgggccgggctggggttactcagctttcaggcaaggcctatctgggagaagctggcgtgacccggaagggccttgaggtatagggcttggggcattgccctggccaaaggtggacagtccttatttacaccctgaggcccagatggcctccagtggccccatacctcctggcctgccctgggtggtatgaactacaaagttctatttggccaggaagaaaayggctctaaggccctctcttcacagcggccctgaggcaccctgcccacctgccctgtaggtccagaatagtatgggagtttcttaacttcagaatcctctctggggagtaacacagtccctgaccagacagcataattacttccagcctgcctggtgggagtggaagacacttgctgcttgctttctcactcatccacccaccccctgcccttcggcaggatttccaaaaccatctccggatgtgtgggtcacactggttcccagcctgcagagtcccccgagccttccagggctgataac

SEQ ID NO: 41284 - DNA, 601 bp, Human
ccctgaccagacagcataattacttccagcctgcctggtgggagtggaagacacttgctgcttgctttctcactcatccacccaccccctgcccttcggcaggatttccaaaaccatctccggatgtgtgggtcacactggttcccagcctgcagagtcccccgagccttccagggctgataaccatggtcctgtcagccatgccattcagtcctatgaccctgaccccatccccaccccaaattccaacgagcaatgtacccttttctccccccacacccataagaggacacatgcaaayggacacaaacacagacgccctgtgccctgggacctagagagactgacaacggacaggggctttcctggggctcattgtggagtggggcaggatggtgcgtcatttggcccatctttcctcctccattgcagatacaaagctgtctggcttatcttcttcatgctgggtctgggaacgctgctcccgtggaattttttcatgacggccactcaggtgaggctggagggactgggctccatggggcagtgcccactgtgcttgcaggatctgactctgtgctggtaggcacagggaaagaga

SEQ ID NO: 41285 - DNA, 601 bp, Human
tacttccagcctgcctggtgggagtggaagacacttgctgcttgctttctcactcatccacccaccccctgcccttcggcaggatttccaaaaccatctccggatgtgtgggtcacactggttcccagcctgcagagtcccccgagccttccagggctgataaccatggtcctgtcagccatgccattcagtcctatgaccctgaccccatccccaccccaaattccaacgagcaatgtacccttttctccccccacacccataagaggacacatgcaaacggacacaaacacagacgccctgtgccctgggacctagagagactgacaacggacaggggctttcctggggctcattgtggagtggggcaggatggtgcgtcatttggcccatctttcctcctccattgcagatacaaagctgtctggcttatcttcttcatgctgggtctgggaacgctgctcccgtggaattttttcatgacggccactcaggtgaggctggagggactgggctccatggggcagtgcccactgtgcttgcaggatctgactctgtgctggtaggcacagggaaagagatttcaacactcctctctgca

SEQ ID NO: 41286 - DNA, 601 bp, Human
ccggtggaggaggggcggggaggggagcaggttctggaagattcatgggctccttcctccgcccttcctcgagagctgagattgttctggaagcttctggattctggcgccccgccccagtgcccggatgctggggcgagggagggtgcactgcggcgccccctcctcgcgtggtcctggccgacgcatgtccggcagtgacgagtgtcggcctggtggctacggccaccatctttcttgggtttggtcctgttctgtaattttgtgctgtgaaagggtcgtggtggagcttttggcttamgaattctttgtccggatttaattgctcctccggtgggtatcgtatggatcccaggttattcctccctgccctatggggcaggagtgtcccgcccttggactggtcttaggaactgacacctcagggggagcagtttaaagttagtgccatttttatcttaaactagtcactttgacctcccccaaataaagaactgtaggtagtgattttcacatttaaatttgtgtaaggattacttgggatctctagatacctgggttggaccaacattatgatttttctgccatactaccagatgat

SEQ ID NO: 41287 - DNA, 601 bp, Human
gcagtgacgagtgtcggcctggtggctacggccaccatctttcttgggtttggtcctgttctgtaattttgtgctgtgaaagggtcgtggtggagcttttggcttaagaattctttgtccggatttaattgctcctccggtgggtatcgtatggatcccaggttattcctccctgccctatggggcaggagtgtcccgcccttggactggtcttaggaactgacacctcagggggagcagtttaaagttagtgccatttttatcttaaactagtcactttgacctcccccaaataaagaaytgtaggtagtgattttcacatttaaatttgtgtaaggattacttgggatctctagatacctgggttggaccaacattatgatttttctgccatactaccagatgatgctgaggctgctggtcaccattctttaagtaggtgggttctgtgacatttggttgaagaatatttagcttattttctttttccttctgaattttcaggcctcccacttagtgtgtagtctgagatctttaagagaatgcatttttagtcttgggaagggatagtactccggttaaaccagtctgaactcactgt

SEQ ID NO: 41288 - DNA, 601 bp, Human
ctagaagagaggcgggtcaaagaagtagtgaagaagcattctcagttcataggctatcccatcaccctttatgtgagtatggacttttaaatcttttacacttaacgtgcaggatgtttcctgttctggagaatctcattgtccctggcttttgctttccctggtagtgttttgtactccaaggctaacttctgtttttgttacttagttggagaaggaacgagagaaggaaattagtgatgatgaggcagaggaagagaaaggtgagaaagaagaggaagataaagatgatgaagaaaarcccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaaggtgtgagaagcctttgcatgttggctcaacatgcacatatggagaggaatgagttaggtggaagagtgttgggtaatagacaca

SEQ ID NO: 41289 - DNA, 601 bp, Human
ataaaataccatcattttcttttttttttctttttttgagatggggtctcgctctgtcacccaggctggagtgcagtggcacgatctctgctcattgcaagctccgcctcctgggttcacgccattctcctgccttagcctcctgagtagctgccactacaggcgcccgccaccacaccccggctaattttttgtatttttagtagagatggggtttcatcgcgttagccaggatggtctccatctcctgaccttgtgattcgcccacctcggcctcccaaagtgctgggattaacaggcscaagccaccatgcctggccgattttttttttttttggactggatctcgctcactgcaaactcaagtctcctgagtggctgggattacagatgtgtgctaccacacccggttaattttttgtagacagggttttgccatgttggccagcatggtctcaaactcaagtggtctgtccacctcctccccctgctggaattaggcttgacaatgcctgttttctctttcaaagtggtaatgtcaatctaaggcttttgtgatcgtccacaggtgacaatctccaatagacttgtgtcttcacct

SEQ ID NO: 41290 - DNA, 601 bp, Human
ttgagatggggtctcgctctgtcacccaggctggagtgcagtggcacgatctctgctcattgcaagctccgcctcctgggttcacgccattctcctgccttagcctcctgagtagctgccactacaggcgcccgccaccacaccccggctaattttttgtatttttagtagagatggggtttcatcgcgttagccaggatggtctccatctcctgaccttgtgattcgcccacctcggcctcccaaagtgctgggattaacaggcgcaagccaccatgcctggccgattttttttttttttggactggatctcgctcactgcaaactcaagtctcctgagtggctgggattacagatgtgtgctaccacacccggttaattttttgtagacagggttttgccatgttggccagcatggtctcaaactcaagtggtctgtccacctcctccccctgctggaattaggcttgacaatgcctgttttctctttcaaagtggtaatgtcaatctaaggcttttgtgatcgtccacaggtgacaatctccaatagacttgtgtcttcaccttgctgcattgtgaccagcacctacggctggacagc

SEQ ID NO: 41291 - DNA, 601 bp, Human
caaggaagtgtgggaagaggtgttttatttttatttttattatttttgagataaggtcttgctctgtcgctggagtacagtggcacaatcacagctcactgaagcctcaacctcccaggctcaagtggttctcctgcattagcctcctgagtagctgggactacaggcgtgtgccaccacacccagctaatatttattttttgattttttgtagagacagggtcttgccatgatgcccaggctgatcttgaactcctgggctcaaacccaccctcccgccttgacctccaaaagtgtttgrattacaggcatgggccattgcacccagcccagaggtggcttttaaactgggcattaaaagatgaataagagctcatcaagtgtggagggcttggggaggagatgatgttccaggctaaggggactacatgagcaagagcctggaagttgagagcctgtagtatgtccaggaacatgtggcttagggtcatgactttctggctgatggaccttctgcctattcctaggtgggtgcctgagtctgcacgctggcttctgacccaaggccatgtgaaagaggcccacaggtacttgctccact

SEQ ID NO: 41292 - DNA, 601 bp, Human
tggagggcttggggaggagatgatgttccaggctaaggggactacatgagcaagagcctggaagttgagagcctgtagtatgtccaggaacatgtggcttagggtcatgactttctggctgatggaccttctgcctattcctaggtgggtgcctgagtctgcacgctggcttctgacccaaggccatgtgaaagaggcccacaggtacttgctccactgtgccaggctcaatgggcggccagtgtgtgaggacagcttcagccaggaggtgagggtgaacgtgtgtgtgagcatgcatatmtgtgtgtggtggggagtgggctgtgtcaagtgcctccctcccagagcccaccatatatggcaggaaaagcccctgggcccccacagagagttccgaactctttaggatgtcctacctggctccagtgggccacatccatcattcgagacaaactcgtctcagctgccatgagcatctccatccccaccactgcagatgggaggaatagagaggggtggggggagagtactgtgtcccattgagatcacatagccaactctgatgttacaacctcacctccttccctaccaggctgtgagc

SEQ ID NO: 41293 - DNA, 601 bp, Human
gcctgtaatcccagcattttggaaggccaaggcgggcggatcactgaaggtcaggaattcgagaccagcctgaccaacatggtgaaaccctgtctctgctaaacatacaaaattagctgggtgtggtggcgaatgcctgtaatcctagctatttgggaggctgaggcaggagaatcgctcgaacctgggagatggaggttgcagtgagctgagatcatgccattgcactccagcctgggcgagaaactctgtctcaaataaatacataaataaaagaaaaaaattaaataataataataakaagaagaagaaaacagccccaagaagccccatcctgcccacccccatcccattcacccctggaaggcagagatgcccttgaggactgtcccaagagcaaccccttgaaaggcccggggttgggggggtctttcagctagctactgagaggtgggaagaggaaaattctaggcatctggtcatgtttagaaagaggtttgcctcctcgaacaacatggcagggcctgtacaaactactgaccttcttccttccacatcaccctttccttatctcccagtctggtgacttgtcttctctttt

SEQ ID NO: 41294 - DNA, 601 bp, Human
tgtaatcccagcattttggaaggccaaggcgggcggatcactgaaggtcaggaattcgagaccagcctgaccaacatggtgaaaccctgtctctgctaaacatacaaaattagctgggtgtggtggcgaatgcctgtaatcctagctatttgggaggctgaggcaggagaatcgctcgaacctgggagatggaggttgcagtgagctgagatcatgccattgcactccagcctgggcgagaaactctgtctcaaataaatacataaataaaagaaaaaaattaaataataataataataakaagaagaaaacagccccaagaagccccatcctgcccacccccatcccattcacccctggaaggcagagatgcccttgaggactgtcccaagagcaaccccttgaaaggcccggggttgggggggtctttcagctagctactgagaggtgggaagaggaaaattctaggcatctggtcatgtttagaaagaggtttgcctcctcgaacaacatggcagggcctgtacaaactactgaccttcttccttccacatcaccctttccttatctcccagtctggtgacttgtcttctcttttagt

SEQ ID NO: 41295 - DNA, 601 bp, Human
gggatcgccctgctggctgccggcaccgccctcctgctgccagagacgaggcaggcacagctgccagagaccatccaggacgtggagagaaagaggtgtgtgcacaggactgtgtctgtgtacgtgtgataacatgcatatggatgcaggtgctcagatacctgacaccttaggattcagacaggaaactatatctgcacatgtgtacttggtgcatgtatgtgtgcgtgcacaggtgagtgtttcagggtgcatgattgggggcatgtaaactgcaagcataaatgtgtacatgagtgtrtgaacacaaatacataaggttgttcaggaagatgtgtatgtgtgcacactcaagtatgcctacacatcaggggtgtgtacaagcatgtgtgtgagtcacttgtacaggcgtttgtataccaggaactggggtgagccctgggacagccctgatggggcaggctggggtggtaggctcggggattaaaccccaccattgctcacaactccttcctccctagtgccccaaccagtcttcaggaggaagagatgcccatgaagcaggtccagaactaagtgggagtggaggcaggccctccac

SEQ ID NO: 41296 - DNA, 601 bp, Human
gccagcccagcgggctgaagccgggcagaggcagggacgcatcctggccccctgcagccccgaagtgggggccttcagggagggaagtctgcagtgactggagcctctcaggagccacgcaaggcagaccgggcagccccaggcgagactctgaacacgaataagccaggatctacgtgcacttcgagctagtgcaagggagagcctcaggctaggctgtcagacctgggtggagccctaccaatgcccccgagccaacatcacctaccctgtaaaatgggatggtgctgcctgcctcctrgctaagggaccggcaactcccggcaggaattgcgtcccagagtcaggtccctggagctcctctgggaggactgggggcagggggtgtggtttccccaagaggttttgactgcctcttgagctgaagcccccactactgtgtcccaccttgaactctcccaacctcttccctcctggcctccccactccacgcaggaagaggttgggagagtgacctagaacttttcagctccaggagctttgggagaggtctggtggtggcggtggtggcacttcttttaggctagtgtggatcagggca

SEQ ID NO: 41297 - DNA, 601 bp, Human
gaggactgggggcagggggtgtggtttccccaagaggttttgactgcctcttgagctgaagcccccactactgtgtcccaccttgaactctcccaacctcttccctcctggcctccccactccacgcaggaagaggttgggagagtgacctagaacttttcagctccaggagctttgggagaggtctggtggtggcggtggtggcacttcttttaggctagtgtggatcagggcatttttgggggtctcagagacagtttcccaccagctacttccttagaggtctgtcctaccaacatasaagaacagccccaccccgtggcaggccggcttctgatgctgcttggttgaatgcttctaggtaatcaagggttaatgcacacgcttttctttttacccttgttgtgaaaaatctgtctgaagtttctaaatccctcttccctacttagcgtgaatctcctagggaggacttctatacaaatacccaggggtgggcttcccttgggggtcttggaagtgggatctccacccaagtgatcctgggcctcccagggctgagcttttggtttcaaacttacttgtgccaagctaagggcatcag

SEQ ID NO: 41298 - DNA, 601 bp, Human
tgtgaaaaatctgtctgaagtttctaaatccctcttccctacttagcgtgaatctcctagggaggacttctatacaaatacccaggggtgggcttcccttgggggtcttggaagtgggatctccacccaagtgatcctgggcctcccagggctgagcttttggtttcaaacttacttgtgccaagctaagggcatcaggatcgccgttcgtgtcatctttacaacaatcctgtgggtttagtgctattattatccccacacacttagggaggggaagtgactggcccaaagtcccgcagtyaacgagccaggcctcccaaccactcctctctgacaagaggctggcacttcttgccctgcctacccagcctgggttgcaaggaattgggggtttaggggcttcaggcctcctggctgctgtcttcccggggctacgctcattcttactgtccaagtgaggccaggggactggtcagagccctggggcctggggaggtttctcttccctgctcacctggctgggtgccgttttatggctatgctctgtctagggggatagcaggtgtgacccctcaacacgaggtcacagcccacacctgtt

SEQ ID NO: 41299 - DNA, 601 bp, Human
gggcagagcaaggcagggcatcgctgtgtgggcgtgcagcatcttttggttcctctgggtgaagcagggtttgggccccattctccacatacttccgggccatctgagggtagcgcccacctggggggtggggaggacaaccagccaggagctcacggttcggtggaagagacaggccacagccatgtggtgtggtggaggggcagggggcaagggtggaggtgggaagaggatcaaggggcgttcccgaggcctctgtgggcttgggggcctgcctgctattggggcagaacaggggaartaggcagtgcccagctgggtgctgaggctctgtgcagaggacaggcaggagttggaggaagaggatgtatttgaacttggatgtggtgagtttgaggtacctggagatcagccaggctgggagttgagctcagagaaaggcccagggaagctttattagcacctgtagtctccagagttcggggatgctcagatcttaggggtgccaccagaggtctcaggaggcactggtatgagtgtcctggaaaagccagaaggcagctgggtgggatgagttggtgaggggcactaagggggtatc

SEQ ID NO: 41300 - DNA, 601 bp, Human
aggctctgtgcagaggacaggcaggagttggaggaagaggatgtatttgaacttggatgtggtgagtttgaggtacctggagatcagccaggctgggagttgagctcagagaaaggcccagggaagctttattagcacctgtagtctccagagttcggggatgctcagatcttaggggtgccaccagaggtctcaggaggcactggtatgagtgtcctggaaaagccagaaggcagctgggtgggatgagttggtgaggggcactaagggggtatcctgcaggtttagggggctgggccarggcccatgtgagagttatgacactgggggagtggaaggggctgagtgtctcaggccaaggctggagatgggaggggggaacctctgctctgcaaccccagaaaggcagggtggggtgggagtaaccagggccagtgcagctggaaccagctcagcctgtcctccacctgcagagcccatccaggaactgtccagcactgggtgctcctgaaggaggctgagtctgcctcttgagcccacaggccctggcttagcttgttgtcctggcccccactccctgcttatctgacccgcacttcct

SEQ ID NO: 41301 - DNA, 601 bp, Human
actgtcccagcatgtcaaatgaccagaggtggccatagggagatgcccaggcagtggggctccctttgctggggaacaactgtcaaaggcaactgtgggaacccctgggactgagggtctgcagacgccggtgccagcagggcttgtcaagcttgggatgtctgcaaaagccggggggctcagcagaagggctcccaccctcccgtggcggtggcaaaggctgagcgtggcatgagaggcctggggttgtcctgggtgcagggctgttgcaatagctgcctccaagcgatgctgctcaggscgagccttggactagaaagttatctgcacggaagagcagctagggaaactaatgctcagaacagccaagaccactagtacctaatcacccatacagaggcatacaagtcccaagggctctgaatccacacctgtccccatcgccagccagaaggcccccacccatccactctgcagcaaagtcacagcaagttcaagggttaagttaagaccagaagccatgcctactttgccttctgccggggtggtggagtgagctcagatattctgggaggggagagttggggaattccagccacat

SEQ ID NO: 41302 - DNA, 601 bp, Human
tgccagcagggcttgtcaagcttgggatgtctgcaaaagccggggggctcagcagaagggctcccaccctcccgtggcggtggcaaaggctgagcgtggcatgagaggcctggggttgtcctgggtgcagggctgttgcaatagctgcctccaagcgatgctgctcagggcgagccttggactagaaagttatctgcacggaagagcagctagggaaactaatgctcagaacagccaagaccactagtacctaatcacccatacagaggcatacaagtcccaagggctctgaatccacacytgtccccatcgccagccagaaggcccccacccatccactctgcagcaaagtcacagcaagttcaagggttaagttaagaccagaagccatgcctactttgccttctgccggggtggtggagtgagctcagatattctgggaggggagagttggggaattccagccacatctggcaggaggccctggttcagagcctaccttgtggggatgtggtctctgcggaggtgagcagtaacacgggcttgaaaaccaacgcccacgtattcagcagtgaagcagagactgcgctgtgtgctgtgt

SEQ ID NO: 41303 - DNA, 601 bp, Human
gccccaccgaggccaggagggtgcttgaggaacagcaggattgaaggagcctatgttgtccagagtgaggctgagtgggccaggccagtgctgctaaggtcctgaggacccctaagggcagtggacatgagaaggcatggctgggcaggttttctgaggatggtggaggtgagcagagtgaggccttgtctcttgtgtcaggcaaggaggtaccccaagaagaggctgcatgagaccagcctgggcaacatagtgagacccccatctctaccaaaatatcaaaaaattacctgggaccggstgcactggctcacatctataatcccagccctttgggaagctgaggtgggcggatcacctgaggtcggaagttcgagaccagcctggccaagatggtgaaaccctgcctctcctaaaaatacaaaaattagccgggcttggtaggacgcacctatagtcccagctactcgggaggctgaggcaggagaatcgcttgaacccaggaggcggaagttgcagtgagccaagatcacgccattgcactccagcctcggcaacagagcaagactccgtctcaaaaaaaaaaaaaaaaaattacctg

SEQ ID NO: 41304 - DNA, 601 bp, Human
ggaccgggtgcactggctcacatctataatcccagccctttgggaagctgaggtgggcggatcacctgaggtcggaagttcgagaccagcctggccaagatggtgaaaccctgcctctcctaaaaatacaaaaattagccgggcttggtaggacgcacctatagtcccagctactcgggaggctgaggcaggagaatcgcttgaacccaggaggcggaagttgcagtgagccaagatcacgccattgcactccagcctcggcaacagagcaagactccgtctcaaaaaaaaaaaaaaaaaattacctggccatggcgtcttgtgcctgtagtcccagccacttgggaggctgaggcaggagaattgcttgggcccaggagttcaaggctgcagtgagctatgattgcaccactgcaccccagcctgggccacagagtgagactttgtctaaaaagaaaaggcctcagtttccccatagcgaatggttcattggggggtaggtggcactgcccaccccaggacataggagagaacccttagttctgaccgtctcccccttcatgcacttggttctctgactgctgctctgaggacggagcta

SEQ ID NO: 41305 - DNA, 601 bp, Human
ggtgaaaccctgcctctcctaaaaatacaaaaattagccgggcttggtaggacgcacctatagtcccagctactcgggaggctgaggcaggagaatcgcttgaacccaggaggcggaagttgcagtgagccaagatcacgccattgcactccagcctcggcaacagagcaagactccgtctcaaaaaaaaaaaaaaaaaattacctggccatggcgtcttgtgcctgtagtcccagccacttgggaggctgaggcaggagaattgcttgggcccaggagttcaaggctgcagtgagctattattgcaccactgcaccccagcctgggccacagagtgagactttgtctaaaaagaaaaggcctcagtttccccatagcgaatggttcattggggggtaggtggcactgcccaccccaggacataggagagaacccttagttctgaccgtctcccccttcatgcacttggttctctgactgctgctctgaggacggagctaagtgagggtgcaggaggaagggggggtctcttggcagtggggcgcagccttttgaggtgctgcatagctagtttgacctgtgggaccactgaccatccctc

SEQ ID NO: 41306 - DNA, 601 bp, Human
tgaaaccctgcctctcctaaaaatacaaaaattagccgggcttggtaggacgcacctatagtcccagctactcgggaggctgaggcaggagaatcgcttgaacccaggaggcggaagttgcagtgagccaagatcacgccattgcactccagcctcggcaacagagcaagactccgtctcaaaaaaaaaaaaaaaaaattacctggccatggcgtcttgtgcctgtagtcccagccacttgggaggctgaggcaggagaattgcttgggcccaggagttcaaggctgcagtgagctatgaktgcaccactgcaccccagcctgggccacagagtgagactttgtctaaaaagaaaaggcctcagtttccccatagcgaatggttcattggggggtaggtggcactgcccaccccaggacataggagagaacccttagttctgaccgtctcccccttcatgcacttggttctctgactgctgctctgaggacggagctaagtgagggtgcaggaggaagggggggtctcttggcagtggggcgcagccttttgaggtgctgcatagctagtttgacctgtgggaccactgaccatccctcct

SEQ ID NO: 41307 - DNA, 601 bp, Human
accctgcctctcctaaaaatacaaaaattagccgggcttggtaggacgcacctatagtcccagctactcgggaggctgaggcaggagaatcgcttgaacccaggaggcggaagttgcagtgagccaagatcacgccattgcactccagcctcggcaacagagcaagactccgtctcaaaaaaaaaaaaaaaaaattacctggccatggcgtcttgtgcctgtagtcccagccacttgggaggctgaggcaggagaattgcttgggcccaggagttcaaggctgcagtgagctatgattgcgccactgcaccccagcctgggccacagagtgagactttgtctaaaaagaaaaggcctcagtttccccatagcgaatggttcattggggggtaggtggcactgcccaccccaggacataggagagaacccttagttctgaccgtctcccccttcatgcacttggttctctgactgctgctctgaggacggagctaagtgagggtgcaggaggaagggggggtctcttggcagtggggcgcagccttttgaggtgctgcatagctagtttgacctgtgggaccactgaccatccctcctcttc

SEQ ID NO: 41308 - DNA, 601 bp, Human
ccctgcctctcctaaaaatacaaaaattagccgggcttggtaggacgcacctatagtcccagctactcgggaggctgaggcaggagaatcgcttgaacccaggaggcggaagttgcagtgagccaagatcacgccattgcactccagcctcggcaacagagcaagactccgtctcaaaaaaaaaaaaaaaaaattacctggccatggcgtcttgtgcctgtagtcccagccacttgggaggctgaggcaggagaattgcttgggcccaggagttcaaggctgcagtgagctatgattgcascactgcaccccagcctgggccacagagtgagactttgtctaaaaagaaaaggcctcagtttccccatagcgaatggttcattggggggtaggtggcactgcccaccccaggacataggagagaacccttagttctgaccgtctcccccttcatgcacttggttctctgactgctgctctgaggacggagctaagtgagggtgcaggaggaagggggggtctcttggcagtggggcgcagccttttgaggtgctgcatagctagtttgacctgtgggaccactgaccatccctcctcttcc

SEQ ID NO: 41309 - DNA, 601 bp, Human
ggctggacctactgagggcttctgtgccaggcatcaggcccacaggctcctgggtggcctgcagggttaggtaggagaggtcagggcagtcccaacctcccagtgcctcccaggccagtccctgcctaggacctggccacacctgccatgcccttggaagattcctctctaagttccactcccactccagtgagggccacctgagacccacctgcgagagcctcccccagggccctgtcccccatctctgtgccttctccctaccaagggttcctccagccaggaggaagagctgggggcracagggattgatgtctaggactcggcactggggctgacttcctgcctgccgctgcctgccccatgtgggggcataatcatctcactcagggaccccacacctacccttcccaggctgccaagtcactggctctgagccccctgggggtcctaatggtatagagagagaggtggccaccgtcaggagcactagcctactggataaatggatgggcttggagctcagggacagggtttcatgggttcagctgtggccccacccccaccccaggaaataccacccctgcaggtcatggcctgg

SEQ ID NO: 41310 - DNA, 601 bp, Human
gggaattcccacggtgccctatggcccagaggcctcgcagatgatctcacagaaatggggcagctatttttacctggcatttaattacatggtttggatcccagaggagagatgagatggtgatcccaggagctgcgagggaggggcattccggaaactgtggggaccctgggaggacaggcgagggcatgatcctctaactcatttccttggaaggatggtcgcttgtcccccaacactaagccggctccttagacagggactccccaggcactacatcaccgcactttatcactattgrtaattttccccctggcttggatgggggctgtaagcacacagcaggttggacctgtgtccccagaggcaatggcaaggcccccaggtgatgggctgggcccaagccatgcagtttagccatccagagctgtgaaggatggaggggcctgggaataagaggatgaagctggggtgaggagacagctgggattcctggattggggattcaaaatcggatttgaatgggaattctgggggaagccagattccagaacgtgggaatgtaagtagaagcgtgcaggccattgtgatggaaagaagc

SEQ ID NO: 41311 - DNA, 601 bp, Human
gggatgtgaattatccctttgtctggcatatccgcactctggatacgacccgctcgccacttaggagttgtctgggttattagatccaaaaaaaatgtagcgggccaggtgcaagtggctcgtgcctgtaatttcagcactttgggaggccaaggccagaggattgcttgaacccaggagttcaagaccagcctcatcaatagagtgagatcccatctctacacacacacacacacacacacacacacacacacacgcagtatacagaggttcagtattagccagtttcaagcatctgctrgggttcttgggacatataccccttgaacgagagggaactaccatatttgatccacactaggaggagacccctcaagtcctggagtcactgcagacctgggcgagaaccctggacctgtcttgtcactaacaagctgtttgtccttaggccccaagtgagggcttaggcggtgacagctgtgacatgcctggtgtgccaaactcattcatttgttcattcagtcagtgtttcccaagcgcctgctgtatgcccagcactgaggacacagccgcttctaggactggcaaaatccctgccttg

SEQ ID NO: 41312 - DNA, 601 bp, Human; identical to SEQ ID NO: 39665

SEQ ID NO: 41313 - DNA, 601 bp, Human; identical to SEQ ID NO: 39666

SEQ ID NO: 41314 - DNA, 601 bp, Human; identical to SEQ ID NO: 39667

SEQ ID NO: 41315 - DNA, 601 bp, Human; identical to SEQ ID NO: 39668

SEQ ID NO: 41316 - DNA, 601 bp, Human; identical to SEQ ID NO: 39669

SEQ ID NO: 41317 - DNA, 601 bp, Human; identical to SEQ ID NO: 39670

SEQ ID NO: 41318 - DNA, 601 bp, Human; identical to SEQ ID NO: 39671

SEQ ID NO: 41319 - DNA, 601 bp, Human; identical to SEQ ID NO: 39672

SEQ ID NO: 41320 - DNA, 601 bp, Human; identical to SEQ ID NO: 39673

SEQ ID NO: 41321 - DNA, 601 bp, Human; identical to SEQ ID NO: 39674

SEQ ID NO: 41322 - DNA, 601 bp, Human; identical to SEQ ID NO: 39675

SEQ ID NO: 41323 - DNA, 601 bp, Human; identical to SEQ ID NO: 39676

SEQ ID NO: 41324 - DNA, 601 bp, Human; identical to SEQ ID NO: 39677

SEQ ID NO: 41325 - DNA, 601 bp, Human; identical to SEQ ID NO: 39678

SEQ ID NO: 41326 - DNA, 601 bp, Human
aataaatcaaccggtcattaccaagggcctgggtgctctgccaggcactgcggatctaacaacgacaaacacaatggacaggattcctgcctgcaggtagcttgcagtgtagtggggggagagacatgaagcaagaaattagatattaaaagttgtgctctgacagtaaagtgccaggtgatgtgagagtttatcaggggatctagtgtatgacaggtcgagagaaagagtcttggaggaaatgctatttaggcagggaaacggtgtgtgtaaaatgctgaggtaagaaagcacctggtasttccaggaaggaggcctagaggggaggaggcaggggagagagaaggagtggcaaatgaagatggagaggctaggtgggcaccggggcaaagtagccttatttgcatttcttcctgcaagccggaggcagccctgatgtgccttgagctttggcacatcagcgacatgacaccggctctgagggctctcaccatgacacatctcctcttgccaaggccaacaggtgcctgtcgggagcctttgtgttgtgttgttttcaagtaaagatagaccagcccctctttaccttccgatgctgtaa

SEQ ID NO: 41327 - DNA, 601 bp, Human
catgctctaatttccctagagagaaatccttcatccacctcctctattcttctttctactttataataaacatatgcaaggtgatagcccccaaataagtcagatacaaatccaaactcctaaatcagcttaaaaattaagtgtcctctcagtcactcttgctaatttctggaggtaaggacaatttctttaggtattataggggtgaataaagctactgtaatattttgggtcctcatcccacagagttttaagaagagtcaacaattattgttcatatatgattagcaaaaaaaaaagtgagttgttccagttttatgttattttagccatgttgtctcttgtcagagaatcaaaatctgactatttagattgtattttctagaatctaaatttcactaattcactgatgcatgtccagctgtgggttgtcagttcagccacactgcccatctgctgttgaagaatcacaggaaggatggctagagttgggaacatgaagctcttttcaccctgccagagaagttaagaggggaagggagagctgatccccatccagaggcagagagttttcagccccactctggacttaagaagccag

SEQ ID NO: 41328 - DNA, 601 bp, Human
tcctcacgaggatatttacagcatgacagctccaacgtaatttcaaaacactgggcccagatgtagttgtaatcttgcattccacctaaacacaagcatatttaatttttgttagggtctaaaattggagtggagccaagtatcacgtgcctcggggacaaatgaatcagacagctacatgtaaacaggaaaaaatgaatttgacatattagcttgtaaaatcagggcttgacattctattacccaggcgtgactagacaatcctaaatattcccatatgggtaactggatcagagctgaytgaagttcaactgtgcatcaaaattaagtgacgggtgaaggaagggtccttttttgtttttattttttgaaatcctacattacaaaaatgattctttgaatttcatttctttcttaaattacattttacatggatataagctagaataagattcctttaaaatatttctacaaatcatttataaatacacttactaagcaaagctaagcatgctaatttgggggaatcatgggccaacattcactattgccaggtaccatatgaagtgctttgtatcagctcatttaatcctcacagcaa

SEQ ID NO: 41329 - DNA, 601 bp, Human
tctatgaatgagtgggcactgcatttctcacacactgcagatactcatgcagagagaattcttaaccatcagatctggcactgaaatgaggctataactacaaagcataaataaaggcttgcgtttagtcaacccagaggtcttgccagatgctctattttgtattaatagggaattaataagaaaattttacaaacctaggtgcacctgctttatatattcaattaatgaggctttgttattattccaaaaggatggaagcttctcctcacgaggatatttacagcatgacagctccaaygtaatttcaaaacactgggcccagatgtagttgtaatcttgcattccacctaaacacaagcatatttaatttttgttagggtctaaaattggagtggagccaagtatcacgtgcctcggggacaaatgaatcagacagctacatgtaaacaggaaaaaatgaatttgacatattagcttgtaaaatcagggcttgacattctattacccaggcgtgactagacaatcctaaatattcccatatgggtaactggatcagagctgactgaagttcaactgtgcatcaaaattaagtgacggg

SEQ ID NO: 41330 - DNA, 601 bp, Human
aatatggtttcattattaaaccatgttatgcatctgtcttaaaccacaagggggcagggttgatgtgccaatatatgtattttttgagtgagttgtttgcatctgattatagagacaggcagatacacattctttataaaacctaatgcaaatgggctgggcatggtggctcatgcctgtaatcccagcactctgggaggccgaggccggcggatcacctgaggtcaggagttcaagaccagcctgggcaatatggtgaaaccctgtctctacaaaaatacaaaattagccgggcatgatrgtgggtgtctgtaattccagcaaattgggaggctgagtgggagaatcacatgaacctgggaggcggaggttacagtgagccgagatcatcacaccattgcactccagcctagatgacagagcgagactccgtctcaaaaacaaaaaaacaaaacctagtgcaaatggactggtaagccttccaaattattaaaaataataataggtatactgcaatttatattgccctttccctggcaatattacatcaacatgatacttcaaagcccaccttaattcagtgcttggtaaataatcttta

SEQ ID NO: 41331 - DNA, 601 bp, Human
cattcgtcatcccctaataacccaaagattcactttctttttttttaaattgaagtctccctctgttgcccaggctggagtgcagtggcaccagttcggctcactgcaactttcatctcccgggttcaagcgattctcctgcctcagcaccccaagtagctgggattacaggtgcccaccaccacacctggctaatttttgtatttttagtagagatgggtttcaccacgttggccaggctggtctcgaactcctgatctcaagtgatccgcccaccttggcctcccaaagtgctgggatyacaggcccaaagactcactttcatatgactcttacctaaacctaaagatggttcttccagctatggaagcctggggtatgcgaatatcactgttactgggcaaacacagaccatgcttatgtatggaatttatattcaaaggaaaacccctcccaccagccaaataaaagcgtgctttagcttgtatatgtctttacaatattttgtctacataccaccaaaccttttacttaagagggaagtaattgttttaccagaaaatgtgatttatttctatatgctgaagttgaaacattgaaa

SEQ ID NO: 41332 - DNA, 601 bp, Human
attcagggtactagtaatgagtagttggcagaagacaccaaaaaaaaaaaaaaaaaaaaaaaaagtcatggtaccctttaaaaaaaggcagcaaatttcttcttggctagaagcagttacactttaatagaacagatttgacttttttgacagtcacatgacagtgattttggatggcctcagggacttgaacaacacctacgtatcagtgtgtgctgcagctgaatcaaggctccagtcaacctgcggtctgcctaccctcaaagatagaaaaaggaagaacaatttgcatttgaagaartgtctgaaaatcttcatattccagtttgaccctcattcgtcatcccctaataacccaaagattcactttctttttttttaaattgaagtctccctctgttgcccaggctggagtgcagtggcaccagttcggctcactgcaactttcatctcccgggttcaagcgattctcctgcctcagcaccccaagtagctgggattacaggtgcccaccaccacacctggctaatttttgtatttttagtagagatgggtttcaccacgttggccaggctggtctcgaactcctgatctcaagtga

SEQ ID NO: 41333 - DNA, 601 bp, Human
aaaatccatgcgtttcagcaaggtaacttgtgctggatggtgttgtgtctgttggcatcttttgtattttttgttgacttccccaaaaccaaccaaatcgaagaaaatcaagtgcataaaaaatgaagcagagctatcattgaaactgacattacacaattttttgtttttttttttgagatggaattttgctgttgttgcccaggctgcaatggcgcgatctcagctcactgcaacctctgcctcccgggttcaagcaatctcctgcctcagcctcctaagtagctgggattacaggcaygcaccatcacgcccatcttattttgtatttttagtagagacagggtttctccatgttggtcaggctggtcttgaactcctgacctcaaatgatccgcccgcctcagcctcccaaagtgctgggattacaggcgtgagccatcgcgcccggctaacattacaccattctttaacattggagataatgatgaaatagaattcagggtactagtaatgagtagttggcagaagacaccaaaaaaaaaaaaaaaaaaaaaaaaagtcatggtaccctttaaaaaaaggcagcaaatttcttctt

SEQ ID NO: 41334 - DNA, 601 bp, Human
ggaagaagctatgcatattatttccttttccagggctctgagctagtttacagtcttcatgccacttagaaaatccatgcgtttcagcaaggtaacttgtgctggatggtgttgtgtctgttggcatcttttgtattttttgttgacttccccaaaaccaaccaaatcgaagaaaatcaagtgcataaaaaatgaagcagagctatcattgaaactgacattacacaattttttgtttttttttttgagatggaattttgctgttgttgcccaggctgcaatggcgcgatctcagctcacygcaacctctgcctcccgggttcaagcaatctcctgcctcagcctcctaagtagctgggattacaggcacgcaccatcacgcccatcttattttgtatttttagtagagacagggtttctccatgttggtcaggctggtcttgaactcctgacctcaaatgatccgcccgcctcagcctcccaaagtgctgggattacaggcgtgagccatcgcgcccggctaacattacaccattctttaacattggagataatgatgaaatagaattcagggtactagtaatgagtagttggcagaaga

SEQ ID NO: 41335 - DNA, 601 bp, Human
atatgcaatatttattagctaactcaatgttgtgagttaatattaagtgttagagagggaaaaaacttatttttgatgtaacttaaaatacagtcaaaattactaatctgatttatagcttaaatttgttcgttgttgaatagcccatttatattagtacgtattatcacagtgagagaacacagatgacaacctaagatccattcctgtcacttccaagttatttactcagtcaccaaactgtactacaaccattggtggattccataaaatcctaaataaaaacggtgtcaatgtattrgttacaacaaaatatttacgtgtgcgagggactcaatagttttgtcttgtagtgcaactacatgggaagcaaaattataatcacaaggcttcttggaagcatggaatcgattggccagtaacagcagccaatatttattgagcacttagtatattccaggctctgtactaactaccaaatgagcattttctcattaaattctcatatcagctctgtgtcatcaattattatcatgattttacagatgaaaaaaactaaggctctggcttattaaaataacctcctcaaactcacacagcc

SEQ ID NO: 41336 - DNA, 601 bp, Human
ccaggtaattttttgtatttttagtagagacagggtttcaccacattggccaggctggtcttgaactcctgacctcaagtgatccacctgcctctcagcctcccaaagtgctgagattacagtcatgagccaccacatccaccctcctttaaaagctttgattttacctggttttgttcatatcagcctgaatctttggttaggctttctttttttttttagtggaggaaatgatcaggacaagacaaatgctaaactaactacaggcaatgtctactgagaaatgcttttattatatatrgtggagaagggaaaaaatggggaatgacatttacataaccactcattggtatgtattttacacattcatttcaatgtccagagtcttaccttcaaatattatcctagaactaatatctagggtcaatgtgtactgtgttagtctaactaatgggaaatgaacaattcataactttattctaaaggtgtggcttatttatgaggttgcatataagtttagattcactacagggaaaatcatatttttaaatagaatagaaatatcacagtaaataggaggaaaataaagggcctttttaga

SEQ ID NO: 41337 - DNA, 601 bp, Human
aaaaataagaacaaactaggctttgttgcagctgagtggtctggcaaatttctgtatagaggaatcattgggcatgaaggatttgatactgggatagaatccaattgcccttggaatggaagtagaatatcctttttaagagcactgaagttctgggatttctccggaataatcacctttgtgatgtgtggatcatgtccagggactgtaacctgagaagaaacaagagacaattatatgagtgacttaagatggttcgtggtgcccacactgaaaacactgatatccatcactaaaatgyagcctttgtgcaatgcatgtaacaatctaccagacctctgggccagcaacagatttggtcctgcaggctgagttatccaatgcctgttgacagagaccagcgttgtgaatgctgttgccaagaattacaaaatgaaataaggacagatgggtacctcatctggcaatgtaagtcaagagaaggaagcagcagatgtttctgccaccatccttttcgtggggcagaagggtaaagagataactctttccctttgtcccaagtgtgtatttaacatcctccttggatatcaagattattttc

SEQ ID NO: 41338 - DNA, 601 bp, Human
gtagaaaacaagcttctaggtacataatttgaataagctgacagaatagtaaccttcaccaacttagaaaatatatctggttttgttacttataaatttaacttgtaattattttattctattattgaagtgatattttattttgaagaaagatggaaatgttaaatgtaaaaatgactttgctctagagctgtgtgatatgtgaaataattcagataagatagataatgttcctttgttcattctttcagtaaatatttactgagcacttaactattgccaggcactttgcttggtgctsgggatataacaagatatgtggtatttgccctcataagggttatagtttaatgagggagaaagtcaaatccacgatgtcaagggttggggggatgggaagtagtagataggagaatggtattccaagtagaaggaacagcaggtagagaagtatggaggcatgagatcatagggcgggcatatttagggaactgcagactgttctctgtgactggtgcccaggatggtgaaaataaagctagagagatgggtagaagaaaagtcatgtagggccttgtaggccatattaagagcttggact

SEQ ID NO: 41339 - DNA, 601 bp, Human
ttaggggttaaataatcttagcttcttatgattttggctttatactttctctaaaaatgtattagacttacagtctttgtgtttctaggcagttcctgggaaaatgtccagggaaagcacatgtagtcgtccttttagaggcaagactgggaaatagggcatatatcttccactcatgtattatgagccagaatttagtcacagccatatgtagctttaagagagtatagaatatgtaatccaattaaaatgcagttatagtagaaggagatgttatctgtctgccatgcctctctgcctktgtctctgatctagctgtgttatttcgagctttggtacctttttttcatgcttttgttatcttctaggaatgctgttctccccctaagcctccttgtaaacttttgctcactttacaggtcccaagcgaaatactttcttaatttgtactttaatgcttctaaaagggcagttctgatcatattccttccttcaacagatactgtctgccctcaaggtaaaattccttaacgggacttggaatattcttcaagatctgccactttttccttctgtgggctcatcttttactactttagtc

SEQ ID NO: 41340 - DNA, 601 bp, Human
ttggacgcataggttctttagcacagtgttagagtgctgttttgcaaccagataaggagcttgctgaagaatgtcaatcaatattgtgcttccttcactgaggccctcttgctatgaaaatgtcaattggactgaacagtatgcttagagacttagtcaaccagttgcaaatactcttaagtaggactgatttagaagtttatcctacagtagtaaccatactgttatatttttgtgcctattatgtttttcttattttcttgagattaattatcaggaatgggattaataatcaaaatgygcaaacgttttcgtggttcttgatatgtacgtcttggctatttaaagtgatttcctttaattgattttagttttaattatatatctagatagagactagagaatctgttgagacaactactatttatttttattcttttttttgtcaccaaatgtatttattttgcccgaaagtggaggcagacaattgctacaatattatttattgcagatgcataaagtttccagaaaaatcaacgtttttaatcgactccttttaaatgacttatttatttttagagttatagaaacagcaaattta

SEQ ID NO: 41341 - DNA, 601 bp, Human
atctgtagatcaattaggggagccattttaacaatattaaacttctgatccatgaacatgggctttctttctattcatttaggttttctttaattttttccaacaatgttttgtagttttcagtgtgcaagtcttacatgacaaagactctgcttcaccaaattttagacaagctcctctgagcactctgttaaactaggtctcatcctcgggctctgtccttggcctgcctaaggaagtcttagcaaagaatcctgctaataccccacccttgatcaagttccttgtcccctatatttgwtatataagtccggccagcttttagcaggaatcctgttaggccagtttagagagaatccccttgcccttgatgcctcctcttagtaattttccatcctctgaccccctcactctgttcattggccacaaatccccactggtcttggttgtgttaggagttgagctcaatctctcccctccattgtgatagccttgacccctattgcagtaatctcaaaatctgccttaccattttttaaccagtgtcagaataatttttctttaacaatatctcttctaacatccttcttgccttgttcct

SEQ ID NO: 41342 - DNA, 601 bp, Human
gatattagttcttctctgtaagtttcatggagttctccagtgaagccagctgattctgggcattgttttggttttgttgggagactttattactgattatactttattactgattcaatcccattactcattactggcctgttcaggttttctatttctttctgattcagtcttggtaggttgcatgtgtcctgggatttatccatttcttctgggttttcaagtttattagcatatagttgttaatagtatttctatggtcacttcttccaatttttagatttgctttaatatgcaaggrctttttcttgaggatatatctatggtgttggttgggcagggcacttagactttgattatgggtacattcagtagtgtagtctgtataatttcttcagctataaacagcatcatcaaccatgtctgtatttttcttagtggcttagggtgtagttgttatggaggctgtggtgaagttttgatgggcatggggatttcaggtgggctagtccttgttttcgagtggtgtcaccagtgggtgaagcatgcctgtcctttggccccaggacagtgtattcattaagttatattacttttttaa

SEQ ID NO: 41343 - DNA, 601 bp, Human
aaacaaaaaaaaaaaaaaaataggtgtgattgggtgcacctgtagtcctagctacttggggggctgaagatggagaattgcttgaacccaggaattcagagctgcagagagctatgatcacaccactgcattccaggctgggttacagaggggtgacctccatctcaaaaaaaaaaaaattttttttcttttaattcttttttattttttattttttttataaatatatatattttttattatactttaagttctagggtacatgtgcacaacgtgcaggtttgttacatatgtaaacatrtgccgtgttggtgtgctgcacccattaactcatcatttacattaggtatatctccaaatgctatcccttccccctcccaccaccccacaacaggccccggtgtgtgatgttccccttcctgtgtccaggtgttctcattgttcagttcccacctatgagtgagaacatgtggtgtttggttttttgtccttgcagtagtttgctgagaatgatggtttccagcttcatccatgtccctgcaaaggacatgaactcatccttttttacggctgcgtagtatttcatagtgtatacgtgcca

SEQ ID NO: 41344 - DNA, 601 bp, Human
atactgagaaattgatgatgcaaaagaaaatggatagcagaaggaatgaagttctatgggttttggccctcacaaaagtaaatacatatcttcctacagaaatcaaacaggtttttatggctcaaagccccggaattatacggggcagaataggcgaatgtgcttgcagtcagctggctttaaaagagcctttcttattggaagtatagagaggaaaattcttttccactagcgggaagaaccacttctggtgctcaacatcatgtgcattgctgcagtggagaagaaaaaagagggaagygttttcattgggctcatactgcttatgataggcctggcagagtcttgcttttggcaactattgagtatgaatggccagtctctacttgtaaagagaggtcattggacttaaatggaattaatggaagtaaaatgttctcaggttgttactgcaaatcattcatgtagtcagtgccaggggttaaacaattctcgcctcttttctagtctgtcaccttcaaaactaccagcagaaatcttgctcgagccatgtgtatgaagaacctcaagctcactattatcatcatcatcgtatcaattg

SEQ ID NO: 41345 - DNA, 601 bp, Human
acatagtgacaccctatctctacaaaaataaaaaataaaaaataaataaaataaagtgactaatgcagtgaacctaatgtttaaaatctattttttgtgatataataatgtgaacaagtagtgacttttataatataatttaaaattataatctagaattaaaaagcaaacacatctgtaatagcaccagtatttttgcagtgttacttacatcatctgcttttcattgttttggtcatcgtaattattgtgtcattatccactgaacagttcgtagcagtgttcttgctcataagtgatrtagatgaaagccttctactcaggcttttaaaatatattcttatattaatcaaaaataaaattcatgtgcaaaacctaaaaatataattaatgaaaccatacttcaggagaattatggttatttgtgatttttttatgacttgttaatgacacatcagtatgagttgctcatttagccttgattctgccgagttaccagtgaagagcaacaaccccactgctttctctcccactgaaggaaacgctagagttcaagtgggtgtgagttataccaaaaacgacaatgttaactacacttctg

SEQ ID NO: 41346 - DNA, 601 bp, Human
ggaagcacaagaagcgtctaaacgcagtcaggaacacagggatagggacggggagaaccaggggcagaaaaagtaggccgagacttgagccacgaggtcctctggagtccacctgcctccccacgagccttgggccgggcggcagctcagaaacagcctctggatttcagcaccgacactcagatggcatgttggggtcatcaccgccccgcccggcccgtaggcccccggccacactacgaaggagaaggcaaaagatattttaaaagtttccaactctccaaccctcctagcagctgcsagctgatgtacacgtaggttctcatctgcaatgtggttcgcccgggttgaggcctaggctcgggtccgcacgccccaattcacaatggggcagagaagtctgtcagtccccgccaactcgcgcgccaccggcctgccacaccacacgcggaattccctacacgacacgcggaatcccccagccctgcaatctcgggtcctgaaatctaccttagtccgtacctcgagaggcggagaggatcatgtccgggaactgcggggtagtagcgatctgggttacccagccgttgtggcccttgag

SEQ ID NO: 41347 - DNA, 601 bp, Human
aaaagtcagacaattcttaacagtgtagcagcaaagcggaagcacaagaagcgtctaaacgcagtcaggaacacagggatagggacggggagaaccaggggcagaaaaagtaggccgagacttgagccacgaggtcctctggagtccacctgcctccccacgagccttgggccgggcggcagctcagaaacagcctctggatttcagcaccgacactcagatggcatgttggggtcatcaccgccccgcccggcccgtaggcccccggccacactacgaaggagaaggcaaaagatatttkaaaagtttccaactctccaaccctcctagcagctgcgagctgatgtacacgtaggttctcatctgcaatgtggttcgcccgggttgaggcctaggctcgggtccgcacgccccaattcacaatggggcagagaagtctgtcagtccccgccaactcgcgcgccaccggcctgccacaccacacgcggaattccctacacgacacgcggaatcccccagccctgcaatctcgggtcctgaaatctaccttagtccgtacctcgagaggcggagaggatcatgtccgggaactgcggggtag

SEQ ID NO: 41348 - DNA, 601 bp, Human
aaccaaatgcacagcagtttgtggctgtagagtagctggggcctcctatgcctacctctgagggccgacagaaatgtagtaatgaatgctggaaaagccacttcaggcgctacaggattggatgcttttactgaaacctgtcccactcaacaaattttacgattaacagccagacatgattcaaaagtcagacaattcttaacagtgtagcagcaaagcggaagcacaagaagcgtctaaacgcagtcaggaacacagggatagggacggggagaaccaggggcagaaaaagtaggccgasacttgagccacgaggtcctctggagtccacctgcctccccacgagccttgggccgggcggcagctcagaaacagcctctggatttcagcaccgacactcagatggcatgttggggtcatcaccgccccgcccggcccgtaggcccccggccacactacgaaggagaaggcaaaagatattttaaaagtttccaactctccaaccctcctagcagctgcgagctgatgtacacgtaggttctcatctgcaatgtggttcgcccgggttgaggcctaggctcgggtccgcacgccccaattc

SEQ ID NO: 41349 - DNA, 601 bp, Human
gtgatccactcgcctctgccttccaaagtgctgggattataggcgtgagccaccgcgcccagcctgtatcctgagaacttaatttaggtgccagaaatacagacaccctttcctgaaactcagacgaactcaacagccactttgtgtcttctctgcaaccaaatgcacagcagtttgtggctgtagagtagctggggcctcctatgcctacctctgagggccgacagaaatgtagtaatgaatgctggaaaagccacttcaggcgctacaggattggatgcttttactgaaacctgtcccmctcaacaaattttacgattaacagccagacatgattcaaaagtcagacaattcttaacagtgtagcagcaaagcggaagcacaagaagcgtctaaacgcagtcaggaacacagggatagggacggggagaaccaggggcagaaaaagtaggccgagacttgagccacgaggtcctctggagtccacctgcctccccacgagccttgggccgggcggcagctcagaaacagcctctggatttcagcaccgacactcagatggcatgttggggtcatcaccgccccgcccggcccgtaggcc

SEQ ID NO: 41350 - DNA, 601 bp, Human
tcccaaatggactggatctcccctgggaaaccagccaattgcatccacctcacttctgcccagattcttcccaaggccccagagctaagtgagcagctacttgcgttgtgagatcccagaggcgcagggttccatcccaggagcctgagagggcaaactggccatctgaggagataaccacatcactaacaaagtgggagtgaccccgcagagcacgctgtggaattccatagttggtctcatccctggtcagtttccacatgatgatggtcttatctaaaggaggtaaaacagaagaaaratcagtgaggaacccgcagcccgtttaacacactggataattcactaagtgtcaaggtcatgagtgggttaacaacaactaaggacgcttaaggagggatggaaacaacagacaagagcagttacagaccaggactgagtggctctattccagactaaaaacgcacgtagaggtaaactgtaccctgataacttttttttttcttgagatggagtctcgctctgtcgcccaggctggagtgcagtggcatgatctcggctcactccaaactccacctcccgtgttcaagcaattctcccg

SEQ ID NO: 41351 - DNA, 601 bp, Human
atgtcctcactcccacttggggattggctgacaatgccatctgtcatcaccaggaccctctaattccacctgccaattacctgagctttcaaggtaaaacatgttcaaactgctgcccactcagaacttttgcacctggcaaaaatgttcagccacactcctcagcaatgctgagtaacttatttaaagtgagggaggccaaacatcttctgtaggtgtgctctgctttccagttcccaaatggactggatctcccctgggaaaccagccaattgcatccacctcacttctgcccagattyttcccaaggccccagagctaagtgagcagctacttgcgttgtgagatcccagaggcgcagggttccatcccaggagcctgagagggcaaactggccatctgaggagataaccacatcactaacaaagtgggagtgaccccgcagagcacgctgtggaattccatagttggtctcatccctggtcagtttccacatgatgatggtcttatctaaaggaggtaaaacagaagaaaaatcagtgaggaacccgcagcccgtttaacacactggataattcactaagtgtcaaggtcatgagtg

SEQ ID NO: 41352 - DNA, 601 bp, Human
tcagacttagcaaacactctcattcaacggtcagactcatttcctgggctttgtctctgtctcattgcatcactcatacaaccctggatttggctctgatcacagagtcaagtgactgagtatatgaaagagaagagccaagtgacagagaatcccttcagaattgcaggacatgtcctcactcccacttggggattggctgacaatgccatctgtcatcaccaggaccctctaattccacctgccaattacctgagctttcaaggtaaaacatgttcaaactgctgcccactcagaactkttgcacctggcaaaaatgttcagccacactcctcagcaatgctgagtaacttatttaaagtgagggaggccaaacatcttctgtaggtgtgctctgctttccagttcccaaatggactggatctcccctgggaaaccagccaattgcatccacctcacttctgcccagattcttcccaaggccccagagctaagtgagcagctacttgcgttgtgagatcccagaggcgcagggttccatcccaggagcctgagagggcaaactggccatctgaggagataaccacatcactaacaaagt

SEQ ID NO: 41353 - DNA, 601 bp, Human
gagctgcggcaactccctttcaccttttcaccgccccccacccatccccaaatccccgatccagcccccaatctgcgatcccaaatctgcgatctagcccagaatccatctcaaaaaagaaaaaaaataaataaaattttgtttaaatagatggggtctcactatgttggccaggctgctctcctgtcctcaagcagtcctcccaccttggcctaccagagagctaggattacaggcgtgagcccagcccagacaagactttaaaaaggcaaagaaagcgggggacggtggctcacgcttrtaatcccagcactttgggaggctgaggcgggcagatcacctgaggttgggagttcaagaccagcctgaccaacatggagaaaccctgtctctactaaaaatacaaaaccgggcatggtggcgcatgcctctaatcccagctacttgggaggctgaggcaggagaactgcttgaacccaggaggcggaggttgtggtcagccgagatcacgccattgtacttcagcctggggaacaagcgaaactgtctccgagaaaaaaaaaaaaaaaggcaaagataggcaggtgggggctcacgcctg

SEQ ID NO: 41354 - DNA, 601 bp, Human
tggccaacatggtgaaaccccatctctactaaaaatacaaaaattagctgggcatgatggcacacgcctgtaatcttctcagacacccaaccatcggcttctgagctgcggcaactccctttcaccttttcaccgccccccacccatccccaaatccccgatccagcccccaatctgcgatcccaaatctgcgatctagcccagaatccatctcaaaaaagaaaaaaaataaataaaattttgtttaaatagatggggtctcactatgttggccaggctgctctcctgtcctcaagcagtyctcccaccttggcctaccagagagctaggattacaggcgtgagcccagcccagacaagactttaaaaaggcaaagaaagcgggggacggtggctcacgcttataatcccagcactttgggaggctgaggcgggcagatcacctgaggttgggagttcaagaccagcctgaccaacatggagaaaccctgtctctactaaaaatacaaaaccgggcatggtggcgcatgcctctaatcccagctacttgggaggctgaggcaggagaactgcttgaacccaggaggcggaggttgtggtca

SEQ ID NO: 41355 - DNA, 601 bp, Human
tttttaaaaatttagagatggtggctggacgcagaagctcacgcctctaatcccagggagggcgaggtaagtggatcacctgaggtcaggagtttgagaccagcctggccaaaatggtgaaaccctgtctctaccaaaaatacaaaaattaaccaggtgtggcggcgggtgcctgtaatcccagctactggggaggctcaggcaggaacactgcttaaacccaggaagcgaagggtgcaatgagccaagattgtgccattgcactccagcctgggcaacgaacaagtgaaacttcatctcmaaaaaaaatataataataataatagggcctggtgtggtggctcacgcctgtaatcccagcactttaggaagccaaggtggatggatcatgaggtcaggagatcaagaccatcttggctaacatggtgaaaccctgtctctactaaaaatacaaaaaattagccagacctgatggcaggcgcctgtagtcccagcgactcgggaggctgaggcaggagaatggcgtgaacccgggaagcagagcttgcagtgagccgagatcgcactactgcactccagcctgggcgacagaatgagactg

SEQ ID NO: 41356 - DNA, 601 bp, Human
tgacgctcaccttgaccagcttgtcccagccacaggagacgatgatagggttgctgctgttgggcgagaagcggacacaagacacccactctgagtggctctcatcctacagaagatggaaaggaaattagggcaaacagtcctatcccatgaaatgctagacctcccagccctacccctcagtaggatgatggctggcagcacctttcaaaaaccaagaacccaaacctttaagctcaatagaatccctttagattccagacaagaaaattttttaaaaatttagagatggtggctggaygcagaagctcacgcctctaatcccagggagggcgaggtaagtggatcacctgaggtcaggagtttgagaccagcctggccaaaatggtgaaaccctgtctctaccaaaaatacaaaaattaaccaggtgtggcggcgggtgcctgtaatcccagctactggggaggctcaggcaggaacactgcttaaacccaggaagcgaagggtgcaatgagccaagattgtgccattgcactccagcctgggcaacgaacaagtgaaacttcatctccaaaaaaaatataataataataatagggcc

SEQ ID NO: 41357 - DNA, 601 bp, Human
atgtttgccattttacgttagagacgctggctaagtgctccttccatgacgctgtcttccactgagtaggagacgccttgtccccaaataccttgcctccagaagcacagagggatccatctggagagacagtcaccgtgttcagatagcctgtgtggccaatgtggttggtcttcagcttgcagttagccaggttccatacctgcatagacgtgcggttgacaggtgaacatcctagctcttgatgagctagggtcaggcccaacaaaaaagggcttggcacttctggatacggtagccrtttctcattcagtaacatgtcctggccacttcacgttagattataacacatatccaatgcagtgtgctgacttacaagggacatcagaccatgtgacaagagaaagagtcaactgagggcatctgcaaagctttccacaggacttggagtgtatgaccacctgggagcacaccctgactggtaaagcccctgccttggcttgacgctcaccttgaccagcttgtcccagccacaggagacgatgatagggttgctgctgttgggcgagaagcggacacaagacacccactctgagtggct

SEQ ID NO: 41358 - DNA, 601 bp, Human
tattttatggctacaagtttaaaatcatgacaaggattctcagcagtcttcctccatttagtacatttaacaacatgaacacatgacaacattaatccaatctatgggaaggctgcaaaatgccactgtgaaccaaacatttgtctctactttcagaaggaattccttatccttaaatggttactattaaaaaacatttctgaagtaattattggcacagcatagagaaaatggaaccgatgaccttgggaacaaaacatctgaaccaagattcctagggtcaaaaccactacagcactayagatttgatatctgtaaagtaagggactgagctaaatcagatatcctcagccagagataggcatcaagattacccatgaggcattctaaaaaaaaaaaaaacaacactgctctgccttcctcccaacttactgaagtagctactcttccatgtgttttttaaaacgctctataagagattttgaagtacattattaagaacctgtggataatatagtttcttaagtttatttctagcccccccaatccatttgtgtaatctaatcatagtcaaaatgtactaaaccaccaccagtttaat

SEQ ID NO: 41359 - DNA, 601 bp, Human
tgatctcggctcactacaacctccgcctcacaggctcaagagattcttgtgccttcagcctcccaagtagctggggttacacacatgcaccaccacgaccagctaatttttgtaattttagtagagacagagttttaccatgttgcccaggctggtctcgaactcctggtctcaagtgatccgcccaccttcgcctcccaaagtgctgggattacaggtgtgagccaccacacccggcccagtttatgttcttcaaatcagcctgagatatctcaaacaggcaataggttgtttttttttktttgtttgtttgttttgagacggagtctcgctctgtcacccaggctggagtgcagtggcgtgatctcggctcactgcaacctctgctgcctgggttcaagtgattctcctgcctcagcctccagagtagctgggcttgcagatgcctgccactgcacctaatttttttgtagtttttagtagagatggggtttcatcatcttggccatgttggtcttgaattcctgacctcatgatccacccacctcagcctcctaaagtgctgggattacaggcgtgagccactgcacccggcctgcaa

SEQ ID NO: 41360 - DNA, 601 bp, Human
cgtgggctctgcgcgtctgcttgggggagggcctttggggtgcttcagggggcgccgggacgggcgccgtgcttgggtcgcccgggaagggttgtgagattgagcccccgaggccgccgcgctgtgcaggcgtccttcccgcaggttccgggtccccagcccaggacaggcgtgaccgagttgccgggtcagttggtctccctggagtgcccaagctgaatccacagggcccagctgccttgcttcttgttccttctgcgagctggtattgagcgcctgccacgagccaggccttccctgstgaagatcacggaatgcccacccagggaagggaggcctggaggcctccgggagagcccaagaggtggcccagggagaacagagtgttcctggccgtcttgcctctcctagggtgtgacagcccactccctggacactgccctgaggaaagcgccagctcttgctggagccacaacactgccagagctcccttctcacctcctgcaggaagccctccctgacctcctgccaggccggggcagggtttccctgagcgtcccccaaccatcacagctcaggccacctcgagagactccctttt

SEQ ID NO: 41361 - DNA, 601 bp, Human
gcgtgaccgagttgccgggtcagttggtctccctggagtgcccaagctgaatccacagggcccagctgccttgcttcttgttccttctgcgagctggtattgagcgcctgccacgagccaggccttccctggtgaagatcacggaatgcccacccagggaagggaggcctggaggcctccgggagagcccaagaggtggcccagggagaacagagtgttcctggccgtcttgcctctcctagggtgtgacagcccactccctggacactgccctgaggaaagcgccagctcttgctggagycacaacactgccagagctcccttctcacctcctgcaggaagccctccctgacctcctgccaggccggggcagggtttccctgagcgtcccccaaccatcacagctcaggccacctcgagagactccctttttagacagaagccctggtgcagagctgcctttgagagtaagctgaggcctgtcaggtttctaccagcccagttacagatgggctgctcagctcagagagaggggtggtgactcccctaggaacacacagctaagaagtggtcccttaaaagacagacccaggtctgcact

SEQ ID NO: 41362 - DNA, 601 bp, Human
gccaggccttccctggtgaagatcacggaatgcccacccagggaagggaggcctggaggcctccgggagagcccaagaggtggcccagggagaacagagtgttcctggccgtcttgcctctcctagggtgtgacagcccactccctggacactgccctgaggaaagcgccagctcttgctggagccacaacactgccagagctcccttctcacctcctgcaggaagccctccctgacctcctgccaggccggggcagggtttccctgagcgtcccccaaccatcacagctcaggccacctsgagagactccctttttagacagaagccctggtgcagagctgcctttgagagtaagctgaggcctgtcaggtttctaccagcccagttacagatgggctgctcagctcagagagaggggtggtgactcccctaggaacacacagctaagaagtggtcccttaaaagacagacccaggtctgcactctgacctggaagcagctccgggtaggtgatgggtaacattccttaaatggtgcatgtcactggcctttcagctgggagccaaccaggtaccccttgccaccggccaaccctggccc

SEQ ID NO: 41363 - DNA, 601 bp, Human
aggcctagactcccgaggcttcctctttggcccctccctggcccaggagcttggactgggctgcgtgctcatccgaaagcgggggaagctgccaggccccactctgtgggcctcctattccctggagtacgggaaggtaagagggctggggtggccagaggaagggcagggccaggccaccgtggccactctcccccagttctaaaaggccttcccaggcgtgtcaagtggagctgctgtggttacagtggccttgggagctcagagaggttgagacataggctgggctcacacagccagstaacagcaaggtggggttggagtcagggtctagggtggcagctgccaagctgtgcaacaaagctgttttctgcgggaggctgaggaccacacaccacttcccactccaggctgagctggagattcagaaagacgccctggagccaggacagagggtggtcgtcgtggatgatctgctggccactggtggtaagggtctccccgcagccaactgctgtggctccaagggcctggtgggagtgggacaggacctcgctgtgtgacatgggatgcagcttactgttgtccagagggtgcctgg

SEQ ID NO: 41364 - DNA, 601 bp, Human
ctcccgaggcttcctctttggcccctccctggcccaggagcttggactgggctgcgtgctcatccgaaagcgggggaagctgccaggccccactctgtgggcctcctattccctggagtacgggaaggtaagagggctggggtggccagaggaagggcagggccaggccaccgtggccactctcccccagttctaaaaggccttcccaggcgtgtcaagtggagctgctgtggttacagtggccttgggagctcagagaggttgagacataggctgggctcacacagccaggtaacagcarggtggggttggagtcagggtctagggtggcagctgccaagctgtgcaacaaagctgttttctgcgggaggctgaggaccacacaccacttcccactccaggctgagctggagattcagaaagacgccctggagccaggacagagggtggtcgtcgtggatgatctgctggccactggtggtaagggtctccccgcagccaactgctgtggctccaagggcctggtgggagtgggacaggacctcgctgtgtgacatgggatgcagcttactgttgtccagagggtgcctggtggccaggc

SEQ ID NO: 41365 - DNA, 601 bp, Human
aagagcttaataaacagcgggcactttcaataactaatgacaatcaatatttctaagaaacttggggaattggggctgacaaagcattttccctcccagaccttgggaatgtggttgtagaattactgggctggaaggggctttctaggtcctctggagaggggcagtgtggggtccaaggacacagagccaggtgtggcacagctgcagccaaaccaaagttgtttacttctttgaaaaaatatttttcattttgttcattacaaaatctacacgccctgctaagggcgctcttagagamcatggaacggagcagtgctctcaccggagacatggcactgccatttttggggtatttcctttctgtgtttccagtcctccttccactagagcaggctgtaatttactatttatgtttccttcataaatatgttatcagccaggggcaccaggccgtccttaggagcagtctcttgctgagcgtcacagaaccacctgctcctgaatcagtgagggaaacaccttaccaccgttcaaacccttgtccctatcaactgattccgactctcttggaggagagccagaaatctgcctttttaac

SEQ ID NO: 41366 - DNA, 601 bp, Human
cagtttcataaagagcaagagccagtgcccctgccatgcctggcctccccacccggcccgcacctacctctctctccaatgacacctgcctctccctttggccctggggccccgggcagccccgggcagcctcggagaatggtgagcttgtcagagccctccaggcccaccaccttcacctctgcagagaaacacaggtgcccactcagtgcctggcccaacagtggctgggaagtgaggttttctgctctgctggggccttggtctgtcctcacccctcaggcactggtgaggcggagawgtgatggggggcagagctctggctttggaggccaccccgacctaggggagccccatctcctcagtgctgtgtgtcctgcagcaagtaacttaactcctctgagctttgtgccctgggctgccaagcggggataataacaaggttgcggccaggatttggttaaagaatgtgcattttaaatctcttattgtaatttatggcatttagaaagagcttaataaacagcgggcactttcaataactaatgacaatcaatatttctaagaaacttggggaattggggctgacaaagcattttcc

SEQ ID NO: 41367 - DNA, 601 bp, Human
gctgccagggaggatccggttccaccgtgcgcctgagctcctggggtgtcacacagcgctccacgtggttctggccagaaaggtgaccctcccgtccccgatgccagccaagaggcagcccccagcccgctcgctgaccccagtggctggggagagtgtatgggggctggttcttgctttagggtatattagccagccatgcccactggtagaagcctggttcaagggaagtctgagccagacttgattcttctcctgccagggaaggtcttcctccccagtgttccctcagcaggggatygggaccgcactctcaggtccagcctgcggagtgggcacagaggacctggccccggacacccacacggaagcctagacacgtcagtgaaagtccaagtcatagggacatttgagcttgtcccatctacactgggacatccccaccaagtgctccgcaggcatcatcttgaatgcgtccaggcatggggagctcaccccctaaggcagcgccctttctgagtttttgtgcacgtctgccttatgccatgcttagggggacccaaaaccacccaaggcaggtgcctgctgttcattctcccat

SEQ ID NO: 41368 - DNA, 601 bp, Human
tgccgtgtctctctgtgtctgtgtctgtgtctctgtctctgtctctccctccctcatttcattacagacagctccaaggtccctgctcaaggcctcctcgctgtctgtcccctggttacctttgggccccactggtcctgcctttccaggggctccagggagaccgcgttctcctgaaaattccaaagacatatcactgagaaaaatgcaacctaaacaattctccctggaaatctttgccccaagtggttaagtcctgaccctcccccactctgccttgaaccccttctggttccaggarctctcagaattgctagccatggatttagcctgggggtgactgcagatggaggtgagggattgagggaggggcctgcaccccaccttgggctcaaggcaaggtgcaccttgctcctgtttgtgccttgggagcaacctgggtttcacactctgttgaccataagcctggacccaagtcacccacacagagctctactgcctagcaagggaccaggttctggaacaaagaatgcgtcctcagagagcctcatcctaccacatccccacacggagagggtgggcgccacgtgcagccgctgct

SEQ ID NO: 41369 - DNA, 601 bp, Human
acaaagcctgcagagacaactgcctgggcccacgggtggctcacctttctctccacgcatccccttctctcctcggtctcctggaggaagaggcaggataatgagcttttgaccccagatgtgtgggccacggaaaggctggtccagagtgggctcccggcctggacactgcatctccccagccctgcaggctcactaaggcatcacaacgcccaggtctcaatggtggggaggggccccgaggcctggaatatcccagggtccctgtccgcctgccactgtctttctctctctgttgccrtgtctctctgtgtctgtgtctgtgtctctgtctctgtctctccctccctcatttcattacagacagctccaaggtccctgctcaaggcctcctcgctgtctgtcccctggttacctttgggccccactggtcctgcctttccaggggctccagggagaccgcgttctcctgaaaattccaaagacatatcactgagaaaaatgcaacctaaacaattctccctggaaatctttgccccaagtggttaagtcctgaccctcccccactctgccttgaaccccttctggttccaggagctct

SEQ ID NO: 41370 - DNA, 601 bp, Human
tgtagacaccagggtttgagccctcgtggattctgacaacaaagcccgctggactccttccacccctccctgcccacagcctggattgacagggacgtgggcggtgggcaggcggactgaggcctctgagacccctcccctggacaaagcctgcagagacaactgcctgggcccacgggtggctcacctttctctccacgcatccccttctctcctcggtctcctggaggaagaggcaggataatgagcttttgaccccagatgtgtgggccacggaaaggctggtccagagtgggctccyggcctggacactgcatctccccagccctgcaggctcactaaggcatcacaacgcccaggtctcaatggtggggaggggccccgaggcctggaatatcccagggtccctgtccgcctgccactgtctttctctctctgttgccgtgtctctctgtgtctgtgtctgtgtctctgtctctgtctctccctccctcatttcattacagacagctccaaggtccctgctcaaggcctcctcgctgtctgtcccctggttacctttgggccccactggtcctgcctttccaggggctccagggag

SEQ ID NO: 41371 - DNA, 601 bp, Human
gagtgactgctgtagacaccagggtttgagccctcgtggattctgacaacaaagcccgctggactccttccacccctccctgcccacagcctggattgacagggacgtgggcggtgggcaggcggactgaggcctctgagacccctcccctggacaaagcctgcagagacaactgcctgggcccacgggtggctcacctttctctccacgcatccccttctctcctcggtctcctggaggaagaggcaggataatgagcttttgaccccagatgtgtgggccacggaaaggctggtccagrgtgggctcccggcctggacactgcatctccccagccctgcaggctcactaaggcatcacaacgcccaggtctcaatggtggggaggggccccgaggcctggaatatcccagggtccctgtccgcctgccactgtctttctctctctgttgccgtgtctctctgtgtctgtgtctgtgtctctgtctctgtctctccctccctcatttcattacagacagctccaaggtccctgctcaaggcctcctcgctgtctgtcccctggttacctttgggccccactggtcctgcctttccagggg

SEQ ID NO: 41372 - DNA, 601 bp, Human
ctgggagtgactgctgtagacaccagggtttgagccctcgtggattctgacaacaaagcccgctggactccttccacccctccctgcccacagcctggattgacagggacgtgggcggtgggcaggcggactgaggcctctgagacccctcccctggacaaagcctgcagagacaactgcctgggcccacgggtggctcacctttctctccacgcatccccttctctcctcggtctcctggaggaagaggcaggataatgagcttttgaccccagatgtgtgggccacggaaaggctggtccagagtgggctcccggcctggacactgcatctccccagccctgcaggctcactaaggcatcacaacgcccaggtctcaatggtggggaggggccccgaggcctggaatatcccagggtccctgtccgcctgccactgtctttctctctctgttgccgtgtctctctgtgtctgtgtctgtgtctctgtctctgtctctccctccctcatttcattacagacagctccaaggtccctgctcaaggcctcctcgctgtctgtcccctggttacctttgggccccactggtcctgcctttcca

SEQ ID NO: 41373 - DNA, 601 bp, Human
tccagaggagcagcatttgtagttggcagagcatcacaggccggtgccacacgcacgcccatctggtctcctcacagactccacaggatgaaagaggaaatgcggtctcagagaagagaggcaacaagccccaagccacacagcaggagagcaccggtcccctcccagcctccccgatggcctggacttttacccacgggtcacttcccccatcatctatgattgtccccatccaggggaatagagaattccagagtgtgttctacaaccaggtgtgcagcctggcctccgggactcccasgctgaccgcctctgcccagccccacactcacggtccagccccctccgtccgtgtccatgtcacagagcacagtcaggggccggcagtcgggcaggtagatggtgtgccagccgctcaggaaatacccccggtctagcaggtccttgcagttgcgtgggcctgggaagggaacccggggaatggctgcaggacgggggccctgggcaggacaggggcagtgggagggaggcccaggagggaggaggagggccacaggcttctgtgcggaccgagcaggactccgaggcctggacagggaca

SEQ ID NO: 41374 - DNA, 601 bp, Human
aaaacctgtgaagaagccaggatacagagttaggcggggcaggccgaggtcccacagcaccggggacccgccctccagaggagcagcatttgtagttggcagagcatcacaggccggtgccacacgcacgcccatctggtctcctcacagactccacaggatgaaagaggaaatgcggtctcagagaagagaggcaacaagccccaagccacacagcaggagagcaccggtcccctcccagcctccccgatggcctggacttttacccacgggtcacttcccccatcatctatgattgtcyccatccaggggaatagagaattccagagtgtgttctacaaccaggtgtgcagcctggcctccgggactcccaggctgaccgcctctgcccagccccacactcacggtccagccccctccgtccgtgtccatgtcacagagcacagtcaggggccggcagtcgggcaggtagatggtgtgccagccgctcaggaaatacccccggtctagcaggtccttgcagttgcgtgggcctgggaagggaacccggggaatggctgcaggacgggggccctgggcaggacaggggcagtgggaggga

SEQ ID NO: 41375 - DNA, 601 bp, Human
tctctctcctgcttcccactctcaggatctaagatgccagtaggaccaagacctgaagaggccttcagcccagggctctaaccgtttcccttcccgatgttgccagagcctgcggcaggggacgcagcccttagaggtcccagtgccacctgagtgtgctcagggcccaatcccctgtgggccaagaggtgcttatgttgcagatggcccaggcctaaggggcaggagcacctcagggccccccaacccctgagccacggcagtggccctaccctgggcagtcagggcgtggatgttgtcrttccccagccagaactcccccagctgactgccgaagccctgcttgtatgcggcccagtcccgatagaagtccacagagccatccatcctccgctggaaaacctgtgaagaagccaggatacagagttaggcggggcaggccgaggtcccacagcaccggggacccgccctccagaggagcagcatttgtagttggcagagcatcacaggccggtgccacacgcacgcccatctggtctcctcacagactccacaggatgaaagaggaaatgcggtctcagagaagagaggcaacaagccc

SEQ ID NO: 41376 - DNA, 601 bp, Human
atcaggccctcagggatggctttctgtttctaaacacctttcccgttatttcagagaactgaacatgccccactggagttcactgggtggaagggagcattctttcattttgaaagtgtaccttctccttctaagggttggtgagccactaacacagcagtgggcgaagctctaattgtagtttcttttgcaggaatttgaggcacctgagtggattccttcaatcatgccacagggcagtgggcagggataatggaccagcaattatacagactgcctcaggaccagctgtgaaactcatcccctgccccagagggttggggggaggccctctcactcaggtgagtgcggctgtggggggcctgctgaggcgtgggctggaggaggcgagcgtgggctctccatgggactaagatgccagcttcagaggcagatcaacagctggagatgggggaaggctaccccaagccccagtggtctctctcctgcttcccactctcaggatctaagatgccagtaggaccaagacctgaagaggccttcagcccagggctctaaccgtttcccttcccgatgttgccagagcctgcggcaggggacg

SEQ ID NO: 41377 - DNA, 601 bp, Human
agcaaactggtggttgccctcaaagtccaccaggtctacacggagctcgctgcttcctgttggaaaaagattttaaggccccagcctttaagatctttctgtcaccaggcatgagggctggggatgggtaatttttttttttttttttttgagacagagttccgctcttgttgcccaggctggagtgcaatggcaccatctcagctcactgcaacctccgcctcctgggttcaagcaattctcctgcctcagcctccccagtagctgggattacaggtgtgtgccaccacacacagctactttttttttttttgtatttttagtagagatggggtttcaccatgttggtcaggatggtctcgatctcttcacctcatgatccaccagcctcagcctcccaaaatgctgggattacaggtgtgagccacggtgcccggctggggatggatatattcttaagggatgtctgaacgtggcatccaggaaaaaaatcaaccggaaatgtcagaaaatcccttgttgctatcaggccctcagggatggctttctgtttctaaacacctttcccgttatttcagagaactgaacatgccccactgga

SEQ ID NO: 41378 - DNA, 601 bp, Human
ggagggcccaaggtcaccaggggagacagagccaggttctctctgctttccaagccccactcaggccaccagccccaagcagacactcacccgcactgcccccgacaaaggctcccagtaccagcttgtacttctctgcctcgtcagccaccttgaatgatttgtacttagcaaactggtggttgccctcaaagtccaccaggtctacacggagctcgctgcttcctgttggaaaaagattttaaggccccagcctttaagatctttctgtcaccaggcatgagggctggggatgggtaatttttttttttttttttttgagacagagttccgctcttgttgcccaggctggagtgcaatggcaccatctcagctcactgcaacctccgcctcctgggttcaagcaattctcctgcctcagcctccccagtagctgggattacaggtgtgtgccaccacacacagctactttttttttttttgtatttttagtagagatggggtttcaccatgttggtcaggatggtctcgatctcttcacctcatgatccaccagcctcagcctcccaaaatgctgggattacaggtgtgagccacggtg

SEQ ID NO: 41379 - DNA, 601 bp, Human
cacgcgtgagatcgtgcctgtgaaaggactgcacagactccaaggctgtcatttccaaggctcccctgggactgccttgctccatggagcagttagttacacagacttccagctgcagcaattctcagtgcctttcacgaacgatgtgcactgggaattccctaagcagacgccctgtaggaaatgcctccccagatcgtgtagccagagactccttttggtaaagaatgtcccacaaggctggtgttccatggagcacagtttgggaaacagctccaaggcacccatgagaaaaggacgwcgtcttccaggtttcagcagtgatgctggtgggtcgtctcagccctgcccaggcagctcactgtgcggcagacatagccttaggaataccagccgctatgtcctgtgagccccacgctgtacagagacacaaatgctagtgtctgcttcatagatggagaaatgggattcagagagaggagggcccaaggtcaccaggggagacagagccaggttctctctgctttccaagccccactcaggccaccagccccaagcagacactcacccgcactgcccccgacaaaggctcccagtacca

SEQ ID NO: 41380 - DNA, 601 bp, Human
gctccagcaaccacctgtttcctccagggctcccgcaaactgtcaggcctcctgctctctcctggaatgacctccctcctccagcctgcgccgctccttccggtctctccccacgtcccctggtggcccttggtaggttcaggacagccctcacctgggggcttctcctctatctcaagccctgagccggaagctcatccctggctcctatagctgagaaatgtcaccccctgagcctcggttttaccacctgcaaaatgggggtgaccttccctgccctgctgccttccttggaggtcaygcgtgagatcgtgcctgtgaaaggactgcacagactccaaggctgtcatttccaaggctcccctgggactgccttgctccatggagcagttagttacacagacttccagctgcagcaattctcagtgcctttcacgaacgatgtgcactgggaattccctaagcagacgccctgtaggaaatgcctccccagatcgtgtagccagagactccttttggtaaagaatgtcccacaaggctggtgttccatggagcacagtttgggaaacagctccaaggcacccatgagaaaaggacgtcg

SEQ ID NO: 41381 - DNA, 601 bp, Human
ctctctccacaacctgaggcccctgctccagcaaccacctgtttcctccagggctcccgcaaactgtcaggcctcctgctctctcctggaatgacctccctcctccagcctgcgccgctccttccggtctctccccacgtcccctggtggcccttggtaggttcaggacagccctcacctgggggcttctcctctatctcaagccctgagccggaagctcatccctggctcctatagctgagaaatgtcaccccctgagcctcggttttaccacctgcaaaatgggggtgaccttccctgmcctgctgccttccttggaggtcacgcgtgagatcgtgcctgtgaaaggactgcacagactccaaggctgtcatttccaaggctcccctgggactgccttgctccatggagcagttagttacacagacttccagctgcagcaattctcagtgcctttcacgaacgatgtgcactgggaattccctaagcagacgccctgtaggaaatgcctccccagatcgtgtagccagagactccttttggtaaagaatgtcccacaaggctggtgttccatggagcacagtttgggaaacagctccaa

SEQ ID NO: 41382 - DNA, 601 bp, Human
aaaatgtggggtttgcagatgctggaaaaagccctgccactgtgagaccctcaccacatcctgcctctgagcagagccaacctcactttagcgacgcatgagccgagctacaggtgcacaaatgacccacccaggccttggaggaaggggaagcaggaggcaacctctggcaacctggtctggaaatctctctccacaacctgaggcccctgctccagcaaccacctgtttcctccagggctcccgcaaactgtcaggcctcctgctctctcctggaatgacctccctcctccagcctgcrccgctccttccggtctctccccacgtcccctggtggcccttggtaggttcaggacagccctcacctgggggcttctcctctatctcaagccctgagccggaagctcatccctggctcctatagctgagaaatgtcaccccctgagcctcggttttaccacctgcaaaatgggggtgaccttccctgccctgctgccttccttggaggtcacgcgtgagatcgtgcctgtgaaaggactgcacagactccaaggctgtcatttccaaggctcccctgggactgccttgctccatggagcag

SEQ ID NO: 41383 - DNA, 601 bp, Human
ttgttgttgtggcccgttagagaattacctgctcacagaaaatgtggggtttgcagatgctggaaaaagccctgccactgtgagaccctcaccacatcctgcctctgagcagagccaacctcactttagcgacgcatgagccgagctacaggtgcacaaatgacccacccaggccttggaggaaggggaagcaggaggcaacctctggcaacctggtctggaaatctctctccacaacctgaggcccctgctccagcaaccacctgtttcctccagggctcccgcaaactgtcaggcctcstgctctctcctggaatgacctccctcctccagcctgcgccgctccttccggtctctccccacgtcccctggtggcccttggtaggttcaggacagccctcacctgggggcttctcctctatctcaagccctgagccggaagctcatccctggctcctatagctgagaaatgtcaccccctgagcctcggttttaccacctgcaaaatgggggtgaccttccctgccctgctgccttccttggaggtcacgcgtgagatcgtgcctgtgaaaggactgcacagactccaaggctgtcattt

SEQ ID NO: 41384 - DNA, 601 bp, Human
gtggagaagaagttgttgttgtggcccgttagagaattacctgctcacagaaaatgtggggtttgcagatgctggaaaaagccctgccactgtgagaccctcaccacatcctgcctctgagcagagccaacctcactttagcgacgcatgagccgagctacaggtgcacaaatgacccacccaggccttggaggaaggggaagcaggaggcaacctctggcaacctggtctggaaatctctctccacaacctgaggcccctgctccagcaaccacctgtttcctccagggctcccgcaaastgtcaggcctcctgctctctcctggaatgacctccctcctccagcctgcgccgctccttccggtctctccccacgtcccctggtggcccttggtaggttcaggacagccctcacctgggggcttctcctctatctcaagccctgagccggaagctcatccctggctcctatagctgagaaatgtcaccccctgagcctcggttttaccacctgcaaaatgggggtgaccttccctgccctgctgccttccttggaggtcacgcgtgagatcgtgcctgtgaaaggactgcacagactcca

SEQ ID NO: 41385 - DNA, 601 bp, Human
ggcttgactgagctgggggcaaaggggcagctgtgggcgtcatgggagtgtgtctggctggggaaatggggtgacttccacgacgcagcgcttgtgggtgtggcctccccactagcaggtgcatgtggaggggtcctggcccgtctaggcgggccgcaccttcatctctgacaccttgtagctatatttgtaccccttcgccgcactccagttgataccattggcatagctctcatggggtcccatgaggtagagaccattgaggtttgaagcatgacagtcggcgtaccaccaggctccytggaacttctcagcacaattcgaagaactcacatcattgtcttggtctttggtggagaagaagttgttgttgtggcccgttagagaattacctgctcacagaaaatgtggggtttgcagatgctggaaaaagccctgccactgtgagaccctcaccacatcctgcctctgagcagagccaacctcactttagcgacgcatgagccgagctacaggtgcacaaatgacccacccaggccttggaggaaggggaagcaggaggcaacctctggcaacctggtctggaaatctctctccacaa

SEQ ID NO: 41386 - DNA, 601 bp, Human; identical to SEQ ID NO: 18791

SEQ ID NO: 41387 - DNA, 601 bp, Human; identical to SEQ ID NO: 18792

SEQ ID NO: 41388 - DNA, 601 bp, Human; identical to SEQ ID NO: 18793

SEQ ID NO: 41389 - DNA, 601 bp, Human; identical to SEQ ID NO: 18794

SEQ ID NO: 41390 - DNA, 601 bp, Human; identical to SEQ ID NO: 18795

SEQ ID NO: 41391 - DNA, 601 bp, Human; identical to SEQ ID NO: 18796

SEQ ID NO: 41392 - DNA, 601 bp, Human
catcttaaaacaccagaaatgtgtcgaaagtaaagagcggatttctgctacttatagggcttttatgctaatgagggatggagagtacctcttagttaattggaagacaaactgcacagttgtcatccgtgggcagagctatgcaaatgaggtatgaaagtacagcttttctattggctatctgactagcatttgctaccgaccaatcaaaaagtcggatttactccccaggaactacctataaaagcggccatgttttacatatttcttgattttgtttgttttctcgtgagcttaggcygctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaac

SEQ ID NO: 41393 - DNA, 601 bp, Human
accaaagtgctgggattacaggcgtgagccaccgcgcccggccggtttctgctttgatcggaattaagtgggcagaaaagtctaggcgggctaagtcttgcctatgcatctgcgcccagctgctcagactggccaaacagacccagtcgtttagtctaacgcttctggaactccactgaagcgttttgcattgtttcgtttggagccttcaaatccgagtgtgtggcaggagataataatcctagcagaagctgtttactgctgacgcgcctcccacttcccagatactgacaccggctcrgggcggatccagccttttccgctcttccctccctccaccccctcctttccctacaactactctcaaaggaaaagggttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttcccccccccagcatttcctgtatgtccgagaatttcgat

SEQ ID NO: 41394 - DNA, 601 bp, Human
ttactgctgacgcgcctcccacttcccagatactgacaccggctcagggcggatccagccttttccgctcttccctccctccaccccctcctttccctacaactactctcaaaggaaaagggttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccrgattttcccccccccagcatttcctgtatgtccgagaatttcgatcctaaggttagaattgccttatgggccttggaatcctttttattcactgaccaaattgcctttgattccagctcccttggcctcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttcca

SEQ ID NO: 41395 - DNA, 601 bp, Human
tgacgcgcctcccacttcccagatactgacaccggctcagggcggatccagccttttccgctcttccctccctccaccccctcctttccctacaactactctcaaaggaaaagggttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttyccccccccagcatttcctgtatgtccgagaatttcgatcctaaggttagaattgccttatgggccttggaatcctttttattcactgaccaaattgcctttgattccagctcccttggcctcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccagtatgtt

SEQ ID NO: 41396 - DNA, 601 bp, Human
ctcccacttcccagatactgacaccggctcagggcggatccagccttttccgctcttccctccctccaccccctcctttccctacaactactctcaaaggaaaagggttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttcccccccccagcatttcctgtatgtccgagaatttcgatcctaaggttagaattgccttatgggccttggaatcctttttattcactgaccaaattgcctttgattccagctcccttggcctcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccagtatgttaattcatt

SEQ ID NO: 41397 - DNA, 601 bp, Human
gttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttcccccccccagcatttcctgtatgtccgagaatttcgatcctaaggttagaattgccttatgggccttggaatcctttttattcactgaccaaattgcctttgattccagctccattggcctcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccagtatgttaattcatttaatccaacaatctaagagataggttttatccttattccgaattttgagatgagcaaactaagaaacagcttaaagaatttaagttgtaaggccaggaaaacagta

SEQ ID NO: 41398 - DNA, 601 bp, Human
ttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttcccccccccagcatttcctgtatgtccgagaatttcgatcctaaggttagaattgccttatgggccttggaatcctttttattcactgaccaaattgcctttgattccagctcccgtggcctcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccagtatgttaattcatttaatccaacaatctaagagataggttttatccttattccgaattttgagatgagcaaactaagaaacagcttaaagaatttaagttgtaaggccaggaaaacagtac

SEQ ID NO: 41399 - DNA, 601 bp, Human
ggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttcccccccccagcatttcctgtatgtccgagaatttcgatcctaaggttagaattgccttatgggccttggaatcctttttattcactgaccaaattgcctttgattccagctccctttgcctcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccagtatgttaattcatttaatccaacaatctaagagataggttttatccttattccgaattttgagatgagcaaactaagaaacagcttaaagaatttaagttgtaaggccaggaaaacagtactt

SEQ ID NO: 41400 - DNA, 601 bp, Human
gatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttcccccccccagcatttcctgtatgtccgagaatttcgatcctaaggttagaattgccttatgggccttggaatcctttttattcactgaccaaattgcctttgattccagctcccttgacctcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccagtatgttaattcatttaatccaacaatctaagagataggttttatccttattccgaattttgagatgagcaaactaagaaacagcttaaagaatttaagttgtaaggccaggaaaacagtactta

SEQ ID NO: 41401 - DNA, 601 bp, Human
ggattttcccccccccagcatttcctgtatgtccgagaatttcgatcctaaggttagaattgccttatgggccttggaatcctttttattcactgaccaaattgcctttgattccagctcccttggcctcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccrgtatgttaattcatttaatccaacaatctaagagataggttttatccttattccgaattttgagatgagcaaactaagaaacagcttaaagaatttaagttgtaaggccaggaaaacagtacttataacagctgactattctataaccacacctccttaagagattattgtcagaaaaatagaaagagtaaaacatccatacataatgggtaaactttgtccacataccagaatgttactaatggctttctaacctctgaagaatttaagggaaggaggaaaggtaattttccccaggga

SEQ ID NO: 41402 - DNA, 601 bp, Human
accttgaaatgaaaagaacctggctcagcaagtgtagattctgaaatcagaaaacaggctgaataagagagatggtttattaggcactactgtgtgccaggcacatttcatgagcttccagtatgttaattcatttaatccaacaatctaagagataggttttatccttattccgaattttgagatgagcaaactaagaaacagcttaaagaatttaagttgtaaggccaggaaaacagtacttataacagctgactattctataaccacacctccttaagagattattgtcagaaaaatrgaaagagtaaaacatccatacataatgggtaaactttgtccacataccagaatgttactaatggctttctaacctctgaagaatttaagggaaggaggaaaggtaattttccccagggaatctacacgaagaggtaaatcttgacaatgtattaatactgtaaacccagggaaaaaaagccagtacaatttttatttagggtgtggcaaataaaacaaagggacacgtgaaaacatggctcagtaaagagctacaagacttggtgcaactgacttattgtggtgagtgagaaaaggagag

SEQ ID NO: 41403 - DNA, 601 bp, Human
atttttatttagggtgtggcaaataaaacaaagggacacgtgaaaacatggctcagtaaagagctacaagacttggtgcaactgacttattgtggtgagtgagaaaaggagagagagaaaacttgaatttcaattcttctctctgggctccaataacaagattttgtattcggtctatttagtagtgaatgatacattgtgttaagtttgttaacctagaggctttcatcttaagcagtacttaagatgtagaccccctcttattcaaatactgataatcagcatagaacttggcatacargagacacttggctgttgggcattgagaaaatgttgaactgaatgaatcaatgactaggcagccaggaagcactttgttgtagagagttggtttattactaaggaagacattaagtattaaatattagactaataggttgctaatagtgttttctctttccaatagaaaatgtcttctgaggctgatctggtgtctcacatctgtaatcccagcacttggggaggctgaggtgggtagatcacctgaggtcaggagtttgagaccagcctggccaacatggcgaaaccccatctctaataa

SEQ ID NO: 41404 - DNA, 601 bp, Human
aaaatgtcttctgaggctgatctggtgtctcacatctgtaatcccagcacttggggaggctgaggtgggtagatcacctgaggtcaggagtttgagaccagcctggccaacatggcgaaaccccatctctaataaaactacacaaattagtcaggtgtggcggtgttcacctgtaggcgcctgtagtcccagctactcaggagactgaggcagaagaatcacttgaaccccgggaggtggaggttgtagtgagccaagatcgtgccactgcactccagcctgggcgacaaagtgaaactcygtctcaaaaaaaaaccaaccccatctctactaaaaaatacaaaaattagctgggcatgctagtgcacgcctgtagtcccagctactcgggaggctgaggcaagagaatcacttgaatataggagggggaggttgcagtgagagtgagactctcaaaaaaaaacaacaaaacaaaaagtaacaacaaaaaagaaactatattccaaaaatccaaatttcattggcagtttgttctgggagcttcagacacatagaaggtgtcagttaaccagttcttacctaagaggtactgctaagagcc

SEQ ID NO: 41405 - DNA, 601 bp, Human
acttgaaccccgggaggtggaggttgtagtgagccaagatcgtgccactgcactccagcctgggcgacaaagtgaaactccgtctcaaaaaaaaaccaaccccatctctactaaaaaatacaaaaattagctgggcatgctagtgcacgcctgtagtcccagctactcgggaggctgaggcaagagaatcacttgaatataggagggggaggttgcagtgagagtgagactctcaaaaaaaaacaacaaaacaaaaagtaacaacaaaaaagaaactatattccaaaaatccaaatttcaytggcagtttgttctgggagcttcagacacatagaaggtgtcagttaaccagttcttacctaagaggtactgctaagagcctagtccctaagcaaagggagcttcagagaaacacagaaggtgccagttaaccagttcttacctaagaggtactgctaagagcctagtccctaagcaaaggacattcctcgtagctctgtcctgtctcctcatctccaaaatactttaccttctactttgaaatgcccactattatattcaaaagccctagttacttccagggaaaattatctattgagca

SEQ ID NO: 41406 - DNA, 601 bp, Human
aaaccaaccccatctctactaaaaaatacaaaaattagctgggcatgctagtgcacgcctgtagtcccagctactcgggaggctgaggcaagagaatcacttgaatataggagggggaggttgcagtgagagtgagactctcaaaaaaaaacaacaaaacaaaaagtaacaacaaaaaagaaactatattccaaaaatccaaatttcattggcagtttgttctgggagcttcagacacatagaaggtgtcagttaaccagttcttacctaagaggtactgctaagagcctagtccctaagsaaagggagcttcagagaaacacagaaggtgccagttaaccagttcttacctaagaggtactgctaagagcctagtccctaagcaaaggacattcctcgtagctctgtcctgtctcctcatctccaaaatactttaccttctactttgaaatgcccactattatattcaaaagccctagttacttccagggaaaattatctattgagcaatgaatttcggtagcttcagttggattccaactcttgagcaagttttcatctcccttgcctgaatggccctggggaggactatttaaattgg

SEQ ID NO: 41407 - DNA, 601 bp, Human
ggctgaggcaagagaatcacttgaatataggagggggaggttgcagtgagagtgagactctcaaaaaaaaacaacaaaacaaaaagtaacaacaaaaaagaaactatattccaaaaatccaaatttcattggcagtttgttctgggagcttcagacacatagaaggtgtcagttaaccagttcttacctaagaggtactgctaagagcctagtccctaagcaaagggagcttcagagaaacacagaaggtgccagttaaccagttcttacctaagaggtactgctaagagcctagtccctragcaaaggacattcctcgtagctctgtcctgtctcctcatctccaaaatactttaccttctactttgaaatgcccactattatattcaaaagccctagttacttccagggaaaattatctattgagcaatgaatttcggtagcttcagttggattccaactcttgagcaagttttcatctcccttgcctgaatggccctggggaggactatttaaattggggcgagtggatgaggatgctaaacctagaggtctcccaattaccaaaggcacctgggcaccagggactaaagtttgtctc

SEQ ID NO: 41408 - DNA, 601 bp, Human
cttcagacacatagaaggtgtcagttaaccagttcttacctaagaggtactgctaagagcctagtccctaagcaaagggagcttcagagaaacacagaaggtgccagttaaccagttcttacctaagaggtactgctaagagcctagtccctaagcaaaggacattcctcgtagctctgtcctgtctcctcatctccaaaatactttaccttctactttgaaatgcccactattatattcaaaagccctagttacttccagggaaaattatctattgagcaatgaatttcggtagcttcarttggattccaactcttgagcaagttttcatctcccttgcctgaatggccctggggaggactatttaaattggggcgagtggatgaggatgctaaacctagaggtctcccaattaccaaaggcacctgggcaccagggactaaagtttgtctcaggaatttactgagatatgaggctgagataaaatcattttttggtacataaggtatcttgaacaaagcagatcagtttaacacaaaatcaacaatcgtaatttccctttttaaatttccaaatctatgtagcaatatcctttccttta

SEQ ID NO: 41409 - DNA, 601 bp, Human
ttctgtaaggacaccagccccaatgggattagggccctatcctgtgatctttagttttatgtaccccctaaaggctctatgtccaaatgcagtcacactggggtttagggttttaataaatgaattttgggggacacagtttagtccataacattctgtccttgacctgccaaaatgtatgtccttctcccatacaagataaatttattccatcccagccgggcatggtggctcacacctgtaatcccagcactttgggaagccaaggcaggcggatcagaaggtcaagagatcgagaccrttctggctaacacggtgaaaccccatctctactaaaataaaaaaaaaattagccaggcgtggtggcgggcgcctgtagtcccagctactctggaggctgagacatgagaatggcataaacccgggaggcagagcttgcagtgagccaagatggtgccactgcactccagcctgggcgacagagctagactccgtctcaaaaaaaaaaaaaaaattattccatcccaacagccccctgaaagtcttaactcattctagcatcaattctaaagttcaaagtgtcatctaaaaaatcatctaa

SEQ ID NO: 41410 - DNA, 601 bp, Human
gacaaccttcctttgttcctttctgttttctctgcctacgttagtttaaattggcagtgtctctgctggaataatcccatctctcttcctggcttctgctgagatggctgattaaatccttgggtcacacccattatctctttatcaaatggttgttcaggctaggctcagtgtttcacgcctgtaatcccaacactttgggagactgaggagggcagatcacttgagctcaggagttagagaccagcctaggcaacatgtcaaaaccccatctctataaacaacaacaaaaaattagccrgggtgtggtggtgcatacatgtagtcccagctacttaggaggctgaggtgggaggattgcttgagcctgaaggcaaaggttgcactgaactgagattgtgccactgcactccagcctggatgacatagccagaccctgtctcaaaaaacataaaaataaaaataaaaccaagaaaaaaaaagaaaaagaaaacattgttcaaccatacctcttcaagaaaaactttctcaatttttacaatatagattgagaaatctatcccaaatctccaagttctgattgtgttttgcttaaaaattc

SEQ ID NO: 41411 - DNA, 601 bp, Human
tctctataaacaacaacaaaaaattagccagggtgtggtggtgcatacatgtagtcccagctacttaggaggctgaggtgggaggattgcttgagcctgaaggcaaaggttgcactgaactgagattgtgccactgcactccagcctggatgacatagccagaccctgtctcaaaaaacataaaaataaaaataaaaccaagaaaaaaaaagaaaaagaaaacattgttcaaccatacctcttcaagaaaaactttctcaatttttacaatatagattgagaaatctatcccaaatctccmagttctgattgtgttttgcttaaaaattccttctttatttcggctctttcctctcacatttcactttaagcagtaaggaggacctaaatcacaccttcaatactttgcttagacatctcttctggtaaatatccagttttactgcttataagttctttccagtaaacactacagcgtaattcagccaagttcttgacacattgtaacaagaacagtgatttctacagtttccaataacctgtccctcattttcatctgagacctcacaagagttgactttaatgtccatatatatatatt

SEQ ID NO: 41412 - DNA, 601 bp, Human
acaaaaaattagccagggtgtggtggtgcatacatgtagtcccagctacttaggaggctgaggtgggaggattgcttgagcctgaaggcaaaggttgcactgaactgagattgtgccactgcactccagcctggatgacatagccagaccctgtctcaaaaaacataaaaataaaaataaaaccaagaaaaaaaaagaaaaagaaaacattgttcaaccatacctcttcaagaaaaactttctcaatttttacaatatagattgagaaatctatcccaaatctccaagttctgattgtgtyttgcttaaaaattccttctttatttcggctctttcctctcacatttcactttaagcagtaaggaggacctaaatcacaccttcaatactttgcttagacatctcttctggtaaatatccagttttactgcttataagttctttccagtaaacactacagcgtaattcagccaagttcttgacacattgtaacaagaacagtgatttctacagtttccaataacctgtccctcattttcatctgagacctcacaagagttgactttaatgtccatatatatatattttttgtgtgtgtgtg

SEQ ID NO: 41413 - DNA, 601 bp, Human
aatgtccatatatatatattttttgtgtgtgtgtggcggggggagtggagtcctgctctgtatcccaggctggagtgcagtggtgtgatcttgggtcactgcaacctccaccccccgggtttaagcgattcttcagcctcagcctcccgagtagctgggaccacagaagcacatcaccatgcccagctaatttttgtatttttagtagagacagggtttcgccatattggccaggctggtctcaaactcccgacctcgtgatctgtgccctcagcctcccaaagtgctgagattacaggcrtgagccaccacgcctggcctaaagtccatattttaaccagcatatttaatattctatccatgatcgttataaatctaagtttctatgaaaatggaagctttctgtccagctctcttcctttctgagcctttgccagaattgcctttaatgtccatatttctttcaatagtcccttcacaattggctttttctagtatgaacctcaaactcttccagcctttacccatcaccaatttccaaagccacttccccatgtttaggtatttgttgttgcagcatcccacgcctgggtaccaaaac

SEQ ID NO: 41414 - DNA, 601 bp, Human
cttccccatgtttaggtatttgttgttgcagcatcccacgcctgggtaccaaaacttagtcagcttggactgccataacaaaatactacagactggtggcttaaacgatagacatttattttctaacaattctgcaggctggaaatctaagatccaagttgccagcatagtcagtttctggtgaggatctcttcctggcttaaattatttcacagacaccaggcagataaccatatccattctttcctgtattcgttaatagtcagagctaaaagtgtagggctctaaatttacacttcarcaaattgttctgttattaagtattcacctcaaaatgaccagactatactatcctctaaattttagaaacttggagcttggctctggtccctagtctttgttctgtctcattaatggcttcatcaatactacggttccaaagactatctatatgcagtaaacttccaattttacatctccagcctgaccttttttctgaaatgcaaatgtgtgtagccacattttcacttgacatctccatttagaactctaataggtctttcaccctaaacacttccaagacacaggaataaacgtgctc

SEQ ID NO: 41415 - DNA, 601 bp, Human
gaaacaaaaaaccttcctagtaattcaaaattatgcatattaatacaacaaagggataccacttttttttttttttttttttttttttttttgagacagagtcttgctcaggtacccaggctggagtgtagtggcatgatctcaactcactgcaacttccaccccctgggttcaagcgattctcctgcctcagcctcccgagtagctgggactacaggcgcctgctaccacgctcagctaacttttgtatttttattagagatggggttttaccatgttggttggccaggatggtctcggwctcttgacctcgtgatctgacggcctcagcctcccaaagtgctgtgattacaggcgtgaaccactgcacctggcctaatttttgtattattagtagagatggggtttcaccatattggccaggctggtgtcgaactcctcctgacctcagatgatccacccacttcaggctcccaaagtgctgggattacaggcatgagccactgtgcccagcctgggataccatttcttacctatgaatagacaaccactaaagccagtatactcaggactgcaaaggatgaggaagaattgccattgt

SEQ ID NO: 41416 - DNA, 601 bp, Human; identical to SEQ ID NO: 32319

SEQ ID NO: 41417 - DNA, 601 bp, Human; identical to SEQ ID NO: 32320

SEQ ID NO: 41418 - DNA, 601 bp, Human; identical to SEQ ID NO: 32321

SEQ ID NO: 41419 - DNA, 601 bp, Human; identical to SEQ ID NO: 32322

SEQ ID NO: 41420 - DNA, 601 bp, Human; identical to SEQ ID NO: 32323

SEQ ID NO: 41421 - DNA, 601 bp, Human; identical to SEQ ID NO: 32324

SEQ ID NO: 41422 - DNA, 601 bp, Human; identical to SEQ ID NO: 32325

SEQ ID NO: 41423 - DNA, 601 bp, Human; identical to SEQ ID NO: 32326

SEQ ID NO: 41424 - DNA, 601 bp, Human; identical to SEQ ID NO: 32327

SEQ ID NO: 41425 - DNA, 601 bp, Human; identical to SEQ ID NO: 32328

SEQ ID NO: 41426 - DNA, 601 bp, Human; identical to SEQ ID NO: 32329

SEQ ID NO: 41427 - DNA, 601 bp, Human; identical to SEQ ID NO: 32330

SEQ ID NO: 41428 - DNA, 601 bp, Human; identical to SEQ ID NO: 32331

SEQ ID NO: 41429 - DNA, 601 bp, Human; identical to SEQ ID NO: 32332

SEQ ID NO: 41430 - DNA, 601 bp, Human; identical to SEQ ID NO: 32333

SEQ ID NO: 41431 - DNA, 601 bp, Human; identical to SEQ ID NO: 32334

SEQ ID NO: 41432 - DNA, 601 bp, Human; identical to SEQ ID NO: 32335

SEQ ID NO: 41433 - DNA, 601 bp, Human; identical to SEQ ID NO: 32336

SEQ ID NO: 41434 - DNA, 601 bp, Human; identical to SEQ ID NO: 32337

SEQ ID NO: 41435 - DNA, 601 bp, Human; identical to SEQ ID NO: 32338

SEQ ID NO: 41436 - DNA, 601 bp, Human; identical to SEQ ID NO: 32339

SEQ ID NO: 41437 - DNA, 601 bp, Human; identical to SEQ ID NO: 32340

SEQ ID NO: 41438 - DNA, 601 bp, Human; identical to SEQ ID NO: 32341

SEQ ID NO: 41439 - DNA, 601 bp, Human; identical to SEQ ID NO: 32342

SEQ ID NO: 41440 - DNA, 601 bp, Human; identical to SEQ ID NO: 32343

SEQ ID NO: 41441 - DNA, 601 bp, Human; identical to SEQ ID NO: 32344

SEQ ID NO: 41442 - DNA, 601 bp, Human; identical to SEQ ID NO: 32345

SEQ ID NO: 41443 - DNA, 601 bp, Human; identical to SEQ ID NO: 32346

SEQ ID NO: 41444 - DNA, 601 bp, Human; identical to SEQ ID NO: 32347

SEQ ID NO: 41445 - DNA, 601 bp, Human
agagagctggggaggaggccacagtgagaaggagccgagaggcggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagaggcggccctcactagagagctggggaggaggccacagtgagaaggagcygagagggggccctcactagagagctggggaggaggccacagtgagaaggagccgagaggcggccctcactagagagctggggaggaggccacagtgagaaggagctgagaggcggccctcactagagagctggggaggaggcaactgtctcccccatctccagctcaaactttccagctccaaaagtgtgagaaacacattcctgctgttttgcctttctggtctatggtgttctgttacagcagcccaaaaggactaaaatgggggcttatgatgactgcagtaagttattttttacca

SEQ ID NO: 41446 - DNA, 601 bp, Human
aggagggaaatggcaaagctgccctgcaggcaggaggaaccttgggaaacaaatgtcaatgcagagtacaggccaacctcactgccccactctgtctgcagagcacaggctgtgtggggagcacctgggccaacctcactgcccccacttctgtctgcagagcacaggctgtgtggggagcacctgagccaactttactgcccccacttctgtctgcacagtgggcgtcgtgggcaggcagagtccttgctccaggcaattagccccatggggtacccagaggacatgtgtggtgggtcayggctcgatgcagaggaatgctgccgccatggagattccagttcccactgcatcctctggcacccaaacccacagtcctcctgcaaagactacctgaggcggcctccatccccatataaagtcaaaaactgacctcccagatttatttgataagggcacatgagctggagaaagtgagggctgatgttttgctcacgccaaacttcactaatgatgaccagcagccagaggtgggcagctgctgagcctgcatcccaaggaagccggtggccagggtacacagtctggcaggtccaggtca

SEQ ID NO: 41447 - DNA, 601 bp, Human
cactggatctccacgcaaggccaagctgcacaccgctgagggtcggcagcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcgggggcctcctcgcccaccgcctgcggtcacggtgtccacrcacaaggccaagctgcacaccgctgagggtcggcggcctccccacccacggcctgcagtcacggtatccacgcacaaggccgagctgcacaccgctgagggtcggcggcctccccacccatcgcccacagtcacggtgtccacagctgcaggcactcggtgtacgcctggctgcagcccactcagcaacagcaccccacctgctcaggccagagggcggcctgaaccacaggggacgtggagacagcacccaaggcgcagtaggtccacaagtggggagaatccagggcatgattctcag

SEQ ID NO: 41448 - DNA, 601 bp, Human
caagagaacaccagacactggatctccacgcaaggccaagctgcacaccgctgagggtcggcagcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcgggggcctcctcgcccaccgcctgcrgtcacggtgtccacacacaaggccaagctgcacaccgctgagggtcggcggcctccccacccacggcctgcagtcacggtatccacgcacaaggccgagctgcacaccgctgagggtcggcggcctccccacccatcgcccacagtcacggtgtccacagctgcaggcactcggtgtacgcctggctgcagcccactcagcaacagcaccccacctgctcaggccagagggcggcctgaaccacaggggacgtggagacagcacccaaggcgcagtaggtccacaagtggggagaatcca

SEQ ID NO: 41449 - DNA, 601 bp, Human
tggggtggtgggtgctgttgcgccctggctaaaggtggcgagtccagaaggtgacgggagctgtgcaggcagcagggctgggccaagcagccctgtctcggagaagagagcctggctgcacacaccctctcctgggtggattttctgtggaagggaagtgggtggagctattgaggaaactgaggcagcacatgagcccagccagccagctggggctgcaggaggcgaggacagtggccagagccaatgcaggtcagcagggagggagaaggcacaggggcaggagaaaacaaggagggcrgtgagagacggagacgtgtccaggatgggtctgggggctctggctggcaggcctagggcacggtgctgcccgcaacctgaagggagggcagagcgggacatgctacacctggcctgacccacttccctctaaagtgccggcaaagcaggggtgggctgggaagtgagggctacagctacccgagaccagcccgaagcatcctctgaggatgctgaagggagccccaccaggccaccagcagccagaggggatagagtgcggcctcccgtgagcacagtcctgttccaagctgtcttgtcc

SEQ ID NO: 41450 - DNA, 601 bp, Human
cctgatgtcaggagtttgagaccagcctggccaacatggtgaaacccctctctactaaaaatacaaaaattagctgggcatgggccaggcatagtggctcacacctgtaatcccagcagtattgggaggccgaggcggatggatcacgaggtcaggagattgagaccatcctggctaacacagtgaaaccccttctctactaaaaattcaaaaacaaaattagccaggtgtggtggcgggcacctgtattcccagctactcgggaagctgaggcgggagaatggtgtgaacccgcgaggcrgagcttgtagtgagctgagatcatgccactgcactccagcctgggcgacagagcaagactccctctcaaaaaaaaaaaaaaaaaaaaattaggtgggcatggtggcatgcacctgtaatcccagctactcgggaggctgaggcaggagaatcacttgaacccagagggcagaggttgcagtgagccgagatggcaccactgcactccagcctgggtgaggcagtgagactctgtctcaaaaaaaaacaaaacaaacaaaaaaccgtgtgatgtaacgaaactcacctagagagaaattta

SEQ ID NO: 41451 - DNA, 601 bp, Human
ctaggtacatcagagtcaaactgccaaatccaaacacaaaaatatttcttaaaagcaggtagtgggccgggtgcagtggttcacgcctgtaatcccagcactttgggaggctaaggtgggcagatcacctgatgtcaggagtttgagaccagcctggccaacatggtgaaacccctctctactaaaaatacaaaaattagctgggcatgggccaggcatagtggctcacacctgtaatcccagcagtattgggaggccgaggcggatggatcacgaggtcaggagattgagaccatcctgrctaacacagtgaaaccccttctctactaaaaattcaaaaacaaaattagccaggtgtggtggcgggcacctgtattcccagctactcgggaagctgaggcgggagaatggtgtgaacccgcgaggcagagcttgtagtgagctgagatcatgccactgcactccagcctgggcgacagagcaagactccctctcaaaaaaaaaaaaaaaaaaaaattaggtgggcatggtggcatgcacctgtaatcccagctactcgggaggctgaggcaggagaatcacttgaacccagagggcagag

SEQ ID NO: 41452 - DNA, 601 bp, Human
caaaaaataatctggataaacacaaagaaaaccacatctaggtacatcagagtcaaactgccaaatccaaacacaaaaatatttcttaaaagcaggtagtgggccgggtgcagtggttcacgcctgtaatcccagcactttgggaggctaaggtgggcagatcacctgatgtcaggagtttgagaccagcctggccaacatggtgaaacccctctctactaaaaatacaaaaattagctgggcatgggccaggcatagtggctcacacctgtaatcccagcagtattgggaggccgaggcrgatggatcacgaggtcaggagattgagaccatcctggctaacacagtgaaaccccttctctactaaaaattcaaaaacaaaattagccaggtgtggtggcgggcacctgtattcccagctactcgggaagctgaggcgggagaatggtgtgaacccgcgaggcagagcttgtagtgagctgagatcatgccactgcactccagcctgggcgacagagcaagactccctctcaaaaaaaaaaaaaaaaaaaaattaggtgggcatggtggcatgcacctgtaatcccagctactcgggagg

SEQ ID NO: 41453 - DNA, 601 bp, Human; identical to SEQ ID NO: 22507

SEQ ID NO: 41454 - DNA, 601 bp, Human; identical to SEQ ID NO: 22508

SEQ ID NO: 41455 - DNA, 601 bp, Human; identical to SEQ ID NO: 22509

SEQ ID NO: 41456 - DNA, 601 bp, Human; identical to SEQ ID NO: 22510

SEQ ID NO: 41457 - DNA, 601 bp, Human
ggtaaagaaagggtaggtcagaaccatcgggcagtgagtgctgttttgatcctttccttctagacttttccgctaggttagattctgcatgcatgaacactgctgctgcctcgagggagagacaggacttaccctacacctaacacacatcaagaaaggcatacaggagttccacaaactcgcacacaacacagaacaaaagtggcagaaaaaccacaaaagagggctgtggctggaaagcacaaccaggagctgccccactgtccccatctgtccagaggcacctggagccaggtgtgtyccttaaaccttgtccacacaagatgctcccagcacgcagcacttgtttccctgtctacaccttcctgccacctgacaggcactgacaacaggccttctggttttgcagcagaaagcaagccccaggccaggtgcggtctcatgcctgtaatcccagtgctttgggaggcgaaggcacgaggatcacttgaggccaggagtttgaggctgcagtgagctacgattgtgccactgcactccagcctggacaacagcgagactgtgtcttagaaaataaggccccacattactgagctcctag

SEQ ID NO: 41458 - DNA, 601 bp, Human
cagctccctcccatcccgaggagaaaacctgtcatgctgaacatgctatgtggttaggagcaaactgcgccccagtgaagcccatctgtcccctgggttgctggctggcttctgggccaccctaggaaacaccaggtgcctggttgtctctatgtcctaatgcatcactagcacctcagagtcctaccctatgaacagactgtcgggggagcattctgctgggcccagcgttctggaccctggggactgtcactagctgtgacactgctgcgggacagcctgttgcaggagtggactatarggtgaaacaggctctcccaccccttgtctctctcctcccactctgcataccctgtaggcagttgttttctggaaaacctgtatgacccccgaaaagagggatggcccctcttggcacctgggagagggcatgggccgagtgtatagcctcagccggtgcccctctgctgctgcagcccgtgttgctcagtcctgttggtgacccagccccacctggtgcttctctacccaaaggacatacgctcctagatgcaaacaggcaaagtaagaaaggggcctctaagcgggccatggaaaccag

SEQ ID NO: 41459 - DNA, 601 bp, Human
ggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctyccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacacccacgtgtcagtaaatgactacagcagttgtacagtggggtattctctttctcatgcaacagaacagctccctcccatcccgaggagaaaacctgtcatgctgaacatgctatgtggttaggagcaaactgcgc

SEQ ID NO: 41460 - DNA, 601 bp, Human
tgggatgacctcaaactaaaaagtttctgcacagcaaaggaatctattaacagaaatgatatcctatagaatggaagagactatgtgcaaaccatctatctcataaggggttaacagcctgaatatacaaaaaactccaactcaggaacaaaatcgattaaaaatgggcaaactgcacttttgtaatcccagctctttgggaggctgaggcacaagaatcgcttgaacctggaaggcggatgttgcagtgcaccctcaccaccgcactccagcctgggcaacggagtaagactctgtctcaaaaaaaaaaggcaaagcccttgaacagacgtttctccaaacacgccatgcaaatagccaacaagcacatgagtagatggtcaacatcattatttatcagggacatgcaaatcaaaaccacatgacactacctcatgtccattaggatgaccattatcacaaacaaaaaagaataggcttgggcgcggtggctcacacctgtaatcccagcactttgggaggcctaggcaggtagatcacttgaggccaggagtttaagaccagcctggtcaacggagtctcgctctgtcatccaggctga

SEQ ID NO: 41461 - DNA, 601 bp, Human
tcttggcaatgatttcttgaacatgacaccaacagcaagggcaacgaaagtaaaaatagacaaatgggatgacctcaaactaaaaagtttctgcacagcaaaggaatctattaacagaaatgatatcctatagaatggaagagactatgtgcaaaccatctatctcataaggggttaacagcctgaatatacaaaaaactccaactcaggaacaaaatcgattaaaaatgggcaaactgcacttttgtaatcccagctctttgggaggctgaggcacaagaatcgcttgaacctggaaggyggatgttgcagtgcaccctcaccaccgcactccagcctgggcaacggagtaagactctgtctcaaaaaaaaaaggcaaagcccttgaacagacgtttctccaaacacgccatgcaaatagccaacaagcacatgagtagatggtcaacatcattatttatcagggacatgcaaatcaaaaccacatgacactacctcatgtccattaggatgaccattatcacaaacaaaaaagaataggcttgggcgcggtggctcacacctgtaatcccagcactttgggaggcctaggcaggtagat

SEQ ID NO: 41462 - DNA, 601 bp, Human; identical to SEQ ID NO: 22511

SEQ ID NO: 41463 - DNA, 601 bp, Human; identical to SEQ ID NO: 22512

SEQ ID NO: 41464 - DNA, 601 bp, Human; identical to SEQ ID NO: 22513

SEQ ID NO: 41465 - DNA, 601 bp, Human; identical to SEQ ID NO: 22514

SEQ ID NO: 41466 - DNA, 601 bp, Human; identical to SEQ ID NO: 22515

SEQ ID NO: 41467 - DNA, 601 bp, Human; identical to SEQ ID NO: 22516

SEQ ID NO: 41468 - DNA, 601 bp, Human; identical to SEQ ID NO: 22517

SEQ ID NO: 41469 - DNA, 601 bp, Human; identical to SEQ ID NO: 22518

SEQ ID NO: 41470 - DNA, 601 bp, Human; identical to SEQ ID NO: 22519

SEQ ID NO: 41471 - DNA, 601 bp, Human; identical to SEQ ID NO: 22520

SEQ ID NO: 41472 - DNA, 601 bp, Human; identical to SEQ ID NO: 22521

SEQ ID NO: 41473 - DNA, 601 bp, Human; identical to SEQ ID NO: 22522

SEQ ID NO: 41474 - DNA, 601 bp, Human; identical to SEQ ID NO: 22523

SEQ ID NO: 41475 - DNA, 601 bp, Human; identical to SEQ ID NO: 22524

SEQ ID NO: 41476 - DNA, 601 bp, Human; identical to SEQ ID NO: 22525

SEQ ID NO: 41477 - DNA, 601 bp, Human; identical to SEQ ID NO: 22526

SEQ ID NO: 41478 - DNA, 601 bp, Human; identical to SEQ ID NO: 22527

SEQ ID NO: 41479 - DNA, 601 bp, Human; identical to SEQ ID NO: 22528

SEQ ID NO: 41480 - DNA, 601 bp, Human; identical to SEQ ID NO: 22529

SEQ ID NO: 41481 - DNA, 601 bp, Human; identical to SEQ ID NO: 22530

SEQ ID NO: 41482 - DNA, 601 bp, Human; identical to SEQ ID NO: 22531

SEQ ID NO: 41483 - DNA, 601 bp, Human; identical to SEQ ID NO: 22532

SEQ ID NO: 41484 - DNA, 601 bp, Human; identical to SEQ ID NO: 22533

SEQ ID NO: 41485 - DNA, 601 bp, Human; identical to SEQ ID NO: 22534

SEQ ID NO: 41486 - DNA, 601 bp, Human; identical to SEQ ID NO: 22535

SEQ ID NO: 41487 - DNA, 601 bp, Human; identical to SEQ ID NO: 22536

SEQ ID NO: 41488 - DNA, 601 bp, Human; identical to SEQ ID NO: 22537

SEQ ID NO: 41489 - DNA, 601 bp, Human; identical to SEQ ID NO: 22538

SEQ ID NO: 41490 - DNA, 601 bp, Human; identical to SEQ ID NO: 22539

SEQ ID NO: 41491 - DNA, 601 bp, Human; identical to SEQ ID NO: 22540

SEQ ID NO: 41492 - DNA, 601 bp, Human; identical to SEQ ID NO: 22541

SEQ ID NO: 41493 - DNA, 601 bp, Human; identical to SEQ ID NO: 22542

SEQ ID NO: 41494 - DNA, 601 bp, Human; identical to SEQ ID NO: 22543

SEQ ID NO: 41495 - DNA, 601 bp, Human; identical to SEQ ID NO: 22544

SEQ ID NO: 41496 - DNA, 601 bp, Human; identical to SEQ ID NO: 22545

SEQ ID NO: 41497 - DNA, 601 bp, Human; identical to SEQ ID NO: 22546

SEQ ID NO: 41498 - DNA, 601 bp, Human; identical to SEQ ID NO: 22547

SEQ ID NO: 41499 - DNA, 601 bp, Human; identical to SEQ ID NO: 22548

SEQ ID NO: 41500 - DNA, 601 bp, Human; identical to SEQ ID NO: 22549

SEQ ID NO: 41501 - DNA, 601 bp, Human; identical to SEQ ID NO: 22550

SEQ ID NO: 41502 - DNA, 601 bp, Human; identical to SEQ ID NO: 22551

SEQ ID NO: 41503 - DNA, 601 bp, Human; identical to SEQ ID NO: 22552

SEQ ID NO: 41504 - DNA, 601 bp, Human; identical to SEQ ID NO: 22553

SEQ ID NO: 41505 - DNA, 601 bp, Human; identical to SEQ ID NO: 22554

SEQ ID NO: 41506 - DNA, 601 bp, Human; identical to SEQ ID NO: 22555

SEQ ID NO: 41507 - DNA, 601 bp, Human; identical to SEQ ID NO: 22556

SEQ ID NO: 41508 - DNA, 601 bp, Human; identical to SEQ ID NO: 22557

SEQ ID NO: 41509 - DNA, 601 bp, Human; identical to SEQ ID NO: 22558

SEQ ID NO: 41510 - DNA, 601 bp, Human; identical to SEQ ID NO: 22559

SEQ ID NO: 41511 - DNA, 601 bp, Human
atttaaacaggttaacaatggcacaaggataattaggcaaattagccgagtggaatagagacttggggacacccatgtttagttcattctgaaggaagcattgtaaatcactgagtaaaacataacccctgctgggcacggtcgctcacacctgtaatcccagccctttgggaggccgaggcgggtggatcacctaaggttgggagttcgagaccagcctggccaacatggagaaaccccatcgctactaaaaatacaaaaattagggcgtggtggtgcgtgccagtaatgcagctactcrggaggctgaggcaggagaattacttgaaccagggaggtggaggttgcggtgagcctagatcacgccattgcactccagcctgggcaacaagagcgaaactccgtccaaaagaaaaagcataacccctagggttgcacataataacaaattccagagggaacatagtgaggtgtatacaatgaacgcataaactactgcggggaatacagtgagatgcagacaatgaacgcataaactactggggggaaaaggtaagtcgctactctccagtacaaacctgaagaagcataaaagggaaca

SEQ ID NO: 41512 - DNA, 601 bp, Human
gttgggagttcgagaccagcctggccaacatggagaaaccccatcgctactaaaaatacaaaaattagggcgtggtggtgcgtgccagtaatgcagctactcaggaggctgaggcaggagaattacttgaaccagggaggtggaggttgcggtgagcctagatcacgccattgcactccagcctgggcaacaagagcgaaactccgtccaaaagaaaaagcataacccctagggttgcacataataacaaattccagagggaacatagtgaggtgtatacaatgaacgcataaactactgsggggaatacagtgagatgcagacaatgaacgcataaactactggggggaaaaggtaagtcgctactctccagtacaaacctgaagaagcataaaagggaacacagtgagatgcatacaatgaacgcataaactactggggggaaatgcaagttgctactctccagtacaaacctgaagcagcataaaagggaatacagtgaaatgtatacaatgaacgcataaactactggggggaagtgtaagtcgctactctccagtacaaacctgaagaagcataaaagggcgggcgcaggggctca

SEQ ID NO: 41513 - DNA, 601 bp, Human
atgaacgcataaactactggggggaaaaggtaagtcgctactctccagtacaaacctgaagaagcataaaagggaacacagtgagatgcatacaatgaacgcataaactactggggggaaatgcaagttgctactctccagtacaaacctgaagcagcataaaagggaatacagtgaaatgtatacaatgaacgcataaactactggggggaagtgtaagtcgctactctccagtacaaacctgaagaagcataaaagggcgggcgcaggggctcacacctgtaacgccagcactttggggcgaggcaggtggatggcttgagcctgggagtttgagagcagtctgggcaacatggtgaaatcctgtctctagaaaaaattaaaataatacgaagaagcacaaaaggaaaggaaccataatgggaaatacggataaggtttgttttgttttgttttgagacagagtcttactctgtcacccaggctggaatgcatgtggcacgatcttgtcttactgcagtctcaacctcccaggctgatgtgatcctcccatctcagcttcccaagtagtgaccacaggcaagtgccaccacgcctcgct

SEQ ID NO: 41514 - DNA, 601 bp, Human
cataatgggaaatacggataaggtttgttttgttttgttttgagacagagtcttactctgtcacccaggctggaatgcatgtggcacgatcttgtcttactgcagtctcaacctcccaggctgatgtgatcctcccatctcagcttcccaagtagtgaccacaggcaagtgccaccacgcctcgctaatttttgaatctttttgtagaaatggggttttgttattttggccaggctggtcttgaactcctggactcaagcagtctaccagcctcggcctcccaaagtgctgggattacagkcatgagccactgcctagctcaaaacatggataagtttaacacaatatggagatgagttttgttagtttatttcagagggataattatttaacctacccaatttaattccattggcttattgtgttcaattttcgtaaaggtttttttttacagtgctttattaattaccgtcattaaatcactcatgtttgtgcttttgaggttaaaattgcagagttttctcgtactccagaagactttctaaagaaatatgatgaactgaaatctaaaaatacaaggaaccttgacccgctggtgtac

SEQ ID NO: 41515 - DNA, 601 bp, Human
tgctgtgccgggcccctgctggaaggacatgtctctctgtcatttattgaaaatgaatcccttagagaggccaaggcttaatgcttgatcatgacctagctctatatgtttagttttttttttaaccaagaattctggaccacaagaatcaatagcagcaaggttctgacccacgtgggagttgtgctgccaggtggccacgtgactctgagcctacccaatcctgactccccatttccctcctccaatttttgacaattttgagggaatgctttcagatcattatattttcaagattctygaaaatacagtaatttttattattccttctgtatttgctacttgctcttggttttgattttatgccctaccctggtcttttgacgtaagtcatctcccagtctctctcattagagctgccacgttcctgcctttgtgacctttaaactccctttggagctgtgtccctgaggcgtcctagcctcctgggtgcgtgttgagtgcagcggctcccaaggacccagccggttcttgctgggcacgttctgtgctggacatggtgctaggcctctgtccacgtctccctcagccgtggcagaag

SEQ ID NO: 41516 - DNA, 601 bp, Human
ttttaaccaagaattctggaccacaagaatcaatagcagcaaggttctgacccacgtgggagttgtgctgccaggtggccacgtgactctgagcctacccaatcctgactccccatttccctcctccaatttttgacaattttgagggaatgctttcagatcattatattttcaagattctcgaaaatacagtaatttttattattccttctgtatttgctacttgctcttggttttgattttatgccctaccctggtcttttgacgtaagtcatctcccagtctctctcattagagctgmcacgttcctgcctttgtgacctttaaactccctttggagctgtgtccctgaggcgtcctagcctcctgggtgcgtgttgagtgcagcggctcccaaggacccagccggttcttgctgggcacgttctgtgctggacatggtgctaggcctctgtccacgtctccctcagccgtggcagaagactgggtcttactgccacgtgcagagacagtttgcatctgcccgtgtccctgaccagccctgagtgggagtcagtgcttccgaaagctgggccagcccaggccgaccccatcagcctct

SEQ ID NO: 41517 - DNA, 601 bp, Human
gttgtgctgccaggtggccacgtgactctgagcctacccaatcctgactccccatttccctcctccaatttttgacaattttgagggaatgctttcagatcattatattttcaagattctcgaaaatacagtaatttttattattccttctgtatttgctacttgctcttggttttgattttatgccctaccctggtcttttgacgtaagtcatctcccagtctctctcattagagctgccacgttcctgcctttgtgacctttaaactccctttggagctgtgtccctgaggcgtcctakcctcctgggtgcgtgttgagtgcagcggctcccaaggacccagccggttcttgctgggcacgttctgtgctggacatggtgctaggcctctgtccacgtctccctcagccgtggcagaagactgggtcttactgccacgtgcagagacagtttgcatctgcccgtgtccctgaccagccctgagtgggagtcagtgcttccgaaagctgggccagcccaggccgaccccatcagcctctggcggccactggcgcaggagggcaggctctctgaccacatgtcaggagccatcctgtcacg

SEQ ID NO: 41518 - DNA, 601 bp, Human
cacgcctggctaatttttatatttttagtagagacggggttttgccgtgttggccagactggtctcgaactcctgacctctggtgatctgcccaccttggcctcacaaagtgctgggattacaggcatgagccaccacgcctagtcaagtacatttttagattgaaaaatgagatttcacaaactaaggacagagcatacctgcttatcttgccccatccccgttagtccaaactcaagaggcagcatggagcgtggtctgcttccccactactcacggctctgcaatgtgggcaccaagrggccaacccttgcctttgccggaaaccctggagaacggtgacgtgaaatccacctgttttcctcatccccaagcaaacagaaccctgctgtaagttaatgaaaagtatagaaaaaccctgctgtaagttatgagaagtatagaaaaccatgctgtaagttaatgaaaagtatggaaaacagtctacttcggccaggcatggtggctcacacctgtaatcccagcacttagggaggtgaggtgcgtggattccttgagcccaggaattcgagaccagcctgggcgacaggacgagactagt

SEQ ID NO: 41519 - DNA, 601 bp, Human
ggctccccgggacacagggacacggagggacatgggggacacggagggacatgggggacacggagggcgcgtgctgccctctctgggggctctggccttcctttgcttgtggtctcaggaaagcacaccccgggcagatgtccgcctgctgcccatggggcccagggcaggaatggcccagctgcttatggccttattcttttgtgtgcaggacattaaattgcctccaattaggtccttcaacctctttggtgcttggatttcctgatctggtggggtctgtcggcttctcttcagtgcratatatttaaatgcataaaaatatgttagttcccaaagaattgtattatgtctattacgtcaagataccgttgttgaaatattttcaaaaaatacattagtgatgtggaaatgttatttctttactaatggaccaaataaaatctggtataatgggcacctttaaagaaagcaccttcacacttgaagtgcgtaaatgatgtttgaagttgttcagatgatgacgtggagatgtctggtttctgtcaatgttggccccgcctaccccacacgagcatcattttgggtgtcagggccccac

SEQ ID NO: 41520 - DNA, 601 bp, Human
cagggacacggagggacatgggggacacggagggacatgggggacacggagggcgcgtgctgccctctctgggggctctggccttcctttgcttgtggtctcaggaaagcacaccccgggcagatgtccgcctgctgcccatggggcccagggcaggaatggcccagctgcttatggccttattcttttgtgtgcaggacattaaattgcctccaattaggtccttcaacctctttggtgcttggatttcctgatctggtggggtctgtcggcttctcttcagtgcaatatatttaaatgsataaaaatatgttagttcccaaagaattgtattatgtctattacgtcaagataccgttgttgaaatattttcaaaaaatacattagtgatgtggaaatgttatttctttactaatggaccaaataaaatctggtataatgggcacctttaaagaaagcaccttcacacttgaagtgcgtaaatgatgtttgaagttgttcagatgatgacgtggagatgtctggtttctgtcaatgttggccccgcctaccccacacgagcatcattttgggtgtcagggccccacgcaccccacacgag

SEQ ID NO: 41521 - DNA, 601 bp, Human
cagaggccagccctgtcccccactccccgtcccggtgaggcgaccgcagggtctgtttccttcacttggctaccggggccggcttgccgggatcgggggtctttgtgcctgtgctctggaggggcgcgggtctcgggttttcctgcagtgccctcgtccgggcctggctttcaggtcatgctggcctcgtggaattgttttcacgtgtccctccatctgtcttttgaaagggtttcaggtcttttgaaagggtttcaggagtggtgttaattctttttgtttttgcctttttgttgtcgtygttttttgtttttttttttgagacggagttttgctcttgtcacccaggctggagtgcagtggcatgatctcggctcactgcagcctccacctcctgggttcaagtgatgctcctacctcagcctcccgagtagctgggattacaggtgcgcgccaccacgcccagctaatttttgtatttttagtagagatggggtttcaccatgtttcccaggctggtcttgaactcttgacctcaggtgatccacccaccttggcctcccaaagtgctgggattacaggcatgagccaccgtgcccag

SEQ ID NO: 41522 - DNA, 601 bp, Human
ccgtctgtcagccacgtctttctgagaaggggcttggcctgttccccgcaggcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcaggtgcgtgggtgtgggtagcaccatcgggtgggcaggcgcgggtgggcagaccatgtcccgaccgtggccgcacgcagcctgctcacgttttcctgcccttgtgttygtggaggagccgctgggatctgagtgtttccagaactcctggtcttcctggccgggtgattccctcctggagcccctgccctggcagcgtgggcagggctgtgttcctcccgaaccatccctcagcctctgtggtgctggtctctgtccggggcctttgcttatggcccttgcatgctcttttcctcagcacttgagctatttgattccgttaaggacctgcaggcactagtcacaagcagctgccgactggcgatggtgcagaacctgcgtgtctagtggcagaagcaggggtctgaga

SEQ ID NO: 41523 - DNA, 601 bp, Human
acgtgcctgcaggacttgttttttctgcaaagcattgtggttgtaactaacagaagcatttccttgcgactctccccccctagaaatttacacagagcatgaaattagatggcgagctgggcgggcagacgctggagcacagcaccgtcctggggctgcccgcaggggccgaggagcgggcccggaaggagctcgccaggaaggtgcgtggcctccaggtttggccagagagagacgcttcctcccggctgggcggcagcctgggcatcctgacgcagggagaacaaacctccccccttttacttccatctcccctcagattgaagaaaagacttaaaattagcttccaagcacaagcacaagagcctctcacaatcttctcagctctctggtccccacttcagccagtcgggctcgagggaacccccacagatcttcagagcgagcgctgtgcagggcgcctgggcgagggcaggggccacacccgctgtccctgctgagctcggtcctgagttagaaccatcaggctctcagcaggcacggacaggctgcatgtcctcggaggcatggccctgcggcgccggctccggggtggcatggt

SEQ ID NO: 41524 - DNA, 601 bp, Human
ggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggtgggtgggcgccaccccggctcagcccttcctcagctcagtccagcgcctgcccctgcccagcaccgccctggctcagcccttcctcagctcagtccagcacctgcccctgcccaacaccgccctggcccagtgctgtccyggctcagccttcccccagctcagcccagcgcctgcccctgcccagcactgccctggcccagtgctgccccggctcagccttcccccagctcagcccagcacctgcccctgcccagcaccgccctggctcagcccttcctcagctcagtccagcacctgcccctgcccagcaccgccctggcccagtgctgtcccggctcagccttcccccagctcagcccagcgcctgcccctgcccagcaccgccctggcccagtgctgccccggctcagccttcccccagctcagcccagcgcctgcc

SEQ ID NO: 41525 - DNA, 601 bp, Human
gccaccccggctcagcccttcctcagctcagtccagcgcctgcccctgcccagcaccgccctggctcagcccttcctcagctcagtccagcacctgcccctgcccaacaccgccctggcccagtgctgtcccggctcagccttcccccagctcagcccagcgcctgcccctgcccagcactgccctggcccagtgctgccccggctcagccttcccccagctcagcccagcacctgcccctgcccagcaccgccctggctcagcccttcctcagctcagtccagcacctgcccctgcccarcaccgccctggcccagtgctgtcccggctcagccttcccccagctcagcccagcgcctgcccctgcccagcaccgccctggcccagtgctgccccggctcagccttcccccagctcagcccagcgcctgccccggctcagcccttcctcagctcagcccagcatctgccccagcccagcgccaccccagctcagcacctgtccctgcatccaggccccatctcccctgcaccctcccctggtccacctggtgtagcctccttcagaaggtggggcaggtctgtgtcctggtgctagtgct

SEQ ID NO: 41526 - DNA, 601 bp, Human; identical to SEQ ID NO: 29127

SEQ ID NO: 41527 - DNA, 601 bp, Human; identical to SEQ ID NO: 29128

SEQ ID NO: 41528 - DNA, 601 bp, Human; identical to SEQ ID NO: 29129

SEQ ID NO: 41529 - DNA, 601 bp, Human; identical to SEQ ID NO: 29130

SEQ ID NO: 41530 - DNA, 601 bp, Human; identical to SEQ ID NO: 29131

SEQ ID NO: 41531 - DNA, 601 bp, Human; identical to SEQ ID NO: 29132

SEQ ID NO: 41532 - DNA, 601 bp, Human; identical to SEQ ID NO: 29133

SEQ ID NO: 41533 - DNA, 601 bp, Human; identical to SEQ ID NO: 29134

SEQ ID NO: 41534 - DNA, 601 bp, Human; identical to SEQ ID NO: 29135

SEQ ID NO: 41535 - DNA, 601 bp, Human; identical to SEQ ID NO: 29136

SEQ ID NO: 41536 - DNA, 601 bp, Human; identical to SEQ ID NO: 29137

SEQ ID NO: 41537 - DNA, 601 bp, Human; identical to SEQ ID NO: 29138

SEQ ID NO: 41538 - DNA, 601 bp, Human; identical to SEQ ID NO: 29139

SEQ ID NO: 41539 - DNA, 601 bp, Human
tccgtctgctgggttcaagcaactcttctgcctcagcctcccaagtagctgggactacaggtgtgcaccaccatgactggctgatttttttgtatttttagtaaagatggggtttcaccatgttggccatgctggtcttgatctcctgatctcaggtgatctacctgccttcgtctcccaaagtgctgggattacaggcgtgagcgaccacgcctggccaagattacttttgttttttttttgagacagtctcactctttttgcccagggtggagtgcaatggcacgatcttggctcaccrcaacctccgcctcccgggttcaagtgattctcctgcctcagcctcccgagtagctgggattacaggcacgcaccaccatgcctggctaattttgtattttttagtagagacggggtttccccatgttggccaggctggtctcggactcccgacctcaggtgatctgcccgccttggcctcccaaagtgctgggattacaggtgtgagccaccgtgcccagtcgattactttcttaatcacaggggaaaagaaaaaaagtttaattacttctctgttgatttgcaatcaaaagaaataaaa

SEQ ID NO: 41540 - DNA, 601 bp, Human
gaaatagatgacagtagacacatataagcaatccacaaaaggcaaaacacgaaagaacaaaaaatatttaaatattatagaaacacaaaataaaataccaccttttgtcagacagataagcaaagactgaaattttgtcaaggaagtaaggaaacaggtagatacacttctggcagatataattttgtctttttgggagctatacaccaaatatctttaaaatccacatacatctttgactagtatttccatttctaataattaattctaagaaaataattggacaaagagatatacattwaaaaaatttactatggcactaactacaatataaaaatctgtccaacaataagggcttggttaaattttagtacatccaaactaagaattattattaaatcacttcaaaacattacatattgtataatcccagtttttaaaaagtaacatatattcacataaaaacatacctgcatagaaaaaaaatctagaagtatacaccccaaaatgttaccagtgattatctctgtaatagaagtggaattttttgtgattttttttgtttgtttttcagggtttgttttttttttttttttgctta

SEQ ID NO: 41541 - DNA, 601 bp, Human
atgatcagggagaaagggccaaaatataccatactggtaaatattatggtaccccagaaaccagtatactcccgttggttatctgttgaataatgactgaaaagtataaagtaatgattataaatactaactcagaaaattatcagagggcataatccaaagaatgttatttacaaataaaaagaaatagatgacagtagacacatataagcaatccacaaaaggcaaaacacgaaagaacaaaaaatatttaaatattatagaaacacaaaataaaataccaccttttgtcagacagatwagcaaagactgaaattttgtcaaggaagtaaggaaacaggtagatacacttctggcagatataattttgtctttttgggagctatacaccaaatatctttaaaatccacatacatctttgactagtatttccatttctaataattaattctaagaaaataattggacaaagagatatacatttaaaaaatttactatggcactaactacaatataaaaatctgtccaacaataagggcttggttaaattttagtacatccaaactaagaattattattaaatcacttcaaaacattacat

SEQ ID NO: 41542 - DNA, 601 bp, Human
tttacttccttttttctggtagctttgcattttctagtttctttaaaatgtaaagtaagattatttatttgaggcctttcttattctttaatgtagatgtttattgctaataatttccctctcaggactgttttcactgcatcatttaagtcacatatattgtttccattttaatttatttctaagtattctctaattcccacatatttgtaaatttccatatatttgtaaattttccagtattccttctgttaatgattactaacttcattccactgtgactggagaagatacatagcawgatttcaatctttttaaatttactgaaacttgttttgtggcctaatacagcctggagaatgtttcatgtatactttaaaagaatatatattttggcagggtgcagtggctcacgcctataatccctgcactttgggaggccgaggagggtggatcacctgaggtcaggagtctgagaccagtctggccaacatggcaaaaccccgtctctactaaaaatacaaaaattagctgggtgtggtggtggacacctgtaatcctagctactcaggaggctgaggcaggagaatcacttgaaccc

SEQ ID NO: 41543 - DNA, 601 bp, Human
tatttacttccttttttctggtagctttgcattttctagtttctttaaaatgtaaagtaagattatttatttgaggcctttcttattctttaatgtagatgtttattgctaataatttccctctcaggactgttttcactgcatcatttaagtcacatatattgtttccattttaatttatttctaagtattctctaattcccacatatttgtaaatttccatatatttgtaaattttccagtattccttctgttaatgattactaacttcattccactgtgactggagaagatacatagmatgatttcaatctttttaaatttactgaaacttgttttgtggcctaatacagcctggagaatgtttcatgtatactttaaaagaatatatattttggcagggtgcagtggctcacgcctataatccctgcactttgggaggccgaggagggtggatcacctgaggtcaggagtctgagaccagtctggccaacatggcaaaaccccgtctctactaaaaatacaaaaattagctgggtgtggtggtggacacctgtaatcctagctactcaggaggctgaggcaggagaatcacttgaac

SEQ ID NO: 41544 - DNA, 601 bp, Human
ttatttacttccttttttctggtagctttgcattttctagtttctttaaaatgtaaagtaagattatttatttgaggcctttcttattctttaatgtagatgtttattgctaataatttccctctcaggactgttttcactgcatcatttaagtcacatatattgtttccattttaatttatttctaagtattctctaattcccacatatttgtaaatttccatatatttgtaaattttccagtattccttctgttaatgattactaacttcattccactgtgactggagaagatacatarcatgatttcaatctttttaaatttactgaaacttgttttgtggcctaatacagcctggagaatgtttcatgtatactttaaaagaatatatattttggcagggtgcagtggctcacgcctataatccctgcactttgggaggccgaggagggtggatcacctgaggtcaggagtctgagaccagtctggccaacatggcaaaaccccgtctctactaaaaatacaaaaattagctgggtgtggtggtggacacctgtaatcctagctactcaggaggctgaggcaggagaatcacttgaa

SEQ ID NO: 41545 - DNA, 601 bp, Human
tctttatttacttccttttttctggtagctttgcattttctagtttctttaaaatgtaaagtaagattatttatttgaggcctttcttattctttaatgtagatgtttattgctaataatttccctctcaggactgttttcactgcatcatttaagtcacatatattgtttccattttaatttatttctaagtattctctaattcccacatatttgtaaatttccatatatttgtaaattttccagtattccttctgttaatgattactaacttcattccactgtgactggagaagatacwtagcatgatttcaatctttttaaatttactgaaacttgttttgtggcctaatacagcctggagaatgtttcatgtatactttaaaagaatatatattttggcagggtgcagtggctcacgcctataatccctgcactttgggaggccgaggagggtggatcacctgaggtcaggagtctgagaccagtctggccaacatggcaaaaccccgtctctactaaaaatacaaaaattagctgggtgtggtggtggacacctgtaatcctagctactcaggaggctgaggcaggagaatcactt

SEQ ID NO: 41546 - DNA, 601 bp, Human
tactattcctgattttgagcctttctatcaagaacagctgttgaattttgtcaactgcctactgtatcaattgaaacaatcacgtgggggttttccccgcttcattctattaatgtgttgtactacaccacccttgcaatcctgggaataagtcccacttggccatggtgcatattcctttaaatatgctgctagattcagtttgctagtattttgttgaagatttttgcatctttattaataaggaatattggtctgtaattttcgcattacgtctttgtttggctttggtatcagggtrataatactggcctcaaagagtgagttaggaagtattcttactctctcctctccaattttttggaagagtttgagagcgattctcatactctttaaatatttaaatatttggtattcttctttaaatatttggtagaatccaccagagaagcaatatggtactggacttctgattgggagtttttgttttgttttgagatagggtctcactctatcacccaggttggagtgcaatggcataatcatggatcactgcagtctcaacctcccaggctcaagtaatcttagtttgggaggtttt

SEQ ID NO: 41547 - DNA, 601 bp, Human
ggattctttgggattttctatatataggaccatgtcatctgcaaacagagacagttttatttcttccttccaaatctgtatgtctttgtttctttttcttgtcacactgctctggctataacttccactacaacttgaataactggtgagaatgggtatccgtgccttgttcctgatcataagggcaaggatttcagtcttttactattgagttggatgttagctgtgggttttttcataaacgctgaatgttgaggaaatgtttaaaaaaaaagttccctactattcctgattttgagcmtttctatcaagaacagctgttgaattttgtcaactgcctactgtatcaattgaaacaatcacgtgggggttttccccgcttcattctattaatgtgttgtactacaccacccttgcaatcctgggaataagtcccacttggccatggtgcatattcctttaaatatgctgctagattcagtttgctagtattttgttgaagatttttgcatctttattaataaggaatattggtctgtaattttcgcattacgtctttgtttggctttggtatcagggtaataatactggcctcaaagag

SEQ ID NO: 41548 - DNA, 601 bp, Human
aatcccaggccctggcaagcaacaatctacattctgtctcatagattacctattgtggatatttcacataaatggaatcatacaatatgtgaccatttgtgtgtgtcttctttcacttaatatgttttctaggttcatctgcatcgtagcatgtatctgtacttcatttctttactgctagacaatttatggaatacagactactgcaatttgtttactcattcatccactgatggacatttgggttgtttccaccatttagctattgcaaatagtgctgctatgaacatgtgtggtcatrtatttgtttgagtacctgctttcaattcttcagggtatatacctaggagtggaattgctgggtcatatgacaagtctatgtgttcctttgaggaattgtcaaactcttttttccacagaggctgaaccatttaacattcccaccagcaacatacgagggttccagtttctccacatcgtcctcaaaaccagttactgcccgtcttttgattctggccatcctagtaggtgagaagtggtatcttactgtggttttcatttgcatctccctgatcactaatgatgttgagtattaatgatg

SEQ ID NO: 41549 - DNA, 601 bp, Human
ccatccaatatatattttatttcagatactgcattcttcatctctatttttatattttctatgtatttccacatcatctttctgttttcccctcgtgtcttgaacatttagagcatattagtaagaactgtttctatatctttgtctgctaaaccatctttatcatttctgggtctctttcttttcagaaaatgtttaaatcctggctatgggtcatattttcattcttctttgtaagcattttaatattttattgaggtagaattgacataatatctaattaatccattcaaagtgaacrttcggctgggcacggtggctcactcctgtaatcccagcactttgggaggccgaggcaggtggatcacttgaggtcaggagttcaagaccagcctggccaacatggtgaaaccccgtctctactaaaaatacaaaatttagctgggcgtggcggcaggtgcctgtaatcccagctactgaggaggctgaggcaggagaatcccttgaacccgggaggcagaggttgcagtgagctgagatcacaccactgcactccagactgagcgacagagggagactacatctcaaaaaaataaataaa

SEQ ID NO: 41550 - DNA, 601 bp, Human
tcgctccagagcagcaacatcttctcaactcagagtctgccagactccacatctcagtttctactctctatgtcacatcctggaaaatctctcagtgcagtaggcctggggcaattgtaggactcaccttgtttgtttcttctctctcaagaatcacttgattcttgagattaagacctgaatgtcttaatcattgttgtttctacatattttgtttttttggagaagaggggtaggattgtttcaagaggacagtaaacacgatccttgttacaccacatggaccagaggcaaaagtccscatccgtccttcttatttaatctatctgtatctatttgagtttcttgtaaacatcataaatataccgtccctgacttacgatggttcaccttatgattcaactttaccatagtgacaaagtgatatgcactcagtagaaaccatactgaagtacctatataagcattctatttttcactttcagtatcacattcaataaattataatgagatatttaacactttattataaaatagggtgtatttagatgattttgcccaactgtagtctaacttaagtgttctgagcacatttaaggta

SEQ ID NO: 41551 - DNA, 601 bp, Human
atctttttggactttgtccaggcatacagttgagtaatttggaaatagtttgttcctttcaagtcttgtttttataatttactagttcgctccagagcagcaacatcttctcaactcagagtctgccagactccacatctcagtttctactctctatgtcacatcctggaaaatctctcagtgcagtaggcctggggcaattgtaggactcaccttgtttgtttcttctctctcaagaatcacttgattcttgagattaagacctgaatgtcttaatcattgttgtttctacatattttgyttttttggagaagaggggtaggattgtttcaagaggacagtaaacacgatccttgttacaccacatggaccagaggcaaaagtccgcatccgtccttcttatttaatctatctgtatctatttgagtttcttgtaaacatcataaatataccgtccctgacttacgatggttcaccttatgattcaactttaccatagtgacaaagtgatatgcactcagtagaaaccatactgaagtacctatataagcattctatttttcactttcagtatcacattcaataaattataatgagatat

SEQ ID NO: 41552 - DNA, 601 bp, Human
tctgatatgggtctttttgtctcttctgtatctctaactttttgaatacatggaatacagttataatgttttaatgccctctgctaattctatcatctgtgtcagttctgtgtcaattttgacggaagattctcataattatgggtcatatttcatgcttctttgcatacatggtaatctttaactgaatgacataccttgttaattttaccttgctatatgactcctataaatctttttggactttgtccaggcatacagttgagtaatttggaaatagtttgttcctttcaagtcttgyttttataatttactagttcgctccagagcagcaacatcttctcaactcagagtctgccagactccacatctcagtttctactctctatgtcacatcctggaaaatctctcagtgcagtaggcctggggcaattgtaggactcaccttgtttgtttcttctctctcaagaatcacttgattcttgagattaagacctgaatgtcttaatcattgttgtttctacatattttgtttttttggagaagaggggtaggattgtttcaagaggacagtaaacacgatccttgttacaccacatgg

SEQ ID NO: 41553 - DNA, 601 bp, Human
tgcttaacagttactcaagtctactatatctttgatgattttctgtccacttctatcaattattgacaggggttactaaaatctccaattatgactggatttctcaatttctccttgcatttctatcaggttttgtttcatgtgttttgaagctctgttattaggtgcataaacatgtaacatcattatgtcctcttaactgacctctttaccattataaatgaaatgaccttctttatccctggaaatattccttgctctcaaatatactttaatattaatatagccactccaagttgcytttgactaggttaccatattatatcttttcccattctttcacttttaacctgtttgtttacaaactatttcttgtaggcaagcatatagttggatcttgcttttatatccaatctgacaaattcagcctttaaactggagtgtttagacaatttacatttagtgtgactattcatatggttaggtttgattctatcatcttgctatttattttatatttttcccatttggtgtttgttccttttttcttctttttggacttctgttgaattattttgtgtgactccattttatctccttt

SEQ ID NO: 41554 - DNA, 601 bp, Human
ggggagctttcagtgagccgagatcgtgccacttcagcctgggcaacagagcgagactgtctcaaaaaaaaaggtgtccagtttttcaccaataagtacaaggtcagctaataaggtttttcatagaagcacattagcaggctgggaaagttcacttccacttctagtttgctgagagtctttatgatactgaatattagattttatcaaatgatttttctgcatctattgagatgatcatgtgatttttgctttttagttcattaatatgttaaattacactactgattttttggaacaytaaaccaaccccacattcctgggataaaccccacatggttatgacatattatccttttaataaactgttgaattagatttgctgaaactttgtttagatttttgcaattatatttatgagacatactggtctgtaatttccttaaaatgtatttgtctgattctggtatcccagtaatgctggcatcatgagccttgtaaaaaattccttccacttcaatatttttaaaagcatataaaattgatattattttttccttaacttgtataattcaccagtgaaactatccggacctagagt

SEQ ID NO: 41555 - DNA, 601 bp, Human
gtccaatagtactgtttaactcctgcctgaataaagcttatctaatgcacatatattctccgtaaggcatatcagagcctcctggtacttagaaacactatatggcacttaaacattacactttaaacattttaaacatcaaaataaccatctttgtaaacatcaaaataaccaacaaaaagcacaaacatgcaaaaaatgcagcactaaataaaccaagaaagggctacttgcttacagtatgaaacccaaaataagaaagcagagcattgtcttgtttgatcccagctgggtatatacrtgtgcactgggtgattcaaaatgttttgcccctgcaagtgtctgagaatgaccacaaaagcactgcaagtattggttttggggttacaaataaaaattagtgagtaagccaattcctaggtaaagaatccatgaataatgagaatcaactgtatcttattcaggtatcctttaatttcttgcagcagtattttgtagttctcattttctttaacatattttgttagacttatctctaagtagttcatatttttgatgcttttgaaaatgctactcttttattttcatttatgattgttct

SEQ ID NO: 41556 - DNA, 601 bp, Human
atttacctatttttacgccaaactattttacagcttttaattcttgaaatcaggtagtgttggctcccacactgttctttttcacagttgtttaaagttctttaaatttccacatgaattttagaatcaccctgtgcagttctataaaaaagcctgcaaagattgaaatataagtctcttaaatctataatttggtgaaaatcaacattttaacaaagttgagtattccaacccatgaaaaggatacacagtcacttctcattattgagataataatatgtcaatgactgttatgtgaatyagcaattatagagccattgctcccaggggaactaacgtattaggttcttgcaagcttctgctgacatttttgtgaactgatcatatgtcatgttttatgtgtttctgtttagagacttcttgtttagtatgtattactaatatatgttactgattcattaacattgaactcatgtccaatagtactgtttaactcctgcctgaataaagcttatctaatgcacatatattctccgtaaggcatatcagagcctcctggtacttagaaacactatatggcacttaaacattacactttaaa

SEQ ID NO: 41557 - DNA, 601 bp, Human
gtggcttttctctttattctcttaccagtgtcttttaaagagcagattttaatagtctaatttatcaatttttatagtttgtacttttaatgtatatctaagaaattattacctaactgaggtctaaaaatttttttctcctgttttcttccacgaacattatagttttaggttttacatttaagtccagaagccattttgagttagttttcctatacagcgcaaggtatgaatccattttttgtatatcaatatccaattgtttccaactgtggaaaaggctacatttctcccactacaytgcctttatgtctttgtcaaaattattagttatctacatataaggagtttatttctggactaccaattctgtttccactgatctatttgtcttttgttgttgttgttgttgttgttgttgttgttgttgttgttttgagacggagtctcgctctgtcgcccaggctggagtgcagtggcgcgatctcagctcactgcaacctccacctcctgggttcaagcgattctgccgcctatttacctatttttacgccaaactattttacagcttttaattcttgaaatcaggtagtgttggctc

SEQ ID NO: 41558 - DNA, 601 bp, Human
ctcaagctcaaaaacatggaatataatcaaatattttaatttctgataatttgatatttgacaaacagtatcccattattgttctttgcatatttttctccactactattttatgtttgtttgggttttttcttgttcagagacagtctcactatgttgcccaggctggactctaaccctgggttcaagctattttccctactcagcctcccaagtagctgaattacaggcttctatccttttttttttttttttgtattatagttaccaacttttccttttatggtctgtgctttttacrtcttgtttaggaagtcctctctaactgtcaagatctcaatgattttacttaaactcactaagccttctattctttctataaaatgagagaaataaatctatcccgcttaagtcccaaagttgttgtgagattaagagttgtaaatgtatgatatggttttctaaactatatcgcaaatacaaggtactattatagcttcagaatatttttctaataccacattattttaacctatatttttcctttctctcatttatagacacatttaattacttttttctttcacttcccataaaaaat

SEQ ID NO: 41559 - DNA, 601 bp, Human
atccaggacacaatggaggagctgggcaagtcagctgagggtacctacataaaaggcacacaacatttaagcaggttaaagagctatgtgaggattggggaaagaaaggaatagtaaaatggtggcagaatcaatggatctgcagtatgaaaggactgtggaagtcaaattactagacggaatgaactagaaagttaagaggcaagtgtcacagaaagatgaaagactgaaattaacattatgcagttattggtaatgataaggtcaagaatgtgattataggcatgagtggctgaaggasagtagagaacaagatcaccggagatgttaaagaaactaaaaggtcaacatgctggaacaatcatctatttaagtgttgaaatcaccaaaaattaaaatggggaatgctaaagagagtgaaagtgagccataagaaatgtgatgaaatcacccagatgtaaatgacaatcatgagggaatgtgggaagtgtgtctgctaatatgaaactcaaaactgggggattgtctcaaggaagaatacctggaattggcaatgaggagcaaagagtatatactacagggaccaagaaatgtaaacgag

SEQ ID NO: 41560 - DNA, 601 bp, Human
tgatataagagaagacaattccataccatactgaagacattaacctctgtcctgtgtttccaaactctggctgtacttttgagtcatttcagagctttaaaaaattcctgatgtgtgtgcttcacccaagaccgattaaattaacgggatgagactcaggcataagtattttttaaagctcctgaaatgattccaattaacagccaaagttgagaaccacttctcacctatgtcagcatatgtgtagtatgtgtgtgaattgccatataattaatgtaccaagaaaaaaaattttttttttgagaccgagtctcactctgtagcccaaactggagtgcagtggtgcaatcttggctcactgcaacctctacctcccaggttcaagcaattctcctgcctcagcctcccgagtaggtgggattatagtcacgcaccaccacaccccggctaatttttgtatttttagtagagaagggtttcaccatgttggccaggctgttctcaaactcctgacctcaagtgatcctcccgcctcggcctcctgaagttctgggattacaggcatgagtcaccatgcccagccccaagaaaattaatgagt

SEQ ID NO: 41561 - DNA, 601 bp, Human
gtaaaccatctcaaagtatcagcactagtacaatttacttgaaacttagccaggcttaccaacaaattatcagaataggaaaataatggaaaagaagaaaataccattttatgttattcatggctctcttcctcatattctaattaaaacagccttctttcgagatttgagcaaaccaaaacaataatctgtagaaaaaataactgtatacaggtacctaggaaataaactaatattacaataactcccattattataaggtatactaacttgtttcagagttcaattaaaaactgagcasaaaaataaaagaagacaaggcaaagactaaaataattattattttaatagtcacatattacaagttgttcagaatttgtgatactcatgggggaaggaggaaatcatgtaaacgtaagataggtcactacctgtcagcatgatataagagaagacaattccataccatactgaagacattaacctctgtcctgtgtttccaaactctggctgtacttttgagtcatttcagagctttaaaaaattcctgatgtgtgtgcttcacccaagaccgattaaattaacgggatgagactcaggc

SEQ ID NO: 41562 - DNA, 601 bp, Human
ccaaagcacttatgaatgaacagacatagttcttttaaaaactttagttcaaaaaagtgggtaggggatggtaaataaatttatcttggcaaaatattcaacgttggtatctatttcaaatttttcataataaattaaaagtaagatttttgtttgttttttgagatggagtctccctctgtcgccaggctggagtgcagtggcgcgatctcagctcacggcaacctccgcctcccaggttcaagcaattctcctgcctcagcctcccgagcagctgggactaaaggctcgtgccaccacrcctggctaatttttgtagttttagtagagacagggtttcgccattttgaccaggatgatctcaatctcctgatctcataatctgcccaccttggcctcccaaagtgctgggattacaggcaaaagtaagatcttaagatgttgtgggtttcataatgaatgttatgagacaaaactcctaacagcatgatatgcaccttatttattttcagtgcaggaacagtgcctgccacatagtaaatactcaacagaccttttactaaggggttgttttagtcctatatatgactaataagcaatg

SEQ ID NO: 41563 - DNA, 601 bp, Human
actcctgtttaagaaaagcagacagaaaagtaaagggaacattgtcttgtgccctaggtaccagctcagccacagcaggaagagcaaaaagcaggctcttggggtccctgagtccacacctacgctggacagcatttccggatctacttcagggagcccactgccctgaagaatgagcccatggaccagtggtggtgttggtggccacacaaggagaggttcctctgcctgtggaaaggggagggaagagtgggagggattttgtattatggattgagtgccagcttagccacaatagaaraaaacatcaggtaaattgctaaggtttttgactccaatccctggctctcagacagcacctctggacacacctggaacccagggaaaaacccgccaccctgaagggaagggccttgggcaaggccagtgctgtgctggcttcaggtctgacccagagcaatcccagggatgatgaccacagaggtgcctgcatcaccacacccccaattccaagtggcttagcactccatttgtttgggagaaagtaaagaaaaagaacaacaatctctgcctggtaatcctgagaattcttccggatctt

SEQ ID NO: 41564 - DNA, 601 bp, Human
caatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggtagctgggattataggcacctggctaattttttatatttttagtagagacagggtttcaccatgttggccaggatggtctcgaactaattacctaacrtgatccacccgcctcggcctcccaaagtgctgggattacaggcgtgagccaacgcaccaagcctccttcagttatttttatgctgccgtgtgtgtgtgtgtgtgtgtgtgtgtgtgtgtgtgtgtgtaggtatgggcatatgtgtactattaatacttgctcactctgttactagcctactataaatgaaacatacaacaagcagaacacacatagcagacaacataacagaaggagtcactgccatacctgggttattgttaacattacttttgggtggcttctgaactggtttgggaa

SEQ ID NO: 41565 - DNA, 601 bp, Human
cgctcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgrgtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcaccaagcctccttcagttatttttatgctgccgtgtgtgtgtgtgtgtgtgtgtgtgtgtgtgtgtgtgtgtaggtatgggcatatgtgtactattaatacttgctcactctgttactagcctactataaatgaaacatacaacaa

SEQ ID NO: 41566 - DNA, 601 bp, Human
acaggcgtgagccaccgctcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctccygcctcagcctcctgggtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcaccaagcctccttcagttatttttatgctgccgtgtgtgtgtgtgtgtgtgtgtgtgtgtgtgtgtgtgtgtaggtatgggcatatgtgtactattaatacttgctcactctgttactagcctactataaa

SEQ ID NO: 41567 - DNA, 601 bp, Human
ctgggatgacaggcgtgagccaccgctcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcrattctcccgcctcagcctcctgggtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcaccaagcctccttcagttatttttatgctgccgtgtgtgtgtgtgtgtgtgtgtgtgtgtgtgtgtgtgtgtaggtatgggcatatgtgtactattaatacttgctcactctgttactagcct

SEQ ID NO: 41568 - DNA, 601 bp, Human
ccgccaccatgtccagctaatttttttgtatttttttagtagagacagggtttcactgtgttagccaggatggtctcaatctcctgacctcgtgatccacctgcctcggcctcccaaagtgctgggatgacaggcgtgagccaccgctcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttyttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcac

SEQ ID NO: 41569 - DNA, 601 bp, Human
tttgagacagagtctcgctctgtcgcccaggctggagtgcagtggcacgatcttggctcactgcaacctctgcctcccgggttcacgccattctcctgcctcggcctcctgagtagctgggactacaggcacccgccaccatgtccagctaatttttttgtatttttttagtagagacagggtttcactgtgttagccaggatggtctcaatctcctgacctcgtgatccacctgcctcggcctcccaaagtgctgggatgacaggcgtgagccaccgctcccggcctactatctttactytaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggtagctgggattataggcacctgg

SEQ ID NO: 41570 - DNA, 601 bp, Human
atcatttttgtttgtttgttttttgagacagagtctcgctctgtcgcccaggctggagtgcagtggcacgatcttggctcactgcaacctctgcctcccgggttcacgccattctcctgcctcggcctcctgagtagctgggactacaggcacccgccaccatgtccagctaatttttttgtatttttttagtagagacagggtttcactgtgttagccaggatggtctcaatctcctgacctcgtgatccacctgcctcggcctcccaaagtgctgggatgacaggcgtgagccaccgckcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggta

SEQ ID NO: 41571 - DNA, 601 bp, Human
gaggggtaaagactacacattgggtacagcatacactgcatgggtgatgggtgcaacaaaatctcagaaatcatcacggaagaatttatcaatgtaaccgaataccacctgttccccaaaaactattgaaataaaaaaaaaaagataatgacatataatgttgttcgtattgtatgcaattagaacaactctttaaaattattcttaggagcttaaaattagaacagtaatttacttagcagtattttacatgcaggtggtttgcggaatttgtgatggggtttctttcttttttttttttcttttgagacagagtcttgctctgtcgcccaggctggagtgtagtggcgtgatctcggctcactgaaacctccgcctgccaggttcaagcaattctcctgcctcaacctcctaagtagtggggactacaggcacgcgccaccatgcccagccaatttttgtatttttagtagagacggggtttcaccatgctggccaggctatatataaatatatagttttatatattatataaatttatataaattatatttatataattatgtataattatataatatatacaatatattataaattt

SEQ ID NO: 41572 - DNA, 601 bp, Human
atgactctcacacacaatattgagaaaaatgagctatcacaagagtctactgtctgattccaacaagaaggcacaactaatctggtagaaatcagaatattggtttcctttagagttgtttaaccaactgaagtgggcatgagggaagcttccatagcactagtaaaacatgtggtgaagtgttcacagcataaaaattcatcaagctctataactgtaatgtgcccttgtctgtatacagtattagactttattttaaaagtttacaccaaataatcgattcattctctcagcttactayaacactcaaccatggaaattcttatctccactggggcctttcagacactctcctgtttccttcctctgactcttgctggtttacttcctgctataatcctctaaatatggacttgacccagagctcagcacacaattaactgctcttgctttacattatatgcctttgctttacattatatgccttagacagcttgttctgttccattccaaatgccactctcaacactcctgcagagcgggaggcatacagtactcaatgcacgtgagtctctttctttcttcacccataaactatgac

SEQ ID NO: 41573 - DNA, 601 bp, Human
aaaaagggcaaaacccagatataagcaacatggatgaatccccaaacaagaaaatcattatacaaagtaaaagaagccagatgcacataaatactgtatgagtctagatataaaaagttcaacaacaggcaaaaactagtctatgataataaaatagtgattatttctgggagaaggatgtgtcaaagacaaagaggtctgaggaaactctcagaggtgatgggaacattctgtatctcgatctgagtggtgatcacgtgaggctatacgtatgtaaaaagtcatcaaataaagtataaayacatatatacatacataaaataaagtcatcaagaggtatacttaagatttgtacattttactgtatgtctatcataccttcataaagtactacaaaaactgcatataaaggacaacttcaacttggttaaatatatttaaatgcaaagaaaaaaagaatgtaaagtacatgaaaatataaaaggtggcaaattctgggattacattatttacattttttcttttttccctataaattacaaacattcatgttcactaatgtatttagacaaatcaagaaaaaaactgagctctgcttggt

SEQ ID NO: 41574 - DNA, 601 bp, Human
acaagaacatgagctccataaggacagggattagtgtctgacttttcattgctttagcaccagactttttaaaagtaataaatttagaagtaataaaagtagtttatttccatttaaaagtaataaattcactagtcagaactgtagcaaaatttcaataaaggaccacagataccaaaataaaacaaatataaagatgtaatactctcataaatctatttactagagtacattagcaataaaattagtatataataggctaggtgttccttactcaggtgactaaagatatctactgtgytgaagtgggcaactagctttatttatttacattggggaacgtcagattaaacataaaggcaatgcgtatattatacagagaaagagaaaataaaacaactacaagagaaatgtgttgtcccttgtgcctcctatgcggtgtggacaccaagctgagggctgggaagcctgccattgtatgcatcacaattagaagcagagatgttacaggagagaatgaaatataccaaggaagccaagaaaagctgagggtttaggcccattagcaaggggaagatagtagatacactctggaagcatt

SEQ ID NO: 41575 - DNA, 601 bp, Human
aatttttatatctgtgaccatgggggatactgatcttaagttcactcttcctcatccttgctttggtaacttgttcaaattttcttctctggtttatgagagttttaaaaagacatttctaatgcgtctttgttatgggtttaggttaatttctcccaaataaaaaaaaatcctaatttaacattaatgttaataatttaacattatttttaacaaaatatttaaaaagttaccttgctgcctatctttcagttctacatctattctataaagtgatatctacatgaagtagaatcagttyaagagttctgacacacattccatgtgtaaagcatatgagaaaagagaaaagaatatattccccaaaccaagggatgtagtatacaaaaggcaaagttctatatctattgaaacaaattgggcttttcaccactttatgcttacttcatttatccaagagaatttaatgttgtatacttggatgactttttcctattgggttgaacatatgaaactgacatatttgtaggtcaaagaaacgtcaaatattggcagtttcatacggtttaacctctaatttaatggccttggaatagtaacc

SEQ ID NO: 41576 - DNA, 601 bp, Human
tacaaatacaaaaattagctgggcatggtggcacgtgcctgtagtcccagctactctggaggctgaggcagaagaatcgcttgaacctgggaggcggaggttgcagtgagccaagatcaagccactgtactccagcctgggcgacagagagaaactccgtctcaaaaaacaacaacaacaacaacaaaaacaacaaaaaaaaaaaaaccaaccatacttaaattgctttctaaatccaacggacactaaaacttcacaaaaccttcactgaaaatcagtatttgaagaaaatgcataaaargtgattgagcattaaggagaaacagctggtggataacgttttttgattcataaaggaaccctccaaaacaaagcagaaaaaaaagcttcaaaagtttttcggaatttttagagcaatgactggcaacctatataaacctttcagaattctgaatactgaaagcccacgtatttatatgtcacatgacatattaaaaagagcttcatggcctagcttggtggctcatgcctgtaatcccagcactttgggaggctgaggcgggcagatcacctgaggtcgggagttcgagaccagcctgac

SEQ ID NO: 41577 - DNA, 601 bp, Human
cgaggcgggtgaatcacgaggtcaggagttcaagaccagcctggccaacatggtgaaaccccgtcttcactacaaatacaaaaattagctgggcatggtggcacgtgcctgtagtcccagctactctggaggctgaggcagaagaatcgcttgaacctgggaggcggaggttgcagtgagccaagatcaagccactgtactccagcctgggcgacagagagaaactccgtctcaaaaaacaacaacaacaacaacaaaaacaacaaaaaaaaaaaaaccaaccatacttaaattgctttcyaaatccaacggacactaaaacttcacaaaaccttcactgaaaatcagtatttgaagaaaatgcataaaaagtgattgagcattaaggagaaacagctggtggataacgttttttgattcataaaggaaccctccaaaacaaagcagaaaaaaaagcttcaaaagtttttcggaatttttagagcaatgactggcaacctatataaacctttcagaattctgaatactgaaagcccacgtatttatatgtcacatgacatattaaaaagagcttcatggcctagcttggtggctcatgcct

SEQ ID NO: 41578 - DNA, 601 bp, Human
tgcaattcttcagtgatatataacagttatgaatacctatgcaccaaataatgcagcagccacctgaagccaaaaactacaggagatgcaaggagatataaacagaagcacacaaatactaagagattttaacacatcactctcagtacaacacagatcaagtggacaaaaaaacatataaaagaccaaagcaacaaactcttacagaagatgttatgctgtatatgtgtgtacatatgatcctccatttgatctcaaagaaagcataaggaagtgccacaaggtggagatattacagtcycaaatcaaaatataacaaactagaaattaataacaaaattttaaaaagcaaagggcccttctacttgaaaaataaaccttttattaagtaatttgtacatgaaagggaaaatacaaactagaaaatcaatactgaaagaataataaaaatactacatagcagaaactatagtacaaatgtaaaacaatggtcgaaggagaattcataaccttcaacagttatagcaataaacgtattcaaatgaatgaattaaattcaacataaatttttagaaggtatatattattactaatttcatat

SEQ ID NO: 41579 - DNA, 601 bp, Human
accgtgccaggccacataatttttaaacaaaaagtaaaatattaatggacatgaaactcactgacatttacagagctttttttctttatattgatgtatctaagaaagaatatttcttactgctaaaatgagataagttctcaattctactcttatttcacttatttcaggtataatcactaagaaatgtaattcacattaaaaactaaatcactctgagttttgttataacaaggtcactcaattttttctatgccaaaacacacactgtgatctaccatcagaaattatttttaatgaygtggcaattgatgttaagtcctctcacaatttgctgaaagcaagtaaccagaaactacctgacttacaaaggatgcattacacatttgctacaattattcagattctccatttctgggaaatattccaaaacagtattactatgacttatcaaatgattatgaattatacctgctattgtttcccttagcagtttaattttatatagtccaaaagggtagaaaacatcaaaatattgttaattccaatatccttttgctgaaataacatttgttttataaaatgttttgatcttatcata

SEQ ID NO: 41580 - DNA, 601 bp, Human
ctttgtgtgtaaaaaagaaaaccatgaaggattggaagggggaaaaaaaagaaattatataaataaaattatcaaactcaggcagataatttcatagaagtatgcattacttactagcaaatcttctcattttggaaaatgtttcactttttaatttttttagacacacaaataagaagaaaaacttccacattcaaaagaaagactaaaccatgcacaaatgaaccctttctgtttcctttaacatacaagaaagtgatttcatgaaatttattaaaactgttatttctggccaggcgcrgtggctcacgcctgtaatcccagcactttgggaggccaaggcacacagatcacgagatcaggagttccaagaccagcctggccaacatagtgaaaccccatctctactaaaaatacaaaaaaaaaaattagccaggcgtgctggcgggcatgctggcaggcgcctgcaatcccagctactcgggaggctgcggcaggagaatcacttgaacctgggaggtggaagttgcagtgagcagagatcgcgccattgcactccagcctaggtgacagagcaagactctgtcccaaaaaaaaaaaa

SEQ ID NO: 41581 - DNA, 601 bp, Human
cagcctcttctcggagtcactgcacgcacccctggctttccactcaccgtcttctggccttgccaatggcctgcacctgctgtgcccttgggcacccctgcctgggccccagactctgatgctgtcccctggctccttctggggtctctgcaagtggaacaagaggccctggcctctgagtgggcctgctgctgtgggcagcctctggcgtaccaccccccaaagcccaggaagtggcatgcatacgctgggaccagccctgtccacggggccctggggcctggtgtgctctgccggagamgggatgcattttgaggaaatgcctctgactccaggcctcccatacaggtctgtgcagattgcacctggcacctacccagagaactcagctgttctgtttacattgtggaggcacctctcaccctgacccacgcaaaggttctggagatttctggagaatatatttattaaagccacctcttcaccaaaagttaccaaaagggttggtttaggaagtaaatgaagggtcagtgtagagtcaaacgcagaagtgggcttgttatagggagggctttcagcatatgataaaagggtaatttgt

SEQ ID NO: 41582 - DNA, 601 bp, Human
ctaatatgtagtttctaaaggcatcaagccaagaaagagtagttcaatggtgtaatagttcagagatgcaaaacaaagaccgagatttccaaacattctgcacatcccatattcttgtttctaactcagccagttaaaaatatttttttgatatccaataagtggcatttttccaacgtctcatcacttcatacagatcattattcttgcttaccatttaagtaaagacttctatttgtatttaaattgactaacactgctccccattacccctttctcaacacagaggtccaggttgccraccctgatctttgcaattttctagaaattatctctaaactcacctattcctcattatatttgttccatcacaatagaaattataaaaaagataataccagcccccactctgtaatttggtatcttctctgaagaatttattctactaattcttctcctagttctaaactcctaaaaggaactgtcaagtaactatcaaataggattaacaaactcaactttaatactgctcactaagcttctttctcttacttataaaagtcatattaaaatgtactatgatggacagggcagtttgtat

SEQ ID NO: 41583 - DNA, 601 bp, Human
aatcagaaaaagaatgccaaaggggttatggtggggggaactacagacaaatatcgtccatgactatagagacaaaaaaccttaatagaatattagcaagtagaatttagcaacatacataaagaatcttagaccatgaccaagtatcgtttattgcaagcatacaaggctggttcaatgtttaaaattcaatcaatgtaatctatcacattaacaggtcaaaaatgagaaatcatatgatcagttaattgatgcagcaaaacatttaacaaaattcaacacccattcacgataaaaaaaattctcaaaaaactaggaagaagaacatgtccagttggatttaaaatatttactaaaaatctacacctaaaatcagacttaatggtgaaagactgttttgtacatgaagaatgaggcaaggaggtccactcccactactcttacacaacacagtgcttgaagatctagccagtgcaataaggtaagaaatgaaacacgtattagtccgttctcacattgctataaagaaatacctgagaccaggtaaattataagaagagttttaattggcttatggttctgcaggctgtacagggagcat

SEQ ID NO: 41584 - DNA, 601 bp, Human
aactggaaacagaaaaaaactatacataaaagcaattaaacaaaatcttggttctttgaaaaggataataaaactgacaaacttccagcaacactgacaaagaaaaaagaagacacaaatcatcaatatcagaaaagaatcagggattatcactagagatcctgtagacatcaaaagaataagggaatactaagatcaattctacacacagaaatttgacaattagacaaaatgagccaaatcctcaaaaagcacaagctatcacaacttacccaatatgaagatgacttgaaaagccctrtaagtattcaataaattgaactcatacatttaaaactcctaaaaaagaaaatctccagttgtgggtgttttcaggaagaattctgccaaacttttaaagatgtaatgtctactctataaaatctcttccagaaaacagaagaggagagaatgtctcccaactctttttatgagtacaatagtatcctgatataaaaatcagaaaaagaatgccaaaggggttatggtggggggaactacagacaaatatcgtccatgactatagagacaaaaaaccttaatagaatattagcaagtagaa

SEQ ID NO: 41585 - DNA, 601 bp, Human
gacctatatggttgcagggtttctaaaattttcataatcagtttagaaaaaataatgcagcttcttacatactgacatggaatgctgtttaaggtatttttcaaaggaaaaaaaaacagattcggaatactattacagaatgatactttcttaaagtaaatacatatacatatacatatccagagaatatcctgaaaggataatacatgaaactggcaggggcaggggcaaaattgggtaactggaatgcaggggtggcatagtatttacattaatatttgaattttttatattttatacygtataaaataaatacaaaaaattaaatacccacaaaaataaaaaagtaaaggctctgagaacttctacaataagaaaacgtttaaattttccttgatccagcattttacaaacctatatgactataggaaactgactcctctccctttttcaaataatagctatttctatcccaacagtgactgtgtattgcttacaccatattaaaaaacacttatttttttaaatcaattttttactagttgtaccaactaaatctagtaagaatataacccaggtcatttgaaatattctttttttt

SEQ ID NO: 41586 - DNA, 601 bp, Human
gtggaagttatgatctatataaatgtaatacaaatgacatctatatatggggtgggagttaaatagacctatatggttgcagggtttctaaaattttcataatcagtttagaaaaaataatgcagcttcttacatactgacatggaatgctgtttaaggtatttttcaaaggaaaaaaaaacagattcggaatactattacagaatgatactttcttaaagtaaatacatatacatatacatatccagagaatatcctgaaaggataatacatgaaactggcaggggcaggggcaaaattrggtaactggaatgcaggggtggcatagtatttacattaatatttgaattttttatattttatactgtataaaataaatacaaaaaattaaatacccacaaaaataaaaaagtaaaggctctgagaacttctacaataagaaaacgtttaaattttccttgatccagcattttacaaacctatatgactataggaaactgactcctctccctttttcaaataatagctatttctatcccaacagtgactgtgtattgcttacaccatattaaaaaacacttatttttttaaatcaattttt

SEQ ID NO: 41587 - DNA, 601 bp, Human
aaggaactaacagcaaagttatactatgttcaaagagatcaaagaaaatatgcttttaatgaataaatgtatggagaatttcagcagagaacagtaattataaaaagtagccaaacaaattctagaatatgatattcaaatttaaaattcactggatagacataatagccaaaaggagatgaccaaggaattaagattaatcaacagaaattatactacctaactattagaaaaaaagaagttaaaaaaatgaactgaagcttagggacctgttagacaaaattaaaaataattaaaattaaaaaaaaggtctaacagaaggagaggaggaaaaggggggaacagaaaaatattaaaagacctaagacccaaaaatttcctttggtaaaaggcatatttacatattcaagaagctcagtgaactagattaatataaagaaaaccacacaagatatgttatagtttaactgctaaaagctaaaaagacatattatttatggggagcaacaattcaaatgatggatgacttctcaagagaaaaaatctgaggccaggagacaagtggaacaacatctttaaagtctttataaagtgctgaaag

SEQ ID NO: 41588 - DNA, 601 bp, Human
gcttgaacccaggaggcagaggttgcagtgagccgagaccgcgccactgcactccagcttgggcaacagagtaaggctccgtctaaataaataaataaataatctggagagagagggagcttcatattctatgtataaaactgttcgaatctctatctgacccctgaaccacacacacacacacacacacacacacacacacacacacacacctggaaccaattcaaagaaatttagctacgagattagaatttgaggtgcctgccacccaatgcagaaaagttttgttgagaccccagcmaactaactgcctgcctaaaaaatttttttggccaggcatagtggctcacgcctataatcctaacacctttgggaggccaaggcgggaagattgcttgaacccaggagttagagaccaggctgggcaacatagcaaaaccccatatctataaagataagacaacaaaaccccatatctacaaaaaattagctgggcatggcagcatgtgcctatagtcctagctactcaggaggcggaggtggggggatcacctgagcctgggaggtggaggttgcagtgagccaagattgcaccactgca

SEQ ID NO: 41589 - DNA, 601 bp, Human
tgcctatataccggaagtacatgaggagctttaaaaaatactgaggacaagtcagtaagaaaaagaccactgaggccaggcacggtggctcatgcttgtaatcccaacactttgggaggccgaggcggctggatcacctgaggccaggagttcaagaccagtctggacaacatggtgaaaccccatttctactaaaaatacaaaaattagccaggcgtggtggtgggtgcctgtaatcccagctactcaggaggctgaggcagaactgcttgatcccaagagacagaagttgcagtgagcygagatcatgccacggaactccagcctgagtgacaaagcgagactccatctcaaaaaaaagaaaaagactactgaatcagcacaaaaactagcacaggttatacacttacagaccacagaaaaggaaatataaatgattttatgcatatgagaagatgtttgacctcattcataatcaaagaaatgcaaattaaaatgccaaagaggtatcattcttcacctaattatattggtaaaaaactccaaaacattcaaaacagcctcgtctctagtctagattattgtaataacctcccaactg

SEQ ID NO: 41590 - DNA, 601 bp, Human
ggcctaggcggaaccaggtttcaaatgaagatagagtggctccacagcaccccctaacctcaatactacattactatattcctctcaacttaaaagtgaatgattgcaagggagagacaggaccagcaagggccaggttctcagctatgtgggagtaaagcaatcaggactagcagaaggacaagttcaaagtgaaaggatgcatgtgagatctgaatggggaagtgctgggagtgaatgtactttgtgactatagactccaagtacctcttaacattgggcatgatctgaccttgaggcrgctacaagatgaggatgggctagatcagtggtttcatctttgcctatataccggaagtacatgaggagctttaaaaaatactgaggacaagtcagtaagaaaaagaccactgaggccaggcacggtggctcatgcttgtaatcccaacactttgggaggccgaggcggctggatcacctgaggccaggagttcaagaccagtctggacaacatggtgaaaccccatttctactaaaaatacaaaaattagccaggcgtggtggtgggtgcctgtaatcccagctactcaggaggctgagg

SEQ ID NO: 41591 - DNA, 601 bp, Human
gtgacaaaccagttgaaaattattatacttttcatgaaatatagcatatctgtgtactgagggacaattttcaaatagatatatatgttcacacatatactctgcagttcaaaaacatacaattttttttaaaatgtaagttttttttttttgaaacagggtctcgttctgtcacccaggctggagtgcagagcatgattatggttaactgcggcctcaacctgctgggctcaagcaatcctcccatctcagtctctcaagtagctgggaccacaagcatgtgccatcatgcctggctaattttttttttttgtagagacaggcactccctatgttgcctaggctggtcttgaattcctgggctaaagcaatcctcccaactcgggcgcccaaagtgctgagattataggcatgagtcactgtgcccagccacttttaacttttcaatatatattcactaaatactgcatgctagtaatctaatagcagaatcttacgtactaaaaacttatggaaaatatggcttattgtttctttgagttgtaagaatattcctattatttaattccagcagcagatatcatctttggttaagggttct

SEQ ID NO: 41592 - DNA, 601 bp, Human
aaagattaacaggggctcctttaggaggtgacatttgaacacagatttgaataaagtgagaattctaggcatggaaatgccagaaagaaaaagtgctctaagcaaataagacagcaagtgcaaaggccctgcagaaataacatgttggttggtccatttttgagaaagggcaagtgttccttgtacctgacaagccctgagtcaaggaatgattagtaggaaactaggtctgagaagtcaccaggcagcaaatcagaacttaattccacatgatggaagccactggaaagttttaagcagraaagtggcacaatctgacatgatttaaaaggatcttgttgctatttacccgaggagaggcaagaagagaataggtgacaagccattccatagtgcaggaaaagtcatctctaaaaataggagactgaactgctcaagaaaatataggattgcaggcagtgctacaatttcacttaaggattgtggtcattatatcaaggtggactagtcagcatagatgtttttctgtagcttcctaggagcaactgcagcagagtcagaggagctggaattaaccagttacagttttgccaagcatcgc

SEQ ID NO: 41593 - DNA, 601 bp, Human
tgcacgataaaggtccaggattatcaccacatcccacaatgtggcccatgtgacttggcaattgcttcagagtccattcaaggagaccacacacaatgcttactgcacaatggttaggtctttctctcttttttttttttttttttttcctgagacgaagtctcgctctgctgcccaggctagagtgcagtggctagatctcggctccccgcaagctccgcctcccgggttctcgccattctcctgcctcagcctcccgagtagctgggactacaggcgcccgccaccatgcccagctaatttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcactgtgttagccaggatcgtctcaatctccgaccttgtgatccgcccgcctcggcctctcaaagtgctgagattacgggcgtgagccaccacgcc

SEQ ID NO: 41594 - DNA, 601 bp, Human
attagaaatatagattagaaatggaccgactacaatgcaaagtaataaggagagcagattcagcataagaataaggagtttaggccagttcttaagcaggaagtgttatattcatacattttacggtgcctgaggtaatgaggctaatgaggtgtgactaaaaagctgcaataatgcagatatgaagagataacagagaatgtaagaagaaacaaaaaaaccaaaagaaattaagcagaaaaaattaagatatgtaataaaatccattaattcaacaattatttatggagcgtcttctatwtgacaggggactatgacaatgaacaacaacacttagagtggggaagataaacaataagaaaaatatgtagaatacctagtatgttagatgtagatgtaagaaaaagtaaagaggaaagggttcagaagtgtcagggaggtaggttttagatagggtggccaagagaagtttcattgagaaaatatcaattgtgtaaagacatgaaataagttagggaacaagccatgcagatctctgggacagtgcatctgaagcagagagtataccagcagcaagggcagcgaggcgggagtgtgccac

SEQ ID NO: 41595 - DNA, 601 bp, Human
caggcgacaacatgtagattaccgtgctttttgcagaagataattacgattagaaatatagattagaaatggaccgactacaatgcaaagtaataaggagagcagattcagcataagaataaggagtttaggccagttcttaagcaggaagtgttatattcatacattttacggtgcctgaggtaatgaggctaatgaggtgtgactaaaaagctgcaataatgcagatatgaagagataacagagaatgtaagaagaaacaaaaaaaccaaaagaaattaagcagaaaaaattaagataygtaataaaatccattaattcaacaattatttatggagcgtcttctatttgacaggggactatgacaatgaacaacaacacttagagtggggaagataaacaataagaaaaatatgtagaatacctagtatgttagatgtagatgtaagaaaaagtaaagaggaaagggttcagaagtgtcagggaggtaggttttagatagggtggccaagagaagtttcattgagaaaatatcaattgtgtaaagacatgaaataagttagggaacaagccatgcagatctctgggacagtgcatctga

SEQ ID NO: 41596 - DNA, 601 bp, Human; identical to SEQ ID NO: 37399

SEQ ID NO: 41597 - DNA, 601 bp, Human; identical to SEQ ID NO: 37400

SEQ ID NO: 41598 - DNA, 601 bp, Human; identical to SEQ ID NO: 37401

SEQ ID NO: 41599 - DNA, 601 bp, Human
aatatccaatagaagtggtcaagtcaacaaagacacaacactaactgtatacatatataacaacaaagtttcaaaatgcataaaacaaaaactaataaaactgtaagaagtagaagtaggaaaatccaaacttatagttggaaactttaacactggacaaaacaagtaatcataacagatacagggcctgaaagaagaaatcaagagggaaatcagaacatattttgagttgaatgaaagtaaaaacccatacagcgtgtatcccagaggtaaaaaaaaaaaaaaaaaaaaaaaaaaaaamcaagagagagacaggaaaaacccaacttgtcaaaatgtgtagggcagagctaaatcagtacttaaagaaaaattcacagcattaaatgcttatattagaaaaaagaaagttctcagatgtatagcctaagcttctacctcacaaaattagaaaagaacaaaaaattaaaaacaaaaacaagtgaaggataaaataaagagcagaaatccaaaaaaactgaaaatagaaaaacagagaaaaatcaatgcaactaaaacctaattgtttgaaaagacttaaaattttataaaccccctagct

SEQ ID NO: 41600 - DNA, 601 bp, Human
cttcaagcaaggaaggggtataataccagaaagaaatttgaatttacacaaataaatgaaggatattgaaaataatcaaaatgagagtaaatataaaaggcattttctgctgattttaatcacttaaaaagataactgactatataaagcaaaattagtaacagtgaattgtacggtttgaaaaatatagaaaactaaaatgtatagccacaataggaggtcagagaaacttagagaagtaacctatgtgaccacaatagaggtcaaaaaagaaaaaaagtaaacagagtaagtgcggggraaaaaaaaggcaactaataaaatggtgtgtttaaatacaacaatctcaataacttcagtaagtgcaaatggtctaatcaccctaactaaagggcaaagtttgtcaaattaaattttaaagaacaagacccaattatatgctttctaaaagaaaccaatttaaagataggttaaaagtaagcacagggaaaaaaatatcccatgcaaacaccagtcaaaataaaactggagtagctatattaatatcaaacaaaacagatttcagaacaaggaataaagggaaatatccaatagaagtggt

SEQ ID NO: 41601 - DNA, 601 bp, Human
ttttcaaggtattatgaaatctccctatcaactctttgaccccatgcagtcaggtgcctaccccttcctaataggggtttcctgttgggagaggctaaaacagagaggctctggataccaggcatagttgagggtgaaatccatgtgtcaccctgcaaataaggagatgggagttccaaggtttcatactgaaaaataagattccaagactcttttctcatttgcccctcagaagacacatccagggttccaaaccacaggaacagaaagataatgaggagaacagaagaaaaaaaatgcaaaaaaaaaaaaaaaaaaaaatcctcaggcacataagagaaagactacacccattaaacaagaataggaaggcttaaaaggaatattctgagaatgaggaagaactctgggaaatcaaaaataaaatagctgatgtgaaaatgtcagagagggactagaaaacaaacttgaggaaatcttcctagaaaacagaacaacaacaaaaacagaaatagggggagaaaagaaaaaccacaagaccatccataagattggcatctcagaaataaataacagcaaaaataaaagtaaagaaattatt

SEQ ID NO: 41602 - DNA, 601 bp, Human
ctattcttaccttatgttacctcaatactatacaattggctggatgtggtggctcaagcctgtaatcccagcactttgggaggccgaggcgagcggctcacctgaggtcgggagttcaagaccagcctgaccaacatggagaaaccccgtctctactaaaactacaaaattagccaggcatggtggcccatgccggtaatcccagatactcaggaggctgaggcaggagaatcgcttgaacccgggaggcggaggttgcagtgagctgagatcgtgccattgcacaccagcctggacaacragagtgaaactccgtctcaaaacatgtatatattatacaatttatccagtaggtaacatatgattttcatctgagagctatgcctaacttcaaaatttctttcttttaaagatcattgtttgaagagtaaggggaagaggtcaggagagatgaggtcaaagtaattactacgagaacttctctcttgaaaaggagaaacccagcaagcacaaagtacagttcatctcccaatccttactttctgtatttcttctactgtacccctcagacacaaacgagaaatataaaaggagatgatat

SEQ ID NO: 41603 - DNA, 601 bp, Human
taatggagtaattccatttgtaggaatttctccaacaaatatgctaccacatacgtaaaattacttatgtatgaggtttttacatggcagataataggaaaatactataaacaatctaaatatccatctgtgaaaaattgattaaataataataaatccctatacatatcaataggaaaggatcttcaggacatactgttaagctaaaataaaatgggtagaacagcatgttcaaaaggctaggggattgaataatatatatttgaatttgtgtgtgtatatatgtgtgtataaaatgtayatacatttatacatatgtatataaatcatatatataaattctgggacaatacacacacaaaaaaacaaccacaagttacctgcttgaaggtcagggtggccactgcactaatgaggacaaaaaatacggagagctgttttgcatttttaatttttccccatttaaaaaccccagtaaaaatagaaaatgaaaaataaaattaatgaaatagtggaatttgaactaaacttcaactaaattcatcatcaaaaatgaaattgaaggtaaaaaacgataaaagatttctacttgttacagcat

SEQ ID NO: 41604 - DNA, 601 bp, Human
ggatagcattaggagatatacctaatgtaaatgacgagttaatgggtacagcacaccaacatggcacatgtatacatatgtaacaaacctgcacattgtgcacatgtaccctagaacttaaagtataataaaataaataaataaataaaataaaataaaaataaagaaatgtttttaatttcagagtcggaaaggtattatttattatacccaacttacacatgctataaaagaaaagactattttaaaatgtcattcaaatatattaaaaagaaaaaccaaactttaaaagaaaacagaraagaattttcatgtcataaaggcacacagatgcacacagtcctaccaagtaaaaaaaaaaaaaagagagaaaaagactaaccaatctaatgtccaaagggacatcagatatggttatgtcattcacagaaaaagtatagaaatggctcatagatctaccaaatacatagtctcattcttaataagagaaatgcaaaataaaactatactgaataccatatttcaactatcaaattggcaaagattcaaaactttgatagcacactgtgttcctgaagctgtagggaaacaggaaatctcc

SEQ ID NO: 41605 - DNA, 601 bp, Human
tacttggacacagggtgaggaacatcacacactggggcctgtcatggggtagggggctgagggagggatagcattaggagatatacctaatgtaaatgacgagttaatgggtacagcacaccaacatggcacatgtatacatatgtaacaaacctgcacattgtgcacatgtaccctagaacttaaagtataataaaataaataaataaataaaataaaataaaaataaagaaatgtttttaatttcagagtcggaaaggtattatttattatacccaacttacacatgctataaaagaaragactattttaaaatgtcattcaaatatattaaaaagaaaaaccaaactttaaaagaaaacagagaagaattttcatgtcataaaggcacacagatgcacacagtcctaccaagtaaaaaaaaaaaaaagagagaaaaagactaaccaatctaatgtccaaagggacatcagatatggttatgtcattcacagaaaaagtatagaaatggctcatagatctaccaaatacatagtctcattcttaataagagaaatgcaaaataaaactatactgaataccatatttcaactatcaaatt

SEQ ID NO: 41606 - DNA, 601 bp, Human
aaagaacttaaacaaatttacaagaaaaaaatcaagcaaccccatcaaaaagtgggcaaagaatatgaacagacacttctcaaaagaagacatttatgcagccaaaagacacatgaaaaaatgctcatcatcactggccatcagagaaatgcaaatcaaaaccacaatgagataccatctcataccagttagaatggcgataattaaaaagtcaggaaacaacaggtgctggagaggatgtggagaaacaggaacacttttacactgtaggtgggactgtaaactagttcaaccattgtgsaagacagtgtggccactcgtcaagagtctagaactagaaataccatttgacccagccatcccattactgggtatatacccaaaggattataaatcatgctgctataaagacacatgcacatgtatgcttattgcagcactattcacaatagcaaagacttggaaccaacccaaaagtccatcaatgatagactggattaagaaaatgtggcacatatacaccatggaatactatgcagtcataaaaaaaggatgacttcatgtcctttgtagggacatggataaagctggaaaccatcat

SEQ ID NO: 41607 - DNA, 601 bp, Human
tctagaaagcctccaagaaatagcagactatgtgaatagaccaaatctacgtctgactggtgtacctgaaagtgacgggaagaacggaaccaagttggaaaacactctgcagtatattatcccagagaacttccccaacctagcaaggcaggccaacattcaaattcaggaaatacagagaacgccacaaagatgctcctcaagaagagcaaccccaagacacgtaattgtcagattcaccaaagctgaaatgaaggaaaaaattttaagggcagccagagagaaaggtcatgttacccayaaagggaagcccatcagactaacagcggatctctcggcagaaactctacaagccagaagagagtgggggccaatattcaccattcttaaagaaaagaattttcaacccagaatttcatatctagccaaactaagcttcataagtgaaggcgaaataaaatcctttacagacaagcaaatgctgagagattttagtaaatgggctaaatgctccaattaaaagacagactggcagtttggataaagagtcaagacccatcagtgtgctgtattcaggagacccatctcacatgcagagaca

SEQ ID NO: 41608 - DNA, 601 bp, Human
cagcctccactggtgatacccaggcaaacaggatctggagtggacctccagcaaactccaacagacctgcagctaagggtcctgactgttggaaggaaaactaacaaacagaaaggacatccacaccaaaaccccatctgtacgtcaccatcatcaaagaccaaaggtagataaaaccacaaagatggggagaaaccagagcaggaaagctgaaaattctaaaaatcagaatgcctcttctcctccaaaggaatacagctcctcgccagcaacggaaaaaagctggatggagaacgacttytacaagttgagagaagaaggcttcagatgattggtaacaacaaacttctccaagctaaaggaggatgttcaaacccattgcaaaggagctaaaaaccttgaaaaaagattcgacaaacggctaactagaataaacagtgtagagaagactttaaatgacctgatggagctgaaaaccatggcacaagaactacgtgacgcatgcacaagcttcagtactgatttgatcaagtggaagtaagggtatcagtgattaaagattaaactaatgaaataaagcgagaagtttagagaaaaaaag

SEQ ID NO: 41609 - DNA, 601 bp, Human
gactcaatgattaagctgggtgcagtggctcatgcctataatcctaacactttgggaagccaaggcaggatgacttcaggccaggagtttgagacaagcctgggcaactccacaagaccttgtctctagtcgggggagtgggggcaaagctgggtgtggtgccacgtgcctgtaaaattagctacttgaaaggctgaggcaagaggatcccttgagcccaggagttcaagtctgcaatgagctatgatcatgccactgcacaactgacagaattttgctaacagagtgagaccctatctcaaaaaaaaaaagacaacgattaaaactggcacatagatagttagatgaacagaggagaacagaaagtctggaataataccaaattcataatcttagtatatggtaacagtgaactctcaatgcagtggggaataaagttgggtccatactttcagtataagtaacagatggatcaagacttcaagatttcaaaaaatgaaactataagagttccagaagataacttaaaagaaatgttttgattggaggttccaagatggccagataggaacagctccatgctgcagctcccagtgtgagc

SEQ ID NO: 41610 - DNA, 601 bp, Human
cagcctatgataaaactgatttcgttatatgtcatttcacttaaagtagtagtttccaagaacctatcaatgatgttaagtaagaacttactggatttaatttttttagtggtaaagcaaaaaaaagaagtctaatgttctgtattaacacaaaatgtaataaagtaaaaacaacaatagtacattggtaaatgcaccagactggagcccagctatctgggtttgagttgaggcagcagatattctccttatcatgctttcttcatctgtaagatgaattagtcttaaggaacttttcatytctttcagccctaataatctatgaatcatcttaacacaaaccagaaagcttggaataaaagaacacacttgaataacatcacccaaaaagcctgttgagtgttttttaaatttgactattactaaagtttttttaaatcttaagaaaaatcaagtaatgtagatggctgtgtcactgatgtaataatagttaaaacaaacatttcacatagtttctcagccatttagtgtttttacatgatccacccaaatatcaatctggtatctgaaacaatagtttgaacattttccatgtaataaa

SEQ ID NO: 41611 - DNA, 601 bp, Human
tatattattcagaaacttatggaagaatccacaatattattaataaaaacaactaactggaactgtataaatattaagtactgggctgggtgcagtggctcacacctataatcagcactttggaaggctaaggcaaaagggctgcttgagctcaggagtttaagaccagcctgggcaacacagcaaaacctcatctcaaaaactgtatttttaaaataatatatatatataaagtacttatccaatttttaaattttcttgtaaaaataacaaattcactttttagaaccaggaaagaagmagcctagcaagaaataaaatttagacaaaacacaccttagtccagccaaatacacacaaaaaaacctgttctcccacttttatctatgtatcaaaggcagagagggactttcacccttgcaaagctgtaacaactctccccaacttccctgatgtggtagtgtcagaaaaaactgagtaggcagcttggactttcatcctagccccgtggtgtcagtggagatcatgtagggacactaaacttctacccccacctagcagtaataggatgccccccacctccgtgctggagtggtgtcag

SEQ ID NO: 41612 - DNA, 601 bp, Human
gaggataatgagtcatcttcaatttttagtttatttaagtggggttaaaatgttgctcgtaaaataaagatcgttcttcttggttatgattcttctcagaaaaactccattagttatgatttccctacgacagaaaaacaccaaaaaatggattatataagtctgacatatgacaaaagtgacctgatctctcagcaggaagaaacacatactgaaatgtctaccgcagcagcttccaaacactgcaccacaatactcctctgccaggattcctattgcttcctagtcaatacctgcaaayggctcacaatacaataatagtacaatacaataacaataataattctggctaaaactcatagagtccttactagatatcaggcttgttccaaatgctttgcatatattagtttagtaatcctcacaatgaccctcaagaagtagggactatgaatattcccattttacacttgaaggccctaagacacaggtgatatgactggcttaaagtcacagccagtaagtggcaggtgttggggcagtatccaggcatctggctacagtcagcaagtataactacctttcagtagtaaaacaaata

SEQ ID NO: 41613 - DNA, 601 bp, Human
ctccacctcttcttttacacacagctcactgcaaatctggtcttccagataaggccctcagacccttagttctgcctaatttttaagccaaatatatactacttatgaaatcaaaaatcaacaatgcaaaatataaactcttgtggaaaactaaaaagagaaaatgttagctaacagcaaaacaatgaaaaaataaaaaaataggtaaataatttgttagaggtttcttcttaagatcagtttcagaatcaccttggaaacgaaaaagacacactaaaaaaagagtcattactgaacagatttttttttttttttttttttttgagacagagtctcgctctgtcccccaggctggagtgcagtggcgccatctcggctcactgcaagctctgcctcccgggttcacgccattctcctgactcagcctcccgagtagctgggactacaggctcccaccaccatgcctggctaattttttatatttttagtagagacggggtttcaccgtgtcagccaggatgttctcgatctcctgacctcgtgatccgcccacctcggcctcccaaagtgctgggattacaggcgtgagccaccacgcctg

SEQ ID NO: 41614 - DNA, 601 bp, Human
ttgttctctcccagggtagcctgaggccacgtattagttaagagtacatgtgacccaagggagcctactggaccaccatggtcatgtccctgaaggtcagggacaggtggaatgcatccttggcatgatctttagctactagactgatgtgagctacagaaatcccccttcctgctgccctgttgttgggatcaaatcgaacaggtagtatttgtaagtgactccacctcttcttttacacacagctcactgcaaatctggtcttccagataaggccctcagacccttagttctgcctaayttttaagccaaatatatactacttatgaaatcaaaaatcaacaatgcaaaatataaactcttgtggaaaactaaaaagagaaaatgttagctaacagcaaaacaatgaaaaaataaaaaaataggtaaataatttgttagaggtttcttcttaagatcagtttcagaatcaccttggaaacgaaaaagacacactaaaaaaagagtcattactgaacagatttttttttttttttttttttttgagacagagtctcgctctgtcccccaggctggagtgcagtggcgccatctcggctca

SEQ ID NO: 41615 - DNA, 601 bp, Human
ctccccaggctctgggtgcttgacttttagctacatgaaagcaagggagatcctgatgacagtgtgggcctcatagccgggaccttgttctctcccagggtagcctgaggccacgtattagttaagagtacatgtgacccaagggagcctactggaccaccatggtcatgtccctgaaggtcagggacaggtggaatgcatccttggcatgatctttagctactagactgatgtgagctacagaaatcccccttcctgctgccctgttgttgggatcaaatcgaacaggtagtatttgtawgtgactccacctcttcttttacacacagctcactgcaaatctggtcttccagataaggccctcagacccttagttctgcctaatttttaagccaaatatatactacttatgaaatcaaaaatcaacaatgcaaaatataaactcttgtggaaaactaaaaagagaaaatgttagctaacagcaaaacaatgaaaaaataaaaaaataggtaaataatttgttagaggtttcttcttaagatcagtttcagaatcaccttggaaacgaaaaagacacactaaaaaaagagtcattactgaa

SEQ ID NO: 41616 - DNA, 601 bp, Human
gacttttgaattggagagctcttaaaaggttttataagcgaacttaggagaaccttgcctttcaatgatcactgatgtcatgattctttcagagatgctgaagaagataagtgtttgtgagtagcaagtggtatcagaggtattaaaacacagcaagccaggcagcaagaaagataatgccactgatccaaatggttactgccactccactggaactcccagtttctctggaagtccttggaatgggcatagctatttcacaacaaataatttcttttcatttttcacagaaaagctttgaaaaaaaaaactttgtttccattgccagcttgaatttacgcctcaacaatgttggactataaatttgtttataaatacccaaatatccaataatactcaggcccactttgctacagtgagtttttcacaataaaaaattataattaaaaattcttaagaactagaaacaggggcttctggttcaaaacaggaaatgtgagaaaattatgaacaacagcatgattatctgtctctagtgatttttaaaaatcatttatatgagaactggtaggctctaagtaaggtctgtagtctagttcat

SEQ ID NO: 41617 - DNA, 601 bp, Human
gttgaagagggacttttgaattggagagctcttaaaaggttttataagcgaacttaggagaaccttgcctttcaatgatcactgatgtcatgattctttcagagatgctgaagaagataagtgtttgtgagtagcaagtggtatcagaggtattaaaacacagcaagccaggcagcaagaaagataatgccactgatccaaatggttactgccactccactggaactcccagtttctctggaagtccttggaatgggcatagctatttcacaacaaataatttcttttcatttttcacagmaaagctttgaaaaaaaaaactttgtttccattgccagcttgaatttacgcctcaacaatgttggactataaatttgtttataaatacccaaatatccaataatactcaggcccactttgctacagtgagtttttcacaataaaaaattataattaaaaattcttaagaactagaaacaggggcttctggttcaaaacaggaaatgtgagaaaattatgaacaacagcatgattatctgtctctagtgatttttaaaaatcatttatatgagaactggtaggctctaagtaaggtctgtag

SEQ ID NO: 41618 - DNA, 601 bp, Human
ctaaataatcattgccactctacaataattcattgttaatttatttttgtttggttactgctcaggataaactttttctcatgtagctactttaggtctgtgccttctttgacctcaattttgctcatggacttcaaccactacacttccctcgctcaggcttgtaacatccattatattcattcaccctttatctgaagaggtcctgaacccattctgccatcatctatcttttgtccctggttttgcctttgatgctcccatcttggtacagtctataactacagtacacagttacaaygcagatacaacatgggcactgttctagtactttacttctcatttaattcccataacaaccatatgaaatgggcattattattttcctatattagagatgaaaaaaactgaagcatggagaagatatgaaactctcccaaggtcatatggataataagcagcaatgctagaatttgactccaggcagtctgtctctagagtttgaatacttaaccattaccttaaatagcctcctaaaagaacaggtaggaaactaaatgcaacatctcaccagctccaaacccctaaggcttaaatccag

SEQ ID NO: 41619 - DNA, 601 bp, Human
caataaagttgtaaaaaaaaattgccaatttgacaaatggagtgtcatattactgatttttgttttttactatctgcataaacattatatatattttagtttaaagaataacttaaatgttataattctaacttctatactcaatttaaaaaatcaagaaacttaacagcattacttcagtattgttattatacaggactaatgggtttgccaatagcaatattataaagcaacaaaaatgctctccacactcaagagaggcattacctcacagcataagaacgtggagttcaggctctcytattctacagtaaagcctaagtggacttttcttcacaaataaagattactttctacagagttcaactaacagactagtcatagaaatagcataaaaacatagatttatgtggtcaagaactgaatgacttttaacttgaacatcagtaacagtatttggatgggtgttaattcacttaggatcttcctgttgtaaatttaagtcgcttttcaatagtataaagatctaaaagtagaatcaaagagtaatttagggtatgcatatttaaggaccttattttgctaattaggtttctcccaa

SEQ ID NO: 41620 - DNA, 601 bp, Human
cttaaggctgggtgctgtggctcatgcctgtaatcccagcactttgggaggccgaagctggcaaatcacgaggtcaggagttcgagaccagcctggccaacatgttgaaaccccgtctctactaaaaatacaaaaaattagctggacgtagtggcaggcgcctgaaatcccagctacttgggaggctgaggcaggagaatcgcttgaacccgggaggtggaggttccagtgagccaagatcacgccactgcactacagcccaggcaactgtctcaaaaaaaaatctttgccagttatcaayagtaacagaaagcaggtcagtggttgtctggggagtggagctggtgggagtgacagattgcaaaagggcatgagaaatcttttggtgagatgaaaatgtcaagactgattaaactgtagacattatgtgcagtttattatacttcaattatacctcaataaagttgtaaaaaaaaattgccaatttgacaaatggagtgtcatattactgatttttgttttttactatctgcataaacattatatatattttagtttaaagaataacttaaatgttataattctaacttctatactcaat

SEQ ID NO: 41621 - DNA, 601 bp, Human
gcacgcaggggccaaggtccagggaactttatcctgatgccattaagtataaaagagttttgtaagtttttttaaaaacactttaaatagcttaaaataatacagacagtcctccgcatgcatgagtcccatatccctggattcaaccaactgtggatagaaaacatttgcaaagagaaacaacaacaacaaaaacaacaacaaaaaaccccacacacaataaaaaataatgcaacaataaaaaaaaatacaaaatttaaaactaatacaatataataactatttacatagcatttatatmatatttgatgttgtgtaatctagagaagatttaagtatactggaatatgtgcataggttatatgcaaatatgatgccattgccattttctatcacggacttgagcatctgtggattttggtatctataaggtgtcctgaaaccaattcttcacggatatcaagggatgactgtatatcaatcctattttatgtattttctttattcctttatgttagctttcaaattctctacattaacatgtgttagtttttttataatcaggaaaaaatttcaataaatttttttacaagaaaacatt

SEQ ID NO: 41622 - DNA, 601 bp, Human
gctccaactgctattgtgctagttaagcttcaggcatcgcaccaaccaatactgtcctgacctcaagtcatgctcagtctatcaggagaggaacgaaaatggataatacaatgtgataggggtctcactagagacaggtgtatagagcagtgggaatgggaaaggagaagtgctaaaagctcagggaaggcttgctggagatgacgatgacagtaaatttcaaaggatgaggagaatacagtccaggaggaagaggactgagagcagatggccagcaggagcaagggcagggacctggagrgtttgtgttctaggaaacctcaggccatgccttatcacaagagcatacagagagtcagaattgcaaatgcaggtggaggcacgcaggggccaaggtccagggaactttatcctgatgccattaagtataaaagagttttgtaagtttttttaaaaacactttaaatagcttaaaataatacagacagtcctccgcatgcatgagtcccatatccctggattcaaccaactgtggatagaaaacatttgcaaagagaaacaacaacaacaaaaacaacaacaaaaaaccccacacacaata

SEQ ID NO: 41623 - DNA, 601 bp, Human
tgggagctgggggtggagggtggttgtcctgattgtatggccctgcactgtgaggagggattatggcatgagggtatcttaaatttccctgccaattaagatctggctggtttcatgctcacccggcatacaggagcctcttaactggtttctggatttctcacaaagaaaaattgcctataaattattgttgaattgctgtgttccagggcttcctattctaccatcttgccaaggctagaacattctcttacttaaaggtctttcaccagtttatcagttacactatagaacccaaackccttaggataacctaggaagcccttaataatctggctcctacttatcgctctatcttcatctacgaaatatttcatgaagatcccatgctccagttacacagatatatccaatactccaggctgtttgatcccaacacatctttatttctattgttcggttacacacatgcacatactctcttagttaagctccaactgctattgtgctagttaagcttcaggcatcgcaccaaccaatactgtcctgacctcaagtcatgctcagtctatcaggagaggaacgaaaatggataatacaa

SEQ ID NO: 41624 - DNA, 601 bp, Human
ctggaggctagcccaactctcctctgactcagtcatttccaatgacctgtctttgagattgatgaccttttcttctgcttgacattgtctgctattgaatccctctggtaactttttcagtttatggtattttttagctccatgctttctgcttgctactttttaaagttttctttttgttgaaattctcactttttttcatgcattgttcaccagacctcagtgggaatgtttgtaaggattactttgaattctctgtcaggtaaatcacatatctccatttcattagggtcagtttctrgagctttatctcattcctttatttaggaaatgttttcctgtttcttcatttttccttgattctctgtgtttgtgtctgcacaaactggcctcatactggagaagatcctaaccaatcagcctggacagagattctggaggcctctcaaacttttatgctagtctaatccactttctttgttcttggcagtccccaggcatcagtcccttgcttgtctcagtcccatcagagctctgagacaagcaagactgaagccaattcttcaggcaactcccagataagttgggtcattggatacat

SEQ ID NO: 41625 - DNA, 601 bp, Human
gggacaagggaaactgaatgtgtggaagtataatggggcagaaaatcaggaatgtgcagtgtcttcaccctgcaatttaatattttatatctcataaaagaggcatgaaaccccaacacatacagcaattgaggcacatcaggtaaaataaaggctgaatcagtccaaatttctttggaggtacaaacgcatgtattcaacagcctagtgatcctctcacctccacaaggatgtcccacagacaactctaactcacgaacacataaaaaagcaaatgggtatcatctcaaaactagcactrtctctaacttgctttgctcatactaccatgtggctgctcatgacccaacctagactcctggcaaccatctctgatttactcataagcaagtagttatcgtgttgctcaaacatctcaagaatatgaccattgtagggattatctagtgcattaattcaagccaggccatggacaggttctgaaatcaagaggagtgggggctatgtcattagttgatggagcttaaaccatattagagaagcactttcctttgactatcatttgtctcagagaagtttcaaaccacatttcaaactgctt

SEQ ID NO: 41626 - DNA, 601 bp, Human; identical to SEQ ID NO: 37402

SEQ ID NO: 41627 - DNA, 601 bp, Human; identical to SEQ ID NO: 37403

SEQ ID NO: 41628 - DNA, 601 bp, Human; identical to SEQ ID NO: 34721

SEQ ID NO: 41629 - DNA, 601 bp, Human; identical to SEQ ID NO: 34722

SEQ ID NO: 41630 - DNA, 601 bp, Human; identical to SEQ ID NO: 34723

SEQ ID NO: 41631 - DNA, 601 bp, Human; identical to SEQ ID NO: 34724

SEQ ID NO: 41632 - DNA, 601 bp, Human
tgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagccygagcccggttctggggcgaaaatgcctgcccttcacatcgaagatttgccagagaaggaaaaactgaaaatggaagttgagcagcttcgcaaagaagtgaagttgcagagacaacaagtaagttggctgttccggaatatttccttctctgaaatgaagcagggtccgatttttcctgcttagtaacagtaaagcaaatagtttagcttatttttccccctttttgtagcttctcttctcaccaccctttggcagtgcctggggactgccagctgatgtggggaaatcctaggaggtaga

SEQ ID NO: 41633 - DNA, 601 bp, Human
gcaaccgactatgtaaaaattgactgtatcattcattagcagtttctccctgctagccagcctgaccctttaggacacggcctgtggcatcaacttcccacctccagaaacctcaagtgtatgccagagggagaaaaaactttggatatatgtaaccttaggaaatacagaaagaggcatctaaatctcaacaataatattaagacatttgattatacacttggaattatacattattattgctaggcaagcattggaatgtttagagatcattcatctccctcactttaaggattaaaaraaacttgagtcccacaaaggctaactagctccacatttaagaccacagagatagatagtgatagggcaggtactaaaacattcttcttctcattcccagtccattattcagtcaataaatagttaacatctgggctacgtgttcagtccttaacttaggcccagacaaaacttgcaagttgcattctggctgtagttaaatgtttatcaaacatgtcctcttgattatggaaggaaatgtatcagaggagcaattactcacatttggaggttacagacctcttctgaaacctaatgaaaa

SEQ ID NO: 41634 - DNA, 601 bp, Human
aaaacattcttcttctcattcccagtccattattcagtcaataaatagttaacatctgggctacgtgttcagtccttaacttaggcccagacaaaacttgcaagttgcattctggctgtagttaaatgtttatcaaacatgtcctcttgattatggaaggaaatgtatcagaggagcaattactcacatttggaggttacagacctcttctgaaacctaatgaaaaaaccttgtaagaaaagattcaatgtagggagcatgtatcttgctgagaaattaacctgggacgacagaccctaarttatgacacgtgcattatcaactctaaaaattcacttaaaatgcatgcactctgaatgtcaacaaacgagagcaaatgttacctgaaagaattgtatttgaaagattttattttgccagattttaagtcacacaactacatcacctagttttcaatttgaggtcagaggcttccacactgatttgcagaggataatcatttggggtgtggaagtaaaatgttaacattgctatttctgtttagttttaaacctcacccatttataatttccagtttatgttttataattttgcatgatgt

SEQ ID NO: 41635 - DNA, 601 bp, Human
ggaaaattaaaataagagtatatttcagttcctaaaatattgtagacatggcataattgtattttagcagaggaaggaaatcatatgagacacaatggaaaaaaactgctggagatgatttatttaatgcagtgactttcaaacattttttaatttgaccaacgaccaacagtaagaaatatattttacataggttgcatcataggtatagtaatagaataaaaatattagagtgcagagcccagattttatatatgtattatatatataatatatacacacacacatgcacatatatatrtaaatgtaaaaaaatgtttaaaaacttcttgtattcaattatacttatttcattaaggcgtagggacaaagtttaaacaaccctaacctaatgtattctcttttttttctatacttaaggtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcc

SEQ ID NO: 41636 - DNA, 601 bp, Human
ttcctaaaatattgtagacatggcataattgtattttagcagaggaaggaaatcatatgagacacaatggaaaaaaactgctggagatgatttatttaatgcagtgactttcaaacattttttaatttgaccaacgaccaacagtaagaaatatattttacataggttgcatcataggtatagtaatagaataaaaatattagagtgcagagcccagattttatatatgtattatatatataatatatacacacacacatgcacatatatatgtaaatgtaaaaaaatgtttaaaaacttmttgtattcaattatacttatttcattaaggcgtagggacaaagtttaaacaaccctaacctaatgtattctcttttttttctatacttaaggtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaagga

SEQ ID NO: 41637 - DNA, 601 bp, Human
agctgtgcgttactataagggtccattaaaattccttgtgtctaacttattcttgctgatgagccagtttcctaaccccaaaggtaaagatcaaatgttaagtcgccaaaccttaaccacgttctactgccttaaccgtggcacaaggttcagattaagaaatcgcctttgacccagaagttccagttccaggacctttaacaataatgacacatacatttacctttgtaactcactgttaccagattaacgaccattactagcgtgctttgggtgcaaccacccactcttcaaattccgyttctgaagaaactaagatccagggccagtagggaaacagaaaccggagtcgggctttggaaaacatagcagcgtccataaccacgctcagtcaataacactaaaacactcgaccactgagatgccacctgtacacacccacccctagtccactactttctctagcctaccatccaaacttgaatctgactcaaacttaaggaaattccaaagatctgggacaaatggtgtgtttccactcgacatggaccccaaagatcccctctagacatcctgttttttggaccaaatgccaggaaca

SEQ ID NO: 41638 - DNA, 601 bp, Human
ttttcaaatgtttcatttattttctgaagtatactgcactctaatttagcggggtcttctttaaaaaaaaaatcgtgtcctaagagaaagcttcagaaccagaaaatgccgttctagtagctgtgcgttactataagggtccattaaaattccttgtgtctaacttattcttgctgatgagccagtttcctaaccccaaaggtaaagatcaaatgttaagtcgccaaaccttaaccacgttctactgccttaaccgtggcacaaggttcagattaagaaatcgcctttgacccagaagttmcagttccaggacctttaacaataatgacacatacatttacctttgtaactcactgttaccagattaacgaccattactagcgtgctttgggtgcaaccacccactcttcaaattccgcttctgaagaaactaagatccagggccagtagggaaacagaaaccggagtcgggctttggaaaacatagcagcgtccataaccacgctcagtcaataacactaaaacactcgaccactgagatgccacctgtacacacccacccctagtccactactttctctagcctaccatccaaacttga

SEQ ID NO: 41639 - DNA, 601 bp, Human
tcatcctcagcctttgtttatttagataaacgctacttttttggataggttctatcagtaagctaacaaaaccatttagagattcatgtgaagtgtggcagcttctgcctatggatatgtatcagattcactatgatcccaaatttaaaatttcaggtcaatatgcattcatactttaaaaaaaaagaaaagaaaaaatgtgtaacaaaagcctttgtcacttcacaccaatgtaaattatagcaatagtagttacctaggtaattacttctcctctcaatcacagaagagcttttttttwaaaaaaaaaaaaaaagaaagaaaaaaaaaggaaaaaaggagaaggtagtgggctctaaattggagaaattctaattttactggctgagctgaggtccaggtaacaatactttaaaaacttcccaagggattctaatgtacagtcagggctgagaaccattactcaagtcactttcctgcaatttaacatggcacactgcagcaggaaaatactcaaaagggcctaggggcctactgatgaaatccaaactctttggcctcgcatgcaaagatctccacagtgtgatcccgaatcccctac

SEQ ID NO: 41640 - DNA, 601 bp, Human
aattaccatgtatcagatccactgttctttctaggtgctacttttatggaactctaagggataagaatgtacacctccctgcctaatatagtacttcatagtcatcaggctatcaaacaacagatggagtgggccttagtgaatacatatataaatatgttgggcgattaacaggaaacggcatagttcagggtgttagttaactatactttttttttttttttgaggtggagtctcgctctgtcgcccaagctggagtgcagtggcgcgatctcggctcactgcaagctccgcctcccargttcaggccattctcctgcctcagcctcccgagcagctgggactacaggtgcccgccatcacacctggctaattttttttttttttgtattttttagcagagacagggtttcaccctgttagccaggatggtctcgatctcctgacctcatgatccatccgcctcggccccccaaagtgctgggattacaggcgtgaacttttttttaacataattgttgccatcaattttctcagtaaagggagaaaacgggctatctgctgaagaatgggtgatcattcagaatatacagtaaggaga

SEQ ID NO: 41641 - DNA, 601 bp, Human
ccaaagcagggagggggcaaactgaagctctaggaaagagacacaataacttatgcagaatgctagctgagagtcaagagggagattcatttattcttcaacatatatttgaagaattaccatgtatcagatccactgttctttctaggtgctacttttatggaactctaagggataagaatgtacacctccctgcctaatatagtacttcatagtcatcaggctatcaaacaacagatggagtgggccttagtgaatacatatataaatatgttgggcgattaacaggaaacggcatagktcagggtgttagttaactatactttttttttttttttgaggtggagtctcgctctgtcgcccaagctggagtgcagtggcgcgatctcggctcactgcaagctccgcctcccaggttcaggccattctcctgcctcagcctcccgagcagctgggactacaggtgcccgccatcacacctggctaattttttttttttttgtattttttagcagagacagggtttcaccctgttagccaggatggtctcgatctcctgacctcatgatccatccgcctcggccccccaaagtgctgggat

SEQ ID NO: 41642 - DNA, 601 bp, Human
gttaaaatcataaccacttaccatttcagctaataatttattctgggttttaacttcatggcctatttcaatggaaagctataaagaagaaggtatacacaggattactcacataaaagtattcaagtgttataaagtaaaaataatgtcattctaagcatacacattttctgaaatgaaacggtcttctagacacataaactctctttttctgatactttttctaccaagatcaataaaaaataaatttggaatttctactcctcccaattatggacatttcttctttcctctttatttyaatttcatcttaatattcaattccatcttttaatttggtatgtactacttctctctgattctcttaaccttgtatgcttttatatctttattatattcctacaaaagctacaaattcctacaaatatctgtatatttccttcttacattttatttattatattttataaattatatatatatattttaacttattttaggtttgggggtacaggtgaaggtttgttatacagttaaactcatgtcacatggatttgttgtacggattatttcgtcaaccaagaattaagcctagtaccca

SEQ ID NO: 41643 - DNA, 601 bp, Human
atgaaaaatgcaaaagcatggcaaaataaaccttatagttattccaaacacattagatacaaatggacgggaatcaaggacttacgatctctgtatttcaaaatgaataaaagttgaaattctattatttgcgaatattagatcaaatttcttaaagttaaaatcataaccacttaccatttcagctaataatttattctgggttttaacttcatggcctatttcaatggaaagctataaagaagaaggtatacacaggattactcacataaaagtattcaagtgttataaagtaaaaatwatgtcattctaagcatacacattttctgaaatgaaacggtcttctagacacataaactctctttttctgatactttttctaccaagatcaataaaaaataaatttggaatttctactcctcccaattatggacatttcttctttcctctttattttaatttcatcttaatattcaattccatcttttaatttggtatgtactacttctctctgattctcttaaccttgtatgcttttatatctttattatattcctacaaaagctacaaattcctacaaatatctgtatatttccttctt

SEQ ID NO: 41644 - DNA, 601 bp, Human; identical to SEQ ID NO: 40598

SEQ ID NO: 41645 - DNA, 601 bp, Human; identical to SEQ ID NO: 40599

SEQ ID NO: 41646 - DNA, 601 bp, Human; identical to SEQ ID NO: 40600

SEQ ID NO: 41647 - DNA, 601 bp, Human; identical to SEQ ID NO: 40601

SEQ ID NO: 41648 - DNA, 601 bp, Human; identical to SEQ ID NO: 40602

SEQ ID NO: 41649 - DNA, 601 bp, Human; identical to SEQ ID NO: 40603

SEQ ID NO: 41650 - DNA, 601 bp, Human; identical to SEQ ID NO: 40604

SEQ ID NO: 41651 - DNA, 601 bp, Human; identical to SEQ ID NO: 40605

SEQ ID NO: 41652 - DNA, 601 bp, Human; identical to SEQ ID NO: 40606

SEQ ID NO: 41653 - DNA, 601 bp, Human
ttcaacagctgcattctgataatctgcctggggaataactgttgatggataaaatacagtcagctcatctcgccagtgaataatgtgctttctggttctaccacgtgaaaatgaactgctcagatcctcttcatctggaataatttccagggaagaatgagtgactgaaactgctgacactttcagaataaacccttgatgtctttgacaattgctccaagtgatttgttttgggataagcttgcgcgccatgtaaggtaaagtgactgattctatagcaatccaattgttcctttgtctscccgtttacatataacaatgttgtcaatgtttgattgaaaatacctagcaggcgacacacacacctagctcctcaggcggagagcacccctttcttggccacccgggtatcccccagggggagtacggggctcaaaacacccttttggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttggttag

SEQ ID NO: 41654 - DNA, 601 bp, Human
ggaagaatgagtgactgaaactgctgacactttcagaataaacccttgatgtctttgacaattgctccaagtgatttgttttgggataagcttgcgcgccatgtaaggtaaagtgactgattctatagcaatccaattgttcctttgtctgcccgtttacatataacaatgttgtcaatgtttgattgaaaatacctagcaggcgacacacacacctagctcctcaggcggagagcacccctttcttggccacccgggtatcccccagggggagtacggggctcaaaacacccttttggaraaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttggttagagaaactgatttttcttttttctttttttttttcccaaaagagtacatctgatcattttagcctgcaactaatgatagagatattagggctagttaaccacagttttacaagactcctctccccgcgtgtgggccattgtcatgctggtg

SEQ ID NO: 41655 - DNA, 601 bp, Human
gggagcttgcggcggcctgaaggcgcagccccgctctcctgggtcggccagacccggggccctggggggcggtgggctgggcattcagggtgtggaagcctcaggtcccggggtcccccaaatcctgcctagtccactccccacccaaccctgccccttctcatccaatgtctggcaccgagcgctgatgcccgcgggttcccatcagctgcgcacgctcccagcccagccccagcaaacaggctcgccagcccgcgtcccccaggactcgagagccccccatccgtctgaagctgccgtrcacgccgccgccggcggagggcagtagagaccgagaaaaggtcggcgctccccgccccgagccaggagccgggaacttggggagggggcctgggggctcgagggccttgcagagccgcctgaagggcgagccgggacgcctgcgttcccgggactccggagatccccggctgcaggggcgggggcgctattttgggggcagcagctgctacggttccggcatctccagccaaaggatcaaaattccccgggtgggaactcccccctctcccgccggtcactcctagcccagcccccgccg

SEQ ID NO: 41656 - DNA, 601 bp, Human
agaagcctcagtccacgaacaggccacccgacaggggcgcggcctcacggacgggcagcgccgctgggggagcttgcggcggcctgaaggcgcagccccgctctcctgggtcggccagacccggggccctggggggcggtgggctgggcattcagggtgtggaagcctcaggtcccggggtcccccaaatcctgcctagtccactccccacccaaccctgccccttctcatccaatgtctggcaccgagcgctgatgcccgcgggttcccatcagctgcgcacgctcccagcccagccccagcaaacaggctcgccagcccgcgtcccccaggactcgagagccccccatccgtctgaagctgccgtgcacgccgccgccggcggagggcagtagagaccgagaaaaggtcggcgctccccgccccgagccaggagccgggaacttggggagggggcctgggggctcgagggccttgcagagccgcctgaagggcgagccgggacgcctgcgttcccgggactccggagatccccggctgcaggggcgggggcgctattttgggggcagcagctgctacggttccggcatctccagccaaa

SEQ ID NO: 41657 - DNA, 601 bp, Human
ggagacaggcagagacaaggacacaggccagcgggcaggaggggaaagagatcaggcagacacccatatccagacaaatgcagggaacagagaggagcaccctctctgctccgcaggggtccactgccctcacctcttcccggaactgggccgggcccagctcgtgcagtgagggcaccagaagcctcagtccacgaacaggccacccgacaggggcgcggcctcacggacgggcagcgccgctgggggagcttgcggcggcctgaaggcgcagccccgctctcctgggtcggccagaccyggggccctggggggcggtgggctgggcattcagggtgtggaagcctcaggtcccggggtcccccaaatcctgcctagtccactccccacccaaccctgccccttctcatccaatgtctggcaccgagcgctgatgcccgcgggttcccatcagctgcgcacgctcccagcccagccccagcaaacaggctcgccagcccgcgtcccccaggactcgagagccccccatccgtctgaagctgccgtgcacgccgccgccggcggagggcagtagagaccgagaaaaggtcggcgctccccg

SEQ ID NO: 41658 - DNA, 601 bp, Human
aagcgctccgtctccttccgtttccctcagcttttctgttccatctttgtttctctcactaaaaaaatggctaggatgtcttgagactttcctaaataaccaggacgggtcctatgtctacaaacatcacattttttaacaacacccatccaatgctagatttcattgtcctcttctcgatccaggtaaactggtgtgtgtgtgagagaatgtgtcactgctagtgaatcatcactggtttgacttaatccagctccaactcctttgtcttggtctcccttttttttttttttttttttttccagagatagggccactcaggctggagtgcagtggtgccatcatagctcactgcagcctcaacctcccaggctcaagcaatcctcctgcctcaccttcccaagtagctgggactagaggcacgagccaccgtgcctggctaagttttgtattttttttctttttaagagtcggggtcttgttatgttgtccagtctggtctcaaactcctggtctcaggggatcctcccaccttggcctcccaaagggctggaattacaggggtgagccactgtgccccgccccctccatgtctacctcg

SEQ ID NO: 41659 - DNA, 601 bp, Human; identical to SEQ ID NO: 41655

SEQ ID NO: 41660 - DNA, 601 bp, Human; identical to SEQ ID NO: 41656

SEQ ID NO: 41661 - DNA, 601 bp, Human; identical to SEQ ID NO: 41657

SEQ ID NO: 41662 - DNA, 601 bp, Human; identical to SEQ ID NO: 41658

SEQ ID NO: 41663 - DNA, 601 bp, Human; identical to SEQ ID NO: 17828

SEQ ID NO: 41664 - DNA, 601 bp, Human; identical to SEQ ID NO: 17829

SEQ ID NO: 41665 - DNA, 601 bp, Human; identical to SEQ ID NO: 17830

SEQ ID NO: 41666 - DNA, 601 bp, Human; identical to SEQ ID NO: 17831

SEQ ID NO: 41667 - DNA, 601 bp, Human; identical to SEQ ID NO: 17832

SEQ ID NO: 41668 - DNA, 601 bp, Human
tactgtactgtgctttttgaatgtcatgcacagccccctacaattgacttgaacactgttacagactgaatgtttgtggcccccaaaatttatatgctgaaattctaacccccaaggtgatagtaggaggagatggggtatttgggaggtaattaatcagagcggagtagtcatgaattggatgaatgcccatataaatgggaccccagaggactctttctctccaccatatgaggatacagtgagaagacaccatctgcacaccaggaagcaggccttcagcaagacactggatctgccrgcaccttgttcttggggttcccaccctcctggactgtgagaaataaatttctcgtaagccacccagtctatggtattctgttacagcagcgagaatggatgaggacacatttcaaaagaatcattgatctgactcaaaaattgtcccaaacttctataccacactcctttcttgtgagattgtgggagtaattgtaattagagaattgtttgatctaatactttatcacaaatgaattagtgggctgctgtcagaacatgggggagacattaacaaatgttcaagagacctgacagacag

SEQ ID NO: 41669 - DNA, 601 bp, Human
gtagtggcatgtacctgtaggcccagccacttgggaggtggaggtgggaggctcacttgagcccaagagtttgaggttgcagtgagccaagatcatgccattgcactccagtctgggtgacagagtgagaccctgtctaaaaaagaaaaagaatagaaaagaaaaaggtctctggcctggtgcagtggctcacgcctgtaatcccagaactttgggaggccgaggctggcggatcatgaggtcaggagatcgagaccatcctggctaacacagtgaaatcccgtctctactaaaaatacaraaaatgagccaggcatggtggcgggcgcctgtagtcccagctactgaggaggctgaggcaggagaatggcgtgaacctgagaggcggagcgtgcagtgagccgagatcgcgccaccgcactccagcctgggtgacagagcgagactctgtctcaaaacaaaaaaaaaaaaaagaaaaagctcaagataaattctgatgaacaaaatttttgatgtactgaagaaggaacaaagcagtttaagcatcagtggatttgtcataacttatgctcaataaggtagctgctcccagtaaaatagg

SEQ ID NO: 41670 - DNA, 601 bp, Human
tgcatttgtacaatcttggtatatttacattaataacctcacagaaaagccaggctttttttctatataatgtgcacatttacacaaaaaagctaaggactttgttttcttgaagcttcacttttaaaattatattatgaaagtggctcaagaccggctgcacacagtggctcatgcctgtaatcccaggactttgggaagccaaggagggaggatcacttgaagccaggagtttgagaacagcctgagaaacacagcaagactccacctctacaaataataataataataataataatcraaaaaataattagcctagtgtagtggcatgtacctgtaggcccagccacttgggaggtggaggtgggaggctcacttgagcccaagagtttgaggttgcagtgagccaagatcatgccattgcactccagtctgggtgacagagtgagaccctgtctaaaaaagaaaaagaatagaaaagaaaaaggtctctggcctggtgcagtggctcacgcctgtaatcccagaactttgggaggccgaggctggcggatcatgaggtcaggagatcgagaccatcctggctaacacagtgaaatcc

SEQ ID NO: 41671 - DNA, 601 bp, Human
acacacagcagagtgccgctcaggactgggagccttccctatccagagactgcttagagggtggaaagtacaccatctacacatgcaatgccttgcgcttgtttaacagcccaaggacatagaagagaaggaccaatgggggtacgtgcaaggaaacccaggcttggtcagagtcaagtggcaacccaagtttacaaagtgatgctacaacccagcagttggtaccttcgtgtaatgatctttccacgatcatggagcaaatgctgggtttgaagccagacacgtgggtgtgattcctggytctcctgcatcctagcaagttatttagaactgttgggaatttagtttccttgctctgaagggtggaaataataatacttgcatcacagagcagaggtgagattagaacagggcttctcaatcttggcacagttggcatttgggatggataattctttggtgtggggactgtcctgtgcattgtaagatgttgaacagcacttctggtctctacttgctggaaaccagtagcatccccttttctgctaaaacaactctcagcctcattcacattgggagacccactgaggtgcctttatca

SEQ ID NO: 41672 - DNA, 601 bp, Human
gcattaacctgtaagagaggaacactttccttcttaggaatagcccgctatgccacttgaaggctgtgcagcctcaggcagatccctcaagccttaggaatttggtgtgttcctattctgatagtcccccgtgagctgtcactgcagctcagaaggttggccggctgctgaggacttgacagtgctactttcccaaaccaccttctgttacgcacaagtcacactcccaaatcctcgctggaagatgtcacaacgacttgcagccttcccatggaaaacccattcatctcaggaagaccayaggctccctgttgtggcacacacagctctccttgaccacgcagacacaaagacacacacagcagagtgccgctcaggactgggagccttccctatccagagactgcttagagggtggaaagtacaccatctacacatgcaatgccttgcgcttgtttaacagcccaaggacatagaagagaaggaccaatgggggtacgtgcaaggaaacccaggcttggtcagagtcaagtggcaacccaagtttacaaagtgatgctacaacccagcagttggtaccttcgtgtaatgatctttccac

SEQ ID NO: 41673 - DNA, 601 bp, Human
tcaataaagtcgggcacattcactctcaaatccagccagagctacagagcagggcaggacaagtacagcaaaagagaagcaggtaagcagcttgctagggggctctggcagggagacatcgacactgactgtgatgagcagaaaggccttgtggtttggcatctccactgagctcctttgagaagaacaggaaagacagaggcagagtgcaagttggaaggcactcagaaaagggcagagaagtggaaatattcagattatcttcaagagtgaatgagtggcccaactgctgcagctggaragggtcaaaggggcagtaatggggattacagatgaaaactcatgctggggctagactgtgagcctccagcagtacagtgatggggctggacttcattctgtagacatcaaaggaggccccccttgattctccaccttagattgttccatctccacctctaactctagctctcctctccagttaaattgcgaaccatggccgttcctcagcacagaaccagccttgcctgtcaacgattgctttagacatagcagttttgatgtggggtttgatgaaactactacctactactacctactg

SEQ ID NO: 41674 - DNA, 601 bp, Human
gctccccactaattctgtccccctcttctcttgggtatgggagatccccctacagagtccctgcatgctggcctgaccaccagctcagctcccaaatcctgtccaggctggaatctattttttttttttcttttgagacagagttttactcttgtcacccaggctgaagtgccatggcgaaatctcagctcactgtaacctccgcctcatgggttcaagcaattctcctgcctcagccttccaggtagctgggattacaggcgcccgccaccatgcctggctaattttttgtatttttagyagaggtggggtttcaccatgttggccaggctggtctggaattcctgacctcaggtgatccacccacctcagcctcccagggtgctaggattacaggcgtgaaccaccatgcctggcccctgaattttagtttcttaatttatgtgtattaactgcctgttgtgtgctatctactgtgataatctcaaagtacaaaaaatgacccccagtttacaaaggggagaagtgaaggtaggcaaactatatttcaagggtgtccacagtgggtcaggaatcaggatcaacgttttacttgtgttct

SEQ ID NO: 41675 - DNA, 601 bp, Human
aagtataacttataaaaggtcctcattctaatttgtaaggacatgtaattttccctgcaaggagcccaccagtaaacacagagagcttcctcccttgaaactgataaggaataatagaaaatcctgcctgatatacctcattcacacccttaaagatgggccatagtgaggttcatggaaatgttagggcctggtcacaagtcatttgggaaaccaagtaaatagctgtcatatgtgaaaacccacgccccatatcacagaaccatgggctgctagagccgaggggaccaaccagcccccttaggacaaattctcacatcccaggtgagggctctgaacccgaaaaagatcaaggaggtaagctccagtctcctcccctcagcctggagctcttagggtgccattgtaccttaaaaggtccaagagctgcaaccctcttatttgttgctgctgctcaaagtgcttatttctgaccctacctgaaattcacaagggaatttgaactatgtgagattactcatttcctaacaggcttaaatgctagtgtgtggggagaaagtctagggttggggaagaggctccccactaattctgtccccct

SEQ ID NO: 41676 - DNA, 601 bp, Human
tgtgagtgatagtgagactgagttctagaactttgagtgcaagtaattcaatgaaatgaaaaatgttaacagtaattaaactttcccaagtaaattccatttttatcatggaatgcaagctcttaggagtataagggatgagtgaatgagatcgcagggaaaatacttgcagttttttagtgatttgaaattctccgaagaaagaatgactcactcacgtttgattttggttttcaaaccaaaaagactaagacaattcttgacgtttacgtcatttgacctccgtgtttgtaaaaccacyacatcataaggttttgttaattttgcaattgttatactcccttgaatagaaaacaatatggggaaaaaactgtggacagtgtctttattatcatccttgttactaaagtataacttataaaaggtcctcattctaatttgtaaggacatgtaattttccctgcaaggagcccaccagtaaacacagagagcttcctcccttgaaactgataaggaataatagaaaatcctgcctgatatacctcattcacacccttaaagatgggccatagtgaggttcatggaaatgttagggcctggt

SEQ ID NO: 41677 - DNA, 601 bp, Human
caggctacaggtagaaaatgtcctaaaacacagctgtgtgagtgatagtgagactgagttctagaactttgagtgcaagtaattcaatgaaatgaaaaatgttaacagtaattaaactttcccaagtaaattccatttttatcatggaatgcaagctcttaggagtataagggatgagtgaatgagatcgcagggaaaatacttgcagttttttagtgatttgaaattctccgaagaaagaatgactcactcacgtttgattttggttttcaaaccaaaaagactaagacaattcttgacrtttacgtcatttgacctccgtgtttgtaaaaccactacatcataaggttttgttaattttgcaattgttatactcccttgaatagaaaacaatatggggaaaaaactgtggacagtgtctttattatcatccttgttactaaagtataacttataaaaggtcctcattctaatttgtaaggacatgtaattttccctgcaaggagcccaccagtaaacacagagagcttcctcccttgaaactgataaggaataatagaaaatcctgcctgatatacctcattcacacccttaaagatgg

SEQ ID NO: 41678 - DNA, 601 bp, Human
aagaattgcttgaacccaggaggcagaggttgcagtgagccaagatagcgccacgacactccagcctgaatgagagagactccatctcaaaaaagaaaaaaaaaagaaaaagaatttaaaaaagaaagaaatccttactcaagcctacacagatcatcctatagctgaagattcaggctttaacttttgcaagttttttattcttcagaaatcaaggttcctgttcttgacacaggggggacactttaacaagctaagcccacattataaactggaagctggtgggctgaattttactggrgagtgtgtttaattgctaggcactgggttttttaaaaattctgaattctgatgcctttaaatgacaaatgcaccgtccagctcctagtagccccatcctgagcacctcctctccccattactacattcaggtcaccagctgttccccaaggacatctgagtctgccatctctgacagggacttcatttaccagggaattctccagtagtaacaaaatgagccagagagttcttggaggaggaagatatagcaagaagaacaaaaaagcaaacccaacaagctcaggggttgaaagaccac

SEQ ID NO: 41679 - DNA, 601 bp, Human
agcctggccaacatggcaaaatcccatctctactaaaaatacaaacattagccaagtgcggtgggggtgcctgtagtcccagctactcgggaggctgaggcagaagaattgcttgaacccaggaggcagaggttgcagtgagccaagatagcgccacgacactccagcctgaatgagagagactccatctcaaaaaagaaaaaaaaaagaaaaagaatttaaaaaagaaagaaatccttactcaagcctacacagatcatcctatagctgaagattcaggctttaacttttgcaagttttytattcttcagaaatcaaggttcctgttcttgacacaggggggacactttaacaagctaagcccacattataaactggaagctggtgggctgaattttactggggagtgtgtttaattgctaggcactgggttttttaaaaattctgaattctgatgcctttaaatgacaaatgcaccgtccagctcctagtagccccatcctgagcacctcctctccccattactacattcaggtcaccagctgttccccaaggacatctgagtctgccatctctgacagggacttcatttaccagggaa

SEQ ID NO: 41680 - DNA, 601 bp, Human
agaaatccttactcaaggccaggcgtggtggctcacgcctgtaatcccagcagtttgggacgctgaggttggcagatcacctgaggtcaggagtttgagaccagcctggccaacatggcaaaatcccatctctactaaaaatacaaacattagccaagtgcggtgggggtgcctgtagtcccagctactcgggaggctgaggcagaagaattgcttgaacccaggaggcagaggttgcagtgagccaagatagcgccacgacactccagcctgaatgagagagactccatctcaaaaaagaaaaaaaaaagaaaaagaatttaaaaaagaaagaaatccttactcaagcctacacagatcatcctatagctgaagattcaggctttaacttttgcaagttttttattcttcagaaatcaaggttcctgttcttgacacaggggggacactttaacaagctaagcccacattataaactggaagctggtgggctgaattttactggggagtgtgtttaattgctaggcactgggttttttaaaaattctgaattctgatgcctttaaatgacaaatgcaccgtccagctcctagtagcccca

SEQ ID NO: 41681 - DNA, 601 bp, Human
tactaaagaggtattcttatactaagtgctttctattttcctatatagtagattatttcccccaaactgtgccctgcttttgagtgcacctgtatcgctagcccttatttcttgccaataacaagttcagtgtggccctgcatttgctgagctccgcacccagcctggcctgggtcatgctgggtcacacagtttggcagttgttgctgtggaattgaactccacatgaggagaccaaaggccctgttgcaaatcactgacaagttaatgaggtgactgaccagggcagatgtgcccaaamctgccttcagacccaaaccacaactaggattcccaggggagagtcttgttatgttagctctatacgtagactcggtctgtttggaaaataggtaatacattctacagtgtagtaggcagataaaagcttcttttctctcttttctcatgcacggatgctggatttaaagagatatttctcagtctactgaaatgatgttagttagttggagttattttcccatgtagacatcagctgctgctgctacttctaccactataatttattaatacgccaaaaagcattaaatgataggcaggg

SEQ ID NO: 41682 - DNA, 601 bp, Human
atagagaaataagcaccttggagacagctgtttgtggatttcttggcaaattattgaatatggttgtttgaaaggagaaatttgcttttatttcctaaaaccattataattcctcatcttagctaattagtcagacgttacatttgtactaaagaggtattcttatactaagtgctttctattttcctatatagtagattatttcccccaaactgtgccctgcttttgagtgcacctgtatcgctagcccttatttcttgccaataacaagttcagtgtggccctgcatttgctgagctcygcacccagcctggcctgggtcatgctgggtcacacagtttggcagttgttgctgtggaattgaactccacatgaggagaccaaaggccctgttgcaaatcactgacaagttaatgaggtgactgaccagggcagatgtgcccaaaactgccttcagacccaaaccacaactaggattcccaggggagagtcttgttatgttagctctatacgtagactcggtctgtttggaaaataggtaatacattctacagtgtagtaggcagataaaagcttcttttctctcttttctcatgcacgg

SEQ ID NO: 41683 - DNA, 601 bp, Human
ttggtattattattcgttgccattaagattgtatgatagaggacgagtgcagtggctcatgcctgtaatcccagcactttgggaggccgagatgggcagatctcttgaggccaggaattcaagaccagcctagtcaacatggtgaaatcccggctctactaaaaatacaaaaattagccgggcatggtggtgtgtgcctgtaatcccagctacttgggaggctgaggcaggagaatcgcttgaacacaggaggtggaagttgcagtgagccaagattgcaccactgcactccagcctggcracagagcaagactctgtctaaaaaataaaaaataaacaaaaaaaagattgtgttatagagaaataagcaccttggagacagctgtttgtggatttcttggcaaattattgaatatggttgtttgaaaggagaaatttgcttttatttcctaaaaccattataattcctcatcttagctaattagtcagacgttacatttgtactaaagaggtattcttatactaagtgctttctattttcctatatagtagattatttcccccaaactgtgccctgcttttgagtgcacctgtatcgcta

SEQ ID NO: 41684 - DNA, 601 bp, Human
tgtatatggtcatttgttacacagccatagaaactgacagaaggcttctccttcagactgtggctaggagagttctaattccacccggttcaagctcaagtgctaacccacagctccctgtgccctgaccccgatatgctcccatgcaaagcaagccagggcaccaaattgtccacctggggagggagcaaggatttttgtctcatcttttccctgatgtgacttgagcacctcaaacagtgcctggcgctcctcaggcagccagaaatagtggccggaggggagtcttgtctgtctctcrgtttggctctgagctccaggctgcagggactttcttctttacgactgaggcctccatggcctggttggatgcctggcatgtggcaagtgctcaatggttacttgccgaatgaatggaaagctattattattggtattattattcgttgccattaagattgtatgatagaggacgagtgcagtggctcatgcctgtaatcccagcactttgggaggccgagatgggcagatctcttgaggccaggaattcaagaccagcctagtcaacatggtgaaatcccggctctactaaaaatacaaa

SEQ ID NO: 41685 - DNA, 601 bp, Human
cctgtctgctttttaagctgcattgcatgctgccgggttccttacccactgtggtcaaatttctctctagtcacgtttcagtccctcaaacatgctagcctgtctccttcccacttcagggctcaagcggaggctgttccccttgtctgaacacttgtagggagctgaatggcgccacaaaaaaagatacgacatgtcttaagcccagagcctgtgactattgccttagacggcaaaagacctgataaagtgaaggttcttgagctgaagagtttctcctgggtgatttaggtgggccctraatgctactacatgcacctttataaggaggacgcagagggagattgatgtggacacatagaggagcaggcgatgtgaagacagaggcacagactgaagtgaggccgctaggaaccaaggaatgccaaggactgctgacaccagaaggagtggaaggaggcaaggagcaggttctcccccagagccgtggagggagcctggcagtgccagcagcttgcttttggacttctggcctctagagaatacatttctgttgtattaagccaccatgtatatggtcatttgttacacagccatagaa

SEQ ID NO: 41686 - DNA, 601 bp, Human
ccactgcagcctctgcctcccaggttcaagcaattctctgcctcagcctccccagtagctggtattacaggcacccaccaccatgcccagctaatttttgtatttttttagtagagacaggttttcgccatgttagccaggctgatgttgaactcctgacctcatgatccacccaccttggcctcccaaagtgctgggattacaggcatgagccaacctaccctgcccctgtctgctttttaagctgcattgcatgctgccgggttccttacccactgtggtcaaatttctctctagtcaygtttcagtccctcaaacatgctagcctgtctccttcccacttcagggctcaagcggaggctgttccccttgtctgaacacttgtagggagctgaatggcgccacaaaaaaagatacgacatgtcttaagcccagagcctgtgactattgccttagacggcaaaagacctgataaagtgaaggttcttgagctgaagagtttctcctgggtgatttaggtgggccctaaatgctactacatgcacctttataaggaggacgcagagggagattgatgtggacacatagaggagcaggcgat

SEQ ID NO: 41687 - DNA, 601 bp, Human
gcacgatctcggcccactgcagcctctgcctcccaggttcaagcaattctctgcctcagcctccccagtagctggtattacaggcacccaccaccatgcccagctaatttttgtatttttttagtagagacaggttttcgccatgttagccaggctgatgttgaactcctgacctcatgatccacccaccttggcctcccaaagtgctgggattacaggcatgagccaacctaccctgcccctgtctgctttttaagctgcattgcatgctgccgggttccttacccactgtggtcaaatktctctctagtcacgtttcagtccctcaaacatgctagcctgtctccttcccacttcagggctcaagcggaggctgttccccttgtctgaacacttgtagggagctgaatggcgccacaaaaaaagatacgacatgtcttaagcccagagcctgtgactattgccttagacggcaaaagacctgataaagtgaaggttcttgagctgaagagtttctcctgggtgatttaggtgggccctaaatgctactacatgcacctttataaggaggacgcagagggagattgatgtggacacatag

SEQ ID NO: 41688 - DNA, 601 bp, Human
gccccaactgcgccaggtgagtctcctcattcctatcaagtctgcctcccaaatatgtccacctcccatccacttccctaccctccacactcaccccctcgctaagccaccaagacttcccacctgcatgactgcagcagcctcataacaggttttccctaacattacctacctgccaccagccacattttccaaacagcaccagatcatcttataacataaatccaatctgcttcttcccttcttaaaatctttcaaaaatttcttattatgcaggaaaatctgtctgcttttttttttytttctttctttcttttttttttaagatggagtctcactctgtcgcccaggctggagtgcagtggcacgatctcggcccactgcagcctctgcctcccaggttcaagcaattctctgcctcagcctccccagtagctggtattacaggcacccaccaccatgcccagctaatttttgtatttttttagtagagacaggttttcgccatgttagccaggctgatgttgaactcctgacctcatgatccacccaccttggcctcccaaagtgctgggattacaggcatgagccaacctaccct

SEQ ID NO: 41689 - DNA, 601 bp, Human
ctgggaggcccgcatgcctctaactgcctgccccaactgcgccaggtgagtctcctcattcctatcaagtctgcctcccaaatatgtccacctcccatccacttccctaccctccacactcaccccctcgctaagccaccaagacttcccacctgcatgactgcagcagcctcataacaggttttccctaacattacctacctgccaccagccacattttccaaacagcaccagatcatcttataacataaatccaatctgcttcttcccttcttaaaatctttcaaaaatttcttattakgcaggaaaatctgtctgcttttttttttttttctttctttcttttttttttaagatggagtctcactctgtcgcccaggctggagtgcagtggcacgatctcggcccactgcagcctctgcctcccaggttcaagcaattctctgcctcagcctccccagtagctggtattacaggcacccaccaccatgcccagctaatttttgtatttttttagtagagacaggttttcgccatgttagccaggctgatgttgaactcctgacctcatgatccacccaccttggcctcccaaagtgct

SEQ ID NO: 41690 - DNA, 601 bp, Human
agcatccctgccccttggccttgccttgatttgctcccacctgtgtcttgtggccccctcttcctcctgtttggagtctcccccagagctcttcagggctgccctggcttcttgtcactttctctccagccaaagcatccatttccaagtggtcaatttcacccacagtcagacaatccctccgtgtccctccctaacccagacctttctttctgagtgccagtcacatatccaactgaccacaagcgctgcaagtccaaacctggactcatgatcgcccctgaaacgtgcttcctgagcrggcaccactgtctgcacagcagcttacacctctcctgggaggcccgcatgcctctaactgcctgccccaactgcgccaggtgagtctcctcattcctatcaagtctgcctcccaaatatgtccacctcccatccacttccctaccctccacactcaccccctcgctaagccaccaagacttcccacctgcatgactgcagcagcctcataacaggttttccctaacattacctacctgccaccagccacattttccaaacagcaccagatcatcttataacataaatccaatctgcttct

SEQ ID NO: 41691 - DNA, 601 bp, Human
tactccaggccattggagaagggttttcccattttaaaacatggcatctgcgtcttctgcggggcctaaacaaggctaagggctcctggtaagctccctgactagctctaacccactcaactctccctccttcttgcctgccctgttctccagcatccctgccccttggccttgccttgatttgctcccacctgtgtcttgtggccccctcttcctcctgtttggagtctcccccagagctcttcagggctgccctggcttcttgtcactttctctccagccaaagcatccatttccaagkggtcaatttcacccacagtcagacaatccctccgtgtccctccctaacccagacctttctttctgagtgccagtcacatatccaactgaccacaagcgctgcaagtccaaacctggactcatgatcgcccctgaaacgtgcttcctgagcaggcaccactgtctgcacagcagcttacacctctcctgggaggcccgcatgcctctaactgcctgccccaactgcgccaggtgagtctcctcattcctatcaagtctgcctcccaaatatgtccacctcccatccacttccctaccctcc

SEQ ID NO: 41692 - DNA, 601 bp, Human
ggaaaaaggcccgttaggtgccaggaagagttatcaaaataaataacaaaaggtgttatcaacagtagacaatccagagactggacttcagtggcagagtgttttcttgtaccttaaagtaaccgcacttgttcacaatgaaataggggcaactgagggatttagcctggagtaacactcattcgagattttcactgtgttcttaagaggcagcatggtgcagtgggaagaaccctgcactgagaaccaggagacatggctttgccactgaacaacaaggtcaccccttactccaggccaytggagaagggttttcccattttaaaacatggcatctgcgtcttctgcggggcctaaacaaggctaagggctcctggtaagctccctgactagctctaacccactcaactctccctccttcttgcctgccctgttctccagcatccctgccccttggccttgccttgatttgctcccacctgtgtcttgtggccccctcttcctcctgtttggagtctcccccagagctcttcagggctgccctggcttcttgtcactttctctccagccaaagcatccatttccaagtggtcaatttcac

SEQ ID NO: 41693 - DNA, 601 bp, Human
cccagggaccaaaacatatggggaatgacaaaaatctaagaaatcgtttgtcattttgtcagtaggagcactaggagaaacactacaaataaacaactacaaatacaggtacagccacactttttctgccatgacttcctgctctttcttagccagaaggtataaataaatgcaaggtataaatcagtgcaaggtataaataaatgaaaaactgaacaaacaggaaagatgcttttgttatactaattatacagattttccaaatcacccttgaactcttaagaccatgacatttatcatmaaaaatgtcacaggaaggggaaggaatgtatttattaggcttggttatggattatgtggctgccatgctccataccttaccttatttaatgcaaccagcaacactgaatagtgtaggctatgatccccatatagatgaaggaaggtgtaacttattcaggctctcacacctagcaagctcagattcacacctggaccagtcagtctctcacctaaacctctcctcttccccctacctgagcctgagcctagcacaatggagggttcatccactaaatcacgctcatgccatgcccggagt

SEQ ID NO: 41694 - DNA, 601 bp, Human
aaaagagaccaaaagataagagggtatgtactgtactttttaaaaaccaaaatcttcaagtcagcctttttggctggcaatgatctggttgtcccagggaccaaaacatatggggaatgacaaaaatctaagaaatcgtttgtcattttgtcagtaggagcactaggagaaacactacaaataaacaactacaaatacaggtacagccacactttttctgccatgacttcctgctctttcttagccagaaggtataaataaatgcaaggtataaatcagtgcaaggtataaataaatgaawaactgaacaaacaggaaagatgcttttgttatactaattatacagattttccaaatcacccttgaactcttaagaccatgacatttatcatcaaaaatgtcacaggaaggggaaggaatgtatttattaggcttggttatggattatgtggctgccatgctccataccttaccttatttaatgcaaccagcaacactgaatagtgtaggctatgatccccatatagatgaaggaaggtgtaacttattcaggctctcacacctagcaagctcagattcacacctggaccagtcagtctct

SEQ ID NO: 41695 - DNA, 601 bp, Human
ttgcgcctccctagagcagcagtaggctctcgggccagctgtacaaataaaggatgaaggagatgagagcagacacagaaccgccggcctccctgtcttctgaagccagggcattcctttaggattttgtcccttgtcggttgcctaagtctagaatgtctcttgaacagggctaagataaaattacttttatttcataacaacttagtaaaagagaccaaaagataagagggtatgtactgtactttttaaaaaccaaaatcttcaagtcagcctttttggctggcaatgatctggttgycccagggaccaaaacatatggggaatgacaaaaatctaagaaatcgtttgtcattttgtcagtaggagcactaggagaaacactacaaataaacaactacaaatacaggtacagccacactttttctgccatgacttcctgctctttcttagccagaaggtataaataaatgcaaggtataaatcagtgcaaggtataaataaatgaaaaactgaacaaacaggaaagatgcttttgttatactaattatacagattttccaaatcacccttgaactcttaagaccatgacatttatcat

SEQ ID NO: 41696 - DNA, 601 bp, Human
gccagagtcagtctagcaaaaagagaaaaaccacccagtggaatgactggctttcagatgcacagcacccctgggtttttttggctacgtgcgcatgcaactgcctctgcagcttcgaagtcagaagacagagccgctgaatccagaaatgacaatcagcttgacagctgaggagactttggcatgccatgtgaagccactagatcatctctttctttctttcttttggttcaaaggccaaattgacaccgtatcatcaaacctgttatttgcgcctccctagagcagcagtaggctctcrggccagctgtacaaataaaggatgaaggagatgagagcagacacagaaccgccggcctccctgtcttctgaagccagggcattcctttaggattttgtcccttgtcggttgcctaagtctagaatgtctcttgaacagggctaagataaaattacttttatttcataacaacttagtaaaagagaccaaaagataagagggtatgtactgtactttttaaaaaccaaaatcttcaagtcagcctttttggctggcaatgatctggttgtcccagggaccaaaacatatggggaatgacaa

SEQ ID NO: 41697 - DNA, 601 bp, Human
gacataagtagcaggcccataaaagacatttttataactagagaatcattaaataatcacaggaattttgcatcactaaaaaaagtctttaaagaaatatttcacccagtcctaaccctgcactctccaccaccaacaataacctgctataaaacaagttgctgtgccagagtcagtctagcaaaaagagaaaaaccacccagtggaatgactggctttcagatgcacagcacccctgggtttttttggctacgtgcgcatgcaactgcctctgcagcttcgaagtcagaagacagagccrctgaatccagaaatgacaatcagcttgacagctgaggagactttggcatgccatgtgaagccactagatcatctctttctttctttcttttggttcaaaggccaaattgacaccgtatcatcaaacctgttatttgcgcctccctagagcagcagtaggctctcgggccagctgtacaaataaaggatgaaggagatgagagcagacacagaaccgccggcctccctgtcttctgaagccagggcattcctttaggattttgtcccttgtcggttgcctaagtctagaatgtctcttgaa

SEQ ID NO: 41698 - DNA, 601 bp, Human
ggggaaggccgagtctaagtgcccaaggtcatgatggtaagaaaggcagagaacaacaaactctttataaaataataaggtagcccacttctaccccaaggcaagacaggcggccctccatatccctggctcccgttctgaggactcaaccgatccagatggaaaatattcgaaaatcaataaacagaaaagaacaatacaacaaaaattaaaaattttaaaatacagtataacaactgtatactgtatatagcatttacatagaattctaaataacctagaaatgatttgtagtatttgrgaggatgtgcataggttatatgcagatactatgcaatttcgtatcagggacgtgagtatccatggattttggtatccagaggggaactggaaccaattcctcatggatgcaaagagataagtgtaaatgctgtcttatgtctctgaattgtcattcctagaacgttggttaacagtaattatgcaaaatggcaatgattccacagcaaactgtgcagagtacaacttcacaccatgagcaatgactctgaataacagagatgttggtgttttttgctgttgagctataatgtaggtgttg

SEQ ID NO: 41699 - DNA, 601 bp, Human
tgcccctgttctggagaaggagatgcctctccaaggtgcctctgcagtaacactctcacccgtgactatcataccctcttcacttgtctgtccctcccaagcccacagccacccaacctctgctcctggaggggaaggccgagtctaagtgcccaaggtcatgatggtaagaaaggcagagaacaacaaactctttataaaataataaggtagcccacttctaccccaaggcaagacaggcggccctccatatccctggctcccgttctgaggactcaaccgatccagatggaaaatattygaaaatcaataaacagaaaagaacaatacaacaaaaattaaaaattttaaaatacagtataacaactgtatactgtatatagcatttacatagaattctaaataacctagaaatgatttgtagtatttgggaggatgtgcataggttatatgcagatactatgcaatttcgtatcagggacgtgagtatccatggattttggtatccagaggggaactggaaccaattcctcatggatgcaaagagataagtgtaaatgctgtcttatgtctctgaattgtcattcctagaacgttggtt

SEQ ID NO: 41700 - DNA, 601 bp, Human
catcagggtgctccaggagcaacacagaggatgagaagtcaatgagaccaacttctccatttgagaagtgaaggaggtgcaggtcaggaacagagcgcgacccacggaagtgaaggcagccaagaaaggggcagtttcaggtcagttatactgtgggcacctgggacttaaccctgaggggagcccacatctcagtgttatcccgccctaggggaagggagtgggggtatttatctccttggctgagggccctggtgatgggtatggagtgcctgccaactgtgcctccggggctttggawaaagccctgacagacacagatgccagcagctgaagtcccccagagcctgagcacagaaacaacaggtctgaggaagacgtgtgggaccccaaaagcacgtgcaagctgccagcaaagtccatctgttcaggccgacatagaacatcctccccaagctcatgagggagaaacagagtgagcacccaggctatgcgtcagcctcctgggtttgaagcccaggaccacactgacttgctgtgtgaccttgggtatgtttcttaacctctctgttccttggcatctttatctgtcaatggctta

SEQ ID NO: 41701 - DNA, 601 bp, Human
ccccatctctacagaaaatataaaaattagctgggcatggtggcgtgggcctgtagtcccagctattcgggaggctgaggtggagaatcacttgagcctaggaagccgaggttgcagtgagctgatcgcaccactgcactacagcctgggtgacagagacagaccctatctcaaaaaaaaaaaaaaagaaaagaaaagaaagacaagaaaagataaaaggaaaaggaaatgaaaggaaaaacaagacaagaaaagaaaatgattgacttaaaacataagaaatagtggcattgcccttttyaatctgaattaagctatatgataaatttcaattactgcacatgtgtatatgtatgtatgtgtgcagtatgtatgtatgtgtgtgcacagaaacacatatatcaagtgattatagttatcttactattttcattctgtcaatcaaatttagagatcttgggctttttaatgaagcaagaaactaaaaaatcaaagttttatttacctttatgttcgtgacacaaatagagtaagggaaactgccagatcttttatttacttcaaataactaatgatttgcctgccctttcgaaggacaaca

SEQ ID NO: 41702 - DNA, 601 bp, Human
atggctggagatggtggctcacacctgtaatcccagcactttgggaggccgagacaacgaggttcactcgagctcaggaattcaagaccagcgtgggcaacaaagtgagaccccccatctctacagaaaatataaaaattagctgggcatggtggcgtgggcctgtagtcccagctattcgggaggctgaggtggagaatcacttgagcctaggaagccgaggttgcagtgagctgatcgcaccactgcactacagcctgggtgacagagacagaccctatctcaaaaaaaaaaaaaaagaaaagaaaagaaagacaagaaaagataaaaggaaaaggaaatgaaaggaaaaacaagacaagaaaagaaaatgattgacttaaaacataagaaatagtggcattgccctttttaatctgaattaagctatatgataaatttcaattactgcacatgtgtatatgtatgtatgtgtgcagtatgtatgtatgtgtgtgcacagaaacacatatatcaagtgattatagttatcttactattttcattctgtcaatcaaatttagagatcttgggctttttaatgaagcaagaaactaaaaaa

SEQ ID NO: 41703 - DNA, 601 bp, Human; identical to SEQ ID NO: 17833

SEQ ID NO: 41704 - DNA, 601 bp, Human; identical to SEQ ID NO: 17834

SEQ ID NO: 41705 - DNA, 601 bp, Human; identical to SEQ ID NO: 17835

SEQ ID NO: 41706 - DNA, 601 bp, Human; identical to SEQ ID NO: 17836

SEQ ID NO: 41707 - DNA, 601 bp, Human; identical to SEQ ID NO: 17837

SEQ ID NO: 41708 - DNA, 601 bp, Human; identical to SEQ ID NO: 17838

SEQ ID NO: 41709 - DNA, 601 bp, Human; identical to SEQ ID NO: 17839

SEQ ID NO: 41710 - DNA, 601 bp, Human; identical to SEQ ID NO: 17840

SEQ ID NO: 41711 - DNA, 601 bp, Human; identical to SEQ ID NO: 17841

SEQ ID NO: 41712 - DNA, 601 bp, Human; identical to SEQ ID NO: 17842

SEQ ID NO: 41713 - DNA, 601 bp, Human; identical to SEQ ID NO: 17843

SEQ ID NO: 41714 - DNA, 601 bp, Human; identical to SEQ ID NO: 17844

SEQ ID NO: 41715 - DNA, 601 bp, Human; identical to SEQ ID NO: 17845

SEQ ID NO: 41716 - DNA, 601 bp, Human
ctggcccaaaattgtaaaattatgtgttcattcacctgacaatctaaaagaattaaggtaagcacatttgagatcatttgaatggccacctcatagccaaatacttccaagttattccacagcctgagtttgcaaatgtgtctgattggactggcgcggaaagtcactaagatgccaatgcttgctggattctgcaatggcacacgggctcctgtggcttcgacgaacatattccagagctccatggcttcccaaacttgaaaaacattgttttggtatattttcattcagtcatttctayaagccagagatctcaaggttgggggaaggggaaagtagttaggcaaccccttcccacagggacatttggcaatgttttgatacattttaagttgtcacaattggagggacgggatgctactgacatctagtggggagaggccagggatgtggctaaacatcctgtaattcacaggacagcctccacaacaatgaaatagcagcagcctgaggttgagaaatccctctctgtgtatattttaatgtctttcttgttgctgttgcttttacaaagttgagtttatatttttgtaacctgtac

SEQ ID NO: 41717 - DNA, 601 bp, Human
ttaaaatgaggtgggcaaacatgctctagaacatctgagaattctgcatcaatattttatcttattttatttatttatattttttgagacgtagtctcactctgtcacccaggctggagtgaaatggcacaatcttggctcactgcaactgccacctcccaggttcaagcaattctcctgcctcagcctcccaagtagctgggactacaggcacacgccaccatgcccggctaatttttgtatttttagcagagacggggtttcgccatgttcgccaggctggtctcgaactcctgacctsaggtgatccacccacctcggcctcccaaagtactgggattacaggcgtgagccactgggcctggcccaaaattgtaaaattatgtgttcattcacctgacaatctaaaagaattaaggtaagcacatttgagatcatttgaatggccacctcatagccaaatacttccaagttattccacagcctgagtttgcaaatgtgtctgattggactggcgcggaaagtcactaagatgccaatgcttgctggattctgcaatggcacacgggctcctgtggcttcgacgaacatattccagagc

SEQ ID NO: 41718 - DNA, 601 bp, Human
tacctcaaactattcttccattgaatagataatatacataaaatgcttcccgtattgagggtaacaaagtaaattccccaatatatcattactaaaactactaatgcttttgataggtggaatttttagaagaatatcaagtttaaatagaaaaaaaaaaaagagttcaatttctacctaaacctgggaaattgaagaaaagccagattagaaacattgtctgttttgtttttttttccttgatttatctacacacctaacacagtgttggtgtagcacctgccctaaagatatctgctgygtgaataaaccattgaacaagcacattaacaaaacatgagtaaaagcatagcatgtattggtaaagatagccactcttattcttgtaattgagataaacctgaacaaaacccttaaaagctgacaagcagccggcttcttcaaaatattggtcatactgctatttttttcatattgtaaaagtaccatatactcagcatagtcaaaagtacaaagaaggaaaactatgaagaattaaaatgtaaaaggtccataattatatcatgtaggcataaatagcaaccatttagggcagtgtttc

SEQ ID NO: 41719 - DNA, 601 bp, Human
tcaccattaattagaaaataaatattttgtgcttttctgggtattactattattctacacttagtatgatctttctttttgtcatagttaaaaacaggctatacataggtcacccatgtttgcaaaccaggcccttactggctctgtcacttggggcaagttccttaaaacctctctcagtcctcatttccttacttccttgaaacctcatttttcttctctgtgaaatggagattgtaatattacctacctcaaactattcttccattgaatagataatatacataaaatgcttcccgtrttgagggtaacaaagtaaattccccaatatatcattactaaaactactaatgcttttgataggtggaatttttagaagaatatcaagtttaaatagaaaaaaaaaaaagagttcaatttctacctaaacctgggaaattgaagaaaagccagattagaaacattgtctgttttgtttttttttccttgatttatctacacacctaacacagtgttggtgtagcacctgccctaaagatatctgctgtgtgaataaaccattgaacaagcacattaacaaaacatgagtaaaagcatagca

SEQ ID NO: 41720 - DNA, 601 bp, Human
tttcttgaatgaattttgccacaatcataaattctcaccattaattagaaaataaatattttgtgcttttctgggtattactattattctacacttagtatgatctttctttttgtcatagttaaaaacaggctatacataggtcacccatgtttgcaaaccaggcccttactggctctgtcacttggggcaagttccttaaaacctctctcagtcctcatttccttacttccttgaaacctcatttttcttctctgtgaaatggagattgtaatattacctacctcaaactattcttccrttgaatagataatatacataaaatgcttcccgtattgagggtaacaaagtaaattccccaatatatcattactaaaactactaatgcttttgataggtggaatttttagaagaatatcaagtttaaatagaaaaaaaaaaaagagttcaatttctacctaaacctgggaaattgaagaaaagccagattagaaacattgtctgttttgtttttttttccttgatttatctacacacctaacacagtgttggtgtagcacctgccctaaagatatctgctgtgtgaataaaccattgaaca

SEQ ID NO: 41721 - DNA, 601 bp, Human
ttttagtgccaataaataatctatcacaagaatgtactgtgatgtattaagccatctcactctggttagattagattatttctatttattttcaataatattttaaaactgtaaaataatagccaaaatttttatttatgccatgatagatgtttttctactgaagaaaagaatgtttcttgaatgaattttgccacaatcataaattctcaccattaattagaaaataaatattttgtgcttttctgggtattactattattctacacttagtatgatctttctttttgtcatagttaaraacaggctatacataggtcacccatgtttgcaaaccaggcccttactggctctgtcacttggggcaagttccttaaaacctctctcagtcctcatttccttacttccttgaaacctcatttttcttctctgtgaaatggagattgtaatattacctacctcaaactattcttccattgaatagataatatacataaaatgcttcccgtattgagggtaacaaagtaaattccccaatatatcattactaaaactactaatgcttttgataggtggaatttttagaagaatatcaagttta

SEQ ID NO: 41722 - DNA, 601 bp, Human
cctcggcctcccaaagtgctgggattacaagcgtgagccaccgcacccggcctattaaaactttgatataatttttggtggtgtgtgtacatatgtgtatatatgtacatatatgtgtatataggtgaataaacaatttgttttatgtttatgaaaatataatcagaatactataataaatatataaacatgatttaaaatatacagcatattttattaaatttttaaataattttatatttttcttacaatattttgtgagcctttttctattatactaaaatctcttcaggatcctgatttttttttttttttttttttgagacagagtgttctctgtcactcaggctggggcacaatggcgcaatctcagctgactgcaacctctgcctcccgggctcaagtgattcttgtgcctcagcctcctgagtacctgggattacagataatgcaccatcgtgcccagctaatttttgtattttcagtagagatgggatttcgccatgttggccaggctggtctcaaactcctggcctcacgtaacaatcctgatttttagtgccaataaataatctatcacaagaatgtactgtgatgtatt

SEQ ID NO: 41723 - DNA, 601 bp, Human
tttttagtagagacgggggtttctccatgttggtcaggctggtctcgaactccggacctcaggtgatccgcccgcctcggcctcccaaagtgctgggattacaagcgtgagccaccgcacccggcctattaaaactttgatataatttttggtggtgtgtgtacatatgtgtatatatgtacatatatgtgtatataggtgaataaacaatttgttttatgtttatgaaaatataatcagaatactataataaatatataaacatgatttaaaatatacagcatattttattaaatttttwaataattttatatttttcttacaatattttgtgagcctttttctattatactaaaatctcttcaggatcctgatttttttttttttttttttttgagacagagtgttctctgtcactcaggctggggcacaatggcgcaatctcagctgactgcaacctctgcctcccgggctcaagtgattcttgtgcctcagcctcctgagtacctgggattacagataatgcaccatcgtgcccagctaatttttgtattttcagtagagatgggatttcgccatgttggccaggctggtctcaaac

SEQ ID NO: 41724 - DNA, 601 bp, Human
cggctaattttgtatttttagtagagacgggggtttctccatgttggtcaggctggtctcgaactccggacctcaggtgatccgcccgcctcggcctcccaaagtgctgggattacaagcgtgagccaccgcacccggcctattaaaactttgatataatttttggtggtgtgtgtacatatgtgtatatatgtacatatatgtgtatataggtgaataaacaatttgttttatgtttatgaaaatataatcagaatactataataaatatataaacatgatttaaaatatacagcatatwttattaaatttttaaataattttatatttttcttacaatattttgtgagcctttttctattatactaaaatctcttcaggatcctgatttttttttttttttttttttgagacagagtgttctctgtcactcaggctggggcacaatggcgcaatctcagctgactgcaacctctgcctcccgggctcaagtgattcttgtgcctcagcctcctgagtacctgggattacagataatgcaccatcgtgcccagctaatttttgtattttcagtagagatgggatttcgccatgttggcca

SEQ ID NO: 41725 - DNA, 561 bp, Human
ctctattaaaactttttttttttttttttttgagatggagtttcactcttgttgcccaggccagagtgcaatgacgcgatctcggctcacagcaacctccgcctcccgggttcaagccattctcctgcctcagcctccagagtagctgggattacaggcatgcgccaccatgcccggctaattttgtatttttagtagagacgggggtttctccatgttggtcaggctggtctcgaactccggacctcaggtgatccgccygcctcggcctcccaaagtgctgggattacaagcgtgagccaccgcacccggcctattaaaactttgatataatttttggtggtgtgtgtacatatgtgtatatatgtacatatatgtgtatataggtgaataaacaatttgttttatgtttatgaaaatataatcagaatactataataaatatataaacatgatttaaaatatacagcatattttattaaatttttaaataattttatatttttcttacaatattttgtgagcctttttctattatactaaaatctcttcaggatcctg

SEQ ID NO: 41726 - DNA, 601 bp, Human; identical to SEQ ID NO: 17846

SEQ ID NO: 41727 - DNA, 601 bp, Human; identical to SEQ ID NO: 17847

SEQ ID NO: 41728 - DNA, 601 bp, Human; identical to SEQ ID NO: 17848

SEQ ID NO: 41729 - DNA, 601 bp, Human; identical to SEQ ID NO: 17849

SEQ ID NO: 41730 - DNA, 601 bp, Human; identical to SEQ ID NO: 17850

SEQ ID NO: 41731 - DNA, 601 bp, Human; identical to SEQ ID NO: 17851

SEQ ID NO: 41732 - DNA, 601 bp, Human; identical to SEQ ID NO: 17852

SEQ ID NO: 41733 - DNA, 601 bp, Human; identical to SEQ ID NO: 17853

SEQ ID NO: 41734 - DNA, 601 bp, Human; identical to SEQ ID NO: 17854

SEQ ID NO: 41735 - DNA, 601 bp, Human; identical to SEQ ID NO: 17855

SEQ ID NO: 41736 - DNA, 601 bp, Human; identical to SEQ ID NO: 17856

SEQ ID NO: 41737 - DNA, 601 bp, Human; identical to SEQ ID NO: 17857

SEQ ID NO: 41738 - DNA, 601 bp, Human; identical to SEQ ID NO: 17858

SEQ ID NO: 41739 - DNA, 601 bp, Human; identical to SEQ ID NO: 17859

SEQ ID NO: 41740 - DNA, 601 bp, Human; identical to SEQ ID NO: 17860

SEQ ID NO: 41741 - DNA, 601 bp, Human; identical to SEQ ID NO: 17861

SEQ ID NO: 41742 - DNA, 601 bp, Human; identical to SEQ ID NO: 17862

SEQ ID NO: 41743 - DNA, 601 bp, Human; identical to SEQ ID NO: 17863

SEQ ID NO: 41744 - DNA, 601 bp, Human; identical to SEQ ID NO: 17864

SEQ ID NO: 41745 - DNA, 601 bp, Human; identical to SEQ ID NO: 17865

SEQ ID NO: 41746 - DNA, 601 bp, Human; identical to SEQ ID NO: 17866

SEQ ID NO: 41747 - DNA, 601 bp, Human; identical to SEQ ID NO: 17867

SEQ ID NO: 41748 - DNA, 601 bp, Human; identical to SEQ ID NO: 17868

SEQ ID NO: 41749 - DNA, 601 bp, Human; identical to SEQ ID NO: 17869

SEQ ID NO: 41750 - DNA, 601 bp, Human; identical to SEQ ID NO: 17870

SEQ ID NO: 41751 - DNA, 601 bp, Human; identical to SEQ ID NO: 17871

SEQ ID NO: 41752 - DNA, 601 bp, Human; identical to SEQ ID NO: 17872

SEQ ID NO: 41753 - DNA, 601 bp, Human; identical to SEQ ID NO: 17873

SEQ ID NO: 41754 - DNA, 601 bp, Human; identical to SEQ ID NO: 17874

SEQ ID NO: 41755 - DNA, 601 bp, Human; identical to SEQ ID NO: 17875

SEQ ID NO: 41756 - DNA, 601 bp, Human
gggtaaggggaaggagagcattaggacaaataccttaatgcatgtggggcttaaaacctagatgatgggttgatagatgcagcaaaccaccatggcacatgtatacctatgtaacaaacctgctcattctacatatgtatcccagaacttaaagtaaaattaaagaaaaagaaaaagaaaaacacttgaatactgagaaaaaaaaaaagaaggaggagggaggaaaggggtctagggatacaaaaatctacacgttaggtaaaatgtacactactcgggtgacaggtacactaaaatctcrgaattcaccactatataattcttccacataagaaaaataaacacttgtaccccaaagctattgaaataaataaaatttttttaaaattacctttctgacccttcaagccatcagggcccctcacacctgggtggcctggaactcctgggtggcctcgctctcctggtggaccaggaaatcccagtcctgggggccccacaggtcctgctttgcctggggggcccagaggtccaggaaatcctttaccacctggggtcgcatcttcatgatccccctgggaatgttatgtcatgagtcaat

SEQ ID NO: 41757 - DNA, 601 bp, Human
ctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacaatgaaaaaatgctcaccatcactggccatcagagaaatgcaaatcaaaaccacaatgagataccatctcacaccagttagaatggcaatcattaaaaagtcaggaaacaacaagtgctggagaggatgtggagaaataggaacacttttacackgttggtgggactgtaaactagttcaaccattgtggaagtcagtgtggcgattcctcagggatctagaactagaaataccatttgaaccagccatcccattactgggtatatacccaaaggattataaatcatgctgctttaaagacacatgcacacgtatgtttattgcggcattattcacaatagcaaagacttggaaccaacccaaatgtccaacaatgatagactggattaagaaaatgtggcacatatacaccatggaatactatgcagccataaaaaacaatgagtgcatgtcct

SEQ ID NO: 41758 - DNA, 601 bp, Human
tgtctcagcccaaaatctccttaagctgataagtaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatgggtaggaagaatcaatatygtgaaaatggccatactgcccaaggcaatttacagattcaatgccatccccatcaagctaccaatgactttcttcacagaattggaaaaaaactactttaaagttcatatggaaccaaaaaagagccggcatcgccaagtcaatcctaagccaaaagaacaaagccggaggcatcacactacctgacttcaaactatactacaaggctacagtaaccaaaacagcatggtactggtaccaaaacagagatatagatcaatggaacagaacagagccctcagaaataacgccgcatatcta

SEQ ID NO: 41759 - DNA, 601 bp, Human
aagtcaaattgtccctgtttgcagacgacatgattgtatatctagaaaaccccattgtctcagcccaaaatctccttaagctgataagtaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagrggatacaaacaaatggaagaatattccatgctcatgggtaggaagaatcaatatcgtgaaaatggccatactgcccaaggcaatttacagattcaatgccatccccatcaagctaccaatgactttcttcacagaattggaaaaaaactactttaaagttcatatggaaccaaaaaagagccggcatcgccaagtcaatcctaagccaaaagaacaaagccggaggcatcacactacctgacttcaaactatactacaaggctacagtaaccaaaacagcatggtactggtaccaaaaca

SEQ ID NO: 41760 - DNA, 601 bp, Human
atgatcaagtgggcttcacccctgggatgcaaggctggttcaatatacgcgaatcaataaatgtaatccagcatataaacagaaccaaagacaaaaaccacatgattatctcaatagatgcagaaaaggcctttgacaaaattcaacaactttcatgctaaaaactctcaataaattaggtattgatgggacatatctcaaaataataagagctatctatgacaaacccacagccaatatcatactgaatgggcaaaaactggaagcattccctttgaaaactggcacaagacagggatgycctctctcaccactcctattcaacatagtgttggaagttctggccagggcaattaggcaggagaaggaaataaagggtattcaattgggaaaagaggaagtcaaattgtccctgtttgcagacgacatgattgtatatctagaaaaccccattgtctcagcccaaaatctccttaagctgataagtaacttcagcaaagtctcaggatacaaaatcaatgtacaaaaatcacaagcattcttatacaccaacaacagacaaacagagagccaaatcatgagtgaactcccattcacaatt

SEQ ID NO: 41761 - DNA, 601 bp, Human
aaaaagagaattttagaccaatatccttgatgaacattgatgcaaaaatcctcaaaaaatactggcaaaccgaatccagcagcacatcaaaaagcttatccaccatgatcaagtgggcttcacccctgggatgcaaggctggttcaatatacgcgaatcaataaatgtaatccagcatataaacagaaccaaagacaaaaaccacatgattatctcaatagatgcagaaaaggcctttgacaaaattcaacaactttcatgctaaaaactctcaataaattaggtattgatgggacatatytcaaaataataagagctatctatgacaaacccacagccaatatcatactgaatgggcaaaaactggaagcattccctttgaaaactggcacaagacagggatgtcctctctcaccactcctattcaacatagtgttggaagttctggccagggcaattaggcaggagaaggaaataaagggtattcaattgggaaaagaggaagtcaaattgtccctgtttgcagacgacatgattgtatatctagaaaaccccattgtctcagcccaaaatctccttaagctgataagtaacttcagca

SEQ ID NO: 41762 - DNA, 495 bp, Human
gaatcctccctaactcatttttatgaggtcagcatcatcctgataccaaagccaggcagagacacaaccaaaaaagagaattttagaccaatatccttgatgaacattgatgcaaaaatcctcaaaaaatactggcaaaccgaatccagcagcacatcaaaaagcttatccaccatgatcaagtgggcttcaccyctgggatgcaaggctggttcaatatacgcgaatcaataaatgtaatccagcatataaacagaaccaaagacaaaaaccacatgattatctcaatagatgcagaaaaggcctttgacaaaattcaacaactttcatgctaaaaactctcaataaattaggtattgatgggacatatctcaaaataataagagctatctatgacaaacccacagccaatatcatactgaatgggcaaaaactggaagcattccctttgaaaactggcacaagacagggatgtcctctctcaccactcctatt

SEQ ID NO: 41763 - DNA, 601 bp, Human
ctcactagggagtgccagacagtgggtgcaggtcagtgggtgcgcgcaccgtgcacgagccgaagcagggcgaggcattgcctcacttgggaagtgcaaggggtcagggagttccctttcctagtcaaagaaaggggtgacagagggcacctggaaaatcgggccactcccacccgaatactgcgcttttccgacgggcttaaaaaacggcgcaccaggagatcacatcccgcacctggctcggagggtcctacgccaggctgattgctagcacagcagtctgagatcaaactgcaaggckgcagcgaggctgggggaggggcgcccgccattgcccaggcttgattaggtaaacaaagcagcccagaagctcaaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaacaggcagactgcctcctcaagtgggtccctgacccctgacccacgagca

SEQ ID NO: 41764 - DNA, 601 bp, Human
gacaaatgcatcaggtaacttataaatgaaaacctatcagacttatagcagacttctcagcagaaaccttacaagccaaaagggattggcatcctatcttcaacctccttaaacagaacaactgtcggccaagaatttcgtattccacaaaactaaatttcataaatgaaggagaaataaagtcattttcagacaagcaaatgctgaggaaatttttcactacaaaacatgcactacaagaaatgctaaaagggaagatggccgaataggaacagctccagtctacagctcccagcgcgcscgacgcagaagacgggtgatttctgcatttccatctgaggtaccgggttcatctcactagggagtgccagacagtgggtgcaggtcagtgggtgcgcgcaccgtgcacgagccgaagcagggcgaggcattgcctcacttgggaagtgcaaggggtcagggagttccctttcctagtcaaagaaaggggtgacagagggcacctggaaaatcgggccactcccacccgaatactgcgcttttccgacgggcttaaaaaacggcgcaccaggagatcacatcccgcacctggctcggaggg

SEQ ID NO: 41765 - DNA, 601 bp, Human
agacaaatgcatcaggtaacttataaatgaaaacctatcagacttatagcagacttctcagcagaaaccttacaagccaaaagggattggcatcctatcttcaacctccttaaacagaacaactgtcggccaagaatttcgtattccacaaaactaaatttcataaatgaaggagaaataaagtcattttcagacaagcaaatgctgaggaaatttttcactacaaaacatgcactacaagaaatgctaaaagggaagatggccgaataggaacagctccagtctacagctcccagcgcgmccgacgcagaagacgggtgatttctgcatttccatctgaggtaccgggttcatctcactagggagtgccagacagtgggtgcaggtcagtgggtgcgcgcaccgtgcacgagccgaagcagggcgaggcattgcctcacttgggaagtgcaaggggtcagggagttccctttcctagtcaaagaaaggggtgacagagggcacctggaaaatcgggccactcccacccgaatactgcgcttttccgacgggcttaaaaaacggcgcaccaggagatcacatcccgcacctggctcggagg

SEQ ID NO: 41766 - DNA, 601 bp, Human; identical to SEQ ID NO: 17876

SEQ ID NO: 41767 - DNA, 601 bp, Human; identical to SEQ ID NO: 17877

SEQ ID NO: 41768 - DNA, 601 bp, Human; identical to SEQ ID NO: 17878

SEQ ID NO: 41769 - DNA, 601 bp, Human; identical to SEQ ID NO: 17879

SEQ ID NO: 41770 - DNA, 601 bp, Human; identical to SEQ ID NO: 17880

SEQ ID NO: 41771 - DNA, 601 bp, Human; identical to SEQ ID NO: 17881

SEQ ID NO: 41772 - DNA, 601 bp, Human; identical to SEQ ID NO: 17882

SEQ ID NO: 41773 - DNA, 601 bp, Human; identical to SEQ ID NO: 17883

SEQ ID NO: 41774 - DNA, 601 bp, Human; identical to SEQ ID NO: 17884

SEQ ID NO: 41775 - DNA, 601 bp, Human; identical to SEQ ID NO: 17885

SEQ ID NO: 41776 - DNA, 601 bp, Human; identical to SEQ ID NO: 17886

SEQ ID NO: 41777 - DNA, 601 bp, Human; identical to SEQ ID NO: 17887

SEQ ID NO: 41778 - DNA, 601 bp, Human; identical to SEQ ID NO: 17888

SEQ ID NO: 41779 - DNA, 601 bp, Human; identical to SEQ ID NO: 17889

SEQ ID NO: 41780 - DNA, 601 bp, Human; identical to SEQ ID NO: 17890

SEQ ID NO: 41781 - DNA, 601 bp, Human; identical to SEQ ID NO: 17891

SEQ ID NO: 41782 - DNA, 601 bp, Human; identical to SEQ ID NO: 17892

SEQ ID NO: 41783 - DNA, 601 bp, Human; identical to SEQ ID NO: 17893

SEQ ID NO: 41784 - DNA, 601 bp, Human; identical to SEQ ID NO: 17894

SEQ ID NO: 41785 - DNA, 601 bp, Human; identical to SEQ ID NO: 17895

SEQ ID NO: 41786 - DNA, 601 bp, Human; identical to SEQ ID NO: 17896

SEQ ID NO: 41787 - DNA, 601 bp, Human; identical to SEQ ID NO: 17897

SEQ ID NO: 41788 - DNA, 601 bp, Human; identical to SEQ ID NO: 17898

SEQ ID NO: 41789 - DNA, 601 bp, Human; identical to SEQ ID NO: 17899

SEQ ID NO: 41790 - DNA, 601 bp, Human; identical to SEQ ID NO: 17900

SEQ ID NO: 41791 - DNA, 601 bp, Human; identical to SEQ ID NO: 17901

SEQ ID NO: 41792 - DNA, 601 bp, Human; identical to SEQ ID NO: 17902

SEQ ID NO: 41793 - DNA, 601 bp, Human; identical to SEQ ID NO: 17903

SEQ ID NO: 41794 - DNA, 601 bp, Human; identical to SEQ ID NO: 17904

SEQ ID NO: 41795 - DNA, 601 bp, Human; identical to SEQ ID NO: 17905

SEQ ID NO: 41796 - DNA, 601 bp, Human; identical to SEQ ID NO: 17906

SEQ ID NO: 41797 - DNA, 601 bp, Human; identical to SEQ ID NO: 17907

SEQ ID NO: 41798 - DNA, 601 bp, Human; identical to SEQ ID NO: 17908

SEQ ID NO: 41799 - DNA, 601 bp, Human; identical to SEQ ID NO: 17909

SEQ ID NO: 41800 - DNA, 601 bp, Human; identical to SEQ ID NO: 17910

SEQ ID NO: 41801 - DNA, 601 bp, Human; identical to SEQ ID NO: 17911

SEQ ID NO: 41802 - DNA, 601 bp, Human; identical to SEQ ID NO: 17912

SEQ ID NO: 41803 - DNA, 601 bp, Human; identical to SEQ ID NO: 17913

SEQ ID NO: 41804 - DNA, 601 bp, Human; identical to SEQ ID NO: 17914

SEQ ID NO: 41805 - DNA, 601 bp, Human; identical to SEQ ID NO: 17915

SEQ ID NO: 41806 - DNA, 601 bp, Human; identical to SEQ ID NO: 17916

SEQ ID NO: 41807 - DNA, 601 bp, Human; identical to SEQ ID NO: 17917

SEQ ID NO: 41808 - DNA, 601 bp, Human; identical to SEQ ID NO: 17918

SEQ ID NO: 41809 - DNA, 601 bp, Human; identical to SEQ ID NO: 17919

SEQ ID NO: 41810 - DNA, 601 bp, Human; identical to SEQ ID NO: 17920

SEQ ID NO: 41811 - DNA, 601 bp, Human; identical to SEQ ID NO: 17921

SEQ ID NO: 41812 - DNA, 601 bp, Human; identical to SEQ ID NO: 17922

SEQ ID NO: 41813 - DNA, 601 bp, Human; identical to SEQ ID NO: 17923

SEQ ID NO: 41814 - DNA, 601 bp, Human; identical to SEQ ID NO: 17924

SEQ ID NO: 41815 - DNA, 601 bp, Human; identical to SEQ ID NO: 17925

SEQ ID NO: 41816 - DNA, 601 bp, Human; identical to SEQ ID NO: 17926

SEQ ID NO: 41817 - DNA, 601 bp, Human; identical to SEQ ID NO: 17927

SEQ ID NO: 41818 - DNA, 601 bp, Human; identical to SEQ ID NO: 17928

SEQ ID NO: 41819 - DNA, 601 bp, Human; identical to SEQ ID NO: 17929

SEQ ID NO: 41820 - DNA, 601 bp, Human; identical to SEQ ID NO: 17930

SEQ ID NO: 41821 - DNA, 601 bp, Human; identical to SEQ ID NO: 17931

SEQ ID NO: 41822 - DNA, 601 bp, Human; identical to SEQ ID NO: 17932

SEQ ID NO: 41823 - DNA, 601 bp, Human; identical to SEQ ID NO: 17933

SEQ ID NO: 41824 - DNA, 601 bp, Human; identical to SEQ ID NO: 17934

SEQ ID NO: 41825 - DNA, 601 bp, Human; identical to SEQ ID NO: 17935

SEQ ID NO: 41826 - DNA, 601 bp, Human; identical to SEQ ID NO: 17936

SEQ ID NO: 41827 - DNA, 601 bp, Human; identical to SEQ ID NO: 17937

SEQ ID NO: 41828 - DNA, 601 bp, Human; identical to SEQ ID NO: 17938

SEQ ID NO: 41829 - DNA, 601 bp, Human
cgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggtaagggtacaacatggcacactaaccacctgactaaatgaaaagttgccctggggggaacggaacaaacactacttttcttcaacctttgcttccacagactttttcatccctaagatactagaagaagagcatacataaaygacaaatatagccaatgtgatacagaatgtcagatactatgatagaaacttggcccttagctgggtggttgaattaggtgctacttttttgagatggagttttgctctgttgccaggttggagtgcagtggcacaatctgggctcactgcaacctctgcctcctgggttcaagcgattctcctgccttggcctcctgagtagctgagaatacagatgtgtgccagcatgcctggctaattttttgtatttttgtggagacggggtttcatcatgttggccaagctggtcttgaactcgtg

SEQ ID NO: 41830 - DNA, 601 bp, Human
tttgtaactctattttttaaatgaatagtagctttatttacttatttctgtttgtaaaaacaaaatatactaattgttgcgagaaacagtagctcttcaaatcctttactaatgatggtctagtttttttggttttttttttttttttttggaggtgggggcatgactttcattccccaggaaaataaaatgaaaattttttacggtataagcagagaataagacaccatacttttgtgtgggttgaaaagtaacaaatacttgacagctatctgttaaagtttgatcaatgatcactcartatgattaacttgtttcaaattgttcaaattttagcttattatttctgattaaaaattatcagaaaatattaaagttgaaattgataaagtataaattatattttctggctgattagggtattagaatgacaccagtaaacactagatataatgaataatattcatatgttgaaatatccatttgctttttttgaactgcaagaaagataaatgtgtgatatatatacataggcttattgtgtgcttttaataaacataataggaaaagccatgacttaaaatgcaaaatccatcaacaa

SEQ ID NO: 41831 - DNA, 601 bp, Human
ttaaacaaaaggaggctcatttcctagtacaacacaactgaattaaatatagaattgtaaaccctgactgatgtctacatacaccgggctcggttttgtgaaccactcaacacagcccaacttgcaatttgccatctgaaagctaccctcgagaccctcagacactctctacagctgcacccgtgggttcttcccagtggggctaccctgggcaatcagaaagacccattcaaggggcatctctccctcaggaatcgggtcaggcccttcaatccaatagttcagtccgaaggctcctcaycgccctctgttcctctccctcagccctttggatggctccgtccagccattcaccctgggaacgaccgttagcaccctcgtggaggctacgaggtaaacagattgtctcccggtgccacagccgcctcagggtcactaagatgttgcaggtgcggacacctcacaaccacctgcggggctgcaataccaggaggcggaggggatgtgcttgggttgggaaggggcgggtggctgcgaacaagatcctgaaagaggtctcttttaccggcaaattgactggaattttgttatcccggaatcc

SEQ ID NO: 41832 - DNA, 601 bp, Human
gaagattaaaaagccacttacaaatatgtttcttaagctcgaaatgtctcttggaggaaagtctgcatagaccaacattgtattaaatcataattcctttatatcaacaagaacaagtggttaccactttggagaaagagtatgtatttcagaatatttcttgggttctatttacagttcattctcttgacaagctgagtaaattgcttgacctctgattccattttttaatcagtaaaattgggttaacaaagtaaactttatagttaaatgagacagtgccaggaaagaaatatattaygctggatatatatatatatatcagttcccctttgtctttccccttagcttcactcaaactcatcattctgtaaggaaagtaaaaagggaatcactaaccattctaggatcaccttccagtgggatgtgcttgctaacttgattgtcttgcagggcttgacaaagtccttggggacaattacattatcaccagataaaactgctcatataagtgctcatggtcatctgcattcaggttatttggtgtttaaaagttacactccaaatatcttttcttacttatcaaccacacaaaaacata

SEQ ID NO: 41833 - DNA, 601 bp, Human
ctcaccatctgttggtaaccctgcgagttgttaccatacaccacaaattcacaagctaaacttcatccaaactccagagatcctttccaggaaactccagagtaggggaccagaagtgcctttgtcccaccccactcagacctcagtcctcccagatgtgatttccactctgctttccatacaccactccctgtgccacccttctgaattctagaaggatccaaatatggtttctaccgtggaatggaaatgaagattaaaaagccacttacaaatatgtttcttaagctcgaaatgtctmttggaggaaagtctgcatagaccaacattgtattaaatcataattcctttatatcaacaagaacaagtggttaccactttggagaaagagtatgtatttcagaatatttcttgggttctatttacagttcattctcttgacaagctgagtaaattgcttgacctctgattccattttttaatcagtaaaattgggttaacaaagtaaactttatagttaaatgagacagtgccaggaaagaaatatattacgctggatatatatatatatatcagttcccctttgtctttccccttagct

SEQ ID NO: 41834 - DNA, 601 bp, Human
tctcaccatctgttggtaaccctgcgagttgttaccatacaccacaaattcacaagctaaacttcatccaaactccagagatcctttccaggaaactccagagtaggggaccagaagtgcctttgtcccaccccactcagacctcagtcctcccagatgtgatttccactctgctttccatacaccactccctgtgccacccttctgaattctagaaggatccaaatatggtttctaccgtggaatggaaatgaagattaaaaagccacttacaaatatgtttcttaagctcgaaatgtcycttggaggaaagtctgcatagaccaacattgtattaaatcataattcctttatatcaacaagaacaagtggttaccactttggagaaagagtatgtatttcagaatatttcttgggttctatttacagttcattctcttgacaagctgagtaaattgcttgacctctgattccattttttaatcagtaaaattgggttaacaaagtaaactttatagttaaatgagacagtgccaggaaagaaatatattacgctggatatatatatatatatcagttcccctttgtctttccccttagc

SEQ ID NO: 41835 - DNA, 601 bp, Human
ctcctcatactcactgactctataacaagtacatgctctgaatttcctctcagttccttctcaccatctgttggtaaccctgcgagttgttaccatacaccacaaattcacaagctaaacttcatccaaactccagagatcctttccaggaaactccagagtaggggaccagaagtgcctttgtcccaccccactcagacctcagtcctcccagatgtgatttccactctgctttccatacaccactccctgtgccacccttctgaattctagaaggatccaaatatggtttctaccgtgkaatggaaatgaagattaaaaagccacttacaaatatgtttcttaagctcgaaatgtctcttggaggaaagtctgcatagaccaacattgtattaaatcataattcctttatatcaacaagaacaagtggttaccactttggagaaagagtatgtatttcagaatatttcttgggttctatttacagttcattctcttgacaagctgagtaaattgcttgacctctgattccattttttaatcagtaaaattgggttaacaaagtaaactttatagttaaatgagacagtgccaggaaaga

SEQ ID NO: 41836 - DNA, 601 bp, Human
agcaaggaatccagcacttaccgtgaaaaatgctagcatgggtgtgggactagcatatctcactgcaagaggcacagctgggtttgtcaaaagtgcttttttttttaattgacacctaaattgtctttccctatcccctcctctcatggtacaacagtatgtttgtttatgctatctaattcagtcactcagtttgagtgatttccctgccctcctcatactcactgactctataacaagtacatgctctgaatttcctctcagttccttctcaccatctgttggtaaccctgcgagttgytaccatacaccacaaattcacaagctaaacttcatccaaactccagagatcctttccaggaaactccagagtaggggaccagaagtgcctttgtcccaccccactcagacctcagtcctcccagatgtgatttccactctgctttccatacaccactccctgtgccacccttctgaattctagaaggatccaaatatggtttctaccgtggaatggaaatgaagattaaaaagccacttacaaatatgtttcttaagctcgaaatgtctcttggaggaaagtctgcatagaccaacattg

SEQ ID NO: 41837 - DNA, 601 bp, Human
cagggtatagtcggtgcccttagaagaatgtaacagggagatccggtcttaagaaaggagtggggcaggggaaataatctcgggtaggtggtctaatctatctcttcctctctgtaattgaaatggaaatttgagccagttccagttcaaaactattgggactccatccattggaatcaattctgtccagcctcggggccaacagaacgacgatcccggcgctagtaggccacaaagcaccttgtgaaactagctgaacacttgcagttgcatcctttacaccctctcctccgcttcaacmtgggtcaggaacaaaatccttagcacgagattattctaggctgccatttaaatgtatccggcgatactggaaacttcttgatggaaggggaaacatcctgcattgcttcagaattcctcggcttttgcagcgaggggatggatccaaccaaacttcttccttcagaaaagcccctgcctgagcttctgattcttaaggtcaaagagtgccgggaccgcagaggtgcggagtccagcaatttgggtctcacttggtcagcaaagaaagtgggagcttggaaaggcaagacttaacagtggt

SEQ ID NO: 41838 - DNA, 601 bp, Human
cgaagtaattatcagagtccacccacaagggggtgaatttgaatctcaaaagatctaagtttattctatttgaatggtatagagattacacattgaaactgcccaatccggtatttggtgacttggaaattattccaatctttgcagtgcataatgtacataaaatgggttgttcatcacccacccacacctggcaattcaggtactactgactcttaattgatttgtcattttgctcttcaatatatattcaggatcaaagttatttagacttcagctttagtagcaacttcaggtttcrtggaaacatttaaacttatgaaggcctgtccattagtttgtatggagaagtgggctgaagttgccaaaagctccaatttttgtgatagtatcaagtatcactgtcactacatttcagtattcctagttgttttaagtatcactgagaactaagaaaataaagaaagggagtcagtttcagggctcactgcagtggttgccctgctttgctcgtgaactttgaaaatcagtttatttcaaagccttaattaagaagaacctcctcccacagcaatgcgaagaatttatgggtgcacttatg

SEQ ID NO: 41839 - DNA, 601 bp, Human
gcgtcccggccctctggttcggctccgcaagggcgcaggcggcggcggtggcgaggacgcagctgcccggggcgcggagccgtgaaccgccgagctcccggcgggcagcggaggcgaccgcggggctgctattgccgccccggctgtgccgctgccactgctcccggacggctcgggcgactccttcccctccctccaccgccctctggctcaggatcggcaggggtctctctcctctttctctcgcctcccttctctctcccctcctctccgccccttccccctatctctctctgcctcyctcttgctcactatcgcaagtgtggagttgtgaagttccaacctccctctcctgcctggtccactccccgcgcgggaccgagaacggcccttcccagccccgagggtgacggtgctgggaaggacaggggggaagacgagggggagaaggaggtaagtagggccaggggttgggggaaggctggattgaggggtgaagacagtgaatgcggacgcgggttccggactcaggtcggacactagccgccagccaataaggatgaggctcaggctccagtcccccggcctgccccaacctctt

SEQ ID NO: 41840 - DNA, 601 bp, Human
gtctttctgggctcctacggaggcgtcccaggtgggaaccagagcaagcaggagaatggggtccccatcccccaggggctcctcccgacaggcaggcctctagtctccgacgaagccttgccccggcgcttcccatgctgatttcgaaccatgggctgagtgagtggcgacttctgagcccaggcaccaaagaaaaactacttctctggtttgggggcactaggtagtgtgtccagaagacccctctcgaactttccaaagaaaacgttaccaataacatttctctctccgctctcaaaattaagtctttggcttctcgcgccagaacaagaagcagaaactttccttttggagccaagaatcgtgccggcctcacccagcgaccccaagggtaggccctctccggagctgccggctgaggtcccccaacccagccccccagcgccacttccccgatgccccacactaaactggaattccaggtgcccggaagaaaggcttctttggaccaaccgggttcccatagcagccagacccacaggtcagcctccggggcttcagctctaggggactctcacagccctacctagaggcttgggga

SEQ ID NO: 41841 - DNA, 601 bp, Human
gatcatcatagcaaaatataaacacctcgagatcgccctattaaagttaaacagaaatcaggccgccacgacgcgcggcgcggctcactgccgggatcgggtaaccgccttgctccggacgcagacccacgaaggcgtcttcgcagctaaaaagatgacaaactatgcacaggaagggcagtgaccaggagaccccaggaagtgcctgatccggtatttcccggagactccacatccacacaggtcaagtatgggagcgcggggcgcgggtgggcgggcacccgcaggtctgcgcagccgrgaccctgcccgcactcccccgggcactcttcggcgaaacccgtgggcgcaccaggctctcgcctaggctctacctcctgctacccaacggcgcacaaacacgcagccgagtttgttttaagttaatcagtggcgtttgcagggggtggggcaggtgggggatggaaagccacggccgggcagaagtttcctctgatttgtttaccaaaaaggaaagagaaatagcccccaccccatcgccaaagtcctccgccacagtatcgccgcagtgatgacttgttcttttgaaaataaagttatt

SEQ ID NO: 41842 - DNA, 601 bp, Human; identical to SEQ ID NO: 28788

SEQ ID NO: 41843 - DNA, 601 bp, Human; identical to SEQ ID NO: 28789

SEQ ID NO: 41844 - DNA, 601 bp, Human; identical to SEQ ID NO: 28790

SEQ ID NO: 41845 - DNA, 601 bp, Human; identical to SEQ ID NO: 28791

SEQ ID NO: 41846 - DNA, 601 bp, Human; identical to SEQ ID NO: 28792

SEQ ID NO: 41847 - DNA, 601 bp, Human
gtgttttcctcatttttacattacctaacctttcgacagtatctaaaattatcattttaattttcattttcaaatactttacctgtttgattaaggacacagttttgaatgtaagaatatcaggaaagtgtttgcatggtttgttttttcatgaaaaatgttctgattatcatagagtggttacaaaccctaacacatactcggaaaatatctggcctaattgtgctaacgcagtgcattctgcttgccctttgcagcctgagatatccttcagccatttttaagcgtagcaataaaggaygtggaaataaagagctggatgtgtccacagtcttaacagcgtgctgatggaattttatcaacttatttaggtctgttcaggtaacttttttgcttccatgtacaaagaacagtgcttaatgtagactgctatgaaagcattattttccatttgcatgtggcttccacattccccagaccatctacttacacagacgatttttaacagtaactcttaaaattaaaagtcggctttgcattttccttctctcagaaattttacaatcaatctcctgtcctaggtaatcacaagtcacagata

SEQ ID NO: 41848 - DNA, 601 bp, Human
gattgtaaaaagtctgtgttttcctcatttttacattacctaacctttcgacagtatctaaaattatcattttaattttcattttcaaatactttacctgtttgattaaggacacagttttgaatgtaagaatatcaggaaagtgtttgcatggtttgttttttcatgaaaaatgttctgattatcatagagtggttacaaaccctaacacatactcggaaaatatctggcctaattgtgctaacgcagtgcattctgcttgccctttgcagcctgagatatccttcagccatttttaagsgtagcaataaaggacgtggaaataaagagctggatgtgtccacagtcttaacagcgtgctgatggaattttatcaacttatttaggtctgttcaggtaacttttttgcttccatgtacaaagaacagtgcttaatgtagactgctatgaaagcattattttccatttgcatgtggcttccacattccccagaccatctacttacacagacgatttttaacagtaactcttaaaattaaaagtcggctttgcattttccttctctcagaaattttacaatcaatctcctgtcctaggtaat

SEQ ID NO: 41849 - DNA, 601 bp, Human
gtgcaatggcaagatctcggctcaccgcaacctccacctcccaggttcaagcaattctcctgtctcagcctccctagaagctgggattacaggcatgtgccaccaagcccggctaattttttgtatttttagtagagacggggtttctccatattggtcaggctggtctcgtactcctgacctcaggtgatccgcccgccttggcctcccaaagtgctgggattacaggcatgagccactgcacccggccccagtaatatcaatttaaaacagcaccacactttactgagtatgtagtatatgccagactcccggtactgggtgctttatctgcatattctcattttcctttgaaaacctcctcaatataagtagttacatctgtgctcccaatactcctccacaaacaccacatatacaagttacacatgagaaaaaccaaggctcagagaatctaacaacctgcctatgaagacataattattaagcagttcatttgattgtaaaaagtctgtgttttcctcatttttacattacctaacctttcgacagtatctaaaattatcattttaattttcattttcaaatactttacctgttt

SEQ ID NO: 41850 - DNA, 601 bp, Human
tatacccaacttaccccttggccaattttaggtccttaattagtactgattaataactgttaattataataaaatcatactactctataacacatgtaatagtttttgccaatgttaaactaagagactataattgcattgttttgatcctaaatataaaaattatgtagattctgcacatttttcataaaacaacagtgataacatcaatttatttatttatttatttttgagatggagtttcgctcttgtcacccaggctcgagtgcaatggcaagatctcggctcaccgcaacctccrcctcccaggttcaagcaattctcctgtctcagcctccctagaagctgggattacaggcatgtgccaccaagcccggctaattttttgtatttttagtagagacggggtttctccatattggtcaggctggtctcgtactcctgacctcaggtgatccgcccgccttggcctcccaaagtgctgggattacaggcatgagccactgcacccggccccagtaatatcaatttaaaacagcaccacactttactgagtatgtagtatatgccagactcccggtactgggtgctttatctgcat

SEQ ID NO: 41851 - DNA, 601 bp, Human
gtggaaaaagttttcccagccttcttaatgccttacagccgctagctgtatttacttcatgtttccttttttacatgaaaataatatgcattatttctttccttgttgatttgtaaaatatatttttattctctgcggctgtctttattttttaaaataattatttatgaaactgtcttattataaactctgagaggaaacatgttgttttattcaacgttgtttttaccttatacccaacttaccccttggccaattttaggtccttaattagtactgattaataactgttaattataayaaaatcatactactctataacacatgtaatagtttttgccaatgttaaactaagagactataattgcattgttttgatcctaaatataaaaattatgtagattctgcacatttttcataaaacaacagtgataacatcaatttatttatttatttatttttgagatggagtttcgctcttgtcacccaggctcgagtgcaatggcaagatctcggctcaccgcaacctccacctcccaggttcaagcaattctcctgtctcagcctccctagaagctgggattacaggcatgtgccacca

SEQ ID NO: 41852 - DNA, 601 bp, Human
ttagccaaatatttaacctcatgctatataaagaagtcactgtaaaatttatccacagaggagggaaaagagaggaatagtggaaaaagttttcccagccttcttaatgccttacagccgctagctgtatttacttcatgtttccttttttacatgaaaataatatgcattatttctttccttgttgatttgtaaaatatatttttattctctgcggctgtctttattttttaaaataattatttatgaaactgtcttattataaactctgagaggaaacatgttgttttattcaacgttrtttttaccttatacccaacttaccccttggccaattttaggtccttaattagtactgattaataactgttaattataataaaatcatactactctataacacatgtaatagtttttgccaatgttaaactaagagactataattgcattgttttgatcctaaatataaaaattatgtagattctgcacatttttcataaaacaacagtgataacatcaatttatttatttatttatttttgagatggagtttcgctcttgtcacccaggctcgagtgcaatggcaagatctcggctcacc

SEQ ID NO: 41853 - DNA, 601 bp, Human
ttttaaaaacatgaaataaattagactaaagtagaatagatagaaaatatcagagtgcgtggcttgtaggttatgtactatctggtgaaactttggtttagttgtgtgtatgtgtttgtatgtttgtgcatctctgtgtgtgtgcgcccgtgtgatgtgtttggtacactatgtcctgccataaaatacatttcctactgtgggtcatgattaaaaaaattgaaagccacagccctagagatgtctcaatcctggcttcaaatgagttggtttgctttctgacaaagtaaatttataaacraaaggaaaaggaattcttccaaatgtcaatagtcacctcccaactctctactgaaactatccttaagtttttctgaattctactctttgttcaccaaaaaatacttgaatcactcctggtcaaagtaagcccaaggcaaactgtgaagtgggtcaaaattatctttctcttctgggaacatctcccaccccttgtagacgaccctcacgtttgtacttttttcccttttccttttttcgtattctatgaaagactgataaatgcattaaacaacaccgtaattgattgaaaaatgctttt

SEQ ID NO: 41854 - DNA, 601 bp, Human
ttctttttcattccaatcttttgaatgaaaaccagaatacctttttttgcaccttgtagatgtatagaaaaacaaaacaacctaccaaatttcctggcccttctgttcccttaactagtaaacaaatgaaattctctttttttcctatgtggtagagagtgtaatttgtcctgagagagtgagcaagaggtaggccgggtgcggtggctcacgcctataatcccagaactttgggaggccaaggcgggcggatcgcaaggtcaggagatcaagaccatcctggctaacacggtgaaacacygtctctactaaaaatacaaaaaattagccggcgtggtggcaggcacctgtagtcccagctactcaggaggctgaggcaggagaatggcgtgaacccaagaggcggagcttgcaatgagccaagatcgcaccactgcactccaacctgggcgacaaagcaagactccgtctcaaaaaaaaaaagagagtgagaaagaggtcatttcaaaattgcctaattaggagcaaatatgtgatttttcatctttgggttttagaggtataaaaaatctgtccaataagtatatcacttgataggtaa

SEQ ID NO: 41855 - DNA, 601 bp, Human
agttggggagttgtaacttcttctttttcattccaatcttttgaatgaaaaccagaatacctttttttgcaccttgtagatgtatagaaaaacaaaacaacctaccaaatttcctggcccttctgttcccttaactagtaaacaaatgaaattctctttttttcctatgtggtagagagtgtaatttgtcctgagagagtgagcaagaggtaggccgggtgcggtggctcacgcctataatcccagaactttgggaggccaaggcgggcggatcgcaaggtcaggagatcaagaccatccyggctaacacggtgaaacaccgtctctactaaaaatacaaaaaattagccggcgtggtggcaggcacctgtagtcccagctactcaggaggctgaggcaggagaatggcgtgaacccaagaggcggagcttgcaatgagccaagatcgcaccactgcactccaacctgggcgacaaagcaagactccgtctcaaaaaaaaaaagagagtgagaaagaggtcatttcaaaattgcctaattaggagcaaatatgtgatttttcatctttgggttttagaggtataaaaaatctgtccaataa

SEQ ID NO: 41856 - DNA, 601 bp, Human
tttctatgagagttggggagttgtaacttcttctttttcattccaatcttttgaatgaaaaccagaatacctttttttgcaccttgtagatgtatagaaaaacaaaacaacctaccaaatttcctggcccttctgttcccttaactagtaaacaaatgaaattctctttttttcctatgtggtagagagtgtaatttgtcctgagagagtgagcaagaggtaggccgggtgcggtggctcacgcctataatcccagaactttgggaggccaaggcgggcggatcgcaaggtcaggagatcragaccatcctggctaacacggtgaaacaccgtctctactaaaaatacaaaaaattagccggcgtggtggcaggcacctgtagtcccagctactcaggaggctgaggcaggagaatggcgtgaacccaagaggcggagcttgcaatgagccaagatcgcaccactgcactccaacctgggcgacaaagcaagactccgtctcaaaaaaaaaaagagagtgagaaagaggtcatttcaaaattgcctaattaggagcaaatatgtgatttttcatctttgggttttagaggtataaaaaatc

SEQ ID NO: 41857 - DNA, 601 bp, Human
ccacggtttctatgagagttggggagttgtaacttcttctttttcattccaatcttttgaatgaaaaccagaatacctttttttgcaccttgtagatgtatagaaaaacaaaacaacctaccaaatttcctggcccttctgttcccttaactagtaaacaaatgaaattctctttttttcctatgtggtagagagtgtaatttgtcctgagagagtgagcaagaggtaggccgggtgcggtggctcacgcctataatcccagaactttgggaggccaaggcgggcggatcgcaaggtcagsagatcaagaccatcctggctaacacggtgaaacaccgtctctactaaaaatacaaaaaattagccggcgtggtggcaggcacctgtagtcccagctactcaggaggctgaggcaggagaatggcgtgaacccaagaggcggagcttgcaatgagccaagatcgcaccactgcactccaacctgggcgacaaagcaagactccgtctcaaaaaaaaaaagagagtgagaaagaggtcatttcaaaattgcctaattaggagcaaatatgtgatttttcatctttgggttttagaggtataa

SEQ ID NO: 41858 - DNA, 601 bp, Human
cgcttatatgtgtcctctagcccttttccctttcatcttccagctctgaaattccacggtttctatgagagttggggagttgtaacttcttctttttcattccaatcttttgaatgaaaaccagaatacctttttttgcaccttgtagatgtatagaaaaacaaaacaacctaccaaatttcctggcccttctgttcccttaactagtaaacaaatgaaattctctttttttcctatgtggtagagagtgtaatttgtcctgagagagtgagcaagaggtaggccgggtgcggtggctcaygcctataatcccagaactttgggaggccaaggcgggcggatcgcaaggtcaggagatcaagaccatcctggctaacacggtgaaacaccgtctctactaaaaatacaaaaaattagccggcgtggtggcaggcacctgtagtcccagctactcaggaggctgaggcaggagaatggcgtgaacccaagaggcggagcttgcaatgagccaagatcgcaccactgcactccaacctgggcgacaaagcaagactccgtctcaaaaaaaaaaagagagtgagaaagaggtcatttcaaaatt

SEQ ID NO: 41859 - DNA, 601 bp, Human
tccactgtactgaatgataccccagtggcctgaaagaattattgtagctttttaaagtgactcattcactcccacggggtcatctggactcagggaaaatctgtctcactgattattagtgatttggtaattggatggtagtgatgggcttctgataacctagagatttgctttagcttcactggcaaaggactgttttctttggagtcaaagattacactgcctctttgtgtgtgtgtgtgtgtgtgtgtgtgtgtgtgtgtgtgtgcgcgtgtgcatgctgggggggatgagggaatgygtacaagaggactgcttctttgaacctgaatctaccagtcccagttctgccattcagtagctggataatcttgggcagattacattcccttctgcctcagtttcttcatatgtaaaaagaggtagggtcaaatgatctcagtgatctcttctagctctgaaaaaccttgtgatttctaggcaatgagtatcttttgatgcacatctgttgttgcaaaagctacaagtttcagagtattaatttcatctttctcaagccattattttggatgaagaccagaattgtcctttacaagtgtgt

SEQ ID NO: 41860 - DNA, 601 bp, Human
gcttcagaaactcaaggcccagaagtgctgaatccactgtactgaatgataccccagtggcctgaaagaattattgtagctttttaaagtgactcattcactcccacggggtcatctggactcagggaaaatctgtctcactgattattagtgatttggtaattggatggtagtgatgggcttctgataacctagagatttgctttagcttcactggcaaaggactgttttctttggagtcaaagattacactgcctctttgtgtgtgtgtgtgtgtgtgtgtgtgtgtgtgtgtgtgtgygcgtgtgcatgctgggggggatgagggaatgtgtacaagaggactgcttctttgaacctgaatctaccagtcccagttctgccattcagtagctggataatcttgggcagattacattcccttctgcctcagtttcttcatatgtaaaaagaggtagggtcaaatgatctcagtgatctcttctagctctgaaaaaccttgtgatttctaggcaatgagtatcttttgatgcacatctgttgttgcaaaagctacaagtttcagagtattaatttcatctttctcaagccattattttgg

SEQ ID NO: 41861 - DNA, 601 bp, Human
agagtaaactatccgcagagggtagggcactagagaatgcttcagaaactcaaggcccagaagtgctgaatccactgtactgaatgataccccagtggcctgaaagaattattgtagctttttaaagtgactcattcactcccacggggtcatctggactcagggaaaatctgtctcactgattattagtgatttggtaattggatggtagtgatgggcttctgataacctagagatttgctttagcttcactggcaaaggactgttttctttggagtcaaagattacactgcctctttgggtgtgtgtgtgtgtgtgtgtgtgtgtgtgtgtgtgtgcgcgtgtgcatgctgggggggatgagggaatgtgtacaagaggactgcttctttgaacctgaatctaccagtcccagttctgccattcagtagctggataatcttgggcagattacattcccttctgcctcagtttcttcatatgtaaaaagaggtagggtcaaatgatctcagtgatctcttctagctctgaaaaaccttgtgatttctaggcaatgagtatcttttgatgcacatctgttgttgcaaaagctacaagtttc

SEQ ID NO: 41862 - DNA, 601 bp, Human
aaccaacttcagcatggctaaattcctttggcacaaactccctgagtctctgagacctattttccacagaaatgctagttgggagtttcagtcaggattaatttagattttttttaatacgtacatgtatcagaatcattcaccgaggggaagttcttatatatccattcccagaattctcttaagacatctggtctcattagaagatcaaatagatcctccagattcattagttgtttaacaaagtgggaattattttctcactgctcttgtgtttgtgagatattcaagacacaggtgaaaaaaaaataactgaaaaaaaaagccaatcttcttgactcacaaggacagctctttcagcagaatacaaaagtctcgaattagctcttaatttctaaaaacacaaggaaacagtcaagagcataggtcactcaacagatttggtttaaagatcagaaaattttattagtggctcacctatcacccggttaccatcctgtgttctcttttttatggacagtttcatgaatgcctgtgtcatctttgtgcagggggtcatgctaatctctgtatctttccaattttattgtatatgctgcca

SEQ ID NO: 41863 - DNA, 601 bp, Human
agtggatcacctgaggtcaggagtttgagaccagcctgaccaacatggagaaaccccatctctactaaaacatacaaaaataaaccaggcgtggtggcaggcgctataatcccagctactcgggaggctgaggcaggagaatcacttgaacctgggaggcggaggttgcagtgagctgagattgcaccattgcactccagcctgggcaacaagagtgaaactccgtcacaaaaaaaaaaaagtagggctgccaggcacagtgggttatgtcttaattccagcactttgggaggccaaggtrggaggactgcttgaacccaggagttccagaccagcctgggcaacgtcgcaagatcccatctccacaaaaaataaaaaattagctagcgtggttgcatgcgcctgtggtcccagctatttgggaagctaaagtgggaagatggcttgaggccacaaggtcaaggctgcagtgagctatgatcatgccactgcactccagcctgggcaacagagagagaccctgtcttaaaaaaaaaaaagtaggactaagtaaatttactaaagaatatagcttaaaattggggcagattcaataaagtct

SEQ ID NO: 41864 - DNA, 601 bp, Human
tcacgcctgtaaactttgggatgccgaggctagtggatcacctgaggtcaggagtttgagaccagcctgaccaacatggagaaaccccatctctactaaaacatacaaaaataaaccaggcgtggtggcaggcgctataatcccagctactcgggaggctgaggcaggagaatcacttgaacctgggaggcggaggttgcagtgagctgagattgcaccattgcactccagcctgggcaacaagagtgaaactccgtcacaaaaaaaaaaaagtagggctgccaggcacagtgggttatgycttaattccagcactttgggaggccaaggtgggaggactgcttgaacccaggagttccagaccagcctgggcaacgtcgcaagatcccatctccacaaaaaataaaaaattagctagcgtggttgcatgcgcctgtggtcccagctatttgggaagctaaagtgggaagatggcttgaggccacaaggtcaaggctgcagtgagctatgatcatgccactgcactccagcctgggcaacagagagagaccctgtcttaaaaaaaaaaaagtaggactaagtaaatttactaaagaatata

SEQ ID NO: 41865 - DNA, 601 bp, Human
ggcaaagaacagccatatggcaagtaaatgtggtagacaccgagcaggatcctctctctcagtttctctttctctcccatagaaaagtagggctggctgggcacagtggttcacgcctgtaaactttgggatgccgaggctagtggatcacctgaggtcaggagtttgagaccagcctgaccaacatggagaaaccccatctctactaaaacatacaaaaataaaccaggcgtggtggcaggcgctataatcccagctactcgggaggctgaggcaggagaatcacttgaacctgggaggyggaggttgcagtgagctgagattgcaccattgcactccagcctgggcaacaagagtgaaactccgtcacaaaaaaaaaaaagtagggctgccaggcacagtgggttatgtcttaattccagcactttgggaggccaaggtgggaggactgcttgaacccaggagttccagaccagcctgggcaacgtcgcaagatcccatctccacaaaaaataaaaaattagctagcgtggttgcatgcgcctgtggtcccagctatttgggaagctaaagtgggaagatggcttgaggccacaaggtc

SEQ ID NO: 41866 - DNA, 601 bp, Human
tcagtgaattgtgagcaagaagaaagctcagaagaaagcaagaagaaagataatggctttctgagtctacaatagacacatgcaatatacgtatgtaagcaagaaaggctgaaataacataaattctcatccaacactatcagccacaccaaagccttctgtttcaggtctgcttggaaaaagatataaaagcagatgcttaacacctgaagagaccttagagaccatgaatcaaacctgctgattccaacattctctccaaattcacaaagacagaacactttcatatctaccttcagcrgaagaaaaaccagttttatcatttccttgtaaacctatgcaggttcgatttatttcattctggcaactttgtgatgagtatgagaactggcaatagatggcttaatgtgccttgagatcaaattttgattggaaaattttcattcattgaaaaatttgactggaaaacaaactttaatgtttattttctttgtgtcatccttgtgcttcccagattagctactttgcatccagagaagtgaaaacaaaggtaagtaaagtggctattgctctgtgacatcacatggcaatgaggagtgct

SEQ ID NO: 41867 - DNA, 601 bp, Human
tctgtgcccctccaattatatatagcctggttttgcaaaatgaggctgaagtctctgcaaccaacaagaccctgttcctgttctgatggggacatactgaattattttgtcttcagtttcctacgatggtctcctctaattattattattattatttttaagacaaagtctcactctgccgcccaggctggagtgcagtagtgcgatcttggcttactgcaacctccgcctcctgaggtcaagtgattctcctacctcagcctcccaagtagctgggattataggcaagtgccaccacgcygggctaattttcataatttttgtagagaaggggtttcaccatgttggccaggctggtctcaaactcctgacctcaggtgatcctcccacctcggcctcctaaagtgctgggatcacaggcatgagccaccgcacctgtctgggcctcctctaatatgaaaaaaaaaaacaaaaacaaaaaacaaaacccagcccagcgcggtggttcatgcttgtaatcccagcactttgggaggccgaggcaggtggatcacctgaggtcaagagtttgagaccagcctggccaacgtggtaaaccccg

SEQ ID NO: 41868 - DNA, 601 bp, Human
ctacttctaggcagacaagctgacaaaattgcttctaccgattgttcagtaggaaccagtgccgagcactgggaggttgggagataaggtaagcctacccaggtattcacaagctggggaggacctcactgctaatgcatacctgactgcctcattctgtgcccctccaattatatatagcctggttttgcaaaatgaggctgaagtctctgcaaccaacaagaccctgttcctgttctgatggggacatactgaattattttgtcttcagtttcctacgatggtctcctctaattattaktattattatttttaagacaaagtctcactctgccgcccaggctggagtgcagtagtgcgatcttggcttactgcaacctccgcctcctgaggtcaagtgattctcctacctcagcctcccaagtagctgggattataggcaagtgccaccacgccgggctaattttcataatttttgtagagaaggggtttcaccatgttggccaggctggtctcaaactcctgacctcaggtgatcctcccacctcggcctcctaaagtgctgggatcacaggcatgagccaccgcacctgtctgggcc

SEQ ID NO: 41869 - DNA, 601 bp, Human
ccaacactgaggaagtaacactggcagcctttccataagatctgtgagcaatctgtgtgcctgctggaaaagcataagtactggaataagcagggaccctaattattctcagcaaacaagcatgtggctacttctaggcagacaagctgacaaaattgcttctaccgattgttcagtaggaaccagtgccgagcactgggaggttgggagataaggtaagcctacccaggtattcacaagctggggaggacctcactgctaatgcatacctgactgcctcattctgtgcccctccaattayatatagcctggttttgcaaaatgaggctgaagtctctgcaaccaacaagaccctgttcctgttctgatggggacatactgaattattttgtcttcagtttcctacgatggtctcctctaattattattattattatttttaagacaaagtctcactctgccgcccaggctggagtgcagtagtgcgatcttggcttactgcaacctccgcctcctgaggtcaagtgattctcctacctcagcctcccaagtagctgggattataggcaagtgccaccacgccgggctaattttcataatt

SEQ ID NO: 41870 - DNA, 601 bp, Human
tgacagtgtgcagacagggaacagggggctcaggcttagtgggctctacctccccaacactgaggaagtaacactggcagcctttccataagatctgtgagcaatctgtgtgcctgctggaaaagcataagtactggaataagcagggaccctaattattctcagcaaacaagcatgtggctacttctaggcagacaagctgacaaaattgcttctaccgattgttcagtaggaaccagtgccgagcactgggaggttgggagataaggtaagcctacccaggtattcacaagctggggargacctcactgctaatgcatacctgactgcctcattctgtgcccctccaattatatatagcctggttttgcaaaatgaggctgaagtctctgcaaccaacaagaccctgttcctgttctgatggggacatactgaattattttgtcttcagtttcctacgatggtctcctctaattattattattattatttttaagacaaagtctcactctgccgcccaggctggagtgcagtagtgcgatcttggcttactgcaacctccgcctcctgaggtcaagtgattctcctacctcagcctccc

SEQ ID NO: 41871 - DNA, 601 bp, Human
ataaagaaaaatactacaccccagtaaaatgcaggtgtaatgtggtttgatcctttcaaaagctaaaaatctcagctggacccttccaaatatgactgaaatgaagttatttttactagattataacacttcattgataaactcataaaagcaattctcaatggtcaaataaaactccttcaataacactcatcagcaggaataccaacagatgagtgcaacatagtaatgcttttaggccgggcggggtggctcacacctgtaattacagcactttgggaggccaaggtgggtggatcaygaggtcaggagttcgagaccagcctgaccaacatggtgaaaccccgtctctactaaaagtacaaaaattaggccgggtgcggtggctcacatctgtaatcccagcactttgcgaggccgagggaggtggatcatgaggtcaggagctcgagaccagcctgaccaacatggtgaaacactgtctccactaaaaaaaaacaaaaattagctgggtgtggtggcatgcgcctgtaatcccagctacttaggaggctgaggcaggagaattgcttgaacctgggaggcaggggttgcagtgagc

SEQ ID NO: 41872 - DNA, 601 bp, Human
tatttttagtagagacggggttttgccatgttggccaggctggtcttgaactcctgaactcaggtgatcctcctgcctcagcctcccaaagtgctgggattacagcacttgcttctgtcatgtctccagcaatttagcatagggattgacacacagtacaaacttgataaatgtttgatgaatgtgtgagtgaataaatgaatatgtgaataaaatttgaatttggcctgatcctaggtcaggactacccatttatggctgaaatgttttaggggcagctttaagagtgtgattcaacaayaaagaaaaatactacaccccagtaaaatgcaggtgtaatgtggtttgatcctttcaaaagctaaaaatctcagctggacccttccaaatatgactgaaatgaagttatttttactagattataacacttcattgataaactcataaaagcaattctcaatggtcaaataaaactccttcaataacactcatcagcaggaataccaacagatgagtgcaacatagtaatgcttttaggccgggcggggtggctcacacctgtaattacagcactttgggaggccaaggtgggtggatcacg

SEQ ID NO: 41873 - DNA, 601 bp, Human
tcagactcctgagttgctgggattacaggcataagccaccatacccagctactttttgtatttttagtagagacggggttttgccatgttggccaggctggtcttgaactcctgaactcaggtgatcctcctgcctcagcctcccaaagtgctgggattacagcacttgcttctgtcatgtctccagcaatttagcatagggattgacacacagtacaaacttgataaatgtttgatgaatgtgtgagtgaataaatgaatatgtgaataaaatttgaatttggcctgatcctaggtcagractacccatttatggctgaaatgttttaggggcagctttaagagtgtgattcaacaataaagaaaaatactacaccccagtaaaatgcaggtgtaatgtggtttgatcctttcaaaagctaaaaatctcagctggacccttccaaatatgactgaaatgaagttatttttactagattataacacttcattgataaactcataaaagcaattctcaatggtcaaataaaactccttcaataacactcatcagcaggaataccaacagatgagtgcaacatagtaatgcttttaggccggg

SEQ ID NO: 41874 - DNA, 601 bp, Human
cgatgcttaagtttttccagtggctcccctttgctttgaataaaatccatattagaaccgtatgtataaatgagctgctcacctgtccagctttaccccttgccccttccctatccttgtccttccagccataggaattacttgaagtttccaagaagtgctatgccaaagcctctgtatttttacacgagctgttctctcctagtgatgccgccctgaaccctcccttactctcaccttgttgtctatgggaattaagttgtcctttccagttcaaacataatcttaaacattggtgtawacagggctggggttattagtgtgctgtcataaccaagtacttgcacaagatttcagggtcagagtttgccattgtgtttagtgccgcatcaatgtcaggaggggttctactttaattgagaaaactgccatgaagacttaacttgtaaagtgaagacggctctcgtcctttttttttttttttgagatggagtctcgctctgtcgcccaggctggagcgcgatggtgcaatcttggctcactgtaacctccacctcccaggttcaagcaattctcctgcctcagactcctgagttgctgg

SEQ ID NO: 41875 - DNA, 601 bp, Human
gacattatgtggtgggcatatgtccctggtacattttcaatcctcctggcccccgatgcttaagtttttccagtggctcccctttgctttgaataaaatccatattagaaccgtatgtataaatgagctgctcacctgtccagctttaccccttgccccttccctatccttgtccttccagccataggaattacttgaagtttccaagaagtgctatgccaaagcctctgtatttttacacgagctgttctctcctagtgatgccgccctgaaccctcccttactctcaccttgttgtctatgggaattaagttgtcctttccagttcaaacataatcttaaacattggtgtatacagggctggggttattagtgtgctgtcataaccaagtacttgcacaagatttcagggtcagagtttgccattgtgtttagtgccgcatcaatgtcaggaggggttctactttaattgagaaaactgccatgaagacttaacttgtaaagtgaagacggctctcgtcctttttttttttttttgagatggagtctcgctctgtcgcccaggctggagcgcgatggtgcaatcttggctcactgtaac

SEQ ID NO: 41876 - DNA, 601 bp, Human
actggatacttaattaatgtatgttgaattaataaatatatgaatggatgagcaattcatcaggtctggggtagaatttgggaatatgtaattttaaaaagctagtgtggaatcactttaggcacactgggctagactgccccctcgatgtgtgcatatactggaaggatgatttggtgtcattaaaataataactatgaaataatcagcaataaatcagttcaaggttaaaaagaaaaacttggctgggcatggtggctcacgcctgtaatcccaacattttgggaggccgaggtggtgkatcacctgaggtcaggagttagagaccagcctggctaacatggtgaaaccctgtctctcctaaaaatacaaaagttaactgcatgtggtggtgcacacctgtagtgccagcttctcaggaagctgaggctagagaatcacttgaacccaggcagaggttgcagtgagccaagatcacaccactgcactccagcctgtgtgacagagtgagactctgtctcaaaacaataaaaaaattaaaactaaaaaagaaaaagaaaactttctggtcaaaaagaatgttatactgaagaaatctgaa

SEQ ID NO: 41877 - DNA, 601 bp, Human
cctgtatactctcttgcttcccttcaacttttttcccatctgcagccagtgcaatagtttttctactgagaattcgatgaaatcactccattgcttaaaatcctcctatggcttcctattccaaacaataaaatccaagccctccaggagctggaccttgtcaaactttttgacattttcaagagccctatttcccccacaatcattgatttttaggtagtgaccttcctttattttcttgaaaatattaagctagcttctacctcaggatttttgcatatgctattcctgtgcctgtagygctgtgtgtccagatttatcaaggctgttttctttcttgttatttggatttcagctgaaatgtcagctcttcacattggtcttctctgaacccctctaactgctcccttcctcctcacttgtttcttcccacttctagaacagggcttgacacatactggatacttaattaatgtatgttgaattaataaatatatgaatggatgagcaattcatcaggtctggggtagaatttgggaatatgtaattttaaaaagctagtgtggaatcactttaggcacactgggctagactgccccct

SEQ ID NO: 41878 - DNA, 601 bp, Human
gaccccaggaggcagaggttgctgtgagccgagatcgtgccattgcaccccagcctgggtgacagagtgagactccctctcaaaaaaaaaaaaaaaaagataattaattaaatagatggcagggaatgtatagaggatccccacccctgagaaatctttgggaagagcttgaatttatatctgcgtggagtggtcgagctgtgccttcttgaataaaaataaggattagaataaatgaatagttcccaaaggtgacatctgagaactggctctggcacctggctctatctgtttagggaasttttagaacatgtgcaggattttcccctagatggtctggttccccttctccacaaatggctcccaaagggttaagccaaaaacctgagtcctgcctgcctcatcttctctcaaagtctttttggcaaattctatcagctttacctcaacatgtatcctgggtccatcaacttctcccccatctccattctcctgccctgatctaagccaccatctctccatctctcccctggggtgatggacctcctgtatactctcttgcttcccttcaacttttttcccatctgcagccagtgcaata

SEQ ID NO: 41879 - DNA, 601 bp, Human
gttcctttgctaaggataatggcctccagccccacccatgttcctgcaaaagacatgatctcgttcttttttatggctgcatagataggtgatcagtcttagttatacccctctgtcttaattactgaaataaatttagattccctaatgtctaaattttttaggttttcacatagctgcaattcagcaagtcatcatgtaaagggttatgatgaagcaaggggtagccacgtgttccatctctattgacaggtccacagggaatgacacgtgatgcagaaggaaggatttaagttgtacrtaaaagaatgtcttgactactgccaaactttaaaatagatggcaggggccaggcatgggggctcacgcctgtaatcccgaggccgaggtgggcagatcactggaggtcagaagttcgagatcaccctgaccaacatggtgaaaccctgtctctactaaaaatacaaaaattagctgggcatggtggtgggcacctgtaattcctgctactcaggagactggggcaggaggatcacttgaccccaggaggcagaggttgctgtgagccgagatcgtgccattgcaccccagcctgggtgac

SEQ ID NO: 41880 - DNA, 601 bp, Human
tcgggggtacatgtgaaggtttgttacctaggtgaactcttgtcatgggggtctgttgtacagattattttatcacccaggtattaagtccagcaccctgtagttatcttttctgctgtctccctcctcccaccctccagccccaagcagactcgtgtctgttgttcccttgtgttcgtgagttctcatcatttagctcccacttcttctttgagacagagtttcactcttgttgcccaggctggagtgcaatggcacgatcacagctcacagcaacctccacctcccaggttcaagcaaytgtcctgcctcagcctcgtgagtagctgggattacaggcacccgccaccctgccaggctaattttgtatttttagtagagacggggtttctccatgttggttaggctggtcttgaactcccaacctcaagtgatctccccgccttggcctcccaaagtgctgggattacaggcgtgagccaccgcgctcagcgagctcccacttataagtgagaatatgaggtatttggttttctgttcctgtgttcctttgctaaggataatggcctccagccccacccatgttcctgcaaaagacatg

SEQ ID NO: 41881 - DNA, 601 bp, Human
tttcacactttaaatacaaggagtgcaaagtttcctgagctcagagccaacctcagaatcaggaacttcaagggaggaagcactaaatgttctcagccattatttctctgcatacgtagccaactgaatttgcacactggtgtctgcataggcacttagtcttttttgtgtgtttttaaacatttattttaggttcgggggtacatgtgaaggtttgttacctaggtgaactcttgtcatgggggtctgttgtacagattattttatcacccaggtattaagtccagcaccctgtagttaycttttctgctgtctccctcctcccaccctccagccccaagcagactcgtgtctgttgttcccttgtgttcgtgagttctcatcatttagctcccacttcttctttgagacagagtttcactcttgttgcccaggctggagtgcaatggcacgatcacagctcacagcaacctccacctcccaggttcaagcaactgtcctgcctcagcctcgtgagtagctgggattacaggcacccgccaccctgccaggctaattttgtatttttagtagagacggggtttctccatgttggttaggc

SEQ ID NO: 41882 - DNA, 601 bp, Human
gggtagtatagacttaaatcctattttaccaaattttaaaatatcatcatctgtgtagatttctatctttatttctacctcctcctagcccaaatgatattctacacaagaaataccttagcagaactgcaaatcggaagcagatttacctgaaactaatgagcttcagcttcagcagcctttacttgcacagaaaatcccatggctttttgagggactcaagcaatgtgtatgctccaggtctaatgtttttgtaaaatgtgcaaaagaaagagatttttgtggtctttttcactgagcrcttcctaaattgtataaaatttagagtccgcaaagctgggattaatctctgctgcaagggaccactgacttgggctaataagtaaactggcaagaagccttttcaacttcaaagatatcagacaaaatattatcaattttttttttcaaatgactagaagtaaattaagtaagtttcgaagtagtgggaaactaagtcctgttggaatattgggagactgaagaattataatagatgaaacactcattgctattagcagggttattgattctgatatgtatgacatatttatgctcatct

SEQ ID NO: 41883 - DNA, 601 bp, Human
ggctgaggtgggtggatcatttgaggtttgagactggcctgaccaatatggtgaaactccgtctctactaaaaatacaaaaattagccaagcatggtggtgcatgcctataatccgtgttactcaggaggctgaggcaggagaattgcttgaactcaggaggtggaggttgcagtgagctgagatcatgccattgcactccagcctgggtgacaagagcaaaactccatctcaaaagaaaaaaaaaaagaatatgaattgtttataaattcttcatcagaactaaaagagaacttacagcaattttccatttaaatttgtttgatatacatattaaaaatttcttagggtaaggagagtgaaattgaactaatgggactatgcctggtatcagctagtctaggtgagcttaggagaaggtggaatgcttaagactgaataaccacagagtgtctaatgaggctataaatgctgaacttagctcagagaaaaattacttctttagtctccaggcatgactttcttgatagtccctgggtcaatgagaaattatttttagaaagaaaaactcactacagatgtctggggttaatatttatttt

SEQ ID NO: 41884 - DNA, 601 bp, Human
tgtagaatatgaattgtttggccaagtgtggtggctcacgcctgtaatcccagcactttggaaggctgaggtgggtggatcatttgaggtttgagactggcctgaccaatatggtgaaactccgtctctactaaaaatacaaaaattagccaagcatggtggtgcatgcctataatccgtgttactcaggaggctgaggcaggagaattgcttgaactcaggaggtggaggttgcagtgagctgagatcatgccattgcactccagcctgggtgacaagagcaaaactccatctcaaaagaaaaaaaaaaagaatatgaattgtttataaattcttcatcagaactaaaagagaacttacagcaattttccatttaaatttgtttgatatacatattaaaaatttcttagggtaaggagagtgaaattgaactaatgggactatgcctggtatcagctagtctaggtgagcttaggagaaggtggaatgcttaagactgaataaccacagagtgtctaatgaggctataaatgctgaacttagctcagagaaaaattacttctttagtctccaggcatgactttcttgatagtccctgggt

SEQ ID NO: 41885 - DNA, 601 bp, Human
atgaggacctccaaaacctttatgacatactttataatcttaccataggaaaccccacagtttcctaattagataatagtaaaacttgtatctatatgcaatactatattgctattgtagaatatgaattgtttggccaagtgtggtggctcacgcctgtaatcccagcactttggaaggctgaggtgggtggatcatttgaggtttgagactggcctgaccaatatggtgaaactccgtctctactaaaaatacaaaaattagccaagcatggtggtgcatgcctataatccgtgttacycaggaggctgaggcaggagaattgcttgaactcaggaggtggaggttgcagtgagctgagatcatgccattgcactccagcctgggtgacaagagcaaaactccatctcaaaagaaaaaaaaaaagaatatgaattgtttataaattcttcatcagaactaaaagagaacttacagcaattttccatttaaatttgtttgatatacatattaaaaatttcttagggtaaggagagtgaaattgaactaatgggactatgcctggtatcagctagtctaggtgagcttaggagaaggtgga

SEQ ID NO: 41886 - DNA, 601 bp, Human
ttacgaatagaaaaattaaatttctgcagtatgaggacctccaaaacctttatgacatactttataatcttaccataggaaaccccacagtttcctaattagataatagtaaaacttgtatctatatgcaatactatattgctattgtagaatatgaattgtttggccaagtgtggtggctcacgcctgtaatcccagcactttggaaggctgaggtgggtggatcatttgaggtttgagactggcctgaccaatatggtgaaactccgtctctactaaaaatacaaaaattagccaagcrtggtggtgcatgcctataatccgtgttactcaggaggctgaggcaggagaattgcttgaactcaggaggtggaggttgcagtgagctgagatcatgccattgcactccagcctgggtgacaagagcaaaactccatctcaaaagaaaaaaaaaaagaatatgaattgtttataaattcttcatcagaactaaaagagaacttacagcaattttccatttaaatttgtttgatatacatattaaaaatttcttagggtaaggagagtgaaattgaactaatgggactatgcctggtatcag

SEQ ID NO: 41887 - DNA, 601 bp, Human
aagacaacaaaagtgcatattttgtcagcttgaaccagcattccatatctatctgttctttatcatatagtatagattgttttcatcagaaagtaaagctcaaggtagtttgtgtgcatctattttaaaactgatcaatttttaagactttccaataaaaaaaatctgctaaatattataattggttctgtctctgagcagagaaatactgagtaacacaggcagtgcttgatcctgtggtcccactgaatatcggctctgctcttcatcacaacctcaaaatccactagaattgagacarttaggtttttaatctaaaatagcctagttagagaagtaattagcagttaattagagcattcaatctcaaaagctctcttttaataaatgtattttttacctctctgctctaaacctgatcaaaccaaaagattcagcaaaagtgggagcaattatgtaaacatttattcagttattctcaatatgggacaatttaacttccagatttgccttatactcaagtgtaatgaaacaacagattttgggcactgttgttgttttaagtgccatttcaatgtgtttttacctagggttttgtttc

SEQ ID NO: 41888 - DNA, 601 bp, Human
gctattatagccaacccaccatgaatttattaatcaacagactataactttaaatttatctgattgctatataatatggttagaatatataataattaaaaatgcttcctctgctccataaaaaattgcttgctggaatacaagttctctaaaaatggtctcacctagaagttccctttgaaaccaatagggtttcccagtattagaagcacctaaaaacagaaaaattaattttcctagatttactcctggtattcctttacctcgatttatataaatgagttaggccctacctctttayaagcaattccttgtgaagatagtcataccaaacatgaatcaatttcctcactagatctaagacaacaaaagtgcatattttgtcagcttgaaccagcattccatatctatctgttctttatcatatagtatagattgttttcatcagaaagtaaagctcaaggtagtttgtgtgcatctattttaaaactgatcaatttttaagactttccaataaaaaaaatctgctaaatattataattggttctgtctctgagcagagaaatactgagtaacacaggcagtgcttgatcctgtggtc

SEQ ID NO: 41889 - DNA, 601 bp, Human
aacggtgttttctttccaagttttatacaagatctaattatttggccttcgggtgttttgattaaaagggtgtcacattatgaggtaaatcatgcattctcaaatcattcaaattttgtcttagatactgaagcaaaattgctattatagccaacccaccatgaatttattaatcaacagactataactttaaatttatctgattgctatataatatggttagaatatataataattaaaaatgcttcctctgctccataaaaaattgcttgctggaatacaagttctctaaaaatggtcycacctagaagttccctttgaaaccaatagggtttcccagtattagaagcacctaaaaacagaaaaattaattttcctagatttactcctggtattcctttacctcgatttatataaatgagttaggccctacctctttataagcaattccttgtgaagatagtcataccaaacatgaatcaatttcctcactagatctaagacaacaaaagtgcatattttgtcagcttgaaccagcattccatatctatctgttctttatcatatagtatagattgttttcatcagaaagtaaagctca

SEQ ID NO: 41890 - DNA, 601 bp, Human
atcttcatataacttcctcacccaccctcaaccgaaaattgttttgtttttaaaagatgttattgagtttagcttcttgttaaaatcaagagaacagaataccaaaggaattctaagcaaaacatgataaataaacactattgtttcttaacaaaaaaaaaagaaaagaaaacagaagagcttttatacacacttttattttttctaaattcacactaccatgcttcacattttctgaaagcctggcgatataaggctcgtaaagactcttgactagaacatcctcacctcagcccacagygttaaaaggaggagggcaaagagctgctgggagaaaagccagcatgagtggataagtggagaggtggcgacaagacacagatgtgcgactttggcttttgctgctcaacttgtgctacaacggtaacggtttatgcacgtctttcaagaacccttcaagtgcacgcaacagattactactctgttttacacctcttctctgtgtggcacttagttttaatgaaagtctaattctaaactacttgcatgctgcaactatttgcatgctccaaattaatttgcatattgctgaagcaaagag

SEQ ID NO: 41891 - DNA, 601 bp, Human
gccacccagcccaacctaattgtggttttaatggcaaaaacagcaattaattttgcactaacctaatacaatttattaaacattagctagtgaaaatgagttactgaaactccggaatttgcttcttaattcaggacctcttcctctacatgtgataccaatctttcctttggctgttgtttaaaagtcagattttgttgtatgacccttaaaataatttttctgtgatgccgaaacctaattatgagaaatacatatgtttttaaaacaacataaaacattttataattctggccttagscatctgttggtatgaataaatgtttaaaagactttcatttgtagattaaaatttatgttttataaaaacggcactaaagtagtagatattatgccttaaacgcttgttaggttttttcttgaaaaaggatagtttgtatacatgtcacatgacatggtctacctaacttttaagtagctttgttgtatcaaattcattttaagtacattttaaacttctctataattaatatttaatttatacaaattaatctattatctctaacagtgagtgagttagtggaagttcctttgtaatatt

SEQ ID NO: 41892 - DNA, 601 bp, Human
caaatttctaacgtagatatgttagaaaataaaaacaatcaactttgtttaataatcagaaagttctgatgcccacgtttggagcaatttgaaatgcttgcttgaatcttcacagaaacgtgaggatactaactttctttaactagcttctttacctgggactatcactaggcttcaatgagtccatgaagccctgggattgcatgcaaaatttctgttttatgcatttttctgggaaaattagtacaagctatcatcagatactcaaataatgttaacagtgactgctagagaacagaaktcaaagccctaaactagaatcaaaaactgcgagagccctaaaggtcatccagactgacgtaccatcttgcaaatgagaaaaagaagtccgaggaagagggaaccacacaactactaagttgatgcaaaattaattgccggtttgtttgtgtttttgtttctgtttgagaccaagtcttgctctgtcacccaggctggagtgcagtagcactatcttggctcactgcaacctccgcctcccaggttcaagcgattctcctgcctcagcctcccgagtagctgggattacaggcacccacca

SEQ ID NO: 41893 - DNA, 601 bp, Human
ttactcccttcccctgttcatcttccgacagagtgtaaatgtaaagcagcgggcctgtgaaataattcaaaggcaatggaccaggggcatggttacaaatctctgccactggcactgtgacttatgcaggcagtttgtcacacatgagccaggtgacctcagtgacataacagagaaaaatatcgccagagatcaaagatgggattcggagcactctaagtaactctgctccatagagtgagcaggttatatggtatccaaggatttccccttatatcaataacatttgttctggtgaaayagaaaaggtagcccagagactccctaattgaaatcatttctgtcaagtagaattggggccatttctgtaacatgaggattagaatttctgttttcttgatcatgccttatagttgctatgaatgccaggaataggcaacataaatccatctaattcaactttaatacagagaaattaatagaaattgaaaaacataaaagtgagtccatgaagaatttgtcagcctgagtacttaaaagctattattgtaaaggtaaaaggaaagttttactatcgcttataaatttgctaggtcaaaga

SEQ ID NO: 41894 - DNA, 601 bp, Human
tgaacagaagtgtctttcattccccacttgcctcacggttcaaaaggaactactaaaatagcagcaaaaaaatccaacagcctgccagtgggcttgcaccggtcccattcctaaaggcatgcaaaaggttggagagctcagcaaaatttttatgtatgggagcaggcccaaggaaaactcacacgccataaccaattgtggacagaggatcatctatcagcagacaaatgcaggaactccagaatgtctctcctcaaatgaaataatatatctttgaaagccaatgcccgttttaggcccsaggcccatatatcaagcctgagaggcttgtggaatcgctccagggccattaaccttccacctgtttccccttgtccttcaggatgagaccctgcccttgattttactcccttcccctgttcatcttccgacagagtgtaaatgtaaagcagcgggcctgtgaaataattcaaaggcaatggaccaggggcatggttacaaatctctgccactggcactgtgacttatgcaggcagtttgtcacacatgagccaggtgacctcagtgacataacagagaaaaatatcgccagagatcaaag

SEQ ID NO: 41895 - DNA, 601 bp, Human
tgcctgatggttcttgttaggcaaattaatcatggatctctgtgtaaagcacctttttccaactgtctgttctccttctttctccaaatcacctcaaactttttggaaataataaagaaaaatagagtaagccatttgctaaaagcctggggagtgcaaaacagtaataaagtcaaaagctatttgatagtatctagcttttatgtaagcaactttttgaaacccaaatgactaaattttggactgagcctgtcttcccaaaatgacacatatgtttgattcctaacatccctttcaccatttttttttttataacaaggccacccttatcaagtcatgtatgaatgaacagaagtgtctttcattccccacttgcctcacggttcaaaaggaactactaaaatagcagcaaaaaaatccaacagcctgccagtgggcttgcaccggtcccattcctaaaggcatgcaaaaggttggagagctcagcaaaatttttatgtatgggagcaggcccaaggaaaactcacacgccataaccaattgtggacagaggatcatctatcagcagacaaatgcaggaactccagaatgtctctcctca

SEQ ID NO: 41896 - DNA, 601 bp, Human
caattaccaggaactataaaatcaaagattttatatatatatatctcaaaccagagttaataattaaatttcaaaatactataaatcaaagcatattagaatccaaatattttcatgaatattaagtctatgaacattaagaggctgaggcaaatgatttttgcagtcttagactctatagtacaactttgagaggccacacaaggttaattcgggtgactggttccattaatctagtgaccagttctatttgattgtaacatttgagccattagacatatttcttggtagcattgcctgwtggttcttgttaggcaaattaatcatggatctctgtgtaaagcacctttttccaactgtctgttctccttctttctccaaatcacctcaaactttttggaaataataaagaaaaatagagtaagccatttgctaaaagcctggggagtgcaaaacagtaataaagtcaaaagctatttgatagtatctagcttttatgtaagcaactttttgaaacccaaatgactaaattttggactgagcctgtcttcccaaaatgacacatatgtttgattcctaacatccctttcaccattttttt

SEQ ID NO: 41897 - DNA, 601 bp, Human
aaactactttacattgttgatagtttgatatctgtaacccattgtcttgcttaaccttactattagaaatatgagttctgaaaaacttccatagaaaaactgtgacatttttatctttaaataaagataagtgttatgatttttaaaaatcagaatttcagtccaaaatcttctagactgaaaaactcagagacatatagccttagtttcttagggtatatgttggaagggtcatcttagttccagaaaaaaaattaaatgcttttcaggtaggttgcatgcctttttaggttaaaaacaytaataaatatgtaagacctttgtagatgcacagcaggtgttttgagggctttacactgaaaagctgacaactaattataaaagcctgactggactaatcaattattcagatcaacattagatgcctattatatacagaaacatgggaattatatctcccttaattaatatactaaaatcatgagtttaaaacattctaatgtgaaatgtgaagacatataagtcttaatactaagactcattccaaataataagtatttgtaatttgttgcctctcattcaagaattaaattcctattga

SEQ ID NO: 41898 - DNA, 601 bp, Human
tgaagtctcaaaactactttacattgttgatagtttgatatctgtaacccattgtcttgcttaaccttactattagaaatatgagttctgaaaaacttccatagaaaaactgtgacatttttatctttaaataaagataagtgttatgatttttaaaaatcagaatttcagtccaaaatcttctagactgaaaaactcagagacatatagccttagtttcttagggtatatgttggaagggtcatcttagttccagaaaaaaaattaaatgcttttcaggtaggttgcatgcctttttagrttaaaaacactaataaatatgtaagacctttgtagatgcacagcaggtgttttgagggctttacactgaaaagctgacaactaattataaaagcctgactggactaatcaattattcagatcaacattagatgcctattatatacagaaacatgggaattatatctcccttaattaatatactaaaatcatgagtttaaaacattctaatgtgaaatgtgaagacatataagtcttaatactaagactcattccaaataataagtatttgtaatttgttgcctctcattcaagaattaaa

SEQ ID NO: 41899 - DNA, 601 bp, Human
atttttcttcttctgtgactaccacatttgtaggtaaacccagaaaaataaaattgcttatacaataatgacagtgaagtctcaaaactactttacattgttgatagtttgatatctgtaacccattgtcttgcttaaccttactattagaaatatgagttctgaaaaacttccatagaaaaactgtgacatttttatctttaaataaagataagtgttatgatttttaaaaatcagaatttcagtccaaaatcttctagactgaaaaactcagagacatatagccttagtttcttagggyatatgttggaagggtcatcttagttccagaaaaaaaattaaatgcttttcaggtaggttgcatgcctttttaggttaaaaacactaataaatatgtaagacctttgtagatgcacagcaggtgttttgagggctttacactgaaaagctgacaactaattataaaagcctgactggactaatcaattattcagatcaacattagatgcctattatatacagaaacatgggaattatatctcccttaattaatatactaaaatcatgagtttaaaacattctaatgtgaaatgtgaagaca

SEQ ID NO: 41900 - DNA, 601 bp, Human
aggcttaaacagaaagagagcagaaacattccattgctaagattaggctagcttgccagattataagtgctttttaattacatgagtgcaattgtcttaaataaatgctcttagtcactaaaatagatataaatatgatcctcaaaagcagggatttttgtctatgctcttcatgttgaatctataagtcctataatgttacctggcatacaactaatacttgataagtatttactgaatgaaagaaggaatcttaagaatatctgacctaccctatggtatttaaactgtactttattattattattattattattattattattattattattattttgagatggagtttcgctcttgttgcccaggctggaatgcaatggtgtaatctcagctcactgcaacctccacctcccaggttcaagcgattctcctgcctcagcctcccaagtagctgggattacaggcatgagccaccatgcccggctaatgttgtattttagtagagacggggtttctccatgtttgtcatgctggtcttgaactcccggcctcaggtgatccacccgcctcagcctcccaaagtgttggagttacaggc

SEQ ID NO: 41901 - DNA, 601 bp, Human
gaatacaattaagataatccctgagcatatgtgggaaatgtacttgaactcaccatatgccagttgggaaaactggtatgatctcctgaaggcttaaacagaaagagagcagaaacattccattgctaagattaggctagcttgccagattataagtgctttttaattacatgagtgcaattgtcttaaataaatgctcttagtcactaaaatagatataaatatgatcctcaaaagcagggatttttgtctatgctcttcatgttgaatctataagtcctataatgttacctggcatacractaatacttgataagtatttactgaatgaaagaaggaatcttaagaatatctgacctaccctatggtatttaaactgtactttattattattattattattattattattattattattattattttgagatggagtttcgctcttgttgcccaggctggaatgcaatggtgtaatctcagctcactgcaacctccacctcccaggttcaagcgattctcctgcctcagcctcccaagtagctgggattacaggcatgagccaccatgcccggctaatgttgtattttagtagagacgg

SEQ ID NO: 41902 - DNA, 601 bp, Human
ttttcccttgattccaagcttcagaaaggaatacaattaagataatccctgagcatatgtgggaaatgtacttgaactcaccatatgccagttgggaaaactggtatgatctcctgaaggcttaaacagaaagagagcagaaacattccattgctaagattaggctagcttgccagattataagtgctttttaattacatgagtgcaattgtcttaaataaatgctcttagtcactaaaatagatataaatatgatcctcaaaagcagggatttttgtctatgctcttcatgttgaatctmtaagtcctataatgttacctggcatacaactaatacttgataagtatttactgaatgaaagaaggaatcttaagaatatctgacctaccctatggtatttaaactgtactttattattattattattattattattattattattattattattttgagatggagtttcgctcttgttgcccaggctggaatgcaatggtgtaatctcagctcactgcaacctccacctcccaggttcaagcgattctcctgcctcagcctcccaagtagctgggattacaggcatgagccaccatgccc

SEQ ID NO: 41903 - DNA, 601 bp, Human
aaaatgcatgataaaacttgttattcattacgaataatggcagatctatgagatttacatgggtaagagctttgtgagtttatctgaaagcatacataatgggtctcatttagctgtaatatggaaaatattattcttagagattctagtaagtgtgaaaatccattgtttattcagatgatttacacccttctctgtgatcagttcacctatataaagttactaactataaatctacctttaaaaaactattatttttccctaaatcattattgttctttttttcccttgattccaagcytcagaaaggaatacaattaagataatccctgagcatatgtgggaaatgtacttgaactcaccatatgccagttgggaaaactggtatgatctcctgaaggcttaaacagaaagagagcagaaacattccattgctaagattaggctagcttgccagattataagtgctttttaattacatgagtgcaattgtcttaaataaatgctcttagtcactaaaatagatataaatatgatcctcaaaagcagggatttttgtctatgctcttcatgttgaatctataagtcctataatgttacc

SEQ ID NO: 41904 - DNA, 601 bp, Human
gaaaatgagcaccacacagacttaaaaaaattgtctcctagcatcctatataagtatagagatatcaaatgcacatagatcaacacatttgttagtttgaagataaattgtgtcggtcttttgcagatgtttcttatctactgagtttctgaaatgtaatttttgttttggaaatgctgagatatatgttcaggaacagcattcgaacacattccccacaaaaatcgcattgggattcacagttttgtacatgtgtatccccctctttaagggtagagaccatttctttcttttcttttctttttttttttttttgagataggtcttcattctgttgtgctctagacaccatctctaatccatctctctgtatccagatattctagcacactgcactctacaaatatttaattttttagataaccacgtaagttatacattacccctatttttagagaaggacagtgaagttacatgctgagcttatgggaagcaaatggaaggggatttgaagccaagtgtgactccaaggcctgcctaatttccacatcaggaggcttctatggtgatgataagagggaagtaactgtatagccagtgc

SEQ ID NO: 41905 - DNA, 601 bp, Human
agtgagccaagatcacaccaccgtactccagcatgggagacagagtgagactccgtctcaaaaaaaaagggaaataaagtggatggagagtacaagtaggagaattacaaaagaagggacctgacaaactccatgaggaaagatggctattgaactgaaaggacaaacttaaacctttcttgagaataagctttaagaggaagggtgtgtgtgtgtgtgtgtgtgttggtgaagaagggtgtatgtgttgaagggagagggacatttgtggatgtatgaatattggaagaggaagagtatscatgggctgcaacaaggcagataaaggtcaaagctgaaaggcagaaaccacctgaataaagacccttcagctactttagaaactaaaatttgtctacccgatattgtccccaattttttatttttatttttgaggagtctcattctatatcccaggctggagtgcagtggcaccatctcggctcatggcaacctccacctcccaggttcaagtgattttcctgcctcagcctcctgagtagctgggattacaggcatgtgtcaccattcccagctaatttttgtatttttagtagagaag

SEQ ID NO: 41906 - DNA, 601 bp, Human
cttgtcaggagtgtgcagaggctacaggatgtaatgacatcatcactctggtgacaaatggaatgtgtatttgtggatgcttgatttgtaaccatatctctgtttttaactcccaatacattatataaactaaaggtctccatagtcctcattttcagaagtgcaaagcgtcctgagaccaaaaggtgtgggaactactgctttaaatcaacacaagtcatttgcatataatcataaatgaatttctgacaagttaaaaattttgtggtgtaactaccaaattcaaaactctgtgctagartttgtgagaggaaacagtgacaagaaagaggttggaaagagttgagggggtagacatataactaacagaaaccaggctaggagtgagtgtgcaattgcgatcatcttacatcccatcccagattttgccagatagtccccatttcaaatagtccccatttcaaatagtccccatgtcaaatacgtccaggcctacatttagactagtcaaatcaatggctttgagtttggcaggtgagacgagatggagaggaagacagtgatgatgagatacctggttgaggaattctaattttttctg

SEQ ID NO: 41907 - DNA, 601 bp, Human
gtacgtgaatgtgagtgtgtgttagggagggggcagaggctgacactcagggaaacctgtgtctgtttgtcagttacctagagacatctgtgctgtcctcaaactggccctggtctcactgatgccccctacctccaggagtacagtctcacagccactgggagagaaatcccaggacactgagaagggtttttgttcccctggatgtccctgatcttacttactgatttgaaaattcaaggttggaaaatgtattcatttggcatcaatctttaatcccaatgaaagagtagacacccayaggagtgataatatttaaatcagtggctttacgagtatggtccagggagtcaagaggttacaactatttttccaattacaccaagatgttatttgcccttttcaccctccacttgtcaggagtgtgcagaggctacaggatgtaatgacatcatcactctggtgacaaatggaatgtgtatttgtggatgcttgatttgtaaccatatctctgtttttaactcccaatacattatataaactaaaggtctccatagtcctcattttcagaagtgcaaagcgtcctgagaccaaaaggtgt

SEQ ID NO: 41908 - DNA, 601 bp, Human
ggaatttccatcgcactccagggtgatttattgtgtacgtgaatgtgagtgtgtgttagggagggggcagaggctgacactcagggaaacctgtgtctgtttgtcagttacctagagacatctgtgctgtcctcaaactggccctggtctcactgatgccccctacctccaggagtacagtctcacagccactgggagagaaatcccaggacactgagaagggtttttgttcccctggatgtccctgatcttacttactgatttgaaaattcaaggttggaaaatgtattcatttggcatyaatctttaatcccaatgaaagagtagacacccataggagtgataatatttaaatcagtggctttacgagtatggtccagggagtcaagaggttacaactatttttccaattacaccaagatgttatttgcccttttcaccctccacttgtcaggagtgtgcagaggctacaggatgtaatgacatcatcactctggtgacaaatggaatgtgtatttgtggatgcttgatttgtaaccatatctctgtttttaactcccaatacattatataaactaaaggtctccatagtcctcatttt

SEQ ID NO: 41909 - DNA, 601 bp, Human
aggctgaggcgagtggatcacgaggtcaggagatcaagaccatcctcaccaacatggtgaaacccgatctctattaaaaatacaaaaattagctgggcatggtagtgtacacctgtagtcccagctactcaggaggctgaggcaggagaatcgcttgaacctgggaggtagaggttgcagtgagccgagatcacgccactgcactcccacctgggtgacagagcaagactctgtctcaaaaaaaaaaaaaaaaaaagaaagagagcaaagggtaaggaggtgcaaaatcagacaggtctgrtacagaaacaggctccaccagtggccagcagatcagtgtgaactcgggcaaataactaaaccccctgagctttagtttattctggctgcagtcaaattctaattaatattgaccctccccactccccttgttgtaagggtttagtgagctaataaatgaatagaacttaaggcttgagctcaataaatagtagtcactgttagagtgcatcactcttctataaaagtcagtctagtccctaaccctagcttgatcaaatattacaaagcaaataataatttaatgcaaatactggagttg

SEQ ID NO: 41910 - DNA, 601 bp, Human
gcataaatgcaaactttcaaagtaaagcatattcttttaagaagcgggctttttgttttttactaaaggtgttgaatatgtgtctatgcaggaaaccctactaatggcttcacttaattctctcaaaaaagttcagagagatacaactgtgctcaagatccatgtttctcaaacttgaacacacttagagttcacctgggggtcctgttaaaatacacagtgatccagcagttcgggggactgtgattctacatgtctaacaagctgactaatgaaaccaatgctggtggttcatgtaccrcactttgaataaaaagctctagaaaattctagcaaaccaatgctccccactccacatgtgcacatcagtcctccacacacactcacacaccaaaatgttagacacaggaatatgggatgagaacaataactaagatggcaaagggggccaggtgcagtggctcacgcctgtaatcccagcacttcgggaggctgaggcgagtggatcacgaggtcaggagatcaagaccatcctcaccaacatggtgaaacccgatctctattaaaaatacaaaaattagctgggcatggtagtgtacac

SEQ ID NO: 41911 - DNA, 601 bp, Human
accagaaaccaaaagggccacccaaatgaggatgtaaaaacatccaccttttgccctggatggcaccccagctagaattctcaggcccagaaagctatctatctctctccattcacacgtgagctaaccagttcacggagggaagcgccaatgagctatcagatcaatatggtgaagtatggagattgatttcatcccggagtaagtgcattaacgagctcctctgtgtgacctttgcctagtggtacaaattagactccaccgcagaccacatacttaaatgggatccttcagtatttgytcgcttttaataaagcacactacagacagacctcaaagatgactacaaaaacttatagtgcgtctttttatacagggaaggaggtcttgtagagttactatattatgtctgaaattatatagcattaaatagacaagatagcataaatgcaaactttcaaagtaaagcatattcttttaagaagcgggctttttgttttttactaaaggtgttgaatatgtgtctatgcaggaaaccctactaatggcttcacttaattctctcaaaaaagttcagagagatacaactgtgctcaagatc

SEQ ID NO: 41912 - DNA, 601 bp, Human
cccagcactttgggaggctgagatgggtggatcacaaggtcaggtgttcaagaccagcctgaccaacatggtgaaatccctaaaactacaagtctaattgtactaaaaatacaaaatacaaaaattagctgggtgtggtggcatgtgcctgtaatcccagctactcaggaggctgaggcaggagaatcgcttgaacctgggaggcggaggttgcagtgagccaagattgtgccactgcactccagcctgggcgagagagtgagactccatctcaaaaaaaaaaaaaaaaaaaaaaaaaaargacctgtcttttagtaatatcaatgttacactttaaagcaagtcatctgcctgtattcagataaatgtgatccatacttttgagcacacatgattcataaaaactacagaagaaaaagaataaacccatggtagaaaagcaacttatttattttaaaaccttttttttttctgactaactgatataccagcacaagagcctaacaccagaaaccaaaagggccacccaaatgaggatgtaaaaacatccaccttttgccctggatggcaccccagctagaattctcaggcccagaaagct

SEQ ID NO: 41913 - DNA, 601 bp, Human
attcatagtttctctggaaaaccgtgtctcaaagttagaagggatctgagtctgcttttatccagtttgcatctggaatctatacatcttttaaaaattggaaatatttggcttgttggcttgtttctacctcatttctagaattattttggcccatttcttcaaggaattagtacccatgtgtgtgttttatgagccggattcaccaagccctacttccttggtgtttctgcaattaaatgaccacatatatacatcaatagcattgagttttgacaaaaaggaacataggggagactcytgagtcctgaagattgcactgagcaggttatcttttcattaagaaatgacctatgttggccgggtgtggtggctcatgcctgtaatcccagcactttgggaggctgagatgggtggatcacaaggtcaggtgttcaagaccagcctgaccaacatggtgaaatccctaaaactacaagtctaattgtactaaaaatacaaaatacaaaaattagctgggtgtggtggcatgtgcctgtaatcccagctactcaggaggctgaggcaggagaatcgcttgaacctgggaggcggaggttgc

SEQ ID NO: 41914 - DNA, 601 bp, Human
gcattgtgcttagattggaagagattcaaggatgaaccggaaacacttttcaacgagcttgtaaccaagcgtaatgaaaatatcaagtcttggcggctttggaggctgctgttttctcaatattcatagtttctctggaaaaccgtgtctcaaagttagaagggatctgagtctgcttttatccagtttgcatctggaatctatacatcttttaaaaattggaaatatttggcttgttggcttgtttctacctcatttctagaattattttggcccatttcttcaaggaattagtacccaygtgtgtgttttatgagccggattcaccaagccctacttccttggtgtttctgcaattaaatgaccacatatatacatcaatagcattgagttttgacaaaaaggaacataggggagactcctgagtcctgaagattgcactgagcaggttatcttttcattaagaaatgacctatgttggccgggtgtggtggctcatgcctgtaatcccagcactttgggaggctgagatgggtggatcacaaggtcaggtgttcaagaccagcctgaccaacatggtgaaatccctaaaactacaagt

SEQ ID NO: 41915 - DNA, 601 bp, Human
ggccaggcacagtggctcacgcctgtaatctcagcactttgggaggctgacataggtagatcacctgaggtcaggagttcaagaccagcctggccaacatggtgaaaccccatctctattcaaaatacaaaaattagtcaggcatggtggcgcacacctgtagtcctggctactcaggaggctgaggcaggagaatcacttgaaccccagaggcagaggttgccatgagctaagatagtgcactccagcctgggtgacagactccacctcaaaaacaaacaaacaaacaaacaaaataaarcagcattgtggtatgggtgtagattgataactagaataacaaaaatgcagtaacatgagaataaattttcaaaattagtctgtcacatgtccttgtcttaatgatgttggccattacacacaagttagagaaccaaagcattttcaggcccatctagtagtacttttcctattatttctttatgtctcattagacttttcactgccaaaaaattttttaaaaaatattacttgctggccgggcgcgggggctcacacctgtaatcccagcactttgggaggccaaggcgggcagatcaca

SEQ ID NO: 41916 - DNA, 601 bp, Human
gatagcctttcctttactcactgttaataatctctacaactattgggtttatatctgaatataatgatgaaagatagcatatcaagatctgtaagaagttatgcatagcacagccatcctgatatacaaaatataagttccccaaaggtggctgagaagtgaaagataaagtattgaatttctttttcccaattattctcatcataaaatgggagaaatactctttgtattaaaggaatgcatttctaacagaggtgagtgacgaagggagttcttttgtctcccttgtaagaagggagaragacagaactgtatcccttcccattgcctttggatttcacacagtaggaataatattctggagaggaggagtggcaataaaaagaaaaaaagaagaaataatattctgacaaaggtttattttaaaaaaagaaataatacccaatttaagtgttgatcttgtgtgtgttttatttgaaatatgaatcacagagaaaatgggtttgatatttatagaaagaaatcgtttacattttccatgagcatgcactgttctttgagggaaagcatttttcagagaaagaagaattgtgtttctaga

SEQ ID NO: 41917 - DNA, 601 bp, Human
catttacaacattgtaaggcacaagttttgacaaatattttagtttccttgtcctggccagttaaacaggggaaaacattctacacaagctgcaaggtaatgattttgaaatcagaatcacattagctagatttttagcaaaaccacacctagctcttttgcactgtctgaagagggtgtgtcttatggcatatttcttattacctctactttcatattcttcctattctagattaaaggagaagaatatgcaggctatgatactatactgcctttcccattcccacccaacatacacacygcctacacactcccttcctaagacgtcagcattgccctgttgaatctgtccccatgaggcaaggactctgtaggtcagtcccaagacaatccctttatgtcttccatatttctagatagcctttcctttactcactgttaataatctctacaactattgggtttatatctgaatataatgatgaaagatagcatatcaagatctgtaagaagttatgcatagcacagccatcctgatatacaaaatataagttccccaaaggtggctgagaagtgaaagataaagtattgaatttctttt

SEQ ID NO: 41918 - DNA, 601 bp, Human
gcgccactgcactccagcccgggcgacagagcaagattccatctcaaaaaataaaataaaataaaagaattccaggtgtgcagcagacccatcatctggatatcagtgattatggcataaattaaggaagattttggttgccctccagcttgtaaaatagatgcacaatgaaggtccttggcatagtagggttaagaagaaagggagaaggtgagggatattccagagggcatgctccgtggctcccttgaggtcatttaatgcaacttcttccttcataggttgctttacaaagccaggaaaaaaaaaaaaggcttatagaggctaaaatgtccttgggtcctttttggctggctgcttccatcaggcagttggccaaagaaaggagaaaagaattcgagtggcctaaatattactcaccaaaagtacaaccgaaattagggcagaggtaaaggagaggtccctaaggactgttcagtgatgggaattctctgggtacaaaggctcctgggagaattcctctgctcagttccccagggacaagtagaggacttgtcccttcacacaatttaaatgtccccttaatgtcacagtgctaagt

SEQ ID NO: 41919 - DNA, 601 bp, Human
caaaaattagccgggcatggtggcacgtgcctgtagtcccagctatttgggaggctgaggcaggagaatcacttgaacctgggaggcagaggttgcagtgagctgagatagcgccactgcactccagcccgggcgacagagcaagattccatctcaaaaaataaaataaaataaaagaattccaggtgtgcagcagacccatcatctggatatcagtgattatggcataaattaaggaagattttggttgccctccagcttgtaaaatagatgcacaatgaaggtccttggcatagtaggrttaagaagaaagggagaaggtgagggatattccagagggcatgctccgtggctcccttgaggtcatttaatgcaacttcttccttcataggttgctttacaaagccaggaaaaaaaaaaaaggcttatagaggctaaaatgtccttgggtcctttttggctggctgcttccatcaggcagttggccaaagaaaggagaaaagaattcgagtggcctaaatattactcaccaaaagtacaaccgaaattagggcagaggtaaaggagaggtccctaaggactgttcagtgatgggaattct

SEQ ID NO: 41920 - DNA, 601 bp, Human
cacgaggtcaggagatcaggatcatcctggctaacacggtgaaactccgtctctactaaaaatacaaaaattagccgggcatggtggcacgtgcctgtagtcccagctatttgggaggctgaggcaggagaatcacttgaacctgggaggcagaggttgcagtgagctgagatagcgccactgcactccagcccgggcgacagagcaagattccatctcaaaaaataaaataaaataaaagaattccaggtgtgcagcagacccatcatctggatatcagtgattatggcataaattaagraagattttggttgccctccagcttgtaaaatagatgcacaatgaaggtccttggcatagtagggttaagaagaaagggagaaggtgagggatattccagagggcatgctccgtggctcccttgaggtcatttaatgcaacttcttccttcataggttgctttacaaagccaggaaaaaaaaaaaaggcttatagaggctaaaatgtccttgggtcctttttggctggctgcttccatcaggcagttggccaaagaaaggagaaaagaattcgagtggcctaaatattactcaccaaaagt

SEQ ID NO: 41921 - DNA, 601 bp, Human
aggcgcggtggctcatgcctgtaatctcagcactttgggaggccgaggtgggtggatcacgaggtcaggagatcaggatcatcctggctaacacggtgaaactccgtctctactaaaaatacaaaaattagccgggcatggtggcacgtgcctgtagtcccagctatttgggaggctgaggcaggagaatcacttgaacctgggaggcagaggttgcagtgagctgagatagcgccactgcactccagcccgggcgacagagcaagattccatctcaaaaaataaaataaaataaaagaawtccaggtgtgcagcagacccatcatctggatatcagtgattatggcataaattaaggaagattttggttgccctccagcttgtaaaatagatgcacaatgaaggtccttggcatagtagggttaagaagaaagggagaaggtgagggatattccagagggcatgctccgtggctcccttgaggtcatttaatgcaacttcttccttcataggttgctttacaaagccaggaaaaaaaaaaaaggcttatagaggctaaaatgtccttgggtcctttttggctggctgcttccatcaggca

SEQ ID NO: 41922 - DNA, 601 bp, Human
atcctgttaaaaatacttaaactgaaatccaaataaataaataaataaataaaggcaaaatatgaaagatgctaaatgaagtacgaaggaaaatatttcaggtgatgcaaaatgttcatgaactagaaaagaaatattttaaagtagattaatgagaaatattttccagtgccttctctttctgggtattgtttcatttatgaccactacctgtttcctgttctccagtttagaaatctcttatgtataattaaagcaatgttctcacatgtctaacctggcagacaatattcaagtaatraaaacagaatccttctcagcttgatatattttcctctgggttgcttggaatgtcaagaaggcagttgtgaatatgatggtcatttttctaatagcataatgaggttatgtttgtaattctcattttccagacaccgccttaaaggcaacaatgccatcagccaaaaaagaattccaggtgtggccaggcgcggtggctcatgcctgtaatctcagcactttgggaggccgaggtgggtggatcacgaggtcaggagatcaggatcatcctggctaacacggtgaaactccgtctctacta

SEQ ID NO: 41923 - DNA, 601 bp, Human
caccacatagcagacatcctgttaaaaatacttaaactgaaatccaaataaataaataaataaataaaggcaaaatatgaaagatgctaaatgaagtacgaaggaaaatatttcaggtgatgcaaaatgttcatgaactagaaaagaaatattttaaagtagattaatgagaaatattttccagtgccttctctttctgggtattgtttcatttatgaccactacctgtttcctgttctccagtttagaaatctcttatgtataattaaagcaatgttctcacatgtctaacctggcagayaatattcaagtaatgaaaacagaatccttctcagcttgatatattttcctctgggttgcttggaatgtcaagaaggcagttgtgaatatgatggtcatttttctaatagcataatgaggttatgtttgtaattctcattttccagacaccgccttaaaggcaacaatgccatcagccaaaaaagaattccaggtgtggccaggcgcggtggctcatgcctgtaatctcagcactttgggaggccgaggtgggtggatcacgaggtcaggagatcaggatcatcctggctaacacggtgaa

SEQ ID NO: 41924 - DNA, 601 bp, Human
gacagaaagcaaaacaggctggtcctctgcttcttgaacagctcaatccagagtcactcagtacaggaagtcagaggcctagacttcaggaaccgctaaagaaaccactctgtaacctagggtccaacagtgagcattcacaaccatgacaagtcattgggaacaggcttatcaaatcctctgtttaaaaagtcatggaatggtgcgatttgtattagagagtctttatcaaaaattttaaaaattctttcaaagtgcaatgtttccaaagttaagtttcattcatccagaacatccatcygcatggtatacacgatatacctagtccccagggatgttaaatgtaacactactttatataaagatatgctagtgtcacttattaaatgtcaggtttttcatttatataactgtgaggtaattacataagtgagtgacatctttgaggtttacagtattgtatgtaaatgttaaacagcactgtgaagaaacatataatcaccagggtatataatgtaacttagtctgcttcttttgcatagaattatagctacattctcagaatttatcaaaccaaaggacaaagtttggccagctttta

SEQ ID NO: 41925 - DNA, 601 bp, Human
agtgaacgagtagcacagcagttgggaaatgaacatgatagctgtcagcagaaggggtagacagaaagcaaaacaggctggtcctctgcttcttgaacagctcaatccagagtcactcagtacaggaagtcagaggcctagacttcaggaaccgctaaagaaaccactctgtaacctagggtccaacagtgagcattcacaaccatgacaagtcattgggaacaggcttatcaaatcctctgtttaaaaagtcatggaatggtgcgatttgtattagagagtctttatcaaaaattttaamaattctttcaaagtgcaatgtttccaaagttaagtttcattcatccagaacatccatccgcatggtatacacgatatacctagtccccagggatgttaaatgtaacactactttatataaagatatgctagtgtcacttattaaatgtcaggtttttcatttatataactgtgaggtaattacataagtgagtgacatctttgaggtttacagtattgtatgtaaatgttaaacagcactgtgaagaaacatataatcaccagggtatataatgtaacttagtctgcttcttttgcatag

SEQ ID NO: 41926 - DNA, 601 bp, Human
taatacaaagtcctatctatcaacacttccttggataactgagctatgctggcccctttccatgtttctccaatgcagcacaaaggacctccccctaacctccttttgccagatctggactctctcttttctattcccaccaaaccccagttttcattcatttcatctcccatgtacgtcacgcccaatagtcccccagaatctggacctacaccatctccatacttctccctcttgttctgttttatcatatacagttactacaactatctgttttggtcacactgttcctttggacaaycacctcttccaaattccctagacttctcttcgaaaatcttcactaaaccagatctccctaatcagtatatgctgggaatagattatccgtatgcctccttctcctctagcctaggttggcctgcagcagccagaaactgagggcagttgcctcagactgcgagcaacccgctttgttgatactgctgtgacatgtaaatattattttttaaatatgagccatataatgaaaaagatggagaagtttttctttaaatgtcctttcccatgtcaacttcagctcttattacatcctagttct

SEQ ID NO: 41927 - DNA, 601 bp, Human
gaccatgccactgcactcagtctgcgcaacagagcaaaaccctgtctcaaaaaagtaaaaaaaggccaggcatggtggttcacgcctgtaatgccagcattttgggaggccgaggcaggcagactacttgaggtcaggaattcgagaccagcctggccaacatggtgaaattccatctctactaaaaatacaaaaattagccagacatagtggcacgtgcctgtaattccagctactcgggaggctgagacaggagaattgcttgaacccggaaggcggaggttgcagtgagccgagatcrcgccactgcgctccagcctgggtgacggagtgagactctgtctcaaaaaaaataaatagaaaaggaaagaaaatgattttgaagatgcttcagaatcattacaaattaagtccagctattattccttctttttttctttctggcaaaaagaaaaaaaaatccctaaagatgaatttccatctctttttgtaacaatgatgacatttatagaagtttgttctgaagaggggagagaaaaattaaaacccaaacaaatcaaaatcaacttaccatatcttaatgagaacctgctctgggcag

SEQ ID NO: 41928 - DNA, 601 bp, Human
tccaggaattcaagaccaacctgggcaacatagtaagatcctatctctacaaaaaaataaaataaaaagccaggcatggtggcacacgcatatggttcaagctactcaggaggctgaggctggaggatcacttgagcccagcaggtaaagattgcagtaagccatgaccatgccactgcactcagtctgcgcaacagagcaaaaccctgtctcaaaaaagtaaaaaaaggccaggcatggtggttcacgcctgtaatgccagcattttgggaggccgaggcaggcagactacttgaggtcrggaattcgagaccagcctggccaacatggtgaaattccatctctactaaaaatacaaaaattagccagacatagtggcacgtgcctgtaattccagctactcgggaggctgagacaggagaattgcttgaacccggaaggcggaggttgcagtgagccgagatcacgccactgcgctccagcctgggtgacggagtgagactctgtctcaaaaaaaataaatagaaaaggaaagaaaatgattttgaagatgcttcagaatcattacaaattaagtccagctattattccttcttttttt

SEQ ID NO: 41929 - DNA, 601 bp, Human
tgaatctggccaacaattagaagaaaaatgtgtagatctttgtcaagcccacatttagcctatcaaaacctttttgcggccccctcccatttcccttttaatagtccagcaagtgagctgttattttactttccttattgcagaggctttttaaaattgacgtcatagatccttgacctcctgggctcaagcaattctcccatctcagcctcttgagtagctaggaccaccagaactcaccaccatgccggctaattttttttcttttttgtagagacgagttctcactatgttgcccagmctggttttgaactcctagactcaaggtatcctcctgccttggtgttccaaagtgctgggactatgggtatgacccccggagcctggccagtgattaaactttaagaaagagatttttaaagaaaacattctacaatatggactggtagttttaagtagatatgaactaatttcttatttctgatcgttaattttggtgtgtcaggtcttgtgttagaaacttgagggaaaacagattattaaaatacaatccctgccttcatgaaactcacactccaatgagaggagacagaagtgtgaa

SEQ ID NO: 41930 - DNA, 601 bp, Human
ccgggcatggtggctcacgcctgtaatcccagcactttgggaggccaaggcaggcagatcacaaggtcaggagttcgagaccagcctggccaacatagtgaaaccccgtctctactaaaaatacaaaaaattaggtgggcatggtggcgggtgcctgtaatcccagctatttaggaggctgaggcaggagaatcactggaacccaggaggcagaggttgcaatgagccgagatggcaccactgccctccagcctgggccacacagcaagactctgtctcaaaaaaaaaaaaaaaaacagargagtgaatctggccaacaattagaagaaaaatgtgtagatctttgtcaagcccacatttagcctatcaaaacctttttgcggccccctcccatttcccttttaatagtccagcaagtgagctgttattttactttccttattgcagaggctttttaaaattgacgtcatagatccttgacctcctgggctcaagcaattctcccatctcagcctcttgagtagctaggaccaccagaactcaccaccatgccggctaattttttttcttttttgtagagacgagttctcactatgttgcc

SEQ ID NO: 41931 - DNA, 601 bp, Human
taggccgggcatggtggctcacgcctgtaatcccagcactttgggaggccaaggcaggcagatcacaaggtcaggagttcgagaccagcctggccaacatagtgaaaccccgtctctactaaaaatacaaaaaattaggtgggcatggtggcgggtgcctgtaatcccagctatttaggaggctgaggcaggagaatcactggaacccaggaggcagaggttgcaatgagccgagatggcaccactgccctccagcctgggccacacagcaagactctgtctcaaaaaaaaaaaaaaaaacagaggagtgaatctggccaacaattagaagaaaaatgtgtagatctttgtcaagcccacatttagcctatcaaaacctttttgcggccccctcccatttcccttttaatagtccagcaagtgagctgttattttactttccttattgcagaggctttttaaaattgacgtcatagatccttgacctcctgggctcaagcaattctcccatctcagcctcttgagtagctaggaccaccagaactcaccaccatgccggctaattttttttcttttttgtagagacgagttctcactatgt

SEQ ID NO: 41932 - DNA, 601 bp, Human
gacttgactgattgttaattttaacacccaacgccgcccccgccactcgagcaattgattccttgttttaatactctccgaggaggttttctatgccaacattccatttcattattttccataattgattatgtggtattttatattatcttgaaattggtgagtgtgcagcttcatggtgctttggataacatagtttttacgcagctctatgaataaaaaaaatagggtaaatgtgatgcctggcttgttcccttgttctcaacaattgagcaatgttgacaattttgaagattttttrttttttaagaaaaacagagttatgggggtgtgggtagaaaaaggaaggggagaaaaataatctacttcttttaagcaaattctccaggtattaatgctgtcaataaacaatttagagtggcatctaggcagttctgggaagaagaccaaagaagtttaagttccacattatatagcaaaacctctcactagtggttagcaataccacctcatataatcgtgtgttatcagctacaataaaaggaagggcttatctcagaaacctagttacttatcagagaaactatttatattgatatta

SEQ ID NO: 41933 - DNA, 601 bp, Human
agtattatgattgtttgcttattgttctgccttccctgagggcagggacggattctgaagctacagctcccaagtgtcttccctggtgcctggcaaaaaaaaaaaaagccacttaataaatgcttgctaaatgaaggaacaaatgactgaattactttcacttctgcagttttctgtgtatcttgtgcatctagcccacaacataagcaaacaactctttcattgtttgtttgtagaattaatgacaatctttacagggcagtgactacctcagcaacttgcatctgacccttctcacacatgccctgcaggtctgcacccacagctggcccttggtaaagacttgactgattgttaattttaacacccaacgccgcccccgccactcgagcaattgattccttgttttaatactctccgaggaggttttctatgccaacattccatttcattattttccataattgattatgtggtattttatattatcttgaaattggtgagtgtgcagcttcatggtgctttggataacatagtttttacgcagctctatgaataaaaaaaatagggtaaatgtgatgcctggcttgttcccttgttc

SEQ ID NO: 41934 - DNA, 601 bp, Human
accccgtctcttaaaaaactagccaggtctggtggcaggcgcctgtaatcccagctactcgggaggctgagacaggagaattgcttgaacccagagggcagaggttgcagtgagccgagatcgtgtcactgcacttcagcctgggtgacagaacaagactctgtctcaaaacaagcaaaaaacagtctgacttttcctagatttcttttcttttaggatgctgaggacacacttcaaaatctgcatatcctctgttcctctgcttctctaaaaattgcaggaataggtgaaattgagcctrtctgttttctgtaattagtacttcatttttgttttgtattctgtgctgttcacattatcctgtcttcctttgtgtctaacacggcatctcctataatctccctgctttcgcaaagtattatgattgtttgcttattgttctgccttccctgagggcagggacggattctgaagctacagctcccaagtgtcttccctggtgcctggcaaaaaaaaaaaaagccacttaataaatgcttgctaaatgaaggaacaaatgactgaattactttcacttctgcagttttctgtgtatcttgtg

SEQ ID NO: 41935 - DNA, 601 bp, Human
cattaagtaaatagctattgttgagagccaattctttggtggttataagtgccaggccctagcatataagggtggacaagataaacgcagtcactgcctttttgaaaatgattctggtgcgggagaatgttcacccaaacagtatttagtggtttagtggacagtgagagttcacatttttctttgaaggaaagtctccagaatggcatgtggttttacaatccaggtggtgggcagcagcttatgcagatctgcccaaatgttccctgccaacagctgacccaaggagctgtggcctaaygtcctagcaatatgcatgtcattgcatacacagcagattccaggaactgatcctctcaggtgctaaggagtgatttcaaagccaggtgtactttgctctctctgggttttattatattctcatacactatcagcatcttatttcagatttattagtctatgatggtaatttggttttgttatgttgttctgtgatgtgaagtattagttgtttatttagcacttatttcagggaagcccaaaatactttactttgaaattggctccccagaaacaattaccatacatgttaatgttgcat

SEQ ID NO: 41936 - DNA, 601 bp, Human; identical to SEQ ID NO: 28793

SEQ ID NO: 41937 - DNA, 601 bp, Human; identical to SEQ ID NO: 28794

SEQ ID NO: 41938 - DNA, 601 bp, Human; identical to SEQ ID NO: 28795

SEQ ID NO: 41939 - DNA, 601 bp, Human; identical to SEQ ID NO: 28796

SEQ ID NO: 41940 - DNA, 601 bp, Human; identical to SEQ ID NO: 28797

SEQ ID NO: 41941 - DNA, 601 bp, Human; identical to SEQ ID NO: 28798

SEQ ID NO: 41942 - DNA, 601 bp, Human; identical to SEQ ID NO: 28799

SEQ ID NO: 41943 - DNA, 601 bp, Human; identical to SEQ ID NO: 28800

SEQ ID NO: 41944 - DNA, 601 bp, Human; identical to SEQ ID NO: 28801

SEQ ID NO: 41945 - DNA, 601 bp, Human; identical to SEQ ID NO: 28802

SEQ ID NO: 41946 - DNA, 601 bp, Human; identical to SEQ ID NO: 28803

SEQ ID NO: 41947 - DNA, 601 bp, Human; identical to SEQ ID NO: 28804

SEQ ID NO: 41948 - DNA, 601 bp, Human
taagaacactgctatacttcctaattgtctagagaatgaaagccatggcacttacttcttcttgccactatagccccagtgccttcttcagtgctggacacatagtaagcactcaatgagtatgtgttgaatgcatctgtggctttcatgtccatgtccaggctcctgtctatgtctccagccacatctgctgcttccctcaagccgtatccatcaactaacagttccccaaactcattttgctctctcttgcctttaagctttcacactggtagtgcttctagcttggaacgctgcaccygcttgggaccacatcccaccttctctcaccaaatctatctggaaaacactgtttcatctctcacaggagaatactgctgcagtcatctctcagaacagaccctggcctctgactagtccacagaatcttcatttttctccaggaccaaagagtctcaaggctgggctgagacaaaaatatagcaggcttcagactcaggggactcgaggctcaggaggagcatctgggacagcaggtaccagcttaggacttggccttaactttcaagagtgactctggtatgatttcacccttaatcac

SEQ ID NO: 41949 - DNA, 601 bp, Human
ttgcttagaacagaaatgcatttgccacctggttttagtcagtaatattctttctaatttttcttcacgttagctttcccaaagagcttatgaataaacatctcctctcataaactgggagaatgcaaactgataacagaaataatttaattttgaggagttatttattagagagttctttggaaaaagtggtctctgaaaaataacctgtatttgaatacggcttttagctaaaccacctcctattacctatcacgagttgcttcggtaaaggcttcgctttaagtttcaaactatttgkttatttttattttttaattttctaagacaggatcttaatccgttgcccaggctggagtgaagtagtacgatcttggctgatcctcccacctcatcctcccaagtagctgaaaccacaggtgtctgccaccacacctggctaattattttgtagagatggggtctcactatgttgcccaggctggtctcaaacccgtggggctcaatcagttctctcaccttggcctccaaagtggtgagattacaggtgtgagccaccatacctggcccatttatttatttttatcagtaaacattttgt

SEQ ID NO: 41950 - DNA, 601 bp, Human
gcagtagcttttctgtctgggccagttgagtcattccctgaggcaaccataacccatcttccctggggtgtttgtctccatgaggacaaaacttacctgggatgtgtataatcaaatgtcacattcaaaatttggaagtttagtatgaagcaaagagctatcatgatgaacaaatataacattttctccattcattttgctggaaacaggattgtatcaatgccaagaaagaattgtacaacattgtcttaactactattacttaacatgggctgaaagcctatcatcttgcatttgcttrgaacagaaatgcatttgccacctggttttagtcagtaatattctttctaatttttcttcacgttagctttcccaaagagcttatgaataaacatctcctctcataaactgggagaatgcaaactgataacagaaataatttaattttgaggagttatttattagagagttctttggaaaaagtggtctctgaaaaataacctgtatttgaatacggcttttagctaaaccacctcctattacctatcacgagttgcttcggtaaaggcttcgctttaagtttcaaactatttgtttattt

SEQ ID NO: 41951 - DNA, 601 bp, Human
actgtgttcatgaaccttacagtttattaatttgacagataaaagaactttgcttcactaagaaaacaagaacatttcacttagcacagaaaaaataaaagaataaaaagagaaaaccagaacaaccatagagccctgcccccaactttgtttggggtcagacttatacagtttaaagtagccacaacaaagagaaaaatgttctgctctgccttagaaatactgtttttttccttccaaattatgattttaaaggtctttcaagggagggccagatgttgtgactcatggctgcaatccyagcacttggagaggccaaggagggaggattgcttgaggccaggagtttgagaccagcctgggcaacatagtgagaccctgtctctataaaaaaattaaaaaattagccaggcaatgagtgtgacctgtagccccagctactcaggaggctgaggcgagaggatcatttgagcctaggagttagaagctgcagaaagttatgatcatgccactacactccagcctgggcaacagagcaggaccctgtctctaaaattaagaagaataaataataaaataaagttctttcaagccctgaagg

SEQ ID NO: 41952 - DNA, 601 bp, Human
aacatacactgtgttcatgaaccttacagtttattaatttgacagataaaagaactttgcttcactaagaaaacaagaacatttcacttagcacagaaaaaataaaagaataaaaagagaaaaccagaacaaccatagagccctgcccccaactttgtttggggtcagacttatacagtttaaagtagccacaacaaagagaaaaatgttctgctctgccttagaaatactgtttttttccttccaaattatgattttaaaggtctttcaagggagggccagatgttgtgactcatggctrcaatcccagcacttggagaggccaaggagggaggattgcttgaggccaggagtttgagaccagcctgggcaacatagtgagaccctgtctctataaaaaaattaaaaaattagccaggcaatgagtgtgacctgtagccccagctactcaggaggctgaggcgagaggatcatttgagcctaggagttagaagctgcagaaagttatgatcatgccactacactccagcctgggcaacagagcaggaccctgtctctaaaattaagaagaataaataataaaataaagttctttcaagcc

SEQ ID NO: 41953 - DNA, 601 bp, Human
ctgtacccggccttttggatactgtattttggacttgcatttgtacacagaacctgcagctacagagggctgactgtatttattgaaaaaaaaattttgagcagaagtggacccacacagttcaaacctgtgtcttcaaaggtcttctttacacagtatttttaatatgctcattgatgagatccaatgtctccgaagaggaaagtaggctgaatcagaaaaagtactgactgtcatttggggttattagttctagacctggatctgaacctaaaatgttggataaatcatctagttttgttttttttaattacaaaactggaggagaatgttctcttaggtctcttcattctgtaagagagaaactaagtgatttattcacctgaggacattttattattaacattactgaagaaaagcatcaccaccacttccttctatggctcattttggtgtttgacactgttagtgttacaacttcaaatagaacctaaatgctgatcatcagtaattaatttcatttattattttatttgcaaagaggagggactcagtttagtctctacattacttatactaatccccttcataggccaggcac

SEQ ID NO: 41954 - DNA, 601 bp, Human
tcagtgtcatattgcaagagccgagttatgattgaacccttcaggaaagcggacggctgtacttgaaaacagaatgtacaaacttactacactcctctctgcctgcccaccacccccactccaccctgccctgccccagggagctcgtccacctaaatcttagagatgcaattggctactttaggatttttaatgccagtgactgccagaggggaaaagaatgactatttgttttgttattatttttccttttaccatcacaagcagttaaaatacatcctaaaatagacatatatataaygaaagctatgatcatttggctttcctaatgtctagtgaatggtccaaagaaaacgtcatacctaagaggtgacaatcagctacaaggaggaagtctttaagaaagaggtaccaaagctgtgaggcaaatgcattctgggagcttgctggagctctgaaacccagagttcacatagagaaaaacaaaactgacaatatccagttgacccttgcacaacacaggtttgaactgcgtgagtccacatcttatgcagacttttctcagccaaacacagataagaacacagtattcacagatacg

SEQ ID NO: 41955 - DNA, 601 bp, Human
agatcagtagttgctctgcagttcttggcttgtttataaagccttcattttcaaatgaagtgtgtgtgtgtatgtatgtgtgtgtatatattcagagagagagagagtctcaaaagtgatgagacagagttcccatatatgatggcttgtgctggagttataagctctgggcagaggtcctgactgggcctggggtatggggccagtctccctatttgcatgttgccttaccaaccactctatagggagctttgacagcaaacctctgccaggttctgatattgaatgccagaggacaaayggcacacacttaagtaaagggaaaagaagcattagatatttctttaaatgtcaaagcagaagaaataatggacaaaattcaaataagaaaaacattcctatatcagaaactaaagactattggaaaactaaccactgcaaataaatttccctatctaaaagacttttatccaaatctttcagctagtaaacattttatttactattaacaatgtcagtgtcatattgcaagagccgagttatgattgaacccttcaggaaagcggacggctgtacttgaaaacagaatgtacaaacttac

SEQ ID NO: 41956 - DNA, 601 bp, Human
gacatcaggactccgattagctaatggaactgcagttaaagcaacgagttcacaccctccactgcacaattagaacatccttgccaggggtagcaaacaactgagcagttagggtgaagaggctatgcatggtgaagtcttttccttttataagagagcacatgccagccttgctggtagattcagaatagtacttcctatcggacaaaaaggaagggtcctcttttaaagaaaaacagacaaggagaaagacgttctgattgaagtgccgtggttttctgggctatgttaacacagcagycttttgtatgcctcacttaatggctgaatgtttgctattcctacaaatctctgttgtctcttaagtgagatgtgagatcagtagttgctctgcagttcttggcttgtttataaagccttcattttcaaatgaagtgtgtgtgtgtatgtatgtgtgtgtatatattcagagagagagagagtctcaaaagtgatgagacagagttcccatatatgatggcttgtgctggagttataagctctgggcagaggtcctgactgggcctggggtatggggccagtctccctatttgcatgttgc

SEQ ID NO: 41957 - DNA, 601 bp, Human
tcagaacagtgtcctggggatccaaaatgcagctctgtatcataggagtttccttctctttggaaagactatatattgccagttcttgccaggcacattggctcacacctgtaatcccagcactttgggaggccaaggtgggcagatcacttgaggtcaggagtttgagaccagcctggccaacatggtgaaatcccgtctctactaaaaatacaaaaattagccgggggtggtagcaggcacttgtaatcctaactactcaggcggctgaggcaggagaatcactcaaacccaggaggcrgaggttgcagtgagccaaaattgcaccactgcactccagctggagagagagagactccatctcaaacaaaaaaaagactctatgttgtcatttcatagcttgcctagtacaatggttctgcatagtggccactcaatatattttgtgtgatttaatgtttcaatactgatgagaggccttgtacttctatttgttcttctctcctggctttggattggtctgtttgaaatttaaccttcttaaccaaacacagccacaactcaagataagacttatcagatttttatcagtaaactagaa

SEQ ID NO: 41958 - DNA, 601 bp, Human
atgaagcctctgattgctgtgagatttatgtaacatgggggttgacaaaggctttctgattaataaaatgtaatcaaggagaatagcatgtgtgtggaacgtgcattagttcagtgaaaacaaggaacagaaagaaagacaagagatgcatgcagcattgctgatggcatggcatgttttggactcttcgcttggtgtaccacgccttattcagaacagtgtcctggggatccaaaatgcagctctgtatcataggagtttccttctctttggaaagactatatattgccagttcttgccrggcacattggctcacacctgtaatcccagcactttgggaggccaaggtgggcagatcacttgaggtcaggagtttgagaccagcctggccaacatggtgaaatcccgtctctactaaaaatacaaaaattagccgggggtggtagcaggcacttgtaatcctaactactcaggcggctgaggcaggagaatcactcaaacccaggaggcagaggttgcagtgagccaaaattgcaccactgcactccagctggagagagagagactccatctcaaacaaaaaaaagactctatgttgtca

SEQ ID NO: 41959 - DNA, 601 bp, Human
gcactatttctgtaatatagaaatccatatctgtgctcttttcctgcgtgtggagttcaaaaatttcagttcaaatcctgactctacatgactgtgtacaagtcacttaacctccattagcttaaattttcttactcagaaataagacgtgtttgtattcagcaacagcataggttctcttccatgctgatgttctgggactcagttcctccagggctgaggccacattggtgctgtccaaaatctgggtaacttgggatgtgggtgttagggacagtgccccttgctaaggctcctggagtgatcccacgcagtttcccaactcctttcagaggagttgaacagagtggttgacacagctaaagcagcaagaaacatcaaccaagagcacatggcattcttacttgatttttcttgctggttattcctagtttgcctggccaatatgtctctgaaaaatcatctcctttcagaggagttgggaaactgaagaggcatgaagcctctgattgctgtgagatttatgtaacatgggggttgacaaaggctttctgattaataaaatgtaatcaaggagaatagcatgtgtgtggaacgtgca

SEQ ID NO: 41960 - DNA, 601 bp, Human
cttatatacacagtcatgtgttgcttaatgacaaggatacattctgagaagtgcactgataggtgatttcgttgcgcgatcatcatagagtgtacttacacaaacttactacacacccgggatatgtggtaaagcctattgctcctaggctacaaacctatacagcgtgtcactgtactgaatatcgaaggcagttgtaacacagtgagtatttgtgcatctaatcatagaaaacaaggtatagtaaaaatacagtctatgagataaaaaatagcacacctgtatggagcacttatcataggtggagactgcaggactggaagttgctctgggtgagtcagtgagtgagtggtgagtgagtgggaaggtacaggacattcctgtagactactgcagactttataaacagtgtacacataggctacattaaatttataaaaaatatttttctttcttcagtaataaattaaccatagcttactatacctttgttactttataaacttttcaatttctttaagctttttgactctttgtaataacacagcttaaaacacaaatacattgtacagctgtatgaaaattttctttatatgcttat

SEQ ID NO: 41961 - DNA, 601 bp, Human
ccaggtgtggtggctcacgcctgtaatcccagcactttgggaggccaaggtgggcagatcacttcaggtcaggagttcgaaaccagcttggccaacatggtgaaacctcgtctctaccaaaaacataaaaaaaaaaaaaaaaaaaattagccaggtgtggtggtgtgcacctgtaatatcagctattcgggaggctgaggcaggagaactgcttgaacctgggagacagaggttgcagagagccgagattgtgctactacactccagcctaggtaacagagcaagactctgtctcaaaaaaaaataaataaataaataaaataaaatctggccaggcacagtggctcatgcctgtaatcccagcactttgggtggctgaggctggcggactgcttgaaccagggaggttgaggctgcagtgagccaggatcacaccactgcattccagcctgggtaacagagtgaggctctgtctcaaaaaaaagataaagaaaagaaaatctgcttagagtaagtaggccagcataagggattaaataccctataatttcagcagtgcttctgaccgtggtgataaaagctgtgatacttcttgaaaccg

SEQ ID NO: 41962 - DNA, 601 bp, Human
gttaagaatggagggaggggtgggtgctataaaagggctagcgcaaaggaaacttgtggtgatgaaaaagttctgtatcatgattatgttggtagtaacatgaacctacatgtgataacattgccagaacccaccccccaacacatacaaacacacaaacgagtgcatttaaactggtgaaatatgcaaactgaataattggtaaagtctacagactataccaatgccattttcctggttttgtttgtttgtttgtttagagatggagttatctcttgttgcccaggctggagtgcaattscatgacctcagctcactgcaacctccacctcccaggttcaagcaattctcctgcctcagccttccaagtagctgggattataggcatgtgccaccatgcccggctaatttttgtatttttagtaaagactgggtttctgcatgttggtcaggctggtctcaaactcctgacctcaggtgatccatgcaccttggcctcccaaagtgctgggattataggcgttagccactgcgccctgcctttctgatttttagattgaggatagttatgtgagatgttgccattggagaaattggatga

SEQ ID NO: 41963 - DNA, 601 bp, Human
tgttaagaatggagggaggggtgggtgctataaaagggctagcgcaaaggaaacttgtggtgatgaaaaagttctgtatcatgattatgttggtagtaacatgaacctacatgtgataacattgccagaacccaccccccaacacatacaaacacacaaacgagtgcatttaaactggtgaaatatgcaaactgaataattggtaaagtctacagactataccaatgccattttcctggttttgtttgtttgtttgtttagagatggagttatctcttgttgcccaggctggagtgcaatkccatgacctcagctcactgcaacctccacctcccaggttcaagcaattctcctgcctcagccttccaagtagctgggattataggcatgtgccaccatgcccggctaatttttgtatttttagtaaagactgggtttctgcatgttggtcaggctggtctcaaactcctgacctcaggtgatccatgcaccttggcctcccaaagtgctgggattataggcgttagccactgcgccctgcctttctgatttttagattgaggatagttatgtgagatgttgccattggagaaattggatg

SEQ ID NO: 41964 - DNA, 601 bp, Human
taacattcttgaaatatcaaaattacagagatggagaagagattagtgattgtcaggtgttaagaatggagggaggggtgggtgctataaaagggctagcgcaaaggaaacttgtggtgatgaaaaagttctgtatcatgattatgttggtagtaacatgaacctacatgtgataacattgccagaacccaccccccaacacatacaaacacacaaacgagtgcatttaaactggtgaaatatgcaaactgaataattggtaaagtctacagactataccaatgccattttcctggttttttttgtttgtttgtttagagatggagttatctcttgttgcccaggctggagtgcaattccatgacctcagctcactgcaacctccacctcccaggttcaagcaattctcctgcctcagccttccaagtagctgggattataggcatgtgccaccatgcccggctaatttttgtatttttagtaaagactgggtttctgcatgttggtcaggctggtctcaaactcctgacctcaggtgatccatgcaccttggcctcccaaagtgctgggattataggcgttagccactgcgccctgcctt

SEQ ID NO: 41965 - DNA, 601 bp, Human
gggcgcagtggctcacgcctataatcccagcactttgggaggccgaggcgggtagatcacgaggtcaggagttcgagaccaacctggccaagatgggaaaccccatctctataaaaatacaaaaattagccgggcgtggtggcaggcacctgtaatatcagctactcaggaggctgaggcaggagaatcacttgaacccgggaggcagaggtcgcagtgagctgagatcgtgtcactgcactctagcctgggcaacagagcaaggctccatcttaaaaaaaaaaaaaaaaaaaaaaaaagwagtctttaaaacaaaaaacaattattcaaaacactaagttgatggtatatgtgctagactggatatagttgaagagggaattatgcaaaaagcagcacagtgagataaaagggggaaaaaagcttaaaaactagaagacacagtagactgtgaggctccaacatatgcctgataggagttagcagagggatttgcatagaagtgacatatgaaaagagaatagcagaattcttcagtgccctctaattggatgtgcacttccggtatactcagacaccttgtagtaaaagtatataagac

SEQ ID NO: 41966 - DNA, 601 bp, Human
tcttactcaaagtaagtctgcaactaataatgtgaaaaaccacacacacacacacatacacacacactttttacatacagcatatacagcaagatatatattgctaaggaaaaagtcagcaaaaataaaacatcaactcactccagaagaaattatttctatggaagaatctgacaaaaacctcaaaatcagtttgcttgaggtgtttaagagagaaatagagatattattcatctaaaaagaaagatatcagtgccataagacaaggcaagaagaaaaaaatcttaataaataaattgaytaattaaaaaggaaaaaatgaaaaaatttaaaagatacgtaatgaaacaatagaagccaaatttaaacattaatgggaaaacgggtctattagaaatctttaaagcaagacagacatggtggcatgcacttgcagtcccagctatgtgggaggcagaagtgggaggattgcttgagcccagaagtttgaggctgcagtgagccatgatcatgccatagcattctaggctgggtgacagagtgagaccctgtctctaaagataataatgataataataattttttttttaaaaaaagaagt

SEQ ID NO: 41967 - DNA, 601 bp, Human
ggttgcaggagctgagatcgcaccactgcactccagcctgggcaacagagtgagactccatctcaaaaaaaaaaaaaaaaaaaaaattatgaacaatagctggagtccagtgaacagtagctggagtccagcttctgaagggtgttggggcctaaagtgtggcaaccatgcatgtggcaaccagagctaggtcttgcttaaagtaaagcatggcgcagggctggggcaggagttccaaacttccactccttttgtaaaaggaggctattagaaggaatgaaagaaggggaaaaaaaaaaamaaaactaatcctaatttactgcccaagctatagatttggtaagctgtggaactaggcaaggtagcagggcaaaaatatatccccggactgggagttaaagcagggcccccactgcctctgtgactggatctaaagtatcttcagtatgaccacagtgcagaagcctaaacaccatataggacttgcctctggactcaggatctcatagagtcagacagaagctaatacagaaatgctaaatgcagaggagtgagcacagtgtgtgtagcaaagaaaacacaagacaggagaaagagacgg

SEQ ID NO: 41968 - DNA, 601 bp, Human
aaacaatgtcaacatctctgtcacaaacagagcagaaatgcagagcagtggccaggatttaaatggtgaacagtagccgggcatggtggctcatgcctgtaatcccagcactttgggaggccaaggtgggtggaacacgaggtcaggagtttgagaccagcctgaccaacatggtgaaaactgtctctactaaaaataaaaaaattagctgggcctggtggcgcgcgcctgtaatcccagctactcgggaggctgagacaggagaatcgcttgaactcgggaggcggaggttgcaggagcygagatcgcaccactgcactccagcctgggcaacagagtgagactccatctcaaaaaaaaaaaaaaaaaaaaaattatgaacaatagctggagtccagtgaacagtagctggagtccagcttctgaagggtgttggggcctaaagtgtggcaaccatgcatgtggcaaccagagctaggtcttgcttaaagtaaagcatggcgcagggctggggcaggagttccaaacttccactccttttgtaaaaggaggctattagaaggaatgaaagaaggggaaaaaaaaaaacaaaactaatcct

SEQ ID NO: 41969 - DNA, 601 bp, Human
ttggtgcactcttcctgttacaaacatatcaatgacagaaaaatacaaagggagagaaaaggacatagctaggctcaaacaatgtcaacatctctgtcacaaacagagcagaaatgcagagcagtggccaggatttaaatggtgaacagtagccgggcatggtggctcatgcctgtaatcccagcactttgggaggccaaggtgggtggaacacgaggtcaggagtttgagaccagcctgaccaacatggtgaaaactgtctctactaaaaataaaaaaattagctgggcctggtggcgcrcgcctgtaatcccagctactcgggaggctgagacaggagaatcgcttgaactcgggaggcggaggttgcaggagctgagatcgcaccactgcactccagcctgggcaacagagtgagactccatctcaaaaaaaaaaaaaaaaaaaaaattatgaacaatagctggagtccagtgaacagtagctggagtccagcttctgaagggtgttggggcctaaagtgtggcaaccatgcatgtggcaaccagagctaggtcttgcttaaagtaaagcatggcgcagggctggggcaggagttcca

SEQ ID NO: 41970 - DNA, 601 bp, Human
tgtgtgtgtgtgtgtgtgtgtgtgtgtgagagagaaacagtgctgggatgatggtggcggtggtggttggtggtgatgggaggattcaaacatttcaggctctttggaaacagaagagttatgctgtgcttctagtcaaaatattgtggtgaattctcattttggtgcactcttcctgttacaaacatatcaatgacagaaaaatacaaagggagagaaaaggacatagctaggctcaaacaatgtcaacatctctgtcacaaacagagcagaaatgcagagcagtggccaggatttaaayggtgaacagtagccgggcatggtggctcatgcctgtaatcccagcactttgggaggccaaggtgggtggaacacgaggtcaggagtttgagaccagcctgaccaacatggtgaaaactgtctctactaaaaataaaaaaattagctgggcctggtggcgcgcgcctgtaatcccagctactcgggaggctgagacaggagaatcgcttgaactcgggaggcggaggttgcaggagctgagatcgcaccactgcactccagcctgggcaacagagtgagactccatctcaaaaaaaaaaaa

SEQ ID NO: 41971 - DNA, 601 bp, Human
gaggactttgagaaggtgcagcagtgggtagtcaacctggtggataccttcgaggcgggccccgactgcatggggaccgtgcgctccagcgacctgcccaacgtggccttcgaactgggcgttttcggctcgcgggaggaggtcaaggcggccgcccgatgcatcgcctaccacagggcaacaccaacaccggcgaagcgctgcaccacatcacagcccgcagcttctccccgcgcgccggccaccgctccggggactgcgcctacaagcaggtggccatactgctcaccaatggctgcasccaggacctggtgctggacgccacggcggctgcccaccgtgccggcattcgcgccggcatccgcgtcttcaccgtggacgtgggagaggcgctcagggaggagctggaggagatcgcctcggagcccaagtccacccatgtcttccacgtgtccgacttcaactcaatcgacaagatccagggcaagctgcggcgctgcctgtgcgaaaatgtgctctgccctagcgttcgtgtagaggagatcgctttaagcacaccaatggagaaaccaaggaaatcacagaaacagcaaaagcagca

SEQ ID NO: 41972 - DNA, 601 bp, Human
tttcaaaacacatttttgtagtttcttaacattcttatatgaacataaaaattatcaggcacgtttttgccttcttgctaaatatattatctctaaagataaaaaataactggagtttggacttggatcataacagtaacatatggaaaacctttatgtagatcataactatcagaaagtaatgaactaattacttaaatatatagatctgaatacattcattgcacatgttaagattgggaattccatgggatttatgatttgtacatggttcagattcaggacttgttaggatttgctytggaaatctctttatgttgcccaaattgatgctgaaatgctagagaacttctgaggccttgagagtcccccacccagactatcagttcatacattctctttttcagcagtctcaatttacatgcactaattggtagctaatgtgctcccaaaggcaaataaaggtatttgttgctttaaaatcctaagtctttttctttttccaacatgtgcttggaaagagaataaaactttgcatatgtatgtctgggactcctggatctgattaagaccctggtaatattactctgtattcacacag

SEQ ID NO: 41973 - DNA, 601 bp, Human
gatcccaggaagttggggctgcagtgaagcaagatagtgccactgcactccagcctgggaaacagagtgagatcttgtctcaaaaaaaaaaaaacaataaacaaaattgcccgtcacccccactagaatgctagaatgaaagccgtgtaggcagagacttggtcttatgtgcagctgtattcctagtgcctggccagtgctcagcacagaggagatcctcaggaaatatgagaataagcttttttgtttaaattcttgccctaaaccaacatttttctttttttcttttctttcttcttctttttttttttttttgcctttgacatgctgctattcttccatatcaaattcatggccaactttatttttattttgtgtagaattgttttataacagcaagtgaaaagcacaaactccattatagattgtactttcttgggaaatggattcaaagaggactttttggctgggtgctttggcttgtagtgccaagcctgcttgtttttctcaaatcctttggacttttccatgtgttgaacattttatttcagtgtgttcaatgctttcaccagctcactcagtgacccatgtggaagactgc

SEQ ID NO: 41974 - DNA, 601 bp, Human
attaataataagaaaatgctgcccttggcaggagctgtctacaaaaatggaggattgcttcagcccaggagtttgagaccagcctaggcaccacagcaagacccttgtctccccctaaaaataaaaataaaaagttggctggatgtggtggtgtgtgcctgtagtctcagctacttgagaggctgaagtaggagcatcatttgagcccaggagttcaagtacagtaggctgtaattgtgccactgcactccagcctgggcaacagagtgagaccctgtctcttaaaaaaaaaaaaaaaaartagatataaagtgtatatactatatatgtacacagaaataacaggcccttacaactgattggtgctttgtagtttacaaaacattcttaacatgctttatttattatttcataccttcgtgtatacacaatgtatacacattcattcattcattcattcatttattcattcagtcttaacagctctggtctgggtgttggagatatggaaataaaaggcacagtctctgtgtacagtagctcaattaatgtgatacagataagcagtgcccttacaggatgggcagctaacacagggttc

SEQ ID NO: 41975 - DNA, 601 bp, Human
ttaaatagcattgtcccacatctggattttagcaaaagacccccagctggaggaaaagagatggatatgagataaaaatttccaccagttcttctgtggcattttaggctggattgcaaaggctcctgcatttggcactctgtgcgttcctttgaaatttatataagcttcattttcatacaatttaaaaacaccagttaataaaccctatcattacaaattctgagttggaaatagtatgtaaacagacagaggcatccccaaccctttctctatagcctttaaattttgatgactggcragagcattttgtgcttctcttagtatcaatctgttatcatctattctactttattcactcagggactaattaccaactttttatatgaagcagcattacgataagctcacagtggggtgctcagattttttccatccttattggaaagtaaacccttaggtcttcttgaatatattatagtactgacttttcagtcacacacaacattcaggctctctctgaagaggaagatactcttctctgcctccctggtagctgccataatggtgcagcctataaaccttgtcattcaacacactt

SEQ ID NO: 41976 - DNA, 601 bp, Human
aaatgcatactttttcatgaaaattaaaacatgaatcccttataaatagaaatttaaattctcagaacttggggatggaaaggggaagcatgtttaatgcaaagctatggcccaaatgtaaacactgaaatcgtcctgatttccattttctctggaatgtccctccaataaaaatcaaatcctattccatattaagtaatggatagtagctggcaacttgggagtctgaactcatctatagcaggagtctctaacaacagaaatatacaagtgaattgatattaaattatattaaaaaaamcaaaatctagacaaatgattacatgttctggagttcccagaaatacatgtttttgaaatttgctgtttggttctcatattaaatagcattgtcccacatctggattttagcaaaagacccccagctggaggaaaagagatggatatgagataaaaatttccaccagttcttctgtggcattttaggctggattgcaaaggctcctgcatttggcactctgtgcgttcctttgaaatttatataagcttcattttcatacaatttaaaaacaccagttaataaaccctatcattacaaatt

SEQ ID NO: 41977 - DNA, 601 bp, Human
taacacctcccagaagacctggaattttcactcatttatgtggttcacttgtatttactttttaggaagagtttagaaacttaagtgtgtttcctcggtactcatggaattagttttgatgaaaatgcatactttttcatgaaaattaaaacatgaatcccttataaatagaaatttaaattctcagaacttggggatggaaaggggaagcatgtttaatgcaaagctatggcccaaatgtaaacactgaaatcgtcctgatttccattttctctggaatgtccctccaataaaaatcaartcctattccatattaagtaatggatagtagctggcaacttgggagtctgaactcatctatagcaggagtctctaacaacagaaatatacaagtgaattgatattaaattatattaaaaaaaccaaaatctagacaaatgattacatgttctggagttcccagaaatacatgtttttgaaatttgctgtttggttctcatattaaatagcattgtcccacatctggattttagcaaaagacccccagctggaggaaaagagatggatatgagataaaaatttccaccagttcttctgtggc

SEQ ID NO: 41978 - DNA, 601 bp, Human
gaccctggattttccactgtaattgaggtagttcacagatagttcacaaggacctaaaagcaatggaagagattaagtgccaaaatacaaatgataacacctcccagaagacctggaattttcactcatttatgtggttcacttgtatttactttttaggaagagtttagaaacttaagtgtgtttcctcggtactcatggaattagttttgatgaaaatgcatactttttcatgaaaattaaaacatgaatcccttataaatagaaatttaaattctcagaacttggggatggaaagggraagcatgtttaatgcaaagctatggcccaaatgtaaacactgaaatcgtcctgatttccattttctctggaatgtccctccaataaaaatcaaatcctattccatattaagtaatggatagtagctggcaacttgggagtctgaactcatctatagcaggagtctctaacaacagaaatatacaagtgaattgatattaaattatattaaaaaaaccaaaatctagacaaatgattacatgttctggagttcccagaaatacatgtttttgaaatttgctgtttggttctcatattaaat

SEQ ID NO: 41979 - DNA, 601 bp, Human
gaatcagtccctgggatgctgcggactggacctgacagacaggtagaccctggattttccactgtaattgaggtagttcacagatagttcacaaggacctaaaagcaatggaagagattaagtgccaaaatacaaatgataacacctcccagaagacctggaattttcactcatttatgtggttcacttgtatttactttttaggaagagtttagaaacttaagtgtgtttcctcggtactcatggaattagttttgatgaaaatgcatactttttcatgaaaattaaaacatgaatcccwtataaatagaaatttaaattctcagaacttggggatggaaaggggaagcatgtttaatgcaaagctatggcccaaatgtaaacactgaaatcgtcctgatttccattttctctggaatgtccctccaataaaaatcaaatcctattccatattaagtaatggatagtagctggcaacttgggagtctgaactcatctatagcaggagtctctaacaacagaaatatacaagtgaattgatattaaattatattaaaaaaaccaaaatctagacaaatgattacatgttctggagttccca

SEQ ID NO: 41980 - DNA, 601 bp, Human
tggtgcatttgtccaagattgatacaattgtgaatttgacctgttaaattatttcacaagccaatttccttcctttttctaactagaaactgattttcaaaaatttggcatatatgtaatggatctctccctgaaataaaatactgtactttacatgtaatagtcttttctattcaaaaagtcctgtgatgaatccttttgtgatctgaataatcaagttctaatttatatgttttgcaaatgaggattttcactggtcagttttgtgttaagggaaacgtgcttatgttctcatttggaytggaatcagtccctgggatgctgcggactggacctgacagacaggtagaccctggattttccactgtaattgaggtagttcacagatagttcacaaggacctaaaagcaatggaagagattaagtgccaaaatacaaatgataacacctcccagaagacctggaattttcactcatttatgtggttcacttgtatttactttttaggaagagtttagaaacttaagtgtgtttcctcggtactcatggaattagttttgatgaaaatgcatactttttcatgaaaattaaaacatgaatc

SEQ ID NO: 41981 - DNA, 601 bp, Human
ctggggataagggatatgctttagttcagccatccccagggaatacaccggtaactccttgcttcacattattggtgcatttgtccaagattgatacaattgtgaatttgacctgttaaattatttcacaagccaatttccttcctttttctaactagaaactgattttcaaaaatttggcatatatgtaatggatctctccctgaaataaaatactgtactttacatgtaatagtcttttctattcaaaaagtcctgtgatgaatccttttgtgatctgaataatcaagttctaatttayatgttttgcaaatgaggattttcactggtcagttttgtgttaagggaaacgtgcttatgttctcatttggattggaatcagtccctgggatgctgcggactggacctgacagacaggtagaccctggattttccactgtaattgaggtagttcacagatagttcacaaggacctaaaagcaatggaagagattaagtgccaaaatacaaatgataacacctcccagaagacctggaattttcactcatttatgtggttcacttgtatttactttttaggaagagtttagaaacttaagtg

SEQ ID NO: 41982 - DNA, 601 bp, Human
tttatatttttagtagagacggggtttcaccatgttgactagggtggtctcaaattcctgacttccagtgatccacccaccttggcctcccaaagtgctgggattacaggcgtgagctactgcgtccagcctcgatggttaatttctatgaatactggtccaaactgacacccttttcccccaaaacttgggaaatatgtgcaattttccttctggcaggaaaatatataggtgtctcatattttggctaaatatactattttttgctaaagctgatcagaattgaatccacatgcctgagttaattatcccattaagctattttgatgaatgttatcatgaaataataaaacatatgctgctaattgtcccaaagattcttacttgccgaatgtctattttgtttctacatctatacacatggcaatgatcctgaagaagttctgagtgaattcctctcatttactgaccatgccattccaggatcattgctctgctgcctgccttgatgctggcttctgtctatttaactgtctgtttccctatgcagaccgtaagctcctggggataagggatatgctttagttcagccatccccagg

SEQ ID NO: 41983 - DNA, 601 bp, Human
tttttatatttttagtagagacggggtttcaccatgttgactagggtggtctcaaattcctgacttccagtgatccacccaccttggcctcccaaagtgctgggattacaggcgtgagctactgcgtccagcctcgatggttaatttctatgaatactggtccaaactgacacccttttcccccaaaacttgggaaatatgtgcaattttccttctggcaggaaaatatataggtgtctcatattttggctaaatatactattttttgctaaagctgatcagaattgaatccacatgcctgagttaattatcccattaagctattttgatgaatgttatcatgaaataataaaacatatgctgctaattgtcccaaagattcttacttgccgaatgtctattttgtttctacatctatacacatggcaatgatcctgaagaagttctgagtgaattcctctcatttactgaccatgccattccaggatcattgctctgctgcctgccttgatgctggcttctgtctatttaactgtctgtttccctatgcagaccgtaagctcctggggataagggatatgctttagttcagccatcccca

SEQ ID NO: 41984 - DNA, 601 bp, Human
tctttgagaaccagttttaacattctgtgataaactatgctgctctgttaaggaaaaacaaaaagaaagaaaactaccaacaaacataaaacaaaggctagatcataagttttggtttatccacttactattatagaatgataatttagagtcttcagctcagcattcaatggttaacttctttcttttttttattttgagacagagtcttgctctgttgccaggctgtagtgcagtggtgcgatctcggctcactgcaacctccacctcctgagttcaagcaatcctcctgcctcagccwcctgagtagctggggttacagacttgtgtcaccacacccagctaatttttatatttttagtagagacggggtttcaccatgttgactagggtggtctcaaattcctgacttccagtgatccacccaccttggcctcccaaagtgctgggattacaggcgtgagctactgcgtccagcctcgatggttaatttctatgaatactggtccaaactgacacccttttcccccaaaacttgggaaatatgtgcaattttccttctggcaggaaaatatataggtgtctcatattttggctaaat

SEQ ID NO: 41985 - DNA, 601 bp, Human
agctagtaacagtcagagattaatagagaggatgtagaaatttgcatagaatgaatgtaaaatgtaagaaaaatgaagaataccctttttagaaagttgtttgaaactttccttttttgataattgtatttctttgagaaccagttttaacattctgtgataaactatgctgctctgttaaggaaaaacaaaaagaaagaaaactaccaacaaacataaaacaaaggctagatcataagttttggtttatccacttactattatagaatgataatttagagtcttcagctcagcattcaayggttaacttctttcttttttttattttgagacagagtcttgctctgttgccaggctgtagtgcagtggtgcgatctcggctcactgcaacctccacctcctgagttcaagcaatcctcctgcctcagcctcctgagtagctggggttacagacttgtgtcaccacacccagctaatttttatatttttagtagagacggggtttcaccatgttgactagggtggtctcaaattcctgacttccagtgatccacccaccttggcctcccaaagtgctgggattacaggcgtgagctactgc

SEQ ID NO: 41986 - DNA, 601 bp, Human
aaattgcaaaatataaacaatcagaaataccttcaatatgtcctaccttggtacatgatagaaaaatctacatttgttttgcattatagtgattaaaacatgactattaaaaatttgaaatgcagtattattttacgctacagtgaaaaatactctcaccagcaagcaaagctagtaacagtcagagattaatagagaggatgtagaaatttgcatagaatgaatgtaaaatgtaagaaaaatgaagaataccctttttagaaagttgtttgaaactttccttttttgataattgtatttytttgagaaccagttttaacattctgtgataaactatgctgctctgttaaggaaaaacaaaaagaaagaaaactaccaacaaacataaaacaaaggctagatcataagttttggtttatccacttactattatagaatgataatttagagtcttcagctcagcattcaatggttaacttctttcttttttttattttgagacagagtcttgctctgttgccaggctgtagtgcagtggtgcgatctcggctcactgcaacctccacctcctgagttcaagcaatcctcctgcctcagcctc

SEQ ID NO: 41987 - DNA, 601 bp, Human
ttaaaaacagtgaggaattagtactgaaatagttatgtagtgagttggtaccacatctctttcaaagtgagatggcagactcaaacatagttgattattcattgatgagttgtacaaacataaatactacacaataaggagctctgagtcttccggtggcatttaaattggcaaccacattggtgtgctctggacattttacccatgcggcactttacagttagtaaagcatattccacctgtcttatttaatatattttaaaaatgattttaagttacttaaaaatatttataagtatgrctatgtatccagagtcatacttggttcaaaattgcaaaatataaacaatcagaaataccttcaatatgtcctaccttggtacatgatagaaaaatctacatttgttttgcattatagtgattaaaacatgactattaaaaatttgaaatgcagtattattttacgctacagtgaaaaatactctcaccagcaagcaaagctagtaacagtcagagattaatagagaggatgtagaaatttgcatagaatgaatgtaaaatgtaagaaaaatgaagaataccctttttagaaagttgtttg

SEQ ID NO: 41988 - DNA, 601 bp, Human
aaggataaagatactaaactcggttcaagtaattcatacccactatatactgttttgggcattatatactgttgaacttaacctacatatgtgtacatgtccatcttgttatttctaaatggctttacactgggctgtcatacattcactgttgaagtgtgttcaggacgatttcagtgtttacatttgggccatagctttgcattaaacatgcttcccctttccatccccaagtctctgacccaaattaaaaacagtgaggaattagtactgaaatagttatgtagtgagttggtaccayatctctttcaaagtgagatggcagactcaaacatagttgattattcattgatgagttgtacaaacataaatactacacaataaggagctctgagtcttccggtggcatttaaattggcaaccacattggtgtgctctggacattttacccatgcggcactttacagttagtaaagcatattccacctgtcttatttaatatattttaaaaatgattttaagttacttaaaaatatttataagtatgactatgtatccagagtcatacttggttcaaaattgcaaaatataaacaatcaga

SEQ ID NO: 41989 - DNA, 601 bp, Human
tctggaaaaaatagacagatacgtgtgtgtgtttacatacacccatgctcagaaagtaaacagatgcagccaccctgccctgctttattttctaattggacaaaaataaataagaaagagaatatggagaaaaccacacagtactatgactaaaaggataaagatactaaactcggttcaagtaattcatacccactatatactgttttgggcattatatactgttgaacttaacctacatatgtgtacatgtccatcttgttatttctaaatggctttacactgggctgtcatacattcrctgttgaagtgtgttcaggacgatttcagtgtttacatttgggccatagctttgcattaaacatgcttcccctttccatccccaagtctctgacccaaattaaaaacagtgaggaattagtactgaaatagttatgtagtgagttggtaccacatctctttcaaagtgagatggcagactcaaacatagttgattattcattgatgagttgtacaaacataaatactacacaataaggagctctgagtcttccggtggcatttaaattggcaaccacattggtgtgctctggacatttta

SEQ ID NO: 41990 - DNA, 601 bp, Human
tgatctttatcaaatgagagccttgtcctttaggcagaacacaagccaggatggtcagtgccctttaacctgcatgtagtttctaaagtctgatactctgtgtttcttttttttcttctggtcactcatgtagagaagatgagcaaaggcatttcattccgcctaactcctgatgactatgcagttgtttttagacatctgccctaaaggtccttataaatactgaataagagagaaagccagaataaaaaaagacagactgacatacaaacacacacacagacaataggcaagggaaaayggtatgctggaatttctcttctggggttgatttatgttaacagtatgacttttatatgatgtgtacatagaagcctctggaaaaaatagacagatacgtgtgtgtgtttacatacacccatgctcagaaagtaaacagatgcagccaccctgccctgctttattttctaattggacaaaaataaataagaaagagaatatggagaaaaccacacagtactatgactaaaaggataaagatactaaactcggttcaagtaattcatacccactatatactgttttgggcattatatactgt

SEQ ID NO: 41991 - DNA, 601 bp, Human
tctgtttgacattttctaaatgattctgaaagtctttgacttgtctagcctatgctaatgaaccatctggtacactccagtgactgccaacagaatattcgctactgggaactctctaaaatatatatcttggtgactaatgatctttatcaaatgagagccttgtcctttaggcagaacacaagccaggatggtcagtgccctttaacctgcatgtagtttctaaagtctgatactctgtgtttcttttttttcttctggtcactcatgtagagaagatgagcaaaggcatttcattccrcctaactcctgatgactatgcagttgtttttagacatctgccctaaaggtccttataaatactgaataagagagaaagccagaataaaaaaagacagactgacatacaaacacacacacagacaataggcaagggaaaatggtatgctggaatttctcttctggggttgatttatgttaacagtatgacttttatatgatgtgtacatagaagcctctggaaaaaatagacagatacgtgtgtgtgtttacatacacccatgctcagaaagtaaacagatgcagccaccctgccctgctt

SEQ ID NO: 41992 - DNA, 601 bp, Human
tcttttcatatcttacaaaaggaaaggattgaggattcctaaagtagagggatcttaatatattgccagcaaatgagtccctggagaaagacctatcttaacccagtatattacacaattcatataattctgtattaatttttctgacccaaggtgaaatctgtgtccagggtatgatgtagttaattctaataaaaagtgacaggattcttgtttctgtttgacattttctaaatgattctgaaagtctttgacttgtctagcctatgctaatgaaccatctggtacactccagtgactrccaacagaatattcgctactgggaactctctaaaatatatatcttggtgactaatgatctttatcaaatgagagccttgtcctttaggcagaacacaagccaggatggtcagtgccctttaacctgcatgtagtttctaaagtctgatactctgtgtttcttttttttcttctggtcactcatgtagagaagatgagcaaaggcatttcattccgcctaactcctgatgactatgcagttgtttttagacatctgccctaaaggtccttataaatactgaataagagagaaagccagaat

SEQ ID NO: 41993 - DNA, 601 bp, Human; identical to SEQ ID NO: 28805

SEQ ID NO: 41994 - DNA, 601 bp, Human; identical to SEQ ID NO: 28806

SEQ ID NO: 41995 - DNA, 601 bp, Human
atgcctgtaatcccagcgctttgggaggccgaggtgggcggatcacgaggtcaggagattgaggccatcctggccaacattgtgaaaccccatctctactaaaaatacaaaacctagctgggcgtggtggcacgtacctgtaatcccagctactcaggaggctgaggcaggagaatcgcttgaaccccaggagacggaggttgcagtgagtcgagatcacaccactgcactctagcctggtgacagagcgagactccatctcaaaaacaaaaacaaaaacaaaaacaaaaaactgaaatgyggccaggcgcaatggctcatgcctataatcccagcactttgggaggccaaggagggcagatcatttgaggtcaggagtttgagacaagcctggccaacatggtgaaattccgtctctactaaaaatacaaaaaatcagccaggcacagtggcgggcacctgaaatcctagctactcgggaggctgaggcaggagaatcacttgaacccaggaggcataagttgcagtgagctgagatcacaccactgcactccagcctgggcgcacagcgagactccatctcaaaaacacaaacaaacaa

SEQ ID NO: 41996 - DNA, 601 bp, Human
ataaaaccaaaatgtgggctgggctaagtggctcatgcctgtaatcccagcgctttgggaggccgaggtgggcggatcacgaggtcaggagattgaggccatcctggccaacattgtgaaaccccatctctactaaaaatacaaaacctagctgggcgtggtggcacgtacctgtaatcccagctactcaggaggctgaggcaggagaatcgcttgaaccccaggagacggaggttgcagtgagtcgagatcacaccactgcactctagcctggtgacagagcgagactccatctcaaaaacaaaaacaaaaacaaaaacaaaaaactgaaatgtggccaggcgcaatggctcatgcctataatcccagcactttgggaggccaaggagggcagatcatttgaggtcaggagtttgagacaagcctggccaacatggtgaaattccgtctctactaaaaatacaaaaaatcagccaggcacagtggcgggcacctgaaatcctagctactcgggaggctgaggcaggagaatcacttgaacccaggaggcataagttgcagtgagctgagatcacaccactgcactccagcctgggcgcac

SEQ ID NO: 41997 - DNA, 601 bp, Human
ttggccaggctggtcttgaactcaggtgatctgcccacctcggcctcctaaagtgctgggactacaggtgtaagccaccacacccagcctgaggtcatctcttagaatgcttacaaggcactagacatcagattaaatccaggtatgcgcacccaggctgacacataaacttgggtttatgagataaggtttatttttactttagaactgattactttaacttattaaaaaagacaaaaatttgttttccttaccaaaacccttcattgccttacgaagaatttctgcatctcttatagcrtcgaagttggcagctggtcggatagttccttgagtgacctgagtcactgtggcaggctgaaaataaaaggcataaaatccgtgtcagcatttccagtaagtttctaatgaggaaacttaaagacttccccagacatcaatcttaagtaagaaggccaatgtttgggttttaaggcaaggatatgagcattttattaccagagctcattatggaacagacaggaaagacctatcccccttcaggacagatttttctcctgccaacagatagccagacaccaaacttccaggagacaagatg

SEQ ID NO: 41998 - DNA, 601 bp, Human
atgtttaagtaaggacaaagtacatgctaggtgctgcttgaggtcatcttttttttttttttttttttttgagacggagtttgtcacccagactgggggtgcaagtgcaatggtgtgatctaggctgactgcaatctccacctcccaggttcaagcaattctcctgcctcagcttcccgtgaagctgggattacaggcatgcatcaccatgcccaactattttactttttatttttagtacagatggagtttcgccatgttggccaggctggtcttgaactcaggtgatctgcccacctcrgcctcctaaagtgctgggactacaggtgtaagccaccacacccagcctgaggtcatctcttagaatgcttacaaggcactagacatcagattaaatccaggtatgcgcacccaggctgacacataaacttgggtttatgagataaggtttatttttactttagaactgattactttaacttattaaaaaagacaaaaatttgttttccttaccaaaacccttcattgccttacgaagaatttctgcatctcttatagcatcgaagttggcagctggtcggatagttccttgagtgacctg

SEQ ID NO: 41999 - DNA, 601 bp, Human
agcatttccatattatttttttttgagacagcgtcttgttctgtcacctaggctacagtgcagtaacacaatcacagctcactaacagcctgacttcctgggctcaagcaatctttctacctcagcctcccaagcagctgggactatggacacacgccaccacgcccagctaatataatttgttgtcatcgttgttggaaatgaagtctccctatgttgcccaggctggtcctgaactcctggcctcaagaaattctcctgctttggcctcccaaagtgctgggattacaggcgtaagccmccacgctcagtccatataattttaacataggacacgtttagagaaagggagagaagcagaaggcgatgcccaggaccaagaataaacaagggctatgtaataagccttgaatcccactgtaacaggcagaagactgagaaccatcctcttgatcatgattgtagttgtgatctactttctactgaatgtctatcacatatgtgactggggtaaggtatgattatgagatcaaggactactctagaatgaaaaagccttttaagagaaataggccaggcatggtggctcacgcctgtaatc

SEQ ID NO: 42000 - DNA, 601 bp, Human
gtcaggcgtggtggctcatgcctgtaatcccagcactttgggaggccaaggcaggcagatcacatgaggccaagagtttgagaccacacttgctaacatggcaaaatcccgtctctactaaaagtacaaaaattagctgggtgtggtggcagacacctataattccagctactcgagaggctgaggcacgaaaatcgctcttgcctggaaagtggaggctgcagtgagcggagatcatgccactgcactccagccttttgagactctgtctcaaaaaaaagtaaaaaaaaaaaaaaaaaaagcaaagcagtgctatccatgttttcccattacatctgaggaacaatggcattttttagccatagaatcttgttggatttagaaactgatcatccattcaacaagtactaagtggctacttgccattatatacttggtactgtaatacaaagatgactatgaccatggtttgtcctatgggagctcagtttttgggggtgggccgtgagattagtaataacagaggttttacaaagtgctatgggactacagtattaagaagcagctaaattctgtccagactaatgaaagaaacttcaga

SEQ ID NO: 42001 - DNA, 601 bp, Human
tgagaatagtgagtctgatgttgaagcttaaggagatctagggtttgtgttgcataatcagtcactgggctgggcagacagggaaaggcaaaatagaataagcaaggtgggaccaatcaatggaccactaccccattctgagaaatataaactagatgcagagaacattaggatatttttaggattcctatctaaatggcaaagcaggtcaggcgtggtggctcatgcctgtaatcccagcactttgggaggccaaggcaggcagatcacatgaggccaagagtttgagaccacacttgcyaacatggcaaaatcccgtctctactaaaagtacaaaaattagctgggtgtggtggcagacacctataattccagctactcgagaggctgaggcacgaaaatcgctcttgcctggaaagtggaggctgcagtgagcggagatcatgccactgcactccagccttttgagactctgtctcaaaaaaaagtaaaaaaaaaaaaaaaaaaagcaaagcagtgctatccatgttttcccattacatctgaggaacaatggcattttttagccatagaatcttgttggatttagaaactgatcatc

SEQ ID NO: 42002 - DNA, 601 bp, Human; identical to SEQ ID NO: 41995

SEQ ID NO: 42003 - DNA, 601 bp, Human; identical to SEQ ID NO: 41996

SEQ ID NO: 42004 - DNA, 601 bp, Human; identical to SEQ ID NO: 41997

SEQ ID NO: 42005 - DNA, 601 bp, Human; identical to SEQ ID NO: 41998

SEQ ID NO: 42006 - DNA, 601 bp, Human; identical to SEQ ID NO: 41999

SEQ ID NO: 42007 - DNA, 601 bp, Human; identical to SEQ ID NO: 42000

SEQ ID NO: 42008 - DNA, 601 bp, Human; identical to SEQ ID NO: 42001

SEQ ID NO: 42009 - DNA, 601 bp, Human; identical to SEQ ID NO: 41995

SEQ ID NO: 42010 - DNA, 601 bp, Human; identical to SEQ ID NO: 41996

SEQ ID NO: 42011 - DNA, 601 bp, Human; identical to SEQ ID NO: 41997

SEQ ID NO: 42012 - DNA, 601 bp, Human; identical to SEQ ID NO: 41998

SEQ ID NO: 42013 - DNA, 601 bp, Human; identical to SEQ ID NO: 41999

SEQ ID NO: 42014 - DNA, 601 bp, Human; identical to SEQ ID NO: 42000

SEQ ID NO: 42015 - DNA, 601 bp, Human; identical to SEQ ID NO: 42001

SEQ ID NO: 42016 - DNA, 601 bp, Human; identical to SEQ ID NO: 41995

SEQ ID NO: 42017 - DNA, 601 bp, Human; identical to SEQ ID NO: 41996

SEQ ID NO: 42018 - DNA, 601 bp, Human; identical to SEQ ID NO: 41997

SEQ ID NO: 42019 - DNA, 601 bp, Human; identical to SEQ ID NO: 41998

SEQ ID NO: 42020 - DNA, 601 bp, Human; identical to SEQ ID NO: 41999

SEQ ID NO: 42021 - DNA, 601 bp, Human; identical to SEQ ID NO: 42000

SEQ ID NO: 42022 - DNA, 601 bp, Human; identical to SEQ ID NO: 42001

SEQ ID NO: 42023 - DNA, 601 bp, Human
aacagagtgagactccatgtcaaaaaagaaaaagaaatcgatttttatggttcatccgttaaactgagagagacatcatccgttaaactgagagagacacgtaatccaaaaattcttgcacttcacaagaacacttaatggatcaaaacttaatttgtaagggataattatgtttaaaatgcacacacttagaagttaatgtcccacctctgaggcagtgtggtacactgatagctgagtgagctccagagatgtctggagaatctactgtttgctatagttaccttattaacttaccaagacagtgatgcaagtgaccagaagggtgaacattcaacttccacatgaagcaaattgaattttgtacatatgacattttctattactgacccccaccccctaaaaaaaatcacagcttaaaaaaaagcatgatatctttggcagatatggatctattcaacaaatcagggttgggaacaaacaatctgaaaactgaaggaagtccttaagaactataaggacaacactgatgtcaaaatgcatgtaacctatcagatttttcattaaaataccaacaaagcatttcaaaagataggcccaa

SEQ ID NO: 42024 - DNA, 601 bp, Human
tgccagtctaaattaaagaaaagggctgggcacagtggctcacaccggtaatttgagcactttgggaggcagacggactacttgagctcaggagatcgagaccagcctgggcaacatggcgaaaggccgtctttactaaaaatacaaaaaattagccgggcatggtagcacacgcctgtaattccaactactggggaggctgaggcacgagaatcgcttgaacccgggaagcgaggttgcagtgggccaagattgcaccactgcactccagtctgggtgacagagcaagactccgtccagaaaaaaaaaaaaaaaaaaaaaaaaaaaaaggtgaataaagacaacattgataggggtgaaactaagggaaaaaagaaaggggatggtcatgggacgcgctctagcagggtggcaatctttagatggttattaagaaatgggatgaaaaaagtagaaactgatgggtgtgaagacaacagtgactccatcttgcatgctaatctaccatgttcacttttgattaacctcagtcccacgaatgcctgctgatttctactttacttgctgtccttagtgtaggaacatgtacccactataaatc

SEQ ID NO: 42025 - DNA, 601 bp, Human
gtttacaactaatttttggaagacagagctcagaagcgtaactctgttcttcctactgccaacttttgagtcagcgaatttttttaaataaaaaactcaaacaggaggaatacagattactacataatgacaatgttattttacaagatgtatgaacaaatgccaacgtaatcaccatgaaggaggatatgaatcaccgcagcatttatgaatatgagaaaactgcataggtgaagactactactcccagattcaggaggctgctgctttatttccccctttggcaacaaaagggaaaaakaaaacaagtatcaggccacttcctggatatttgacacctgatctgaagaaagataaaaagcatattaattccctaaaaataacataccaattaaaggttaaaaacagaacttctagtgaaggagaaagacctgtgaaacacaaagcagtttatccatgcgttatcctgtttatatacagggtggtgacttgagctggtgactgaaaatgacccactttccttaaatgaataattcctgtaagatgtataaaacactcattagagggcaaaatatgcagcatacacatctcttaccttttg

SEQ ID NO: 42026 - DNA, 601 bp, Human
taaatattttgaaaaaaaatagtagactccttaaattcatttttcaaacctctcactgagataaaactgtttttaaatctctctggcaaagtaaaaggcaactaagtttacaactaatttttggaagacagagctcagaagcgtaactctgttcttcctactgccaacttttgagtcagcgaatttttttaaataaaaaactcaaacaggaggaatacagattactacataatgacaatgttattttacaagatgtatgaacaaatgccaacgtaatcaccatgaaggaggatatgaatcmccgcagcatttatgaatatgagaaaactgcataggtgaagactactactcccagattcaggaggctgctgctttatttccccctttggcaacaaaagggaaaaagaaaacaagtatcaggccacttcctggatatttgacacctgatctgaagaaagataaaaagcatattaattccctaaaaataacataccaattaaaggttaaaaacagaacttctagtgaaggagaaagacctgtgaaacacaaagcagtttatccatgcgttatcctgtttatatacagggtggtgacttgagct

SEQ ID NO: 42027 - DNA, 601 bp, Human
ctcttccactctgtaccctaactcacttcagcctctcccttcactcagtagataatgtatttcctacttcatagagcaaataaacgcctttacaattaaaaatgatttccccaaatctgtacatccctccagttaccaatctttcttttccctcttcaagctaactttgtcagattcctaatctctgaacccactgtaatctagctttagtcacttatatcactccctcaaaattgctcttgctaatcttacccacagccctattgtgcttctaaatctaatgacatttttcaattctcaytgtatttgttcctttggtaacatttgtgacaatactcatccttttggaaactctctcaaacactcattctccaggaattcctctagtatctcaggctgctttttcttggtctcctaatttacagcctccaacactatattctgcctccctctcaggacagcagcaacatttcctcaagaacgtatttcctctaggcctaaggctagtgcgtatgctcttctctctgcccagaatattctttttcactttgcaaaattaagactctggatatcaccttagttaccacttctttagagaagc

SEQ ID NO: 42028 - DNA, 601 bp, Human
gtacacctgaaagtgacggggagaatggaaacaggctgaaaaacactattcaggaaattatccaggagaatttccccaacctagcaaggcaggccaacagtcaaattcagaaatacagagaacaccacaaagatacttctcgagaagagcaaccacaagacacgtaattgtcagattcaccaaggctgaaatgaaggaaaaaatcttaagggcagccagagagaaaggtcgggttacccacaaagggaggcccatcagactaacagtggatctctctgcagaaaccctacaagcaagaagrgagtgggggccaatattcaacattcttaaaaaaaagaattttcaacccagaatttcatatccagccaaactaagctttctaaataaaggagaaataaaatcctttgcagacaagcaaatgctgagagattttgtcaccaccaggcctgtcttacaagagctcctgaaggaagcactaaacatggaaaggaacaactggtaccagccactgcaaaaacatgccaaattataaagaccatcgatgctatgaagaaaccgcatcaattaacgagcaaaataaccagcgaacatcataatgaca

SEQ ID NO: 42029 - DNA, 601 bp, Human
agcctcctgagtagctggtactacaggtgtgtgccaccacacccagctaatttttgtatttatagtggagaaggggtttcaccacgttggccaggctggtctcgaactcctgacctcaagtgatctgcccgcctcggcctctcaaagtgttgggattacaggcgtgtgtcactgtgcctggcctaaaatatcttttttaagttaacaaaggttatgacattatggcagattgcattttccaaatataatacatcccaatatgtcccatcctacatgctctttttatgtgacgctgacattygtctgcagtggtagggtctgtgtgccctctccttgaagctgggcagacctttgtaattgctgtaacagaatacagcaaaattaacatctgtgacttctgagggtaggtcataacaataccatgtacttttgcattgttcttttgggatgcttcctcttgcaatccagtcactatgctgtgaagaagctcagccacatgtattggccagactttaggcattctggctgacagccagcctcaaccttagccttcaagataccccagtgccaggcatttgacggcaaatacatgtcagatttg

SEQ ID NO: 42030 - DNA, 601 bp, Human
cctttcactgatgctttaatccaggccattatcatctcccacttagacaacagaaaacagctttctaaactctctctcaccaactagcctctcctcattctagtccagtggttcttaaacactataatcataaggggagattttaaaatcctgatcaggcctcactccttaaccttgtaatgtcctgtatgtaaccactcaacatgtggctagtaacacagattgaaatggatacatggggctaattaatagatattaaaactaattttacctgtttctttttactttttaaaaatgtggacctgcacttgcatgtccctgactgagagtgagtgcctctttaaattttgcacattaggtgctactcgagcctcacattagaacctggtatctaacatgtttggaaaactgctgttctatcttcaggaccaaatttaaagaaaaagctttgaagaagactccccaaacttaggcagtcaccatcttctgtttacatttttgtattaatatgtactacattataatccattagtatgtctcaatcagattattaaccctttgaggggaagatattgtcttattcaattttgagtcagtcatt

SEQ ID NO: 42031 - DNA, 601 bp, Human
cctcaagaatggatgggcctcgtctcctgtatttttggtagattctgatttgcatacaaatctcttaacatgcatgtcaatctttgaaagagagatctatagaaagctggtcagatcccaactctcattcctcacaaacaggctggataacatttgtgtaaatcagttcagcagcggttcctgctgtcctcattattttcagagaaatcagggcaaagcatactgatgaataaaaatagacagtgttccctgtttccctgcccctgcagtcacctctatcagggatgtagagtgcggaacrcaccttccttcttcatctgaatgcttcatcccgggaccaagaaaagaaaactacaccttagatacacactccactcccaccagggccactgcttttcgtccaaagaggtactctttacagcactcaattactacgtctcctggttctggctacagttttgaaacatggaaagtttgacaaggcatatattgacttttacaaagcctatagtataatgaaaatgcttgccagctaagcaccgctgagttttcctggcagttctgtaagtcagtggggaccattaatggtctgtatgctgag

SEQ ID NO: 42032 - DNA, 601 bp, Human
atgcagtgattaaatgatattacttctcacaactttaacataaagtattcctgaatgataataattctaataatggttgacactcaatgcgtgcttgctatgctgtttttttgtttgtttgtttgttttttggttttttttaagacagagtctcactcactctgttgtccaggctggagtgcagtgacgcaatcttggctcacagcaacctccgcctcccaggttcaagcgattctcctgcctcagcctcctgagtagctgggactacaggtgtgtgccacaatgcctggctaattttttrtatttttagtagagacagggtttcaccgtgttagccaggatggtctcgatctcccaacctcgtgatctgcccatctcagcctcccaaagtgctgggattacaggcatgaaccaccgcgcccggcctactatgctgttttaagcattttatacatgtagccctaggaagtgaatactattattttatctccattttacagatgtggaaatggaggcacagagaggtcaagtagggagagtaattttcccatgatcctacaccagtacaggatggattaaggaccctagtaatatagtttca

SEQ ID NO: 42033 - DNA, 601 bp, Human
gatctcatgggagaggacaaataatactcagcttactttcattaacggtggagagaaaggatcagtgacaatccagagaagattggctctgtgtgaattggggccctaaggaggcctgtggtggttcccaaagtgggtgtgttcaggagaaagaaggacaggcagatgctgccagtggctggtgtcacttggtctcattagagagagtcaccaaacagatcattgatgggattagattcccagcagttctagctttccccaccacctgtcatgtcaaattctttcatttgagggagaggayccaatatgcagagagtgctgatgttaccttcattgcagctcaattcccaccaacagtggggttgtaagaagcagcctggagagaccagaaccggagttggcaatctatagtccgcgggccaaatccagtccaccacctgattttgtaaataaagtttcattgggacatagccacattcattcatttatgtactgcctatggctgcttttgtggtacaacagcagagctgagtagtgggaacagaccaaacgacacgcaaagcctaaaatatttattatctggtcctttatagaaaaggtt

SEQ ID NO: 42034 - DNA, 601 bp, Human
ttttacaaacggcttaagttgatctagccatggttgtttgaatttcaagaccatgtttatcattgagtctctttactttgtacttttaactcgaagccaacttactcttaaggtgactttaatcagtgtagactatcagcttcttcactgaaatgctgacactgtttctaaaggttgagttctttaaaagggaggcacgcagcatccataaaacggtaattgcctctcaagtagccttggtgcttatgattatccttgagatggtccacacccactcctccagccttactctctgtgccartggtgggaacagtaagtaaagacagcattgcagagtgcttccaaacatgggcttggggatcagactgaataattgattttagggcttgactatcctacttacaaattgtataatcctgggggagttacttcacttttccaaacctaacattaggatccatggaaatcccactgcactgggccaggtatatggtaaaccttgaataaactgaaactattattgtcatcctgataataaaccttacaagatattctcaagaagttcacagacttacaagctggacagagacttagaagtcat

SEQ ID NO: 42035 - DNA, 601 bp, Human
tcataggctaaattatagccataagaaaaattccttataatttgaatttgataaaaatatgtagacctgtacctcttggtttttattccattggccagaaaattgggtcatattttgtctctttcgctgacttactctgtgtttaaacacaaatgaaatactttctcagcgactaatttttctacctacaaattgagtgtatttgctacacaaaataggcttaaaatacaagctaaacttttatgaaataataaacaaacagaaaatgtttaacaccaatgacctagagttgatattaggwtaggcttccttctctctatagattctatataaatgcaaaggaagcagtctcttttttttccttttgtaatgcaatcctttgtatttcttttccctccctgaggtttattcattttagagatttaaaaatatgtccctgatgcagcagacctggtgcatcactttcctaagctatatataatttgttacatcctccaagttgggaatggaaaaaaaatctactagatcatcttttgccggaataggatacagttccctgatagaagacctatctgatgtgaaattaatactacacttgatc

SEQ ID NO: 42036 - DNA, 601 bp, Human
tgtaggacagtaatctttgagtgacaagtcataggctaaattatagccataagaaaaattccttataatttgaatttgataaaaatatgtagacctgtacctcttggtttttattccattggccagaaaattgggtcatattttgtctctttcgctgacttactctgtgtttaaacacaaatgaaatactttctcagcgactaatttttctacctacaaattgagtgtatttgctacacaaaataggcttaaaatacaagctaaacttttatgaaataataaacaaacagaaaatgtttarcaccaatgacctagagttgatattaggataggcttccttctctctatagattctatataaatgcaaaggaagcagtctcttttttttccttttgtaatgcaatcctttgtatttcttttccctccctgaggtttattcattttagagatttaaaaatatgtccctgatgcagcagacctggtgcatcactttcctaagctatatataatttgttacatcctccaagttgggaatggaaaaaaaatctactagatcatcttttgccggaataggatacagttccctgatagaagacctatc

SEQ ID NO: 42037 - DNA, 601 bp, Human
ggtccaggccagagactgagtcattagatcccactccctccctaagactgcacaaatcctgagagtttatttctgcttttatggtaaagaaataccatcactagctccacccttctgcccaatgagctctatgagaaaggtatggtacagttcaagaaatactccatctgttggacaataagttgttacaaaaaaaaaaggaagaaagacaaaaaacagaaacatccctggggtctttgtgtctttgtggatacatcactacctccatcctatgaaaaatactagttggccatttgtataygtggctaattataaagtaggtgttcacacaccaagctgtatcagttcttgtctattttagaatgcactgcaaccaacagattagatacaaggcaagagagagcaaagtgcttccccagtcccctgagatacttgtgtggaggaaagtaccagttggacaaagaagaaccaggggccatctgtaccacaggtggaaaatgaaatgtgagcctccaaaacagctgttacatcagtcaatttagtgagaaaagtgggtcaagctactttctgactgattgccatggtagtgacagacacagtt

SEQ ID NO: 42038 - DNA, 601 bp, Human
ccccaacaccaacagaaagcatgcaatccatctgtaaggtgtggtgggaggaagggattgaagcaatataacaagtaggtgatagcactaactttgaaggcagactccatttttagaatacatgatagatggggaaactcagtctctctaagactcatctcaaaaatgagaacaataattgagtatcatgaggcttaaaagaaacaatggacataatgttcttcgcacagtatcttgctcatggtaagtgacgaataaatgtttctagtgtgcagcatgtagtgaacactcaataaatatygattgaatgaatgggtgagtgaccaaatgaatgaatggacaatcaaccagataaaacctgttttatgttcctaatatagattcctctcctctagacttaaatttctgcttaagaaatggaatagattgtacattgcgggcttagtaatgttggaaaagggtagatttgctcccagggtctcctaggagaaagagtgaagacttgggccaattccacactcccctgctggcagaattcccataccagtccacaggagccaggtggagggttgtctgaaccctcaccaagggatcattattg

SEQ ID NO: 42039 - DNA, 601 bp, Human
agaatcattaaagtcttctctgagaaaataaagtaacaaaaatgtgttctggatattctggtacattttcaatatttgattgagttgttattcttccttgttccctgtaatcacacagccaaggctactgaatcaaccccactgctgagtaacactgcgagatcctctctaagctcattttaaaaccgcattcctctgaatcttcaaaaccaaattcttctggaactggaactgaggttaaatttaggtcaacatggttttcataaaagtaaaaacctttaaagtttgcattaaaaattcrtgtgtccaactgaacagccttggttgggtgatgataataaatattaccaaaagttaagttcccctctccaggctttctaacaaggaagttctgaagtttcatccctaccatattgaaagatttcatctcaacttggcaacacaagcaggactgagtgtgatactcagtcatcaatttgttccattctgtcatcagtagcaacaagtgcatgtagccacatgtcaggttagttcctgctcacatcaatttgtccccatccaggttcctgggattcagtctatggtcatagatccactctgt

SEQ ID NO: 42040 - DNA, 601 bp, Human
actgaagtctcgaaatttcaaaatatctgcaggagaaaaataagtcaaaagcaaaacagcttgctacaaaaagtaaagatcattccttggcttaaaacaatgactgtactcatttggaattcagatcaattaccctgacaacttagattttcacattactgtaagaataaggaaaaataggtctctctgagtggttttacattagaatttgttaaggagagaagaatcattaaagtcttctctgagaaaataaagtaacaaaaatgtgttctggatattctggtacattttcaatatttgmttgagttgttattcttccttgttccctgtaatcacacagccaaggctactgaatcaaccccactgctgagtaacactgcgagatcctctctaagctcattttaaaaccgcattcctctgaatcttcaaaaccaaattcttctggaactggaactgaggttaaatttaggtcaacatggttttcataaaagtaaaaacctttaaagtttgcattaaaaattcgtgtgtccaactgaacagccttggttgggtgatgataataaatattaccaaaagttaagttcccctctccaggctttct

SEQ ID NO: 42041 - DNA, 601 bp, Human
tactgaagtctcgaaatttcaaaatatctgcaggagaaaaataagtcaaaagcaaaacagcttgctacaaaaagtaaagatcattccttggcttaaaacaatgactgtactcatttggaattcagatcaattaccctgacaacttagattttcacattactgtaagaataaggaaaaataggtctctctgagtggttttacattagaatttgttaaggagagaagaatcattaaagtcttctctgagaaaataaagtaacaaaaatgtgttctggatattctggtacattttcaatatttkattgagttgttattcttccttgttccctgtaatcacacagccaaggctactgaatcaaccccactgctgagtaacactgcgagatcctctctaagctcattttaaaaccgcattcctctgaatcttcaaaaccaaattcttctggaactggaactgaggttaaatttaggtcaacatggttttcataaaagtaaaaacctttaaagtttgcattaaaaattcgtgtgtccaactgaacagccttggttgggtgatgataataaatattaccaaaagttaagttcccctctccaggctttc

SEQ ID NO: 42042 - DNA, 601 bp, Human
ctactgaagtctcgaaatttcaaaatatctgcaggagaaaaataagtcaaaagcaaaacagcttgctacaaaaagtaaagatcattccttggcttaaaacaatgactgtactcatttggaattcagatcaattaccctgacaacttagattttcacattactgtaagaataaggaaaaataggtctctctgagtggttttacattagaatttgttaaggagagaagaatcattaaagtcttctctgagaaaataaagtaacaaaaatgtgttctggatattctggtacattttcaatattwgattgagttgttattcttccttgttccctgtaatcacacagccaaggctactgaatcaaccccactgctgagtaacactgcgagatcctctctaagctcattttaaaaccgcattcctctgaatcttcaaaaccaaattcttctggaactggaactgaggttaaatttaggtcaacatggttttcataaaagtaaaaacctttaaagtttgcattaaaaattcgtgtgtccaactgaacagccttggttgggtgatgataataaatattaccaaaagttaagttcccctctccaggcttt

SEQ ID NO: 42043 - DNA, 601 bp, Human
actactgaagtctcgaaatttcaaaatatctgcaggagaaaaataagtcaaaagcaaaacagcttgctacaaaaagtaaagatcattccttggcttaaaacaatgactgtactcatttggaattcagatcaattaccctgacaacttagattttcacattactgtaagaataaggaaaaataggtctctctgagtggttttacattagaatttgttaaggagagaagaatcattaaagtcttctctgagaaaataaagtaacaaaaatgtgttctggatattctggtacattttcaatatwtgattgagttgttattcttccttgttccctgtaatcacacagccaaggctactgaatcaaccccactgctgagtaacactgcgagatcctctctaagctcattttaaaaccgcattcctctgaatcttcaaaaccaaattcttctggaactggaactgaggttaaatttaggtcaacatggttttcataaaagtaaaaacctttaaagtttgcattaaaaattcgtgtgtccaactgaacagccttggttgggtgatgataataaatattaccaaaagttaagttcccctctccaggctt

SEQ ID NO: 42044 - DNA, 601 bp, Human
tccatttttcactcatcaggtcagcaagaggcaaagacagatcacattgccctgatcagatgctaggctatgcattttccactgaatggatttttaatgtggcacttgcttgccttcttacccagggccaataaaaacagaacatttgctattccgtggagaatatgaagcttctctgacttttttggttttcttctgcatccacttattatcacagtagtgttttacatgattaatgggctaatcatgttctaatgaaacttacactttagaacctggattccagaatcagaaagcagaktcttgctttgtgagttattttggaagtcgctgcagactgtactgttccctttgctattttaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaaggtgagaaactgcttcttcttcagagtggggatggggaggggggaataaagataaagatttccaat

SEQ ID NO: 42045 - DNA, 601 bp, Human
aataaaagttgccattgatttgcctaaaactgtgtcaaaagattttttgtaggataactatggatgtctctcaaataaaatttaatataaagcccataatcactgaaatatataaagataattgctattataagagaatctcagacagatgactttatagctcctgtaataagagatctttaaacagtttatattttaatttataaagttacacaagttctgggcagataatttagaatataacagaaaagtataacaaaaaaattaaaatcccctctgatttctcatcagtgataacccttttttttttttttttttgagataaagtcttgctgtgtcacccagactggagtgcagggggtgcattcttggctcactgcaacctctgcttcatgggctcaagcgattctacaacctcagcctcctaagtagctgggaccacaggtgcaagccaccaacgccgggctaatttttttgtatttttgtagagatgggatttcgccatgttgcccaggctggcctacagctcttgagctcaaagtgatgctcccgcctgctgcctcggcctcccagagtgctgggattacaggcctgagccaag

SEQ ID NO: 42046 - DNA, 601 bp, Human
ccggatggctcctggcaatcattgaggttgttgggcttacagttgttattactctgatccatttctgactccatctttacaagactttttcctctgtttttgtcctaaattgatcaaatataaaataattaacaaataatttatctaatgatggagtagtatcacaaactaggagaaatattatgccttcaccaagccttcctcagacactttttgtgtgacctgcaatggtatattgatgatactgacataggtgggtaggctcattcaattttggaggagggtgtgagaatgctttacrtagtccttgtacgatgacagcagagaaagttttgttgtttaagaatggggactcatgtttccttctccccttgactactgcaatcagcactgttctgcattgagatattcatgtttctgtggagatggaggtggggagcagagggacagttttcctttcatgttaaaggatatttgctcacatttttttggcaacaatcaataaaagaaaggactcatttctaaaagattcgctctgaagttctcctttatgcttttacctccatttttttccagaacacagaaaagtagatagctcaac

SEQ ID NO: 42047 - DNA, 601 bp, Human
gagggtgtgagaatgctttacgtagtccttgtacgatgacagcagagaaagttttgttgtttaagaatggggactcatgtttccttctccccttgactactgcaatcagcactgttctgcattgagatattcatgtttctgtggagatggaggtggggagcagagggacagttttcctttcatgttaaaggatatttgctcacatttttttggcaacaatcaataaaagaaaggactcatttctaaaagattcgctctgaagttctcctttatgcttttacctccatttttttccagaacrcagaaaagtagatagctcaaccgtggcatgcatgactatgatcaggcaagattgagttcaaaaaggaagactaaagcaatagactacaaggatatactatactcctgaacatcacatcaatacatgaaaaccatgagcaccaaaaccccctaagttctgtaaagtggttttataataactcttcaagttagatttgacattagagtaatagagctgatgttccgcatcctatccacctacctacctgcgttcacataggctaaaccatgacaaccaaaacaaggagaatatttgtacctt

SEQ ID NO: 42048 - DNA, 601 bp, Human
ctgttctgcattgagatattcatgtttctgtggagatggaggtggggagcagagggacagttttcctttcatgttaaaggatatttgctcacatttttttggcaacaatcaataaaagaaaggactcatttctaaaagattcgctctgaagttctcctttatgcttttacctccatttttttccagaacacagaaaagtagatagctcaaccgtggcatgcatgactatgatcaggcaagattgagttcaaaaaggaagactaaagcaatagactacaaggatatactatactcctgaacrtcacatcaatacatgaaaaccatgagcaccaaaaccccctaagttctgtaaagtggttttataataactcttcaagttagatttgacattagagtaatagagctgatgttccgcatcctatccacctacctacctgcgttcacataggctaaaccatgacaaccaaaacaaggagaatatttgtacctttacatgttcctcttgattttggaacaagtcattccaaataccatcagctcaaatgactggattttctaatggctattcaaaatttatctaggttaagaattgaaaactgtt

SEQ ID NO: 42049 - DNA, 601 bp, Human
caacaatcaataaaagaaaggactcatttctaaaagattcgctctgaagttctcctttatgcttttacctccatttttttccagaacacagaaaagtagatagctcaaccgtggcatgcatgactatgatcaggcaagattgagttcaaaaaggaagactaaagcaatagactacaaggatatactatactcctgaacatcacatcaatacatgaaaaccatgagcaccaaaaccccctaagttctgtaaagtggttttataataactcttcaagttagatttgacattagagtaatagakctgatgttccgcatcctatccacctacctacctgcgttcacataggctaaaccatgacaaccaaaacaaggagaatatttgtacctttacatgttcctcttgattttggaacaagtcattccaaataccatcagctcaaatgactggattttctaatggctattcaaaatttatctaggttaagaattgaaaactgttatgtaaacctattataaaactcattcacttttaaagcagatagctgagaaaacaacgtagacactccatttctcacacctgatctgctcaattaccctgata

SEQ ID NO: 42050 - DNA, 601 bp, Human; identical to SEQ ID NO: 36673

SEQ ID NO: 42051 - DNA, 601 bp, Human; identical to SEQ ID NO: 36674

SEQ ID NO: 42052 - DNA, 601 bp, Human; identical to SEQ ID NO: 27288

SEQ ID NO: 42053 - DNA, 601 bp, Human; identical to SEQ ID NO: 27289

SEQ ID NO: 42054 - DNA, 601 bp, Human; identical to SEQ ID NO: 27290

SEQ ID NO: 42055 - DNA, 601 bp, Human; identical to SEQ ID NO: 27291

SEQ ID NO: 42056 - DNA, 601 bp, Human; identical to SEQ ID NO: 27292

SEQ ID NO: 42057 - DNA, 601 bp, Human; identical to SEQ ID NO: 27293

SEQ ID NO: 42058 - DNA, 601 bp, Human
caggctggtctcaaactctcaggtgatccacctgccttggcttccaaaagtgctgggattacaggcgtgagccaccatgacctgccaaattttttctttttctttttctttttcttttttatttttttgagatgggagtttcgctcttgttgcccaggctggagtgcaatggcgcgatctcggctcactgcaaccttcgcctcctgggttcaagtgattctcctgcctcagcctcctgagtagctaggattacaggaatgcgccaccatgcccggctaagtttgtatttttagtagagacrgggtttctccatgttggtcaggctggtctcaaacttccggcctcaggtgatccacctgccttggcctcccaaagtgctgggattataggtgtgagccaccatgcccggccaaattttttatttttaatgacatggccttgctctgtcacccaggctcaagtgcagtggtatgatcatagttcactgtaactttgaactcctgggctcaagcaatgttccttcttcagcctcctgagtagatagaactataggcatgtgccactatgcttggctagtttttcaatattttgtagagataag

SEQ ID NO: 42059 - DNA, 601 bp, Human
gacataagaatgcagatcttatttatttatttttattttattttattttatttttttgagacaagagttttgctcttattgcccaggctggagtgcaatagcatgatcttggctcactgtaacttccgcctcctgggttcaaggcattctcctgcctcagcctcttgagtacctgggattacaggcatgcgccaccatgcctggctaatttttgtattttaatagagacggggtttcaccatgttgatcaggctggtcttgaactcctgacctcaggtgatccgcctgctgcggcctcccwaagtgctgggattacgggtgtgagccactgtgcctggccaagaatgcggatcttaaaggcgtggttcttaaccttttgtggaccaagatcacttctatcatctgatgaaaacattcatccttacctaaaaagatgcatataaacatgcccatacaatattatgtataatttctagaggttcctggattccctgcagccctggaagctccaggactttcaggttgcgtctctatgttgaaggggaaagaaacagcttaaataaatgtgatcccattgagttcagtgaatcttttctcctgc

SEQ ID NO: 42060 - DNA, 601 bp, Human
aggtggatcacttgaggttaggagcttgagaccagcctggccaacattgtgaaaccccgtctctactaaaaatacaaaaaattagccaggcatggtggcacatgcctgtaatctcagctactcgggaggccgaggcaggagaattgcttgaactacttgagaggctgaggtaggagaattttggctcattgcaaccactgcctcccaagatcgcgccacttcattccagcctggaaaacagtgagactccgtctcaaaaaaaataaaaaaacccacagaggctagatagatgaatgacagrtcaatactattatgaagggaagcaaaggtgttttggagtttatcctaaaaatagaagttctgattaggataatcagccatgccattctaccaaatggtaaagttactgcccctatcattgagtttaccagcctgcttggattaaaacaatctggattgtaaaatgagggcaaatcatactttgtgacttggaaagtaaataaggaaaacaagtaaatagggaaagtaaatagagaaacaagtttccatgaactcatatcatttttagtagtaatagcatatcatttctgagagaggaaaa

SEQ ID NO: 42061 - DNA, 601 bp, Human
aaccccgtctctactaaaaatacaaaaaattagccaggcatggtggcacatgcctgtaatctcagctactcgggaggccgaggcaggagaattgcttgaactacttgagaggctgaggtaggagaattttggctcattgcaaccactgcctcccaagatcgcgccacttcattccagcctggaaaacagtgagactccgtctcaaaaaaaataaaaaaacccacagaggctagatagatgaatgacagatcaatactattatgaagggaagcaaaggtgttttggagtttatcctaaaaayagaagttctgattaggataatcagccatgccattctaccaaatggtaaagttactgcccctatcattgagtttaccagcctgcttggattaaaacaatctggattgtaaaatgagggcaaatcatactttgtgacttggaaagtaaataaggaaaacaagtaaatagggaaagtaaatagagaaacaagtttccatgaactcatatcatttttagtagtaatagcatatcatttctgagagaggaaaatagtgaaatcagttctttaggaacttgatgggaaacagtggtttcctatcac

SEQ ID NO: 42062 - DNA, 601 bp, Human
tcagtattagctagtttcgattatttatatatttataggttgcctaggaggaaggtaggcatttaagattatcattaggttcattataaaaatgatgataattcagtaataatgatagatttttattgccagtgttttcaagtatattattttgatgcttgaagccactccataagataagtggggaaaatgtattacctaccttcattatatgttaccttcactatataagttagaaaatggaaacccagggaggttaaacatcataaacaaggttccacaggtaccaagagtcaagatwtgaacacagatctgcttgttcccagtctggtacactttcattaacactatgcatgcttcctcctgaaacattttcaatgtatacttgcccataagaagacaatttaatggactatttatttcagaagcacacattactatggtaacaaagccctccctagcaataagatcaccagcacattttcccactgaagtttagattggattatgtaatcactaccaagaggagaataattatcaaaatttgctggcctggtcttcaaagtggttatgcagttccgtgaagctaatgtgcattttt

SEQ ID NO: 42063 - DNA, 601 bp, Human; identical to SEQ ID NO: 27294

SEQ ID NO: 42064 - DNA, 601 bp, Human; identical to SEQ ID NO: 27295

SEQ ID NO: 42065 - DNA, 601 bp, Human; identical to SEQ ID NO: 27296

SEQ ID NO: 42066 - DNA, 601 bp, Human; identical to SEQ ID NO: 27297

SEQ ID NO: 42067 - DNA, 601 bp, Human; identical to SEQ ID NO: 27298

SEQ ID NO: 42068 - DNA, 601 bp, Human; identical to SEQ ID NO: 27299

SEQ ID NO: 42069 - DNA, 601 bp, Human; identical to SEQ ID NO: 27300

SEQ ID NO: 42070 - DNA, 601 bp, Human; identical to SEQ ID NO: 27301

SEQ ID NO: 42071 - DNA, 601 bp, Human; identical to SEQ ID NO: 27302

SEQ ID NO: 42072 - DNA, 601 bp, Human; identical to SEQ ID NO: 27303

SEQ ID NO: 42073 - DNA, 601 bp, Human; identical to SEQ ID NO: 27304

SEQ ID NO: 42074 - DNA, 601 bp, Human; identical to SEQ ID NO: 27305

SEQ ID NO: 42075 - DNA, 601 bp, Human; identical to SEQ ID NO: 27306

SEQ ID NO: 42076 - DNA, 601 bp, Human; identical to SEQ ID NO: 27307

SEQ ID NO: 42077 - DNA, 601 bp, Human; identical to SEQ ID NO: 27308

SEQ ID NO: 42078 - DNA, 601 bp, Human; identical to SEQ ID NO: 27309

SEQ ID NO: 42079 - DNA, 601 bp, Human; identical to SEQ ID NO: 27310

SEQ ID NO: 42080 - DNA, 601 bp, Human; identical to SEQ ID NO: 27311

SEQ ID NO: 42081 - DNA, 601 bp, Human; identical to SEQ ID NO: 27312

SEQ ID NO: 42082 - DNA, 601 bp, Human; identical to SEQ ID NO: 27313

SEQ ID NO: 42083 - DNA, 601 bp, Human; identical to SEQ ID NO: 27314

SEQ ID NO: 42084 - DNA, 601 bp, Human; identical to SEQ ID NO: 27315

SEQ ID NO: 42085 - DNA, 601 bp, Human; identical to SEQ ID NO: 27316

SEQ ID NO: 42086 - DNA, 601 bp, Human; identical to SEQ ID NO: 27317

SEQ ID NO: 42087 - DNA, 601 bp, Human; identical to SEQ ID NO: 27318

SEQ ID NO: 42088 - DNA, 601 bp, Human; identical to SEQ ID NO: 27319

SEQ ID NO: 42089 - DNA, 601 bp, Human; identical to SEQ ID NO: 27288

SEQ ID NO: 42090 - DNA, 601 bp, Human; identical to SEQ ID NO: 27289

SEQ ID NO: 42091 - DNA, 601 bp, Human; identical to SEQ ID NO: 27290

SEQ ID NO: 42092 - DNA, 601 bp, Human; identical to SEQ ID NO: 27291

SEQ ID NO: 42093 - DNA, 601 bp, Human; identical to SEQ ID NO: 27292

SEQ ID NO: 42094 - DNA, 601 bp, Human; identical to SEQ ID NO: 27293

SEQ ID NO: 42095 - DNA, 601 bp, Human; identical to SEQ ID NO: 42058

SEQ ID NO: 42096 - DNA, 601 bp, Human; identical to SEQ ID NO: 42059

SEQ ID NO: 42097 - DNA, 601 bp, Human; identical to SEQ ID NO: 42060

SEQ ID NO: 42098 - DNA, 601 bp, Human; identical to SEQ ID NO: 42061

SEQ ID NO: 42099 - DNA, 601 bp, Human; identical to SEQ ID NO: 42062

SEQ ID NO: 42100 - DNA, 601 bp, Human; identical to SEQ ID NO: 27294

SEQ ID NO: 42101 - DNA, 601 bp, Human; identical to SEQ ID NO: 27295

SEQ ID NO: 42102 - DNA, 601 bp, Human; identical to SEQ ID NO: 27296

SEQ ID NO: 42103 - DNA, 601 bp, Human; identical to SEQ ID NO: 27297

SEQ ID NO: 42104 - DNA, 601 bp, Human; identical to SEQ ID NO: 27298

SEQ ID NO: 42105 - DNA, 601 bp, Human; identical to SEQ ID NO: 27299

SEQ ID NO: 42106 - DNA, 601 bp, Human; identical to SEQ ID NO: 27300

SEQ ID NO: 42107 - DNA, 601 bp, Human; identical to SEQ ID NO: 27301

SEQ ID NO: 42108 - DNA, 601 bp, Human; identical to SEQ ID NO: 27302

SEQ ID NO: 42109 - DNA, 601 bp, Human; identical to SEQ ID NO: 27303

SEQ ID NO: 42110 - DNA, 601 bp, Human; identical to SEQ ID NO: 27304

SEQ ID NO: 42111 - DNA, 601 bp, Human; identical to SEQ ID NO: 27305

SEQ ID NO: 42112 - DNA, 601 bp, Human; identical to SEQ ID NO: 27306

SEQ ID NO: 42113 - DNA, 601 bp, Human; identical to SEQ ID NO: 27307

SEQ ID NO: 42114 - DNA, 601 bp, Human; identical to SEQ ID NO: 27308

SEQ ID NO: 42115 - DNA, 601 bp, Human; identical to SEQ ID NO: 27309

SEQ ID NO: 42116 - DNA, 601 bp, Human; identical to SEQ ID NO: 27310

SEQ ID NO: 42117 - DNA, 601 bp, Human; identical to SEQ ID NO: 27311

SEQ ID NO: 42118 - DNA, 601 bp, Human; identical to SEQ ID NO: 27312

SEQ ID NO: 42119 - DNA, 601 bp, Human; identical to SEQ ID NO: 27313

SEQ ID NO: 42120 - DNA, 601 bp, Human; identical to SEQ ID NO: 27314

SEQ ID NO: 42121 - DNA, 601 bp, Human; identical to SEQ ID NO: 27315

SEQ ID NO: 42122 - DNA, 601 bp, Human; identical to SEQ ID NO: 27316

SEQ ID NO: 42123 - DNA, 601 bp, Human; identical to SEQ ID NO: 27317

SEQ ID NO: 42124 - DNA, 601 bp, Human; identical to SEQ ID NO: 27318

SEQ ID NO: 42125 - DNA, 601 bp, Human; identical to SEQ ID NO: 27319

SEQ ID NO: 42126 - DNA, 601 bp, Human
taacaaaggaaagtctaaattcttagtccttttttgtatgcatcatatttgtatcaaagtggtaggagtggtcttctgacacaaaaatgaacaaaatggagacctcattttctagatagaacttgtattccaagactgtcctcaggctactaagtgtgtgaataggaactaattattgaaatttgagtctctcactttatcgataagttgtgatgatctacaaggatacattttctagaccagtgacaaaagtggtttaatttttaatataaattggcatgggcaggaaatgaaaataacracacaactgaagctccagccttggtaaacctttgagtgttggcacacttaaagactgctctcaaaaaagatttaaaaaaaaaaaaaaagactgttctcaggagatggcggggagaccgttatctagttccttgtaatttcaacgaaacaagaaagcttctttaaatacatgtaaaaatgaaaacagtttatttatatttttgtcattaaaaaatacctttcaaatctttatccaaatttggtcaataagtcagtaattttaaatttcactggaattctgtctttcctgaaagagatagcc

SEQ ID NO: 42127 - DNA, 601 bp, Human
tgatctacaaggatacattttctagaccagtgacaaaagtggtttaatttttaatataaattggcatgggcaggaaatgaaaataacgacacaactgaagctccagccttggtaaacctttgagtgttggcacacttaaagactgctctcaaaaaagatttaaaaaaaaaaaaaaagactgttctcaggagatggcggggagaccgttatctagttccttgtaatttcaacgaaacaagaaagcttctttaaatacatgtaaaaatgaaaacagtttatttatatttttgtcattaaaaawtacctttcaaatctttatccaaatttggtcaataagtcagtaattttaaatttcactggaattctgtctttcctgaaagagatagccttattttttatggcagaactgtaccttagtaaattcttacagatttcagtgaatttttaatgtacaaatcgatatcctcagagtatacatctttacccctagtgttcagttctgttgtgtagccagaatgactgtgcagaaaagacttaatagactactattcacagatgctttatttcccaagtgaaccctagttgggtcgatgtaactagc

SEQ ID NO: 42128 - DNA, 601 bp, Human
gctttatttcccaagtgaaccctagttgggtcgatgtaactagcatccagtcaaaatctcaagaactgagacaccaaagaacatctcttgtagacagcatttcccaaatacgatgttggaggaagtctgagtgagcattctgtgtaatatcactgggagagaactcatatgagcttgcaccgtttcccttctatactccatgtgatttttaccatgtataatatcactatattaaaaataattaggactatttcagtcatgttaacttttccaacaaatcactgaatctgagggtgttatktggtacctccataacagtgatcaaccagagattgcctgagactgaaggtgtttctgggatgctcaacctttattactaaccaggaaagactcaggcaaactgagatggacttttcaccccacatacagacaggaggaaaagctgattcttgtataaaagtcaatgcttgtgcctgaactacctctcagccacagtgatcaccagatactacctttggttgctcctccaggttccgagaagtaaagctttggaggtcacaaaattagcaatagaagctgggttccgccatatagattctgc

SEQ ID NO: 42129 - DNA, 601 bp, Human
aaataattaggactatttcagtcatgttaacttttccaacaaatcactgaatctgagggtgttatgtggtacctccataacagtgatcaaccagagattgcctgagactgaaggtgtttctgggatgctcaacctttattactaaccaggaaagactcaggcaaactgagatggacttttcaccccacatacagacaggaggaaaagctgattcttgtataaaagtcaatgcttgtgcctgaactacctctcagccacagtgatcaccagatactacctttggttgctcctccaggttccragaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaaggtactgtgtctatgatgagcttgtgtgcacatgtatttattgtgattgtgtggagatgacaattctatgactggatgagtagttgtgggtgaattttgcttctgggttcaaatttattcacacatactcacatactaa

SEQ ID NO: 42130 - DNA, 601 bp, Human
tttcaccaacagatgaaaatggaaaagtaatatttgacatagtggatctctgtaccacctgggaggtgagtgcttggcggagaggacacagagaaggatgacaaaaagagaaaatctgtttcccaggttcaataggaaagaatggaatatgcaccattagatctagaaattcagaaactttacaagagtagctttggtgagatgaagggaaaaacacaaaaggaatgtttagagagtggggcacaagacttgggggcaaggaggacaggaatctctttccttgcttgtgcattaatctatscagtttcctaaggaagagatagaaattcttactcttgctgcctctatcttcttcccctatttgctgtttgaatttttctttttttgacaatcactgctagctattttcattgtcatactttgaaagttgttgctctcacagttctgtcttgcatttaccgtgatttgcagccaactgcacaaataattcctcacaacccctttctccacaggccatggagaagtgtaaggatgcaggattggccaagtccattggggtgtcaaacttcaaccgcaggcagctggagatgatcctcaacaa

SEQ ID NO: 42131 - DNA, 601 bp, Human
tatgaaaaaaaatccttcaccaaatcaaaatgaagaacaaatattcctcaaagacaaagtttaatacttgcctctaaatatcaatttcctaagagattactataataaccaccaatggtggaggcaaattattttgttctttcttgctctctgattatctcactcattactctggacttggacatttttccttaagatttttaattaattttattaatttttgttagtgctcattcttacccaatgggtagatttttttcttgatgctgaaatctatccaaacatcaccagtgacatttcyttgaaagtagtgcttttgtctttcagacttgcactcacgagtccttgaccaaattcttgctttctggcacaatctgaagcccaaaggctctaagaatcttactgtatcccagatatggaacttgttacatctccttctagttgtcaaaggtctttggaagccaggatctgattcatagatgagcttctgttcagaaatggcatttccatttatacttttagaagatatataaaatttatttctatgaaaaaggttattacttgacaataatatcctcagctcaaatataatgctatactg

SEQ ID NO: 42132 - DNA, 601 bp, Human
agaacaaatattcctcaaagacaaagtttaatacttgcctctaaatatcaatttcctaagagattactataataaccaccaatggtggaggcaaattattttgttctttcttgctctctgattatctcactcattactctggacttggacatttttccttaagatttttaattaattttattaatttttgttagtgctcattcttacccaatgggtagatttttttcttgatgctgaaatctatccaaacatcaccagtgacatttctttgaaagtagtgcttttgtctttcagacttgcmctcacgagtccttgaccaaattcttgctttctggcacaatctgaagcccaaaggctctaagaatcttactgtatcccagatatggaacttgttacatctccttctagttgtcaaaggtctttggaagccaggatctgattcatagatgagcttctgttcagaaatggcatttccatttatacttttagaagatatataaaatttatttctatgaaaaaggttattacttgacaataatatcctcagctcaaatataatgctatactgattattattcagcttccttactttcatcttttc

SEQ ID NO: 42133 - DNA, 601 bp, Human
actcattactctggacttggacatttttccttaagatttttaattaattttattaatttttgttagtgctcattcttacccaatgggtagatttttttcttgatgctgaaatctatccaaacatcaccagtgacatttctttgaaagtagtgcttttgtctttcagacttgcactcacgagtccttgaccaaattcttgctttctggcacaatctgaagcccaaaggctctaagaatcttactgtatcccagatatggaacttgttacatctccttctagttgtcaaaggtctttggaagscaggatctgattcatagatgagcttctgttcagaaatggcatttccatttatacttttagaagatatataaaatttatttctatgaaaaaggttattacttgacaataatatcctcagctcaaatataatgctatactgattattattcagcttccttactttcatcttttcaatattaacataactatttcatataaattgatgcttctctcttttggtcaactgcaggtagaatgtcatccgtatttcaaccggagtaaattgctagatttctgcaagtcgaaagatattgttctggt

SEQ ID NO: 42134 - DNA, 601 bp, Human
ctggacttggacatttttccttaagatttttaattaattttattaatttttgttagtgctcattcttacccaatgggtagatttttttcttgatgctgaaatctatccaaacatcaccagtgacatttctttgaaagtagtgcttttgtctttcagacttgcactcacgagtccttgaccaaattcttgctttctggcacaatctgaagcccaaaggctctaagaatcttactgtatcccagatatggaacttgttacatctccttctagttgtcaaaggtctttggaagccaggatctgwttcatagatgagcttctgttcagaaatggcatttccatttatacttttagaagatatataaaatttatttctatgaaaaaggttattacttgacaataatatcctcagctcaaatataatgctatactgattattattcagcttccttactttcatcttttcaatattaacataactatttcatataaattgatgcttctctcttttggtcaactgcaggtagaatgtcatccgtatttcaaccggagtaaattgctagatttctgcaagtcgaaagatattgttctggttgcctatagt

SEQ ID NO: 42135 - DNA, 601 bp, Human
ctttcatcttttcaatattaacataactatttcatataaattgatgcttctctcttttggtcaactgcaggtagaatgtcatccgtatttcaaccggagtaaattgctagatttctgcaagtcgaaagatattgttctggttgcctatagtgctctgggatctcaacgagacaaacgatggtaataaaaacaatgggacctttacataaaccttcattttgcagaaaattttttagtcagagcatcctcagtttcctgtagttaagtttcaagtggctcatggagaggaaagagaattgcrtttctgacgagatcttggatgatgctgatggtgatgctcgggggcctcgcttgagaagctccggtgcagagtggacgccttagtctgtttagggagccgcctaacaaactatcgccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcg

SEQ ID NO: 42136 - DNA, 601 bp, Human
ttgatgcttctctcttttggtcaactgcaggtagaatgtcatccgtatttcaaccggagtaaattgctagatttctgcaagtcgaaagatattgttctggttgcctatagtgctctgggatctcaacgagacaaacgatggtaataaaaacaatgggacctttacataaaccttcattttgcagaaaattttttagtcagagcatcctcagtttcctgtagttaagtttcaagtggctcatggagaggaaagagaattgcatttctgacgagatcttggatgatgctgatggtgatgctcgggggcctcgcttgagaagctccggtgcagagtggacgccttagtctgtttagggagccgcctaacaaactatcgccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagcggggctgtgggc

SEQ ID NO: 42137 - DNA, 601 bp, Human
gtaaattgctagatttctgcaagtcgaaagatattgttctggttgcctatagtgctctgggatctcaacgagacaaacgatggtaataaaaacaatgggacctttacataaaccttcattttgcagaaaattttttagtcagagcatcctcagtttcctgtagttaagtttcaagtggctcatggagaggaaagagaattgcatttctgacgagatcttggatgatgctgatggtgatgctcgggggcctcgcttgagaagctccggtgcagagtggacgccttagtctgtttagggagcygcctaacaaactatcgccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagcggggctgtgggcctcaggtctcctgcacagtgtccttcacacgtgtgcttcttgtaaggctctcaggaca

SEQ ID NO: 42138 - DNA, 601 bp, Human
ttctgcaagtcgaaagatattgttctggttgcctatagtgctctgggatctcaacgagacaaacgatggtaataaaaacaatgggacctttacataaaccttcattttgcagaaaattttttagtcagagcatcctcagtttcctgtagttaagtttcaagtggctcatggagaggaaagagaattgcatttctgacgagatcttggatgatgctgatggtgatgctcgggggcctcgcttgagaagctccggtgcagagtggacgccttagtctgtttagggagccgcctaacaaactaycgccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagcggggctgtgggcctcaggtctcctgcacagtgtccttcacacgtgtgcttcttgtaaggctctcaggacagccttgggccagct

SEQ ID NO: 42139 - DNA, 601 bp, Human
tgcaagtcgaaagatattgttctggttgcctatagtgctctgggatctcaacgagacaaacgatggtaataaaaacaatgggacctttacataaaccttcattttgcagaaaattttttagtcagagcatcctcagtttcctgtagttaagtttcaagtggctcatggagaggaaagagaattgcatttctgacgagatcttggatgatgctgatggtgatgctcgggggcctcgcttgagaagctccggtgcagagtggacgccttagtctgtttagggagccgcctaacaaactatcgscagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagcggggctgtgggcctcaggtctcctgcacagtgtccttcacacgtgtgcttcttgtaaggctctcaggacagccttgggccagctcca

SEQ ID NO: 42140 - DNA, 601 bp, Human
ttctggttgcctatagtgctctgggatctcaacgagacaaacgatggtaataaaaacaatgggacctttacataaaccttcattttgcagaaaattttttagtcagagcatcctcagtttcctgtagttaagtttcaagtggctcatggagaggaaagagaattgcatttctgacgagatcttggatgatgctgatggtgatgctcgggggcctcgcttgagaagctccggtgcagagtggacgccttagtctgtttagggagccgcctaacaaactatcgccagcctcagggcctcagcstttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagcggggctgtgggcctcaggtctcctgcacagtgtccttcacacgtgtgcttcttgtaaggctctcaggacagccttgggccagctccatttccctgtatttcccata

SEQ ID NO: 42141 - DNA, 601 bp, Human
agacataacagcatttctgtggtatttcagccaaaaatgcataacctcaattgtgagaaaacactagacaagctgaaattgaggagacacttccaaaataacggatcagtactcttcacaagtataaagattacaaataacaaaagaattgttacaggctgaaaaagactaaagagaaatagccaatgcaatcttgagatctagctaaatctcgagacagaacaaaagaaaatatgcataggaaaacttctgaaattcaattcaggtcatagttcagttattattttttttttggagatattattattattattttttttttggagatggatagcccaggctggagtgcagtggcaagatctcggctcactgaagcctccgcctcctgggttcatgcgattctcctgcctcagcctcccgagtagctaggactataggcattcactaccaagcccagcttatttttgtatttttagtaaaaacagggtttcaccctgttggccaagctggtctcaaacttgtgaccccaagtgatcagctcacctcagcctcccaaagtgctgggattacagacgtttagttatcactattgcatcaacgt

SEQ ID NO: 42142 - DNA, 601 bp, Human
tatggaacctgttggtgacaaaaaaaagaacagcttcagagtgatgggtggacagatgtcagattggagcatgtgaagagtgaacagaaacgggagagagaagtggttgagaatggaacaaggggtttaaactgacttttcactttatctatgaagtttcatttatttaaaacccaggaagaagagtattgatgttatgaacttcttgagaagacataacagcatttctgtggtatttcagccaaaaatgcataacctcaattgtgagaaaacactagacaagctgaaattgaggagacayttccaaaataacggatcagtactcttcacaagtataaagattacaaataacaaaagaattgttacaggctgaaaaagactaaagagaaatagccaatgcaatcttgagatctagctaaatctcgagacagaacaaaagaaaatatgcataggaaaacttctgaaattcaattcaggtcatagttcagttattattttttttttggagatattattattattattttttttttggagatggatagcccaggctggagtgcagtggcaagatctcggctcactgaagcctccgcctcctggg

SEQ ID NO: 42143 - DNA, 601 bp, Human
cccctgtgaagcaatgtgctgtggaggaacatgatcccagagaaacctctaaaacacattcacgttaccaaaaactgagaaaccaagaggacaaacttattaggaaatgatacagtactatagtaagaagaaaacaaaaaagaaaagctacttccaaaggatatcagaccacattaaagcaaaaagtattttggtcacttttacattttgtgggggtaaatggatttgccggtaatccccccacaattatcgtctacaaccatcattcgtataatcctcacaattatggcctgtgatcttstgaggctcaatctttcctaatttgtggttttgtgtatatgacaataaactgataacatctatctatcaagctaatgaattttagggtgggatttgatatcagacaggttttatttcttaaaaccttagagaatgaaaacaaagatctagtatctctatttagttgtcaaaaggtttccaagaactttttagtcctatggtagtgttgtccagagatgcagtccccatcttactccaagcccaacatcacagaaagtatccggggcatttaagcaagggtctgcaaagcctcctccaagtc

SEQ ID NO: 42144 - DNA, 601 bp, Human
taagatttaaaatatgagtttaatttaggtcactagatccaaaaatagaaaaatatccatcagtgcttttattgcttctatttatttcgcaacctatataggagtctcacccttggtatctcaccaaaggccacaacaccatccattctggtaagggttgatttgcttttggttgagtgtgtctagttaaagcaaaggatccaaaggaccttctgcctactaaattgggctcatgggtccaacaagcttgaaaattactgatttaggtccagggtctacggctttctagtccaaagagcascctagcatggagcatcctagattgctattttcagttggcacacccgaccttttcctgttattgaatgtttgttgtcttgctgaaatctctatgatgctgtctgttctatcttcgtcctaataattaacgtgggatctatcatcattttgccttcaaaatccatgctttgatctcaaagcaaattcagtccttggtctttcccccttaaacagcacattacagcataatggtttccatctgttggagtgaaggagtcacgcttacccagaggtccacctgaatctcttaaagagcttttac

SEQ ID NO: 42145 - DNA, 601 bp, Human
cataggtgaggttaacagtgaaaacacagcattgcaggttcttgcagcaatgagacaaagaagccatcttctgtctgtggcatatgtcaactaagcgtttatgaacaaatcttaccgggatgaactgctccagtcggccttggggaaagatgccatagagttttggcccaagtgacctctctgcgagaatggcaaacataacgctctccagaaccatggcctcagccccctaaaacagatggcaacaaatcaggtgtttactgagtgtttgctaagcgccaggcatcagaagcactctcayaggagtgtttcatctgatcctcatgagtattctttcacgtgggcactactgttatcatcatccccattttaaatatgaagaaacagaggttccaaagtcacacatcgtgtcatttgcaggattcatgcttgcaagcactatgctatattgataagatttaaaatatgagtttaatttaggtcactagatccaaaaatagaaaaatatccatcagtgcttttattgcttctatttatttcgcaacctatataggagtctcacccttggtatctcaccaaaggccacaacaccatccattct

SEQ ID NO: 42146 - DNA, 601 bp, Human
caaaattagtcaaacatggtggcacgtgcctgtagtcccagctactcgggaggctgaggtgagaggatcacttgagcctgggaggttgaagctgcagtgagctgagatcaggccacttatacttcactatactgggcaatagagtgagaccctatcttaaaaaaaaaaaaaaaaaaaagcaaatctagaaataacatacggtattaggttgaatcaaatgaaactgccattcttgttggtcaaaaacagtcaaacaccggcggcgtcatatggttcaaacctagtatataacagaattttwaaaaaatcttcactatggctgggtgcagtggttcacacctgtaatcctggtgacttaggaggctgagacaggagaagagcttgaagccaggagagttcaagaccagccagggtaacacagcaagacccatctctacaaaaaaaaatttttaataagctgggtgtgctggtgtgcacctgtactcccagctacctgaaaggctaaggcagaaagatcacttgagtccaggagttcgaggctgcagtgagctatgatcatgctattgcactccagcctgggcaagagagtgagactcccatc

SEQ ID NO: 42147 - DNA, 601 bp, Human
cagttcccaagtttagtgaatattctttcggatttcttccatgtaattttttttttttttttaacaggatcttgctctgtcatccaggctacagtacagtggtgcgatcacagcatactatagccttgaactcctaggctcaagccatcctcctgcctcagcttaccaagtagctgggactacaggtgcacactactatacctggctaatgtttttattttttgtagagatggggtcttgctatgttgcccaggctggtctagaactcctgggctcaagcaatcctcccaccttggcctcycaaagtgctgggattacagacatgagacattgtgactggcctcatactctataaaaataatacaaaacctcattgtctggttgtatcatactttaatgtacctaatactcttgatgctaccttacatttttcagacacactgccagtaattttctaagtatgcacacaaacctcatctgtaacagaacatagcaattcttaccttcttgacagtcattatgacaaaatacaactggagatggagtagattcaagcaatgatctgaaaagaaaggtttcactgttacccatcacgcttctc

SEQ ID NO: 42148 - DNA, 601 bp, Human
cccctgctcacagccctagtcctcgccagacccccaggatcactgtggaacaaagcctggcctcttgctctgctgtcaggacagtacttcccaaatgttctgcatggtggcatgcaggagctcgtgctagccaaacaccaccctcagcagccctgggacttggtttgctgtctgcaggccagctggctgcagcactccagctgggaagctgtgggagtgccctcctggtaagaaaggcaagggagagctcagctgccacaggggatcccctgctttgttcttgcctgcttttccttcccamggagaccacaggcagcattcctacaagactatttgctttagtattggattctgggtcaggagttggtcagccatcagcctggctctgcaggcctgcgttcctgagatccccacactcgacatgatgttcagcatctccgacatcctgctgctggcaccagtgagccaaccttcgctaggttttcagcagctctctctccttaggatttctagtggaggtatagtgtctaggctcttcagcatactttttccatttagagtagcaattacaatgtaaactggagaccagaaaacgtgtatt

SEQ ID NO: 42149 - DNA, 601 bp, Human
catctcctacctgttgtttcttggtgggatacttccggatgtttgctctgaaaaaagggtatttttcatagctataatcatacatccactcacagaagtgatttccaatgtcgaatcccctgaaataagacataagacagtgcacacaatgaggcaaaccgtatgcctggaggctccctgactgcagaagaaagaaaggctgagttccgagcacgccactcctgttgccatctggacttgctgagggagcaggactgtagctgctttaatgacagagagagacaacaggtggttgatcagmatcacagctgactaaagctatacaggtgcacctgaaccactactccagaacattgtgtctcctagaccaggatttatgagaagaaaatgacctctgaagccaaaagaaaatgccaaagtctggactgaatggcatggctgtccccaactagcgctgtctgctaggaacaaagaaggctgtgctgcttcaccacaaccatcaccggccactggacgagaagccactgattccaggtgaagcagcttgcaactcagagcggcattttgacttattttctctaataactgttaattaagcata

SEQ ID NO: 42150 - DNA, 601 bp, Human
gaagcatcagtgacaagtttgcagggacagatgcagtagcccacatctgtaatcctagcactttggggggccaaggcaggagaaccacttgagcccaggagttcatgaccagcctgggcaacagagcaagacctcgtgtctacaaaaaaatacaaaaattagccaggcatggtggtacgtgcctgtagtcccagttacttgggaggctgaggcaagaggcttgctaagagttagaggctgcagtgagccatgatcgcatagctgcactccagcttgggtgacagatcaagactccatctcaaaaaaaaaaaaaattctataggctctgggtggcagcagccctgtatggctgggttgttgtgtctggatgacagttcagaatgccacaaagtgtcctgacccttcttggacatgggaactcttcttgtgatatggtttggctctgtctccccacccaaatctcatctttaattgtaatccccatgtgtggagggagggacctggcaggaggtgattagatcatgggggtagtttcccccatgctgtcctcacaatagtgagggagttctcacaagatctgatggttttacaagtatttggt

SEQ ID NO: 42151 - DNA, 601 bp, Human
tgctgtcatgcactggtgccaccttccttttgcactgccgagtgttctcagtacacggatctggcactgtcgtatccacacacctgctgactggcatttaggctgcttccagtttgggacgattataaatgaaggtgcagaccgggcgaggtggctcacacctgtaatcccaacactttggaaggccaaggcagacggatcacttgaggtcaggagtttgagaccagactggtcaacacggcgaaaccccctctactaaaaataaaaaattagctgggtgcggtggcgggcgcctgtaatcccagctactcaagaggctgaggcaggagaattgcttgaacccgggaggcggaggttgcagtgagccaagatcgggccactgtactcctcctgcctgggcaacagagtgagactctgtctcaaaaacagacaaacaaatgaagctgctatgagtgtttgagtgcaagtcttggtgtggaatttgttttcatttgttctggaaaaattccccaggagggctgctgggtggtctaacccatcttcacactggctgtcgcgactgcattcccagcagcagcgcatgcgcattcccattgctcca

SEQ ID NO: 42152 - DNA, 601 bp, Human
tacatgtgagaatcctggtaatctgcctataaatgctatttctgtttactgcaagattctcctttgtgactgtagcaaagacatattgctggacaggtaatctgctaggtatagaagctcctagttcctccagaatgtttccattaaccttaaggctctgattcaaacttataatcactgttttaattagagggcatctgtctctgctacatggcacaaaaaagggggtaggcctataaggctgctctgacaccatacttgaccaactacactgatatttttcctaggatcctgaagcackcccattccttttttttttttaagcagttttctcttgagctgatctaatgcttcctccttgaaattgattccaatgtccttcttgtctttcagagattcctcacactttctggtattcccaggacacccttttattcatatcaagctttgctaaagttatactgtttttacctttaaaatcttctatttttttttctttttttactttctaaggacttgaagtaattttaggtaatctcttaagattgaaatgactttctttgtaatttccccaaataacttatttttctgtaatgacaat

SEQ ID NO: 42153 - DNA, 601 bp, Human
ctgcctgcactacaaagtctggtgaccaggagaccaagaagaggttctaggagatgtgattaagtcaacaagaaaccaaaaaattattcctggcctaataacaataaccacctcagctaaagatgtaacttggagaccctaaagggaggttgtcttagacctctgtaatctggatttcttttttctgtaactgttggaaagttttggtgcttatccttagacaatctttcatcttttcaattcatgatcttatccagtctcgtgatgttataaataacacactatatgctaactgacaccraaatctgtatctccataccagaacctcacctgaaatccagacatgaacattcattcacctgtctactcaatatctccacttagatttctaataggaatctcatacttaacatgtctaaaactgagtttctgatcttctcaaatgtctattcctggtgcagtcttccccatttcagttaatggccattctttactttcaggtgttcagtcaaaaccctgcagtcatcctcaactctctgtttgtatggtggttcatgaataataaagttcatgaatctttgcatgtgtgaaaatgttttat

SEQ ID NO: 42154 - DNA, 601 bp, Human
gaaagcagtctaagaaaaaaccaagtagcctgtgcctgtgtttagcagctaggaccaaacgggaacactaaactctcttggtttttaaaatctggctgtctctgcttttcaaagatattaaagctaagagaaactttctgcaaaacaggcacgtttcatattgtagactgagaacaggagcttgattcaactagctccctacttgcatctcccaagtttcttcagatcatctcaatatgccacctcacagcatggcctctgtagaccctgtgcctgcagggttgggttacatgtaaatggmagcttcatgaccctctctaggcctctagcaacattgtggttttcctctgtgttaacacaaccactgtagatggcctccagagaccaaagacttgcttgactccgaccgacacaggcaacttcacaaatatttatcttgcgctgcgctgagcagattctctggcaagactaggccaggattcagactccaagactctctgctgcctgcactacaaagtctggtgaccaggagaccaagaagaggttctaggagatgtgattaagtcaacaagaaaccaaaaaattattcctggcctaataa

SEQ ID NO: 42155 - DNA, 601 bp, Human
agaaaagaaataaaaaaagaataccaatgacacgcaaactctttcagaaggcagaagatgaggaaacatttcccaactcattttatgtggacagtattcctttgataccaaaactgaaaacaatataaaactacaaagaaataccctttatgacacagacaaaaaaatcttctgaaaatattagcaaactgaatataaaaagggtaatacattataatcaagtggggtttatctttgagaagaaaaggtgatttaaaaattaacataggccagacgtagtggttcgtgcctataatcccarcactttaggaggctgaggcaggaggaacacctgagggcagtagttcaagaccaacctgggcaacatagcgagcccagtctctgcaaagacaaaaaattttttttaattattcaggtgtggtggtgcacacctgtagtcccagctacttggtaggctgaagcaggagaattgcttgagcccaggaggttgaagctgcagtgagctacaatgaggccactgtactccaccctgggcgagagaccaagaccctatcgctttaaaaaaaaccaaaaaacataaattactgtttcaacagaataa

SEQ ID NO: 42156 - DNA, 601 bp, Human
gttctagtttccagtaatggagagctaattaacccttttactaaaaaccatgaaaaatacaacataaaaattttttttttcttcttactaacatcctaaaaatctatactggaaaaatcccaagccagtttttggttgaaagtaaaaattcagagcctaaacagaaaatctgattaacaataaatggggtagggagagaaagagctaaggagaaagaacattcaaagcccaacaccagctcatggtagtctttggcaagataggttccatgataagctgagatacagcccacctccaaacrgtgggctcaggataagaacaaattacaaaccagaggatagtctcagggtaagaacaaactacagaaaggtcagactaaggtaagaaaaaagaaaaagtaggtaggggaaaaccatcctggagaaattgttgaaatcaaccctagggaagagttgcagcatggagatatattgcttggctagaccaaaaacctttaagcacatggcagccctaatgccaatgcttacaggacccagcagaagccaaattgaagcctctctagagaggagcaaatccacactagtccttggggaaccttaca

SEQ ID NO: 42157 - DNA, 601 bp, Human
caaaggctgggcacggtggctcacgcctgtaatcccagcactttgggaggccaaggcgggcggaccacaaggtcaggaaatcgagaccatcctggctaacacggtgaaaccccatctctactaaaaataaaaaaaaattagccgggtgtggtggtgggcacctgtagtcccagctactcagaaggctggagcaggagaatggcgtgaacccaggaggcagaacttgcagtgagccgagatcgtgccactgcactccagcctgggtgacagagcaagactccgtctcaaaaaaaaaaaaaaagaaagaaagaaagaaaaatacaggctgggtgcagtggctcatgcctgtaatcccagtactttgggaggccgagacgtgtggatcacctgaggtcaggagtttgagaccagcctggccaacatggtgaaaccctgtttctactaaaaatacaaaaatgagccaggcgtgatggcaggtgcctgtaatcccagctactcaggaggctgaggcaggagaatcgcttgaacccgggagatggaggttgcagtgagtggagatcacgccactgtactccagcctggggaacaagaatgaaactcc

SEQ ID NO: 42158 - DNA, 601 bp, Human
ctcacgcctgtaattccagcactttgggaggctgaggtgggtagatcactcgaggtcaggagttcaagaccagcctggccaacatggtaaaaccatgtctctaccaaaaatatttttaaaaactagccgggtgtggtagcatgagcctgtaatcccagctacttgggaggctgaggcaggagaactgcttgaacctgggaggcagaggttgcagtgagctgagattgtgccactgcactccagcctgggcgacagagccagactccttctcaaaaacaaacaaacaaacaaacaaacaaamaaaaacaaacaagttcatttgaaagctgttgctcttcactgacatctaaaacaccgatgctccactgcctgaatggatcaaacacatggattgctcctagttttgtttcaaagtatagttgacgcactgccttttaccagtccataacaaggaaagtacaaaaactgagataagcgttcagaaactctcagagcaactgacactaccccaacattcaggtccatcaccagtggactctgcagaataagatatttttcaatgtagtcgaacatatgacacaagcaaaatattagccatgca

SEQ ID NO: 42159 - DNA, 601 bp, Human
gaacatttcttactaaagaagtctttttctatatcaactctagaccactcctttggatttggaaagaacttgatgtcctgagtatcatgtaactaacgactgccagcatccctggacctaggtcatagtaactcttgagttgcctccatgtttatcatccatgacagatccttcttactaatgtccctgactttcgcggggtcaaaatcatttcgtattgattttgaagccctgtatagttgcaacacatataaacacatcatcaataaagattaactattttttaaattaatttttacaraaacagacattagactccttaaagatcctccttctggggcctttaacacgctcagccaattcccaaggttcctatctccttaagcatgttcactacaatctttcctctgattggtaccatgccaagtattactttaaattcttctcaaggatcttttggaagatcccccaaaaccagctctctcctaccaagtaaacactctgcctgtcgatcagcttatatttgccttctcaacaatctagtcagtatctcatggtatatcagaaactaaaaattaccagatgcatatccaagggcctc

SEQ ID NO: 42160 - DNA, 601 bp, Human
gcacacaacacttctcatattgttactttcgtaaaaaggaaggtactacttatttatctactactacttgtttatcagtatatgctcagtgtcttaaataatgcctggcatattgcaggtactcaataaatgcttactgaaaaactgaactatcttagcattaaacaaaaagaattacacggatttgtaacaatagtgggcctcaaagtattagcaaatggcaagcggttgataagaaataggctgcccaggcaagggaaaaacaatgaatttaaactttccatattaacttgaacactcyagattctgcctaaacaactagcaaaatagtattctagtgaactaacaaaggttatggagagtagacagagcaccctgtacatcagcacattatctatatactcaatatcacgatgtccttcacagtgggccaattttcctactaacatagaaaataagaggccatgtgacagaattataaatgttcaagggcatgtctagtaccaaaatatcttgctatatattccttgggaaaacagtcaagtattcatagatactacagagaaaaaacaaaaacttggtaatcagatggatgaatgag

SEQ ID NO: 42161 - DNA, 601 bp, Human
ataggaaatcaaaagagtttaaaagctattttttttcttgacccactgaatagaaactgagactcactaaatttggtattatctactatgttctaataactgctccaatagtctatgggatcttacctgtacagtattcttaaacacaaaacagatcaaagatcttaactacattgccattaagagatgatccttacacgaaagcaattcttcaaaaacaatgaccaaaattatgtattaaaggtaaagacagaattgaaagaacagacataaagacagtctttactcataaatctattgyatataacactgtttataaatcacaaatttcaagtaacagagtgcccactcaaccctctatgctttatgatttatcattgtgcatacagtttcctatgtcaatcagttttaccatttctcatctgtctcatgaggctttttcccctacttttcctggtacgtaacatttcggaaacaaatttacacgtttctttctttattacctggttacttcttggtggtacctacgtacctcatctcctttactttgtgaacactatatgcattctttcagcttctcttacaaacttaaccttggcta

SEQ ID NO: 42162 - DNA, 601 bp, Human
tgaaagtaataatactcaatgaattttatctgattttaagaatactgtaatatatgtgaataaaatattactttggcttgggatttatttttttagacagtcatttgacaggctcgtcaaggttataaaaaaattaaaatttagattaaaaaataagacttaaagactatgtcaaattacattctcaaaaataaatgcaatctggaaaactattctatctgataacagcagcataacaaagacactattaagttttcaatatctgaaaatattacagattagaaatcactatcgaatcctyatctatttatcacattgcctgataacagactcacctccccctccctttcactccatcactaaatgtttgttttactatttccctcttaattgttaagtcctagaagggtcaaataagcagcaaaaaatcccccaccccaccaacagaggtcactacattgcttaagtccttgtccctcaagctttctaatcagagagagcaaagtttcctttggaacagcccaggtcaagcccagaccatagggaggaaaagcaaaaatccctaaaattagttacctgtgagcctgcatatgatgtgcta

SEQ ID NO: 42163 - DNA, 601 bp, Human
tcatccttaaagagtaaataaaacactagagacatccccatgaaagtaagtatgaggtaaaaacacctgctagtgctaccagtctaacactgtttttgcactgtttagcctaagcatttttcaaatagaaagaggtggtaggagatccaatacaataaaacaggaaaaagaaaatctttcccgaaaggcacaagagagatatgctatgctaatggttgggaggagtcaatgttttgtttttgtttttttgtagaggcaggggtcttgctttgttgcccaggctgctctcgaactcctggcytgaagtgatccgcctgtctcagcctcatgaagttctgggattacaggcatgtgccaccaggcccggcctcagtgtcacagaatataaattcttccaatactgatttacaaattcaatgtattttgaaacacaaataattgatcaactgattggggaagttcagatctctgtaactcatataaaacttttaaacacacaaataaaacatgggaaacataaactcacagtgcataaaaagttcactctgttaatcaaatacaagttaaaatgagacagctttttttgtttatcaaattggca

SEQ ID NO: 42164 - DNA, 601 bp, Human
attaaaacagaaaacatccccaccccccaccctcccccccaaaaaaagtttctatatcatgtacttatgcaaagcatgtacacctatgtcaaaatttgctctggccaggcacagtggctcatacctataatcccagctctttgggaggccaaggcaggcgaatcgcttgagcccaggagtttgagaccagcctgggcaacatggtgaaacgccatctctacaaaaaaaaagaaaaattaactgggtgtgttgatgtgcacctgtagtttcagctattcagaaggctgaggtgggatgatcrtttgagcctgggaggtcaaggctgcagtgagctacgattacaccactgtgctccagcccaggtgacagcaagactctcaaaaatttttttttattctggtcccagctgaggttctgtagcactggctttgggcaaaattagtaaatgagtttacttgttttatatttcctcttttcctcctgtttccccctttacaacttgtggctcctagacattctcctgctaccaaaacagttatgaatgtgctctatggactacctgactatactttataataaaggcaaagtcaataaaatgtta

SEQ ID NO: 42165 - DNA, 601 bp, Human
taattttgccatttaccagagtccctaagtaattctgagatatttttaaacacttgctaacacaaaggatatatttaagttatcaacaggtaaaacttgcctttacagaatatactttgacacaggcttcaaatatacattaacatgtaaagtattactttgctactaaaacatggccacatctaagtggcataattagctattaacagaacaagaagctgggtgtagcactacgtgcctatagtcctagttgctcaggaggctgaggcaggaagatcacttgagctcgggaattagaggmcagcctgggcaacacagcaagatcctctctctttagaataaattaaaaaataaaaaaataaaataaaaaggtaagaaaaatgtgccttattaaacctagaacgattgtagttgtgtaaatatgattttaattagaattttctcataaccccatgacctacttaacatgaatgaaaataaatgttttgataactattaataagtacaaagaattagtttttaataataaagtcaaaatatggacatctactagcctaaacatatcacaaaatgtggtaaccttcaaaaacagcaagtctcc

SEQ ID NO: 42166 - DNA, 601 bp, Human
atgctgtatgtataaatccctgtacataaaaattcaaaaacatgtattttcatacaaacgatctaattttttccttttttttaaagtttcagtcctaaattgttttaaaaatccatggtaagactatatctttttttttttttttgagacagagtcttgctctgttgcccaggctggagtgcagtagcactatcttggctcactgcaacctccacatcccagatgcaagtgattcttgtgcctcagcctcccgaatagctgagattacggatgtatgccaccatgcctggctaatttttgyatttttagtagaggtggggtttcgccatgttggccaggatggtcttaacctcctggcctcaagtgatctgccaggcttggcctcccaaaatgctgggattcaggcgtgagccacggcacctggctgagattacatatttcttaggaggaaatatttgtaaattaacccaaaagggcaacagagctttttaaaatacatatatgcacaaaatatatacatatttatttatttaaagtaaaaagtatatatccagactccatcatgaaaattctattcaattagtctaaattgaggcatctg

SEQ ID NO: 42167 - DNA, 601 bp, Human
tggggggaaaaggctaattataatatgattaataaagatgagcatcaaaagtgtttttaaattgtgtcagtaaagtatttttagaaaattcacctgcatggaataccttgctttcggagtatggcaaataaatcaagtgatactgtattcaaatcttacctgctgggaattatcaccgttccctatactgagagaatctgaaggtttgtcaatggggctataaaaagaaaacaaattgaataaaatcagaatatagtcattctcctacaataaaaacaaactcctcaaaagaaaaaaaaaacagacactttaccatcttaacaaatgtttattgaggtactgggaagtaaaacattgattaaatgttgaggacacaaagaagtacaggttgagcatcccaaatcagaaaatccaatatctgaactgcttcaaaatttgaaacttattgcacgctgacatgacactcaaagaaaattggtcactagagcatttcagagttcagattctcagatttggggtgttcgcccaataagtataatgcaagtatcccaaaatccaaaagaaaaaaaaatctgaaatccaaaacacttctgttcccaag

SEQ ID NO: 42168 - DNA, 601 bp, Human
aactttgaacagtttatctggcttatcatttcaaagctgatagtcatttggggaaaataagaagggaaactgttagggacaaatacacttgactgaaatagaaaattaaagtagagagcaaggggcaaggggagtatgtggtaggaatacaattcttaaaagcaaggaactcagaaggcatgctagcctgggaccatttggcacagggtcaaaaagaccaataacattagcagactctaaagataatagtatctggtcataatgataattctgagtcattaaaaaagggttaaactatgcyctatatattctggggggaaaaggctaattataatatgattaataaagatgagcatcaaaagtgtttttaaattgtgtcagtaaagtatttttagaaaattcacctgcatggaataccttgctttcggagtatggcaaataaatcaagtgatactgtattcaaatcttacctgctgggaattatcaccgttccctatactgagagaatctgaaggtttgtcaatggggctataaaaagaaaacaaattgaataaaatcagaatatagtcattctcctacaataaaaacaaactcctcaaaa

SEQ ID NO: 42169 - DNA, 601 bp, Human
aaatgccaacatataacacgacaatgttttagaacaccccactaaagttctagatcactactttctgttccatcaatacattatttcagtatgcaagtctgataacagagtgtaaatgctagtgcagtccttgggccaagatctcactatattaagaaacagtgctaggctacaaaagttgattgcagatttcttgcatttcttcttggagatagtgatagcattatcatctttaaatccttgtggagctctccctgtttccttatgctgaaaacaacaacttccttgattggggaaaaamaaaaaaacaaaaaaacccagcagatatgctatcattctatatggtgtaacacagagtagctcttcttcaaagatgaatcggagatcacatctttagtgtgtatgtaatacatcttggtgccattactataagtttttttccattttgtaatattagagatgtcaccagtctagtggttatgtgtgttgtcccctaaattctctttggtactgcagaaaaatcctgggtaaattaaactccacctctgttttactcttttagttctgacactggtaattttgtagttagcataagtttatt

SEQ ID NO: 42170 - DNA, 601 bp, Human
attagccgggcacggtggctcacgcctgtaatcccagcacttttggtggccaaggcacatggatcacttgagatcaggagtttcagaccagcctgggcaacaaagcaaaaccctgtctctagaagaatacaaaaattagccacgcatggtggtgtgtgcatgtagccccagctacttggagggttgaggtgggaggatcacttgagccagggaggtcgaggttgcagtaagccgtgtttgcgccactgcactccaatctgggcaacacagtgaaaccctgtctcaaaaaaaaaaaaaaaaaggaagaagaagaagaaaagggaaaattcaagcctgtcaggaatccagtaggaaaatcatataggtagtgtacattaagatttagtcatgacttccctgttaattgtggtaaattacatggagaaagaaacttctcctttgtccaaagaaaaagaaactggttagaggggtgaacacaagctaccggaaagagacttataatagtcaatagttaaaacctgaaagcgtgttataaaacaaaggttgcagggcttgtgtatttggagattatataaaatccttattttaataatatgcttcg

SEQ ID NO: 42171 - DNA, 601 bp, Human
aatatatattgaatatatcttgaattcagcagtttctggtaaaatttgctgatgattcccttttgggataacatggtaaagtatagcatggataacagcagtgtttagatgaatctacacagaacttgagatactgagtcagcctaaaagtctctgtaatactcttggcttatatttgactccatgctttttattatacttaacaaaagccacaaagttcatttaaatatgcaaacggaaagccaattctacagatgacagaatagtggaaactacaactattcttaaattaaaactcttacattctttgacaaatgttattaatagtgttattaataacatgcatctatcactttataatcacatagttctttcataagacaaacttctaagatggggatatacaaacaggatacattctaacaataccaaatccaaacacatacaatttaacagatatacattagatttttaaaaatgcatttggaaagggtagaatggaaaagatctaaccattagcgtgtatgggaaaaggtctagtggttttacttaaataggcttatgatacttggtctggcaactgggtaatggaacgcctaaa

SEQ ID NO: 42172 - DNA, 601 bp, Human
caaaaccactgttagaaaaataccaaaaatggaagaaatggcagactctggaagcaacatgcttagaattattatttttttatttttattttttgaaaccaagtcttgctctgtcacctaggctggagtgcaatgctcgatctcggctcactgcaacctccacctcccaggttcaagcaattctcccgcctcagcctcctgagtagctgggattacaggcaagtgccaccaagcccagctaattttttttttgtatttttagtagagacggggtttcaccttgttgaccaggctggtctcraactcctgacctcggatgatctgcctgccttgcctcccaaagcactgggattacaggcctgagccaccatgcccagtctagaattagttcttgagaaatttctaaaacagatttggggcttgatgatttcttcagaaatgaatatgatgggtttatcaaccactgttctgtctgcttgtgtttgggggtatttttcatgggaaataatgcgtagcattttgactagaactcagcttgattccacctaaaatatacaggaagtttaattctgaaattgaacaagtagtcatagaggttcca

SEQ ID NO: 42173 - DNA, 601 bp, Human
actgaaaatgagttttatcccaggctcttaatcctcacaggtgagagcacaaaaccactgttagaaaaataccaaaaatggaagaaatggcagactctggaagcaacatgcttagaattattatttttttatttttattttttgaaaccaagtcttgctctgtcacctaggctggagtgcaatgctcgatctcggctcactgcaacctccacctcccaggttcaagcaattctcccgcctcagcctcctgagtagctgggattacaggcaagtgccaccaagcccagctaattttttttttgtatttttagtagagacggggtttcaccttgttgaccaggctggtctcgaactcctgacctcggatgatctgcctgccttgcctcccaaagcactgggattacaggcctgagccaccatgcccagtctagaattagttcttgagaaatttctaaaacagatttggggcttgatgatttcttcagaaatgaatatgatgggtttatcaaccactgttctgtctgcttgtgtttgggggtatttttcatgggaaataatgcgtagcattttgactagaactcagcttgattccacctaaaat

SEQ ID NO: 42174 - DNA, 601 bp, Human
gaaaccctaggaggacgtgacataattttaggatttacaaaagcagggaatgggaataattatacttgagttcttagatggcaggcatcctcgctattttgcaaataccacagtgtattgcaatcatttgtttacatgttcactttttacaactagactttgagctcctctaggaaaaggacctcgatttaatcatttctatgtagtagacaatgcctgaacctgaacttcagtaggtactgtatgtttcccaaacatataaccctgaacgtttgctaccatgttttttttttttttttttggagacggagtctcgctgcgtcgctcagcctggagggcaatggtgcgacctcggctcactgcaacctctgcctcccaagttcaagcgattctcctatctcagtttcccaaatagctgggattacaggcacacaccatcacacccggctaatttttgtatttttagtagagacagggttttaccatgttggtcaggctggtcttgaatgcctgacctcgtgatccaccagcctcagcctcccaaagtgctgggattacaggcgtgagccaccgcacccagcctgcttccagattttttaag

SEQ ID NO: 42175 - DNA, 601 bp, Human
atggaaggtgtcaaccaccctaacatctctgaagtctaaatctgctagaagaaaataaacctgataaaacattccttgctgacgatctctcttttccaaggtgaaaataaggaagaaaacttttattctggacttaattctgaccaacgaagaactggttggctactgcaaaaataacagaaaccctaggaggacgtgacataattttaggatttacaaaagcagggaatgggaataattatacttgagttcttagatggcaggcatcctcgctattttgcaaataccacagtgtattgcratcatttgtttacatgttcactttttacaactagactttgagctcctctaggaaaaggacctcgatttaatcatttctatgtagtagacaatgcctgaacctgaacttcagtaggtactgtatgtttcccaaacatataaccctgaacgtttgctaccatgttttttttttttttttttggagacggagtctcgctgcgtcgctcagcctggagggcaatggtgcgacctcggctcactgcaacctctgcctcccaagttcaagcgattctcctatctcagtttcccaaatagctgggat

SEQ ID NO: 42176 - DNA, 601 bp, Human
gctggaaagtgactttccccaacaaaatctgtttaattcctatctgtataatgctgtgaacagatggttctctccaaaaagatgcaaagctttctgaatgcaggaggagtaagttaagttttggggtccaagaggcttctctgcatgtaaactgaaggaaatgagccactaagatgatatgtttttaatagcatttcagatgccaaaacacaagcaaatatacttttaaaaagtccaacgcatcaaaactgtttaaagaaggaatgttttattaaaaacaaatactccactattatgtgtrcaggatattaaacaaaagtctctaagatatattctacccatttttctacttcagccactattccttcactcactatgcactttatgtactcaattactttagtatcaacaatccaatgaggttaagtagtaggttcattttacaaatgaggaggctgagtaggcactgtagtttaaagaatttgtcccaggttatggagttaaagtgttgcagtcagcaattaaaatcagtctgactccaaagcatttgttcttgccatcaagcatactaccaaccagtctgtgtcctgggcaggactca

SEQ ID NO: 42177 - DNA, 601 bp, Human
acttgagaagagctggaaagtgactttccccaacaaaatctgtttaattcctatctgtataatgctgtgaacagatggttctctccaaaaagatgcaaagctttctgaatgcaggaggagtaagttaagttttggggtccaagaggcttctctgcatgtaaactgaaggaaatgagccactaagatgatatgtttttaatagcatttcagatgccaaaacacaagcaaatatacttttaaaaagtccaacgcatcaaaactgtttaaagaaggaatgttttattaaaaacaaatactccaytattatgtgtacaggatattaaacaaaagtctctaagatatattctacccatttttctacttcagccactattccttcactcactatgcactttatgtactcaattactttagtatcaacaatccaatgaggttaagtagtaggttcattttacaaatgaggaggctgagtaggcactgtagtttaaagaatttgtcccaggttatggagttaaagtgttgcagtcagcaattaaaatcagtctgactccaaagcatttgttcttgccatcaagcatactaccaaccagtctgtgtcctg

SEQ ID NO: 42178 - DNA, 601 bp, Human
aaacacaaaagcacttaaaccatgacctctgttttcaaggggctaaaagtctagacagtgggacaatgaaaataaatgaaaagttcaacaactacatctgaaaaagcaacagaagaaatgccaaggtggtatatgattaaaatatgctacataagttcagtaaaaagacaggccagttgggacacgtacgggaacgtgttggtgggtgaagaacagtagcattcgtggagttgccattttagttactacatagttctccccctcctcccacaccaaacctgaaaatctcacaacaggttgraactatctttagtatttctgcataacactgtactagtccaactgtttactaggaagtacacagaaaggcatttaaacaatgactatattatagactatatttcagaatgaattctgacatcagacctttcacagaacactgcttgggcaagcacacacagttagcattaatagcatctagtgggtatctttctgttctccaggttaactgcaatatgttaattattatgaaatgtaaaactataaatagcaaaatgtgggaaaacctgctcctaacagtaagctgtcactggcaacaagc

SEQ ID NO: 42179 - DNA, 601 bp, Human
aattgtatccagttgagaaccactgacacaaaggaagtcgattcctttgcttctagggctcttatatgatctcgcttgaatgcacattttcctttcaaatagtaccaggactttgccccctgactcaacctgatgcaagttcattttcttttctttatacaggacttcacactggagtacaattcaacgtgtataagtcagcaggtctcatagagaaaacattgtagataggttgtataaggcatctccacaactggctgtcaatataatttaggcatgtacatcccaggacacctaattyataactaaaaataacacctgccttactctctcataaggataaaaataagagaaggaaatgcaatttggagcacattacttgctaaatgcctaataacaaatgctccactggtggtcaataccgaacggatagtaaattttccaaaaagctaaggcagggtatttcttactgccaggaactagccctgtgtactagtctccttttaggaacttaggaataacactcatcattctcagaggtactgtgtagtcaatctaataatgagtcttcttatcactaaaacattacaaagacaagaca

SEQ ID NO: 42180 - DNA, 601 bp, Human
caacctcatcaccactgacagtttgaactacataattctctgttgtggagtgctgtcctaagcactgtgggaggtttagcagcattgccggcctctacccactagatgctaggggtaccaactccccagttttgacagccaaaattgtctttagacgttgaaaatgtcttctagggaagcaaaattgtatccagttgagaaccactgacacaaaggaagtcgattcctttgcttctagggctcttatatgatctcgcttgaatgcacattttcctttcaaatagtaccaggactttgcccmctgactcaacctgatgcaagttcattttcttttctttatacaggacttcacactggagtacaattcaacgtgtataagtcagcaggtctcatagagaaaacattgtagataggttgtataaggcatctccacaactggctgtcaatataatttaggcatgtacatcccaggacacctaatttataactaaaaataacacctgccttactctctcataaggataaaaataagagaaggaaatgcaatttggagcacattacttgctaaatgcctaataacaaatgctccactggtggtcaa

SEQ ID NO: 42181 - DNA, 601 bp, Human
aatttgtcttggctgcgagggcttctggcaattccattctttgaaacacatacagcagggtttatcaacctcatcaccactgacagtttgaactacataattctctgttgtggagtgctgtcctaagcactgtgggaggtttagcagcattgccggcctctacccactagatgctaggggtaccaactccccagttttgacagccaaaattgtctttagacgttgaaaatgtcttctagggaagcaaaattgtatccagttgagaaccactgacacaaaggaagtcgattcctttgcttcyagggctcttatatgatctcgcttgaatgcacattttcctttcaaatagtaccaggactttgccccctgactcaacctgatgcaagttcattttcttttctttatacaggacttcacactggagtacaattcaacgtgtataagtcagcaggtctcatagagaaaacattgtagataggttgtataaggcatctccacaactggctgtcaatataatttaggcatgtacatcccaggacacctaatttataactaaaaataacacctgccttactctctcataaggataaaaataagagaa

SEQ ID NO: 42182 - DNA, 601 bp, Human
actactctaaaaaaagtttgttttaagggacatttgttcctgtaattgtagactaatcaaatcaagcaagggtatgttagccaaagaaattcacatatggcacatgatgcagaaacagtgagaaatttagatcctcccaggtgcactatgattacaggataccttgggaaataaattagctagtttataatgcaacaatcttgacacccctcctccccccaaaaaatcatgtgccttgacattttgggagcctgacagcatggatgtggcttacagtaaagctgcaagtgttacagggaartagaatgatgcttttagctcttggaataggatcatattccatctagcttagaagaaaagaagtttatttcactgttttttccactattgctatgccaagtgctggcacaaagaaaaggtgagagaaaggaaatcagcttaatcctaatcccatcaaaatagctcatctcagtccggccatacctgaagtcacctccttgattccctattccctcccaatgacccaaatttgtcttggctgcgagggcttctggcaattccattctttgaaacacatacagcagggtttatcaacctcatc

SEQ ID NO: 42183 - DNA, 601 bp, Human
aacaatctgctcctaacttttgctttaccatttagtgagcagtgaaattgaggaacatttaattttgcattaacagaataacacttgcatttacataaatcttatttgaaaattagtaataaagtcaaaagacaataaaggcagaggggttatatgacaattctccgtacttcccactcagttttgctgtgaacctaaaactactctaaaaaaagtttgttttaagggacatttgttcctgtaattgtagactaatcaaatcaagcaagggtatgttagccaaagaaattcacatatggcrcatgatgcagaaacagtgagaaatttagatcctcccaggtgcactatgattacaggataccttgggaaataaattagctagtttataatgcaacaatcttgacacccctcctccccccaaaaaatcatgtgccttgacattttgggagcctgacagcatggatgtggcttacagtaaagctgcaagtgttacagggaagtagaatgatgcttttagctcttggaataggatcatattccatctagcttagaagaaaagaagtttatttcactgttttttccactattgctatgccaagtg

SEQ ID NO: 42184 - DNA, 601 bp, Human
cactctaacttttaaagcagtccaactgtcatgctgaataacttaaaatagcttccaattaggcaaaagccaaacagggaaaacttcctataagaaaaataaaatcccccagaaataaaaagatgatgtataactacatgggaacattttcaggaagataaatgatcttacaccgagtggctaatatccctaagaagtccatgcaaatgatcctccctcttctactgaatagggagagagagaatatcccataactcagaacaatctgctcctaacttttgctttaccatttagtgagcartgaaattgaggaacatttaattttgcattaacagaataacacttgcatttacataaatcttatttgaaaattagtaataaagtcaaaagacaataaaggcagaggggttatatgacaattctccgtacttcccactcagttttgctgtgaacctaaaactactctaaaaaaagtttgttttaagggacatttgttcctgtaattgtagactaatcaaatcaagcaagggtatgttagccaaagaaattcacatatggcacatgatgcagaaacagtgagaaatttagatcctcccaggtg

SEQ ID NO: 42185 - DNA, 601 bp, Human
tcaagaatacaatcactagtttccccctggctccctaactacatgagacacaaacaagatcataaatataagtcctagaacactctcaatcacagtaaggtttacggctatggtacactctaacttttaaagcagtccaactgtcatgctgaataacttaaaatagcttccaattaggcaaaagccaaacagggaaaacttcctataagaaaaataaaatcccccagaaataaaaagatgatgtataactacatgggaacattttcaggaagataaatgatcttacaccgagtggctaatrtccctaagaagtccatgcaaatgatcctccctcttctactgaatagggagagagagaatatcccataactcagaacaatctgctcctaacttttgctttaccatttagtgagcagtgaaattgaggaacatttaattttgcattaacagaataacacttgcatttacataaatcttatttgaaaattagtaataaagtcaaaagacaataaaggcagaggggttatatgacaattctccgtacttcccactcagttttgctgtgaacctaaaactactctaaaaaaagtttgttttaagg

SEQ ID NO: 42186 - DNA, 601 bp, Human
gtgaaaagcagcttatgttgaagagatctcggtttttatttaatctgtgctaaaaaccaaactgttggcagtcagtgtagctgaagggagtgagaaagttacctgtgatgatggctgggtctgtccagctgccagggctgtcccaactcaggctgtcggtggtggcagtgttggacgttggtgcactgtggttggcgttggagggggaagaagaattgggcagtccaccaaagttgatgttaatgttgggtagaagtgcccttagcccgtcctgccattccttcatatttaaactctctayagaactgctgttgtctgggagatttaccaacaaaaaaatgaaagataaaaaaaaataaaaagctacgttagaaacatatgttgttctttagtggttaagcgggagaagaattattctttctttattgagcatttaaaatgggttgtcctagcaagataaacttggttaggattttgctcgtgagctcagagcccctgaagtgaggaaaaacttgctcaaggatcaggagagggaggttcttgtctctctatagcctcttcaccattatgggtttgtaaatcaataatccagtttaaagac

SEQ ID NO: 42187 - DNA, 601 bp, Human
gagaaaagaaaaaagagggaaaatggtgagtttgtgtggaaagaataaggtcgtcaaacaaatttagaaagcaaaaccaaaaggaaagacagaagagattacaattttaaactccttccaaataagaccttttaaaccaatcctcccccaacaacaaagaacttattggcacacaaacccatgcctcctcttgaactagacttagtcccccactgtcacagaggcagagctgcaaaacaccattccccagaactgcctgatggcatttcccaattgtgcttttcctcctctgacagggatrcgtaacaagacagccttataatagagagctttataacaaaaagtggagtatgttccttataagaagagtaagtcagatccttttgtactttgaggcctacaaaatacacatgttgccagatgttaacacctacttaaaccagaagaagcaacctaggcaccaaatgccttcttattaatacacaactaggccgacaggttaaatgagacttgcatgacccctgagaacgaaacaagccactccacacttgtggctttgtgaaaagcagcttatgttgaagagatctcggtttttatttaa

SEQ ID NO: 42188 - DNA, 601 bp, Human
aattaagtatagaaagtgtatgtccacttttaggccgggcgcattggctcacacctgtaatcccagcactttgggaggctgaggtgggcagatcacctgaggtcaggagttcaagacgagcttgggcaacatatagaaaccctgtctctactaaaaatgcaaaaactagccgggtgtggtggtgcgcgcctgtaatcccagctactcgcagggctgaggcaggagaatcacttgaacttgggaggcagaggttgcaaagagctgagaacatgccactgcacttaagcctgggggacagagygagactctgtctcaaaaaaaaaaaaaagaaagtgtatgtccacttttagatgttgccgcagaatttttattgtatttttagaagagtttcagtctgcagcagttaggaaatgtttcaaaaccagttcttctccatagacactttaagaagcactggcatttagtgaactctgagtcaagtcttattcaatccattcacttatttattcacttattcattttcggagactacaattaaagaaaacctggggatctttagccgggcttcctattacttgggagtgcattcacaaaagaagga

SEQ ID NO: 42189 - DNA, 601 bp, Human
tgttcacgtttcttgtattagtttctataactggggaaaatgattgagcttattattttaaagattcctttagttcatttattatttacctagaaagagagtgtgtgtgtgtgtgtgtgtgtgtgtgtgctttgttttgtttttccccgtcatgacctcacaaaaggctataggtcttagtcccacaaaagtaaaatagctctgccactgggatgtgtcttccttgttctgagctttttctcaaaaccctatcactggccctttagttttcagccgatgtacccaaaatatttcccttcckatgactttcttggagcagaacttcaataccgtttaactcaggacatacttgagtgcctacggtgtgccaggcgctggtgccagttgcttcaggggatagagtgtgagtcatgcagcttctgcctcatggtgtccagccctgcagcagaatcaaggccaggcagcagggatgacaagcaattatgttatcaaatggaatcttagtgcctttagaaacacttgaaagtggccgggcgtggtggctcatgcttgtagtcccagtactttgggaggccaaggcaggcagatcacgaggtcagga

SEQ ID NO: 42190 - DNA, 601 bp, Human
cacccgcctggagatgacccaccccaagcggagcagggaagggggctgcactcgccaactttgtgtctttcagggttgtttcatttacaaatgctatttgctttcccaagttcagtcataatttagacattttgaaatcatccttttgagtttcatgctaagagctctaagtttttatgttataaataagttaaccttgttgtttattgttgtaaaaaaccagatgaattgccaatttatgttaaaattatatatgtaggaattctctcaagaaacgtcacaatcttttctatttttttgtttttttttgttttttttttgtttgtttgtttgttttggtgagatggagtccttctctgcctcccaggctggaaggctggagtgcaatggcgcagtctcggctcactgcaacctccgcctcccaggttcaagcaattctcctgcctcagcttcctgagtagctgggattacaggcacatgccacaatgcccggctaatttttttgtatttttagtagagatggggtttcaccacattggccaggctggtcttgatctcctgacctcaagtgatctgcccaccttggcctcccaaagtgctg

SEQ ID NO: 42191 - DNA, 601 bp, Human
aacactttaatttcaaaaaataatttctggctgggcacattggctcacacccatagtcccagcactttgggaggccgaggcaggtggattgcttgaacccaggagttcgagaccagcctggccaacatagcaagaccccatctctataaaaaaatttttttttcccagcttgaaaaagtttttgtctttataagcttctaactattggagtaagcttttacattcttccgaatagtagaataaataacacaggtgccattatcatgtaaatgtaatctttgctctagatcattagattttrgctctatgtttttatcaatatttcttaaaaatagtgttggagggataataaatcatagaaaaataaactgtaagaaaaataggtggagaaaaggacttatctttcaatgtatatttctcagctatagggttgttaattttatgcatgtactctgctaatcaatagctccatcaggagtgcgacaggcttagtgcttcatttttctttgacagatttggatttgtcccaatgtgattgtatttgcttgtttgctgtctttaaccccagtttttttttttctctgtcttttaaaaaagcaac

SEQ ID NO: 42192 - DNA, 601 bp, Human
caaaacaaaaaaccaaagacttaaacgttagaattaaaactataaaactcttagaagatgcagtagcatcttcagagagaaggctcctctatgtgctggaactgtgctaccctctatggcacagctcataatagcatgcttttaaaagtatcatttaggctgggcaaagtggctcacgcctgtaatcccagcactttgggaatacaaggcaggtagatcacctgaggtcaggagttcgagaccagcctggcaaacatgatgaaaccccacctctactaaaaatacaaaaattagctgggcrtggtggtatacgcctgtagtcccagctactcgggaggctgaggcaggagaatcgcttgaacctgggaggtggaggttgcagtgagctgagatcgtgccattgtactccagcctgggtgacaaagtgagattctgtctcaaaaacaaacaaacaaaaaaaatttttttaaaaaagaaaatagaatattggttgctggggggggtggggaaaatatttacagtttaatgtattgagagcttgtatgggatgatggaaaagttcaggagacagatagtggtgatggtcacacagtaagactgt

SEQ ID NO: 42193 - DNA, 601 bp, Human
ttcaattaccttcaacgatatttgtagcttaagtatacattaacaaaatatgtgtatgatctgtatgctgaaaattatatgctaaactgtatgctaaaacactaatgaaataaatagtattttacatcatttaaaattttatatattggccaggcgtggtggcacaggcctgtaatcccagcactttgggaggccgaggtgggtggatcaccctgaggtcaggagttcgagaccagcctggccaacatagcaaaaccccatctgtactaaaaatacaaaagtgagttgggcatagtggtgrtgcacgcctgtaatcccagctacttgggaggctgaggcaggagaatcgcttgaacctgggaggcagaggttgcagagagccaagatcgcgccacttcactccagcctgagagactgagaaaaaaagataaaaaataaggagttccaataagtcagagtttgtgtttataaatacagtagccattaaaacataaaaatccatcttgaatagctagcattccatattttcttgaattttaattcagttacaggtttctttctgatctggaaaaatgatgatggcaacataaataataaaggt

SEQ ID NO: 42194 - DNA, 601 bp, Human
ggcatagtggtggtgcacgcctgtaatcccagctacttgggaggctgaggcaggagaatcgcttgaacctgggaggcagaggttgcagagagccaagatcgcgccacttcactccagcctgagagactgagaaaaaaagataaaaaataaggagttccaataagtcagagtttgtgtttataaatacagtagccattaaaacataaaaatccatcttgaatagctagcattccatattttcttgaattttaattcagttacaggtttctttctgatctggaaaaatgatgatggcaacatraataataaaggttatcaaaggtttttgcatttttcatatattctgctcccctctagcacttttgactgtaggtcccagaattttacaagtactcagattatcaaagtaaagtttttaaattcaccatgtctagctgtatgtgcacttttttctgtttagtaaagtccatctctctggctgttttagtcagtggtgattgatgagaaccaaaagcactttgcctacccccaggcagaaatggaggccttgcctttgatattagtggacctgcaggctctggacactggagaaatggaattt

SEQ ID NO: 42195 - DNA, 601 bp, Human
acttttttctgtttagtaaagtccatctctctggctgttttagtcagtggtgattgatgagaaccaaaagcactttgcctacccccaggcagaaatggaggccttgcctttgatattagtggacctgcaggctctggacactggagaaatggaattttctagatcagatttacagaaagacgtagaatataaatctcttgccttaggatgctaaagataatttcactgctgaatggatcaagccattccttctcaagagtaaaatcgttcctcctactctgtttattttgttttcttttgtttttttttttttttttttgagacagggtctcgctctgttccccaggctggagtgcagtggcacaatcacagctctctgcaacctccgcctcccaggttcaagcaattctcgtgcatcagtctcccgtcctcccactctttaatgtttaatagaagtggtgggctcctcatttttttttcagtccaaagcaaaggtgtgtggcaaaatcatgttcccagtttgttcttcagtgaaacagctaaaccttgccttctccgaattgggatggggcaacagagtggagccatggtggatccagaa

SEQ ID NO: 42196 - DNA, 601 bp, Human
gagccatggtggatccagaaaggtcaggaaatacacacttggctgccatcctcatctgttgctccttgaaactgaccttcccatatggccttttccacttttctcctttactgatgcctattatccagctgtcaagcactctttcttaagttcccaagaaggttgatggttatgtgttgttcttagctattttaggtacaaggtatgtactgtcattttgatgactgactaactgcacaggtgatcttagcatatgaaggcagcttctggtctgtattttgtggaaaacctacttacatcrtaggaaaaagcctcaggcattggtttttaggctgcattgtttgtgttatgcctgtagacgttgtgctgccagagggggatactaagtgactacagaaaaagttaagtggttaatgatgatttttattttaatggaatccccattatcttttctcaaataaatatgcggccatcacccaacaggatgatgttaattttatatcattagagaattcagaaatttctaaaagtgagctatttctgaaataattctaaggagaaaaatagtcatttggtttttgaatgaacagctgcagatcct

SEQ ID NO: 42197 - DNA, 601 bp, Human
cttcccctgccgtctgcaatcttctaaatccctttcgtgctaatgccgggttatcaggggcagcctcaggaatctacatggggatgtctgtggactcacagaagggcaaagctaccagctgagggctcgtaaccatttttcacaaataggaaactgatggttttgcctccaagttaattctccaagcttccaaagcacctcacagctagaattcacgtatttcataaccatatttatgctacttcaaggggaaaatgggtgtggaggagagagaaagaacacaaaactcagtaaaagcttsctaatcggttcttgcatggcttcatttttgtataattctttttaagagagagagacagggtctcactctgttgcccaggctggagtacagtggtgagattgtggctcactgcggcctcgaactcctgggttcaagcaatcttcccaccttagccaaccgagtagataagactacaagcgtatgccaccatgcctggctaattatttaattgtttgtagagatggggtcttgcagtgttgtccaggctggtctcaagttcctggcatcccacagtgctaggatgaatgggccactgtgcct

SEQ ID NO: 42198 - DNA, 601 bp, Human
tctccaagcttccaaagcacctcacagctagaattcacgtatttcataaccatatttatgctacttcaaggggaaaatgggtgtggaggagagagaaagaacacaaaactcagtaaaagcttcctaatcggttcttgcatggcttcatttttgtataattctttttaagagagagagacagggtctcactctgttgcccaggctggagtacagtggtgagattgtggctcactgcggcctcgaactcctgggttcaagcaatcttcccaccttagccaaccgagtagataagactacaagygtatgccaccatgcctggctaattatttaattgtttgtagagatggggtcttgcagtgttgtccaggctggtctcaagttcctggcatcccacagtgctaggatgaatgggccactgtgcctggccattttgttataattcttaatcctatcacaggtattggattttggaagagagagagagagagcgccgtataacccattgctgtcatctgcatgttacattcagttacagtgtatttctggaatttgaaaaaaaaattatcttgaagggaaatgggaagaaggatatgattatcaa

SEQ ID NO: 42199 - DNA, 601 bp, Human
tgttgcccaggctggagtacagtggtgagattgtggctcactgcggcctcgaactcctgggttcaagcaatcttcccaccttagccaaccgagtagataagactacaagcgtatgccaccatgcctggctaattatttaattgtttgtagagatggggtcttgcagtgttgtccaggctggtctcaagttcctggcatcccacagtgctaggatgaatgggccactgtgcctggccattttgttataattcttaatcctatcacaggtattggattttggaagagagagagagagagcgcygtataacccattgctgtcatctgcatgttacattcagttacagtgtatttctggaatttgaaaaaaaaattatcttgaagggaaatgggaagaaggatatgattatcaagtaactgtttgcaagatagcttctgtcatacgatgcgttggtactaggaagaattcgttgtggggggctagggataatacatgagccttttcccttgggcaaggaaaatgtttaatgtacagaattacaaagtactaatattttataagctattctttcttaattagttcttccttaatttccattgtgtt

SEQ ID NO: 42200 - DNA, 601 bp, Human
ttcaagcaatcttcccaccttagccaaccgagtagataagactacaagcgtatgccaccatgcctggctaattatttaattgtttgtagagatggggtcttgcagtgttgtccaggctggtctcaagttcctggcatcccacagtgctaggatgaatgggccactgtgcctggccattttgttataattcttaatcctatcacaggtattggattttggaagagagagagagagagcgccgtataacccattgctgtcatctgcatgttacattcagttacagtgtatttctggaatttgaaaaaaaaattatcttgaagggaaatgggaagaaggatatgattatcaagtaactgtttgcaagatagcttctgtcatacgatgcgttggtactaggaagaattcgttgtggggggctagggataatacatgagccttttcccttgggcaaggaaaatgtttaatgtacagaattacaaagtactaatattttataagctattctttcttaattagttcttccttaatttccattgtgttcaatgttaatatttcttaactatctcacataggaattttagtattttcttaatgtttaaaa

SEQ ID NO: 42201 - DNA, 601 bp, Human
accttagccaaccgagtagataagactacaagcgtatgccaccatgcctggctaattatttaattgtttgtagagatggggtcttgcagtgttgtccaggctggtctcaagttcctggcatcccacagtgctaggatgaatgggccactgtgcctggccattttgttataattcttaatcctatcacaggtattggattttggaagagagagagagagagcgccgtataacccattgctgtcatctgcatgttacattcagttacagtgtatttctggaatttgaaaaaaaaattatcttraagggaaatgggaagaaggatatgattatcaagtaactgtttgcaagatagcttctgtcatacgatgcgttggtactaggaagaattcgttgtggggggctagggataatacatgagccttttcccttgggcaaggaaaatgtttaatgtacagaattacaaagtactaatattttataagctattctttcttaattagttcttccttaatttccattgtgttcaatgttaatatttcttaactatctcacataggaattttagtattttcttaatgtttaaaatacatttaaaataagc

SEQ ID NO: 42202 - DNA, 601 bp, Human
acaaagctagccacctttgaaatggatgctaaagaaactttgaaatgtatccagaagcaataataattatcagcatttaatatacttacatattcaccttcccttttaagaactgatatgctactttaaaatccttactatatctatataatattttgttatttatgtatattacttttttttgagacagtcttgctctgttactcaggttggagtgcagtggcgtcattttggctcactgcaacctctgcctcccaggctcaagcaattctcatgtctcagcctccagagtaactaggactacaggtgtgtaattttgcatttttagtagagatggggtttcaccgcattggccaggctggtctcgaagttgatccgcctgcctctgcctcccaaagtgttgggaatacaggcgtgagctaccgcgcatggctttctgtattactttaatatatggaaacacgatagtaaataagagtaggattaatcttaaaactgccccctgctggaagcagcttgcagtccactgaaaagccagactgagtagaaggtctgacataatatatttttttaaatgaattgacaaaaaatacatagtttt

SEQ ID NO: 42203 - DNA, 601 bp, Human
gttaataaatgagggagtgtataatttgcacttcaggatcaacagatcattgaaagatctttacataggcgaagcaagaacaaagctaatttataggttccttttattgtgttaccattgccaagcctaaggaatatttctaaaggtattgagaagtttcttggatccattttattgcatttcatttattaaactattgcctaaatatgttttctgtaaagaaaatttaatgttgcttttcttctagtgattgaaattaggcttttcattatcccaattcattaataaatgggaaaataatttttttctcagcctcatgaacgactcaaatattgctctctttctttttctctagtccatctcaaaatactcaggagatatacacgtactgcaaattatataaaataatttgtgctcagatattcttccaatgcttttcaccccaaaatgcattttttgtggaattacatagtcccagtatgaattttgagaaaaaggtttgattgttttgcctttgtgaaagagaaactgtggctatagggagttaggcatctttaaagaagttgccaaacgtacattagcatctttcatgggaatttca

SEQ ID NO: 42204 - DNA, 601 bp, Human
gaagtttcttggatccattttattgcatttcatttattaaactattgcctaaatatgttttctgtaaagaaaatttaatgttgcttttcttctagtgattgaaattaggcttttcattatcccaattcattaataaatgggaaaataatttttttctcagcctcatgaacgactcaaatattgctctctttctttttctctagtccatctcaaaatactcaggagatatacacgtactgcaaattatataaaataatttgtgctcagatattcttccaatgcttttcaccccaaaatgcawtttttgtggaattacatagtcccagtatgaattttgagaaaaaggtttgattgttttgcctttgtgaaagagaaactgtggctatagggagttaggcatctttaaagaagttgccaaacgtacattagcatctttcatgggaatttcattcaggggaggaaaatagagaaagagaaaaaatagttggaaaaaaagaaaaaaaaaaaaagaaaaaaagaaaaaggaaatgaacacagaaaatctgagacaaacagataaaataagatggtagacatcccaaaatatcagtaatcaacaatg

SEQ ID NO: 42205 - DNA, 601 bp, Human
aaaaactcccatctatttgcaatttgagaaacatacatctaaataattcatgagacagggagagatcataagggaaattagagagtatttagaatcaactggcgcagttgctcacgtctttaatcccagcactttgggaggctcaggcagaaggatgcttgagcccaggagttccagaccagcctgggcaagacattgagactgtgtctgtacaaaaataaaataaaattagccaggtgtggccaggcatggtggctcatgcctgtaatcccagcattttgggagggcaaggtaggaagaytgcctgagctcaggagtttgagaccagcctgcgcaacatagcgagacttcatctcatttaaaaaaagaaaaaaaaagaaaaaaagccagttgtggtggtgcctgctactcaggaggctgaagtaggggcgggtggcttgagcccaggagtttgaggctgcagtgaactctgatcacaccactgcactccagcctgggtgacagagagactctgtctctcttttttttttttttttttaggacagagtctcgttctgtcacccaggctggagtgcagtggcaggatcttggctcactgcaa

SEQ ID NO: 42206 - DNA, 601 bp, Human
aatttgagaaacatacatctaaataattcatgagacagggagagatcataagggaaattagagagtatttagaatcaactggcgcagttgctcacgtctttaatcccagcactttgggaggctcaggcagaaggatgcttgagcccaggagttccagaccagcctgggcaagacattgagactgtgtctgtacaaaaataaaataaaattagccaggtgtggccaggcatggtggctcatgcctgtaatcccagcattttgggagggcaaggtaggaagattgcctgagctcaggagtttragaccagcctgcgcaacatagcgagacttcatctcatttaaaaaaagaaaaaaaaagaaaaaaagccagttgtggtggtgcctgctactcaggaggctgaagtaggggcgggtggcttgagcccaggagtttgaggctgcagtgaactctgatcacaccactgcactccagcctgggtgacagagagactctgtctctcttttttttttttttttttaggacagagtctcgttctgtcacccaggctggagtgcagtggcaggatcttggctcactgcaacctccgcttcccaggttcga

SEQ ID NO: 42207 - DNA, 601 bp, Human
ctgtagtcccagctactcgggaggctgaggcaggagaatgtgaacccgggaggtggagtttgcagtgagctgagattggaccactgcactccagcctgggcgacaaagtgagactccgtctcaaaaaaaaaaaaaaaaaaaaaaaaaaagaaatgtttaattttctacaaaaagatggaacagtcaacataaaggtgaaaatgaagaaaacatagcccggtttgcaaactggctttgagcgtctcgctccctgcaggtgcagatgtccggcgaagtgcgggacaagtcctatctcctgccrccccagcctgtcaagcagttcctcatctcccctccagcctctcccccagtggggtggaagcagagcgaagatgcgatgcctgttataaattatgatttactctgtgctgtttccaaattgggaccaggtaataaacttctatttttcctattttcttccccaagaaacttttgtattgaagatcgtattcagcagtgtgcattgtggcagtatgattagagcagaggataaagtcaaacacacctgggttcagattccagctgtggcatctgcttgctctgtgatcttgaacaagttact

SEQ ID NO: 42208 - DNA, 601 bp, Human
ggaggtggagtttgcagtgagctgagattggaccactgcactccagcctgggcgacaaagtgagactccgtctcaaaaaaaaaaaaaaaaaaaaaaaaaaagaaatgtttaattttctacaaaaagatggaacagtcaacataaaggtgaaaatgaagaaaacatagcccggtttgcaaactggctttgagcgtctcgctccctgcaggtgcagatgtccggcgaagtgcgggacaagtcctatctcctgccaccccagcctgtcaagcagttcctcatctcccctccagcctctcccccrgtggggtggaagcagagcgaagatgcgatgcctgttataaattatgatttactctgtgctgtttccaaattgggaccaggtaataaacttctatttttcctattttcttccccaagaaacttttgtattgaagatcgtattcagcagtgtgcattgtggcagtatgattagagcagaggataaagtcaaacacacctgggttcagattccagctgtggcatctgcttgctctgtgatcttgaacaagttacttagcctccattttctgagcttctgcttttccatctataaagcagggag

SEQ ID NO: 42209 - DNA, 601 bp, Human
aatgaagcaagactctgtctccaaaaaagtaaaaataaaaaattaagtattaaatgatgtatagataatactcagtaaatgtaactaatttttactactacagattttgctagtacttgataggcagttagtgaatatgaggtgccttctctccccagccccaccaagtatcagacaaacaacaactactttgaatatattacaaggaattggtggtgatatcatctcactccttcaatatttttgtcatttctttttcatttcctttttccttctctttactttctctacctctcttccttttaaaatcatataagaaaccgatgtgatgctggttcagacagttgtccacccaagacagagttatgtctcttgtaggggaataaaagaggcattttgaggaagaagtgattcagtgctgtttttagacgttagagctgtgtcttagatatccaagttcctataatcaagggagtgcctatgctgcctggatccttacaagtatctcccaaactgaaaccattatgatgtcagagtcacttggctggatgcggtggctcacacctgtaatcccagcactttgggaggccaaaacaggcag

SEQ ID NO: 42210 - DNA, 601 bp, Human
atttctttttcatttcctttttccttctctttactttctctacctctcttccttttaaaatcatataagaaaccgatgtgatgctggttcagacagttgtccacccaagacagagttatgtctcttgtaggggaataaaagaggcattttgaggaagaagtgattcagtgctgtttttagacgttagagctgtgtcttagatatccaagttcctataatcaagggagtgcctatgctgcctggatccttacaagtatctcccaaactgaaaccattatgatgtcagagtcacttggctggrtgcggtggctcacacctgtaatcccagcactttgggaggccaaaacaggcagatcacctggggtcaggagatcgagaccagcctggccaacatgataaaaccccgtctctactaaaaatacaaaaacaaattagccgggcgtgatagcgggcgcctgtagtcccagctactcgggaggctgaggcaggagaatggcgtgaacccgggaggcggagcttgcagtgagccgaggtcgcaccactgcactccagcctgggcgacagagcaagactccatctcaaaaaaaagaaaaaaaaaaac

SEQ ID NO: 42211 - DNA, 601 bp, Human
gcaggagaatggcgtgaacccgggaggcggagcttgcagtgagccgaggtcgcaccactgcactccagcctgggcgacagagcaagactccatctcaaaaaaaagaaaaaaaaaaaccatctcgactgaaaatacaaaaattagctgggcgtggtggcacacacctgtagtcccaactactcgggaggctaaggcaggagaatcgcttgaacctgggaggcagaagttggagtgagccgagatcgtgccactgcactccagcctgccgacagagcgagactccatctcaaataaataaatwaattaattaaacagattaactcatattattcataaaacaataattagcatttgcattttaactcccaagacttcagtactgaaacaacattttatacaagccttaaagtatcaaatctttaacaccaaaacaagataaaatactctaacatagtatttaaagatttaaagaacaagaatcacccattaaaataggagtagaacaaaaagttgcaagggacaaaagagttctttttgctggaagtgatgcttttgtcatggttattttgtttgcctctgcaggagagaaatatgaacttca

SEQ ID NO: 42212 - DNA, 601 bp, Human
ttaaagtatcaaatctttaacaccaaaacaagataaaatactctaacatagtatttaaagatttaaagaacaagaatcacccattaaaataggagtagaacaaaaagttgcaagggacaaaagagttctttttgctggaagtgatgcttttgtcatggttattttgtttgcctctgcaggagagaaatatgaacttcacgcgggaacagagtcgacacccagcgtggtggttcatgtctgtgaaagtgaaactgaagaggaagaagagacaaaaaaccccaaacagaaaattgcccagacraggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaag

SEQ ID NO: 42213 - DNA, 601 bp, Human
cagcagctcttcggaccaagaggcttctcctttcacagagaaggaaactgagacccagagaccccttcattccctcagccagttgctggcctcctggagggcaagtgtgtccgatcaacagtcccaacctaccaagggaaatcaggctgactttaagttgacaacccttgtatgcctatggcatcaatcaaaacatacatctttgtgccagccgcccccactaagcacagcacaggagaaatcacccaatggccgggccggcacctccaactcccaccccaccaattccatcactcaggcygaggaagggaaaagcaaaatttaagcgtgtaacccaggaagggagggagactgacagactgggtcaccccaacaattacagaggaataacatgaatttgcaaggatttcccaaggagctggctctagaagccttttcagcctgggtaccggaggcttgcagagaatgattcatgggaaaacactgcttcctgtttttgctttggggcttagatccatggtggcagatctggctggcccagaggcccgggtgtttttccgggctctgccatactggaagaccagggtattaacagcgagtt

SEQ ID NO: 42214 - DNA, 601 bp, Human
cagaggaacagcagcgactgcctgggttaacgagacagatgcgggcagagccagcagctcttcggaccaagaggcttctcctttcacagagaaggaaactgagacccagagaccccttcattccctcagccagttgctggcctcctggagggcaagtgtgtccgatcaacagtcccaacctaccaagggaaatcaggctgactttaagttgacaacccttgtatgcctatggcatcaatcaaaacatacatctttgtgccagccgcccccactaagcacagcacaggagaaatcacccaayggccgggccggcacctccaactcccaccccaccaattccatcactcaggctgaggaagggaaaagcaaaatttaagcgtgtaacccaggaagggagggagactgacagactgggtcaccccaacaattacagaggaataacatgaatttgcaaggatttcccaaggagctggctctagaagccttttcagcctgggtaccggaggcttgcagagaatgattcatgggaaaacactgcttcctgtttttgctttggggcttagatccatggtggcagatctggctggcccagaggcccggg

SEQ ID NO: 42215 - DNA, 601 bp, Human
gacccccagggcaacaagggtgaaagcaaggagacctgtttggttttcgggagtctgggggcaataattcaggtgggggaagatagcttagtcgtgggtggaggcagaggaagccagggaaatctgttagattctgaagatactttgaatgtggagtcagaaggatttactaaaattaaaatgtggcgcagtagcgaagcagagagtgaaacaggagtccaaggtttggggcctgaacagctggaggaacggtgttcccttttaggggaagagcacgtgggaaacacaaatttggcttggrgtatgtatgttgagtctgagatgtcaatgagacatgttagatcttccatgatctggtcctccatttcttccctcttccctccctgagcctgcattccaaacagaccatcatccttcctgaacggtcatgccaattcatgtcacttttttttccaagagtactttgccctaaaaaaaatcgtacccacctttacttgagtacccagtccacccatccaactaacaagagactcagtgcctgatctacatccagcccagggagggctatattagtagcatctcgtgctgacctggcattgca

SEQ ID NO: 42216 - DNA, 601 bp, Human
gccaggtgaattggcacgtacctgtagtccccactactcgggaggctgaggcaggagatttgcctgaacccggcaggtggaggttgcagtgacccaagatcacgccaccgcactccagcttgggcgacagtaagcctccacctcaaattaaaaaagaaaaaccaaagagaagacagggagcaagacttgcagctatctgagaaaatgtccaggcaaaggcaataactagcaggtaccaagacagatgtgtggcatgttcaagaagcagcaaggaggcaagaatgctggagccgaggccacrgtaaggactctggctttcaccgaggtgggaagccactagaggcctgtcttgtgtttcagccactccagcgagtgttgtgaacagacccccagggcaacaagggtgaaagcaaggagacctgtttggttttcgggagtctgggggcaataattcaggtgggggaagatagcttagtcgtgggtggaggcagaggaagccagggaaatctgttagattctgaagatactttgaatgtggagtcagaaggatttactaaaattaaaatgtggcgcagtagcgaagcagagagtgaaacaggag

SEQ ID NO: 42217 - DNA, 601 bp, Human
taaaaaatacaaaaattagccaggtgaattggcacgtacctgtagtccccactactcgggaggctgaggcaggagatttgcctgaacccggcaggtggaggttgcagtgacccaagatcacgccaccgcactccagcttgggcgacagtaagcctccacctcaaattaaaaaagaaaaaccaaagagaagacagggagcaagacttgcagctatctgagaaaatgtccaggcaaaggcaataactagcaggtaccaagacagatgtgtggcatgttcaagaagcagcaaggaggcaagaaygctggagccgaggccacggtaaggactctggctttcaccgaggtgggaagccactagaggcctgtcttgtgtttcagccactccagcgagtgttgtgaacagacccccagggcaacaagggtgaaagcaaggagacctgtttggttttcgggagtctgggggcaataattcaggtgggggaagatagcttagtcgtgggtggaggcagaggaagccagggaaatctgttagattctgaagatactttgaatgtggagtcagaaggatttactaaaattaaaatgtggcgcagtagcgaag

SEQ ID NO: 42218 - DNA, 601 bp, Human
ttgaggttgggagttcaagatcagcctggccaacacggcgaaaccccattacctactaaaaaatacaaaaattagccaggtgaattggcacgtacctgtagtccccactactcgggaggctgaggcaggagatttgcctgaacccggcaggtggaggttgcagtgacccaagatcacgccaccgcactccagcttgggcgacagtaagcctccacctcaaattaaaaaagaaaaaccaaagagaagacagggagcaagacttgcagctatctgagaaaatgtccaggcaaaggcaataacyagcaggtaccaagacagatgtgtggcatgttcaagaagcagcaaggaggcaagaatgctggagccgaggccacggtaaggactctggctttcaccgaggtgggaagccactagaggcctgtcttgtgtttcagccactccagcgagtgttgtgaacagacccccagggcaacaagggtgaaagcaaggagacctgtttggttttcgggagtctgggggcaataattcaggtgggggaagatagcttagtcgtgggtggaggcagaggaagccagggaaatctgttagattctgaagatac

SEQ ID NO: 42219 - DNA, 601 bp, Human
gatgcccagttagggggacaggcagatacctatgtacacttgtaggcagccgtagcctgctgcttgttagcttgcttcctacttattgtcagcaatgagaaagacagaaggccggggatggaaaattctattccggggacacccctctactaaggtgactacatctaagtataaaccaaagggaaaggcctagtgtggtggctcacgcctgtatcccaggactttgggaggccaaggcgagcgagcagatcacttgaggttgggagttcaagatcagcctggccaacacggcgaaaccccrttacctactaaaaaatacaaaaattagccaggtgaattggcacgtacctgtagtccccactactcgggaggctgaggcaggagatttgcctgaacccggcaggtggaggttgcagtgacccaagatcacgccaccgcactccagcttgggcgacagtaagcctccacctcaaattaaaaaagaaaaaccaaagagaagacagggagcaagacttgcagctatctgagaaaatgtccaggcaaaggcaataactagcaggtaccaagacagatgtgtggcatgttcaagaagcagcaagga

SEQ ID NO: 42220 - DNA, 601 bp, Human
aaacaggtaagaaacaccctttttctacaagtttaagaagtgccattatgctgggttcacaaaacagcttttaagtcaacaaaataaatgacagagggggctccaagtgcaaagctggcaacggtgctcgcctcttaggtatgaaaggcgattccacaaaatttaggtccggcaatctacactgagctgagctttccttgttctcatgcagtaagacctcagtggctgcctattatcttcacgacacagcctggttttccaggctttttaatcaatgagtaactcactgagcacctactgygtgccagacactctcttaggcgaggacacggcagtgactgaaagagaggggaaagccctgctggcctggagctgatgcccagttagggggacaggcagatacctatgtacacttgtaggcagccgtagcctgctgcttgttagcttgcttcctacttattgtcagcaatgagaaagacagaaggccggggatggaaaattctattccggggacacccctctactaaggtgactacatctaagtataaaccaaagggaaaggcctagtgtggtggctcacgcctgtatcccaggactttgg

SEQ ID NO: 42221 - DNA, 601 bp, Human
ggtcctctgtggcttagggtatggcttgccaagacaggggcttagtgaacatgtgtgggaaacgtgagagccagagatggctgcaccacgcaacggaacctgcgctgacgccgccttcatctttgagcagcttcctaattggcttccctgcctcagatctcagatacagaacttctccttaccgtaggctggatctgattacttgtctgtgagacctctgaatggctccagtggccttcagagcagggctgcgctatggtagggctgtgtgagccacctgccaccactgcacaccagcacytctcagcctgggtcctgtccactcccctcacgctcagtgccacagtaacagcccataagcacccggcccttcggtcctcccagatgtggtcccatctgcagaagcccagcgtcctgactggcacctgcagccactcagattctcctgagatgaaggccccccaccaccctctgcttcccctgccgtcaggtggtcagactgaaggcctagaggttcctggctctgcacctggcaggcgctgctgccagctcgtttgcacccaggtgataatccaacgcaccacttccttctgccacctag

SEQ ID NO: 42222 - DNA, 601 bp, Human
gtacccctggcatttggggctggacagttctttgtggaaggacggccatgtaccttgtcggatgtttggccacaaccctgacttcagataccagtggcacaaaaatgtctgcaaacgttgccagatatccctcaggggaatgaggtgggggaaattacccctccctgaaaatcactgattttaatcctggtcctctgtggcttagggtatggcttgccaagacaggggcttagtgaacatgtgtgggaaacgtgagagccagagatggctgcaccacgcaacggaacctgcgctgacgccrccttcatctttgagcagcttcctaattggcttccctgcctcagatctcagatacagaacttctccttaccgtaggctggatctgattacttgtctgtgagacctctgaatggctccagtggccttcagagcagggctgcgctatggtagggctgtgtgagccacctgccaccactgcacaccagcacttctcagcctgggtcctgtccactcccctcacgctcagtgccacagtaacagcccataagcacccggcccttcggtcctcccagatgtggtcccatctgcagaagcccagcgt

SEQ ID NO: 42223 - DNA, 601 bp, Human
cctgcctggtttctccccacctctgccgtgtgtctcaacgctcctcctggagaactcttattcatccttcaagacccaactcaaatgtggcacttctccagcagctgtccccgctctgtggcacagctggctcctccctcacattcccagagcacccagggcattgttcttttgaagcacttaacctggtgccttcgaaggttctttaccagagttttcaaccttggtacccctggcatttggggctggacagttctttgtggaaggacggccatgtaccttgtcggatgtttggccacawccctgacttcagataccagtggcacaaaaatgtctgcaaacgttgccagatatccctcaggggaatgaggtgggggaaattacccctccctgaaaatcactgattttaatcctggtcctctgtggcttagggtatggcttgccaagacaggggcttagtgaacatgtgtgggaaacgtgagagccagagatggctgcaccacgcaacggaacctgcgctgacgccgccttcatctttgagcagcttcctaattggcttccctgcctcagatctcagatacagaacttctccttaccgtag

SEQ ID NO: 42224 - DNA, 601 bp, Human
cacccctcattggactacgtgtgagcgggacaccaccacctccgttttcagtcttcccctctcctactccccacccagggcccaccagggccttaactgatgagttgcaaaggtagacctgggggtggctcccagggttcaaattccagcaccttccagaggttcagcatcctcacctctcaaaagagagatgagggtatccacccaacagggcagtcatgaagacaagagcagaggtccctgccagggcccagacaaccttctgaagatgctttacgaattagctccgttaaatcttacrctgatcccatgataacattcctcccactctcgcaggcatggaaacagaagaggcaagcacaccaagtttcagccacagaccagcacaaaatacactcaacaaagaacagagaggtgctcaggggtatacactggattggacagtggggcgggggtaggggtgggatgctggcctttccctggagagcaggcaggacccatacgtagaagtgacaagcaaggtgaccaaagctaaggacccacaggtctaaggagcaggcacatcgccagggcagggagtgcctgcccatcactgagacgg

SEQ ID NO: 42225 - DNA, 601 bp, Human
ggttggtctcaatgttagtgtgattctttaatacagagaataaagtctgcactggccaaccagctgtgtgcttccaaacagtgtacaggcagctccttgagctggctgaggacggggtggtcactcacaggccgccatgccctgaacgactttcccctcctgcctcccagctcagcctcagatgccttgaaacaggcctgggggtactcaccgtgtggccctgcacagcagcacccctcattggactacgtgtgagcgggacaccaccacctccgttttcagtcttcccctctcctactcyccacccagggcccaccagggccttaactgatgagttgcaaaggtagacctgggggtggctcccagggttcaaattccagcaccttccagaggttcagcatcctcacctctcaaaagagagatgagggtatccacccaacagggcagtcatgaagacaagagcagaggtccctgccagggcccagacaaccttctgaagatgctttacgaattagctccgttaaatcttacactgatcccatgataacattcctcccactctcgcaggcatggaaacagaagaggcaagcacaccaagttt

SEQ ID NO: 42226 - DNA, 601 bp, Human
agcacggtgagtcaagggaggtaacaaatgctcaacaccttcacacaatcccaggtcacgtcactgcaaatcagggaccatatgtggcggcctttactcctccctgtggttttgttgtcttccttacggttggtctcaatgttagtgtgattctttaatacagagaataaagtctgcactggccaaccagctgtgtgcttccaaacagtgtacaggcagctccttgagctggctgaggacggggtggtcactcacaggccgccatgccctgaacgactttcccctcctgcctcccagctcrgcctcagatgccttgaaacaggcctgggggtactcaccgtgtggccctgcacagcagcacccctcattggactacgtgtgagcgggacaccaccacctccgttttcagtcttcccctctcctactccccacccagggcccaccagggccttaactgatgagttgcaaaggtagacctgggggtggctcccagggttcaaattccagcaccttccagaggttcagcatcctcacctctcaaaagagagatgagggtatccacccaacagggcagtcatgaagacaagagcagaggtccctg

SEQ ID NO: 42227 - DNA, 601 bp, Human
ggccaaggctgaatgacagcaaaaaacctcagctccaaagcaggaatgtaaacttctgcgacaacacaacgccttctcctaattatcttttaaggcccaggcaaagggcttctcctccaagcagccttccctgatgctccaagctagaaatcatctctcccaccctgaacccccaccttccctgactcccaccccactgccctcactactttccaccttggactacacatcatttgtgccccacctgccttctgcactacgtggacaccagagtggggaaggttcacacttgattcaccayagcagctgccaaataccgacaaagaccagaacttggctggagcctggtagctgtttatcaagaaacaaatccccaccggccacttactattcactctcagacaggccctgggtgggcccctcagtggattctctttgaaacctcacaacacctgctgtaaggaaggtaacctcataatcccacatgacaaagaaaccaaggcagacactgggcgatacgccccaggccacccagctgttaagtggcagcgccagacctgaactcagggccagttgctgactcacctgggttatgagcata

SEQ ID NO: 42228 - DNA, 601 bp, Human
aaaaagcgctcagtgtcattagtcttgggaaatgcaagtcaaaactacaacagaataccactccatactcactagaatcaataaaaagaaaagactgacatcaccaagtgctggcaagggtagaggggtggggacactggaatgttcacactgctggtggaaatgcaaaatggtacagttggaaaagagttgggcaggttatttataaacctaaacagacactactcacaccaaacaccagcaaccccactcctaggtatctgccctggagaaatggaagcatgtgtccaccaaaagacayaggagcaatgttcacagaagctttctttgcaatggccaaaaactggaaatacccaaatatccatcaacaggtgaacagagaaacaggcaacacaccgcactgcttagtgatagaaaggaacaaagtgcaaatgcactcaacaccagctatcaatcgccaacatgttatgcaaagtgaaaaagccagacagaaaagactacacattgcctctcacttcatatgaaagaagattttagaaaaggcaaccccaatgacagaaagcagataagcagctgctgggggtgagggtggaaggggtgg

SEQ ID NO: 42229 - DNA, 601 bp, Human
agcacatgaaaaagcgctcagtgtcattagtcttgggaaatgcaagtcaaaactacaacagaataccactccatactcactagaatcaataaaaagaaaagactgacatcaccaagtgctggcaagggtagaggggtggggacactggaatgttcacactgctggtggaaatgcaaaatggtacagttggaaaagagttgggcaggttatttataaacctaaacagacactactcacaccaaacaccagcaaccccactcctaggtatctgccctggagaaatggaagcatgtgtccaccraaagacacaggagcaatgttcacagaagctttctttgcaatggccaaaaactggaaatacccaaatatccatcaacaggtgaacagagaaacaggcaacacaccgcactgcttagtgatagaaaggaacaaagtgcaaatgcactcaacaccagctatcaatcgccaacatgttatgcaaagtgaaaaagccagacagaaaagactacacattgcctctcacttcatatgaaagaagattttagaaaaggcaaccccaatgacagaaagcagataagcagctgctgggggtgagggtgga

SEQ ID NO: 42230 - DNA, 601 bp, Human
tgaagcctccaagtatggcccaagctatccgtatcaactcttctgtgcttccagatcatttaacatgtccaccgggatggcacaacacacatcatagtccctagcattcctgtccatctcctccaactctgctgtgccctgcttaacatgacctttatctcactagccatctcaataagtggttttggggagaaaaaaagaagtacacacagaccttctctttcatccctaagacttaacacagcattatgtgatataatagacaccagtcataaattaatccattttgggataatcgttygccagtgaaattagaatgtatgaaggtgtctatccaaagaagatactacgaatgacaagtaagcacatgaaaaagcgctcagtgtcattagtcttgggaaatgcaagtcaaaactacaacagaataccactccatactcactagaatcaataaaaagaaaagactgacatcaccaagtgctggcaagggtagaggggtggggacactggaatgttcacactgctggtggaaatgcaaaatggtacagttggaaaagagttgggcaggttatttataaacctaaacagacactactcacac

SEQ ID NO: 42231 - DNA, 601 bp, Human
cagactcctgtgagggtgcccgggcacccctagcatgaccccacctgctgccaccccacccctcatctcccttagacccctcctcaagacctgaggggcccccatctcacgagactgagaccacagaagtacagaccctgattcctgcccaccttctgccatcctgtttaagctccacgtctgtgtgtagtctgtgcccttggccagcacctctccctgcctacggacacccactcacccatcaggcctaacggaagcgttccctcctccatgaagcctccaagtatggcccaagctatcygtatcaactcttctgtgcttccagatcatttaacatgtccaccgggatggcacaacacacatcatagtccctagcattcctgtccatctcctccaactctgctgtgccctgcttaacatgacctttatctcactagccatctcaataagtggttttggggagaaaaaaagaagtacacacagaccttctctttcatccctaagacttaacacagcattatgtgatataatagacaccagtcataaattaatccattttgggataatcgttcgccagtgaaattagaatgtatgaaggtgt

SEQ ID NO: 42232 - DNA, 601 bp, Human
cgagccttgcccccatacagtacctccggaggcaatgtagaatccgctgggcgcatacttggccaccaccacctgatgggcgtgctctgtgtagatgtcagcaagggctgggttctgcaggaggagaccccggaatgaacagaaggaatggagaagcagtcaagcttccagctctccacatcaacagatatggggtgaaaggggtgtacaaagaaacactgaagctaaaaccgtgaagaaaatcgcagaagcataccacttgcctacgtatctactgcctgcctacctatctctgggtgayagaatttcatgttactttaattcgttctccttagtctatgactgtacaacaaggtgatttttttccttttctgcttttctgtactttccataatacagaacaaatatatcagtgaaacacatacacaaaaggtggattagagcaagaagccctggttctaatccctcccatttgtgggaagctgcattcattccagcgctctgttctcttccgtgtttaggaccagctctcctggctgccaatcaatgttggaccccaaactcagcgcctggctgtgctgtgcaggagcagagcaggaca

SEQ ID NO: 42233 - DNA, 410 bp, Human
agtgagtgaatgaatgagtgggccaccattctagaaggggtaccactctcactcctgtacctcttgttcccatctgtgtacaggaaaagctctgcgtcaaagaactaagtaaataaaaaaacatccttcaagaggaaagatctctccacccctgcctctgcctagcctcccactgagccacacaaaagcccaggctgcagagagcaaaggcccagtgtacaaataaaacgtgagcgctggcctggaggccagcattgtggtagcactgggaaaggagcagcgggtaaagatgacacaaaayaaaacatccattcacacatacacacacacacacacacacagacacacacacacacacacacacacacacacacggcccacaagggctccaacataccatgccatggctt

SEQ ID NO: 42234 - DNA, 494 bp, Human
atcagcttactcacttggcctccctgggctgcagatggctaggcaaggcaggcagtaagtatctgttgagcttatgaatgaatgagtgagtgaatgaatgagtgggccaccattctagaaggggtaccactctcactcctgtacctcttgttcccatctgtgtacaggaaaagctctgcgtcaaagaactaagtaaataaaaaaacatccttcaagaggaaagatctctccacccctgcctctgcctagcctcccactgagccacacaaaagcccaggctgcagagagcaaaggcccagtstacaaataaaacgtgagcgctggcctggaggccagcattgtggtagcactgggaaaggagcagcgggtaaagatgacacaaaacaaaacatccattcacacatacacacacacacacacacacagacacacacacacacacacacacacacacacacggcccacaagggctccaacataccatgccatggctt

SEQ ID NO: 42235 - DNA, 601 bp, Human
aggatggtacaagcatagggccacggcgtgcatgagtcccgccctcccctactggtgcttagctctctcagcaatttggtcatagctgtcactctccagagaggctgatgaggcccacatcagcttactcacttggcctccctgggctgcagatggctaggcaaggcaggcagtaagtatctgttgagcttatgaatgaatgagtgagtgaatgaatgagtgggccaccattctagaaggggtaccactctcactcctgtacctcttgttcccatctgtgtacaggaaaagctctgcgtcraagaactaagtaaataaaaaaacatccttcaagaggaaagatctctccacccctgcctctgcctagcctcccactgagccacacaaaagcccaggctgcagagagcaaaggcccagtgtacaaataaaacgtgagcgctggcctggaggccagcattgtggtagcactgggaaaggagcagcgggtaaagatgacacaaaacaaaacatccattcacacatacacacacacacacacacacagacacacacacacacacacacacacacacacacggcccacaagggctccaacatacca

SEQ ID NO: 42236 - DNA, 601 bp, Human
gcacaaagcagagtaagacagagccgaacccaggtcttccccaaccccaaggcctaccatctcccatacacccttcaggacaggctgctgtgcacacgcaggatggtacaagcatagggccacggcgtgcatgagtcccgccctcccctactggtgcttagctctctcagcaatttggtcatagctgtcactctccagagaggctgatgaggcccacatcagcttactcacttggcctccctgggctgcagatggctaggcaaggcaggcagtaagtatctgttgagcttatgaatgaatragtgagtgaatgaatgagtgggccaccattctagaaggggtaccactctcactcctgtacctcttgttcccatctgtgtacaggaaaagctctgcgtcaaagaactaagtaaataaaaaaacatccttcaagaggaaagatctctccacccctgcctctgcctagcctcccactgagccacacaaaagcccaggctgcagagagcaaaggcccagtgtacaaataaaacgtgagcgctggcctggaggccagcattgtggtagcactgggaaaggagcagcgggtaaagatgacacaaaa

SEQ ID NO: 42237 - DNA, 601 bp, Human
cagccatgctgggcatatccatgccttactggctccttcacaccctaagaggcaggcactagcagccccagtttggaagagaaaattcgggcccaggaaggtgagttactcaactaaggctacgccaccagtaagaggctgccatggtctgagtgtgacctcgaaaaccatgtgctggaaacttaatccccaatgcatcagaggcggcctatggagaggtgattaggccaggagggctctgccctcaggaatgggtattatgacatgagcagcttcccaataaaaggacaagcccagcccstcttcttctctcaccttctctttgttcttctgccatggactgacacagcaaaaggcccttgacagataccggcccctgctgtgcaacggcccctgctgtccaactgcccagccccaagaactatgagccaatacatttgtgttagtcgtaaattacccagcctgtgagcacaaagcagagtaagacagagccgaacccaggtcttccccaaccccaaggcctaccatctcccatacacccttcaggacaggctgctgtgcacacgcaggatggtacaagcatagggccacggcgtgcatg

SEQ ID NO: 42238 - DNA, 601 bp, Human
gcatgttttacagatggagctggagaagatctaaacacaaaaaccattaaatgcctactatgagccagactccgggcccaacccttcaccgtgacctcagctgaccgccaacagcagtcagccagctcacccagccgcctggctcgatcagaacagagccccagttttgtgacaggtaacgggtcacccaggggtaagtacccattagtgcaacagccatgctgggcatatccatgccttactggctccttcacaccctaagaggcaggcactagcagccccagtttggaagagaaaattygggcccaggaaggtgagttactcaactaaggctacgccaccagtaagaggctgccatggtctgagtgtgacctcgaaaaccatgtgctggaaacttaatccccaatgcatcagaggcggcctatggagaggtgattaggccaggagggctctgccctcaggaatgggtattatgacatgagcagcttcccaataaaaggacaagcccagcccgtcttcttctctcaccttctctttgttcttctgccatggactgacacagcaaaaggcccttgacagataccggcccctgctgtgcaac

SEQ ID NO: 42239 - DNA, 601 bp, Human
taggggcatcagaatgacgtgtgggcctcaggccacctttgtggaatgggacggcactggctacacctgcctctcctttgcagttgctgcagtgacttctggaaacgaggtgcacagctgtgagggtgcagcgtgctgcccactgcgatgcctcagcgtggcctggcggcctccacctgggcctgcagaccgggcttcctgtgcagcttcccaacagcgtgctgctgcctggcaaatcagcagcctcactcacacaccgagcagttccacgacgcacaggaatccaagcgtaagattcttytgtgagagtagcaggtgggtgttgcgggggaaggagaattacacacagaactcgatgctgattctcttctcaccggagcgtgggcagccaattgtaacagaagcaacaccgggggccacgtacccccaatcccccaccacgatcctgtcaccaagtaccaagtcccaatcccgacacaccctctccaaatgagcactgtgttggcgtgaagaaatgggagcattctagactaactctcaaggcttcacgctttaaaacctcagccccatctgctaagcaggtaaaggcgcctttttaaga

SEQ ID NO: 42240 - DNA, 601 bp, Human
ctctgcattttgccagaaatcttgccagaaatcatctggataacaaaccctgcttaggcatcagaaaaagcccagggacacatgatggtaaactccaatatgcccggaagtggtttagttttctcactgtgtttcttttcttgtaggggcatcagaatgacgtgtgggcctcaggccacctttgtggaatgggacggcactggctacacctgcctctcctttgcagttgctgcagtgacttctggaaacgaggtgcacagctgtgagggtgcagcgtgctgcccactgcgatgcctcagcktggcctggcggcctccacctgggcctgcagaccgggcttcctgtgcagcttcccaacagcgtgctgctgcctggcaaatcagcagcctcactcacacaccgagcagttccacgacgcacaggaatccaagcgtaagattcttttgtgagagtagcaggtgggtgttgcgggggaaggagaattacacacagaactcgatgctgattctcttctcaccggagcgtgggcagccaattgtaacagaagcaacaccgggggccacgtacccccaatcccccaccacgatcctgtcaccaagta

SEQ ID NO: 42241 - DNA, 601 bp, Human
tcagctcaggcacagcatcatggagttctgcttcagcttgtactgaaacgccttcagaacatgccttgttccttttcaaggcagcagctccaacacgacccagctggtccctccgcagtcatacgccagtccctctcccacctgggtaactagggaagcacctgccaccccagcgctgcacccccaagctcagggcagcttcctggtcccggccacagggggcctctgcagggagtgggtgcagaaggcgcagatgaagacaggcccgagttgccaccacagctgctcattctcaggaggsgaggggcggcaggcaaggccaccaaggcctgagcgctggtgcggaggcaaaggcagcccagactcagccgtcatgtgctgcagaatgaaagatctggggaaaaaagaccactgctatgtggatttcacagcaagtggaacttaattccctctaaaataaaaaatgcccacatatagttttaaaatcttttactataaaaggctcaattaattcctgagaacttccacatcccaggctttccgaccgcatcagaagagcccacatacgggaggaagcccagcgatgctcagcccaccatgt

SEQ ID NO: 42242 - DNA, 601 bp, Human
gcctcattcaggcaaatgaagaccaaagctgggctacggtccctcaggacgaggggcacacagggaatgctgcttgcatttcagctcaggcacagcatcatggagttctgcttcagcttgtactgaaacgccttcagaacatgccttgttccttttcaaggcagcagctccaacacgacccagctggtccctccgcagtcatacgccagtccctctcccacctgggtaactagggaagcacctgccaccccagcgctgcacccccaagctcagggcagcttcctggtcccggccacagggkgcctctgcagggagtgggtgcagaaggcgcagatgaagacaggcccgagttgccaccacagctgctcattctcaggaggcgaggggcggcaggcaaggccaccaaggcctgagcgctggtgcggaggcaaaggcagcccagactcagccgtcatgtgctgcagaatgaaagatctggggaaaaaagaccactgctatgtggatttcacagcaagtggaacttaattccctctaaaataaaaaatgcccacatatagttttaaaatcttttactataaaaggctcaattaattcctgagaa

SEQ ID NO: 42243 - DNA, 601 bp, Human
ccatttcattagacacaaactatccagtgcaccaccaactcctgggacctaggacatgcacacagctgtgagccacactccagagggggcgtgtggtcatcctagaccaccaaaccaactgctcacccgaccggaggaagcggatggccagagaggcaaagaacctggcccaagtaatgcgcatggcgaaggcagacaacagagagaaactcagtggggcctttaaacccatccaggagtacctatcccaggagcctgcctggcatgaagacatccccatgggtgagatgggggaaggcarggagatggtctcgccaccctccctttttcaggccacggtcagaccctctgaggggaacctacccctgggttcgcaaaatgccagtgctggagacccgagaccacggagcccagggtctcctttcagaaccgttctcctgtaaccccggaagttacttccgcaggtcacctaccgcgtcttcaatgtcactgggtaggaatgagccggcacccaggcttattccaggccaaatgttcctccactcccatcttcctggagcctcattcaggcaaatgaagaccaaagctgggctacggtccc

SEQ ID NO: 42244 - DNA, 601 bp, Human
tcttccgtgctgaacatttttccacctacaatcacagcttgttagatctggcagtgagttctcagttctgcatcataaggctgagcccccaggacgacatgctgctctaagtaaccatttcattagacacaaactatccagtgcaccaccaactcctgggacctaggacatgcacacagctgtgagccacactccagagggggcgtgtggtcatcctagaccaccaaaccaactgctcacccgaccggaggaagcggatggccagagaggcaaagaacctggcccaagtaatgcgcatggygaaggcagacaacagagagaaactcagtggggcctttaaacccatccaggagtacctatcccaggagcctgcctggcatgaagacatccccatgggtgagatgggggaaggcaaggagatggtctcgccaccctccctttttcaggccacggtcagaccctctgaggggaacctacccctgggttcgcaaaatgccagtgctggagacccgagaccacggagcccagggtctcctttcagaaccgttctcctgtaaccccggaagttacttccgcaggtcacctaccgcgtcttcaatgt

SEQ ID NO: 42245 - DNA, 601 bp, Human
aggctcatcctaactaaccgtccttggggcacctactggccatgtgacctgggccaggtcaccctccctgctgtcagcccccagttttcaggagtcagccatcagcccagtgaagagcaaggccagtcgacaggaggggtggcgcgtgctgaagacaagggaggcggtcctgcatgcccatcacaggggcatggcccaggcagccaccatacatgccagaagggctgaaacatctgctctctgccctgtcttgagtgaggaaatatgaaaaagaaaaaccaccagaaaccttgcctgtttwgagctcaaattttccttatctatcaggaaggcagcacttccggtaacagccacagctgaggtttccagccctgcttggctccagcctcaagtgggagaactatgtgaggtatgaggtccccgcagggcagaggcaatggaacagagggagcagtggcaccccagtgagggaagccagaagtcttccgtgctgaacatttttccacctacaatcacagcttgttagatctggcagtgagttctcagttctgcatcataaggctgagcccccaggacgacatgctgctctaagtaaccattt

SEQ ID NO: 42246 - DNA, 601 bp, Human
ctgtatcaacgagcccccctccccacagtcctcactccctcccaccaatatgctccctctcaccaccgaggaaaccgaggcttgaagcactgaggtcataattaagtaccacacccatgtcaacatcacagagcgacagagcgctgcaggccccagctggcctgtctccagcacacacacgctcactacctacctagtcagctcaggaaccctctgggagcccaccccattccccccagcctcagctgaccctgtacacaagaggaccacaagcccacccttaggctgttcacatgcctaygagctggtagaaggggacaggctctcggtcccctgtgcccagtcccaccccacacaagcccagcacgggcctccacgacccttggtcaatgggtgttcccaaaacacctttacaccgtgacctgcgaggctggctctggaccatccttcagcccacccatcccccgcagcaaacttccctgcaaagtgccctggggcagccctgcagcccggtccacttagttgggctgaggggcacgaaggagctacccacccaactgcctctcccgtcacccgggacgggtcagctcagtcaccatgt

SEQ ID NO: 42247 - DNA, 601 bp, Human
ccagccaaccagcggggctgcagcagtctcagtccagcctcatccctggtggacaactgacggtgtccggtccacactcctgcctgtcctcccttgcagccaacacatagccaagactgacctgtatcaacgagcccccctccccacagtcctcactccctcccaccaatatgctccctctcaccaccgaggaaaccgaggcttgaagcactgaggtcataattaagtaccacacccatgtcaacatcacagagcgacagagcgctgcaggccccagctggcctgtctccagcacacacaygctcactacctacctagtcagctcaggaaccctctgggagcccaccccattccccccagcctcagctgaccctgtacacaagaggaccacaagcccacccttaggctgttcacatgcctacgagctggtagaaggggacaggctctcggtcccctgtgcccagtcccaccccacacaagcccagcacgggcctccacgacccttggtcaatgggtgttcccaaaacacctttacaccgtgacctgcgaggctggctctggaccatccttcagcccacccatcccccgcagcaaacttccc

SEQ ID NO: 42248 - DNA, 601 bp, Human
aagaactaagagaaaagagctcaccccaaatgcccgaatcacccaagcccagatgagtgggtgggacagtggacgctgatggctcttgctacaaaatggaggaaactaatcagccactgttcaattccaacctgtcacaagtgcccatttcagtggctccctgaggtcaaaacatggacattcctactccagttccaggtcccagaagcgaggacattcctgctcgcgcaaaccccaggaccccaaatccaagtctgtggttcacctctgccgacgcctcccacaggctctggcagggtgstgtcatgtgtccctccctggccccagaacccagcaggggcaagggaggggcccggcacagtccagggacacagatgcccctcgagtagctcatccccatcaccttttcctgcacctcgagccaaggagtccaaatgcagacactgatgtctgctcctgaaatagccccttcaaagagagaagccgcgaaaagcccattaaccaaaaaaagcgagggctaaaaatagccctttccacacggaggcccggccagtgaacaaagagggagagggattggggaacctcccggggagttcagggg

SEQ ID NO: 42249 - DNA, 601 bp, Human
acccctgggtccttctgacgaatgagttaagaactaagagaaaagagctcaccccaaatgcccgaatcacccaagcccagatgagtgggtgggacagtggacgctgatggctcttgctacaaaatggaggaaactaatcagccactgttcaattccaacctgtcacaagtgcccatttcagtggctccctgaggtcaaaacatggacattcctactccagttccaggtcccagaagcgaggacattcctgctcgcgcaaaccccaggaccccaaatccaagtctgtggttcacctctgccracgcctcccacaggctctggcagggtgctgtcatgtgtccctccctggccccagaacccagcaggggcaagggaggggcccggcacagtccagggacacagatgcccctcgagtagctcatccccatcaccttttcctgcacctcgagccaaggagtccaaatgcagacactgatgtctgctcctgaaatagccccttcaaagagagaagccgcgaaaagcccattaaccaaaaaaagcgagggctaaaaatagccctttccacacggaggcccggccagtgaacaaagagggagaggga

SEQ ID NO: 42250 - DNA, 601 bp, Human
cctccaagccagcctgagcttccttgaagtgcagtgggccagggagatggctgggcctggctgacccctgggtccttctgacgaatgagttaagaactaagagaaaagagctcaccccaaatgcccgaatcacccaagcccagatgagtgggtgggacagtggacgctgatggctcttgctacaaaatggaggaaactaatcagccactgttcaattccaacctgtcacaagtgcccatttcagtggctccctgaggtcaaaacatggacattcctactccagttccaggtcccagaagcraggacattcctgctcgcgcaaaccccaggaccccaaatccaagtctgtggttcacctctgccgacgcctcccacaggctctggcagggtgctgtcatgtgtccctccctggccccagaacccagcaggggcaagggaggggcccggcacagtccagggacacagatgcccctcgagtagctcatccccatcaccttttcctgcacctcgagccaaggagtccaaatgcagacactgatgtctgctcctgaaatagccccttcaaagagagaagccgcgaaaagcccattaaccaaaaaaa

SEQ ID NO: 42251 - DNA, 601 bp, Human
aaggcagtggtgggagggcctgaggcaaagcacttctagaccccctgttgggcggggggtggacaggggtgtatgcaccactactccttccagatgaggccacacaaccttgaccatgacataaccacagctcgaatcctagacctctgaccagcacatcgagttctctcgctgccgaactccgcttccttggccagcacagcctcgccttgccgctgacttcgcactggctcctccaagccagcctgagcttccttgaagtgcagtgggccagggagatggctgggcctggctgacccctgggtccttctgacgaatgagttaagaactaagagaaaagagctcaccccaaatgcccgaatcacccaagcccagatgagtgggtgggacagtggacgctgatggctcttgctacaaaatggaggaaactaatcagccactgttcaattccaacctgtcacaagtgcccatttcagtggctccctgaggtcaaaacatggacattcctactccagttccaggtcccagaagcgaggacattcctgctcgcgcaaaccccaggaccccaaatccaagtctgtggttcacctctgccgacgcc

SEQ ID NO: 42252 - DNA, 601 bp, Human
cttgtccatgtcagtccatagggtccacattccctgtgtcaaagggcctcacagggcagttcccgagagagctgcaggaaggagccggctgcagtgaaggcagtggtgggagggcctgaggcaaagcacttctagaccccctgttgggcggggggtggacaggggtgtatgcaccactactccttccagatgaggccacacaaccttgaccatgacataaccacagctcgaatcctagacctctgaccagcacatcgagttctctcgctgccgaactccgcttccttggccagcacagccycgccttgccgctgacttcgcactggctcctccaagccagcctgagcttccttgaagtgcagtgggccagggagatggctgggcctggctgacccctgggtccttctgacgaatgagttaagaactaagagaaaagagctcaccccaaatgcccgaatcacccaagcccagatgagtgggtgggacagtggacgctgatggctcttgctacaaaatggaggaaactaatcagccactgttcaattccaacctgtcacaagtgcccatttcagtggctccctgaggtcaaaacatggacatt

SEQ ID NO: 42253 - DNA, 601 bp, Human
tgttcccgtcggggttagccgatggggtccacctcctatctgtgtcaacatggcccacggtcccttgtccatgtcagtccatagggtccacattccctgtgtcaaagggcctcacagggcagttcccgagagagctgcaggaaggagccggctgcagtgaaggcagtggtgggagggcctgaggcaaagcacttctagaccccctgttgggcggggggtggacaggggtgtatgcaccactactccttccagatgaggccacacaaccttgaccatgacataaccacagctcgaatcctasacctctgaccagcacatcgagttctctcgctgccgaactccgcttccttggccagcacagcctcgccttgccgctgacttcgcactggctcctccaagccagcctgagcttccttgaagtgcagtgggccagggagatggctgggcctggctgacccctgggtccttctgacgaatgagttaagaactaagagaaaagagctcaccccaaatgcccgaatcacccaagcccagatgagtgggtgggacagtggacgctgatggctcttgctacaaaatggaggaaactaatcagccactg

SEQ ID NO: 42254 - DNA, 601 bp, Human
tgctgttacccaccatgagggagccgtcatgcactgagggcctgttcccgtcggggttagccgatggggtccacctcctatctgtgtcaacatggcccacggtcccttgtccatgtcagtccatagggtccacattccctgtgtcaaagggcctcacagggcagttcccgagagagctgcaggaaggagccggctgcagtgaaggcagtggtgggagggcctgaggcaaagcacttctagaccccctgttgggcggggggtggacaggggtgtatgcaccactactccttccagatgaggycacacaaccttgaccatgacataaccacagctcgaatcctagacctctgaccagcacatcgagttctctcgctgccgaactccgcttccttggccagcacagcctcgccttgccgctgacttcgcactggctcctccaagccagcctgagcttccttgaagtgcagtgggccagggagatggctgggcctggctgacccctgggtccttctgacgaatgagttaagaactaagagaaaagagctcaccccaaatgcccgaatcacccaagcccagatgagtgggtgggacagtggacgct

SEQ ID NO: 42255 - DNA, 601 bp, Human
attctttccgcagtcaacaagagtttgtatcagagactgatccttaaataagcagttgtaaagctgccaacacctgccctgccctcttgctgcccacctgcaggcggcgctaacccggcaaatgcacatccagtgctaacaactctcttggcacaggaagggctcgctgctcagcaggtacgaacactaaccttcaggaaaagcaattcaaccccaaggcggataagctgccccgcgctctaagtaaatcacggacttaattttaaagcatgagctacctgtgtgggggacctgcctgtgkttgattgtgtaatgttttcagttgaattgtgcctctccaaaagacatgctgaagtcccaaccctgggacccaatgagaccttattcagaaacagggtctttgcagatgcagtccagttaaaatgaggtcattagggcaggctgtaaatccagcaggacttggtgtccttttaagagggaaatctggacacagatacagagttggggtgaagctggaggcagagatgggagttctgctcacaaaaagtaacccccagggctgtcagtatctgggaaagacaaggaaggactcggagtgcgt

SEQ ID NO: 42256 - DNA, 601 bp, Human
tctctgctcactacaagctccgcctcccgggttcacgccattctcctgcctcagcctcccgagtagctgggacgacaggtgcccgccaccacgcctggctaatttctgtatttttagtagagatggggtttccctttgttagccaggatggtctcagtatcctgacctcatgtttccccgctttggcctcccaaagtgctgggattacaggagtaagtcactgcgcctggccaataattaacttttaaacaaagttaatgattatgaccttcatcaagaacaagagcctgagcgactaaarggaaatgacatgacttccaggggcgactctgttactcgaataaggaaatgaatgcattctttccgcagtcaacaagagtttgtatcagagactgatccttaaataagcagttgtaaagctgccaacacctgccctgccctcttgctgcccacctgcaggcggcgctaacccggcaaatgcacatccagtgctaacaactctcttggcacaggaagggctcgctgctcagcaggtacgaacactaaccttcaggaaaagcaattcaaccccaaggcggataagctgccccgcgctctaagt

SEQ ID NO: 42257 - DNA, 601 bp, Human
tgccccccccagtgaggtgcccccagcagccgccctcttccctctgggctctgaaagagctcaagccccaatccttaagcttcacgatggctgagaccaggaggcctcttcctggaggcaccagccctgtctggctctgttgcccaggctggagtgcagtggcacaatctctgctcactacaagctccgcctcccgggttcacgccattctcctgcctcagcctcccgagtagctgggacgacaggtgcccgccaccacgcctggctaatttctgtatttttagtagagatggggtttccytttgttagccaggatggtctcagtatcctgacctcatgtttccccgctttggcctcccaaagtgctgggattacaggagtaagtcactgcgcctggccaataattaacttttaaacaaagttaatgattatgaccttcatcaagaacaagagcctgagcgactaaaaggaaatgacatgacttccaggggcgactctgttactcgaataaggaaatgaatgcattctttccgcagtcaacaagagtttgtatcagagactgatccttaaataagcagttgtaaagctgccaacacctgcc

SEQ ID NO: 42258 - DNA, 601 bp, Human
atgccccccccagtgaggtgcccccagcagccgccctcttccctctgggctctgaaagagctcaagccccaatccttaagcttcacgatggctgagaccaggaggcctcttcctggaggcaccagccctgtctggctctgttgcccaggctggagtgcagtggcacaatctctgctcactacaagctccgcctcccgggttcacgccattctcctgcctcagcctcccgagtagctgggacgacaggtgcccgccaccacgcctggctaatttctgtatttttagtagagatggggtttcmctttgttagccaggatggtctcagtatcctgacctcatgtttccccgctttggcctcccaaagtgctgggattacaggagtaagtcactgcgcctggccaataattaacttttaaacaaagttaatgattatgaccttcatcaagaacaagagcctgagcgactaaaaggaaatgacatgacttccaggggcgactctgttactcgaataaggaaatgaatgcattctttccgcagtcaacaagagtttgtatcagagactgatccttaaataagcagttgtaaagctgccaacacctgc

SEQ ID NO: 42259 - DNA, 601 bp, Human
catcagtgtgaactgttagtccactggaaaatttcagagcttaaaaaaacatcctgggcagtcccttagtggaggggcaggagtctgctccagcctgcctgccatgctgaccgctctacctgctgggaaagctgattagcccgagcgaaggcagaccacctccagttatgccccccccagtgaggtgcccccagcagccgccctcttccctctgggctctgaaagagctcaagccccaatccttaagcttcacgatggctgagaccaggaggcctcttcctggaggcaccagccctgtctsgctctgttgcccaggctggagtgcagtggcacaatctctgctcactacaagctccgcctcccgggttcacgccattctcctgcctcagcctcccgagtagctgggacgacaggtgcccgccaccacgcctggctaatttctgtatttttagtagagatggggtttccctttgttagccaggatggtctcagtatcctgacctcatgtttccccgctttggcctcccaaagtgctgggattacaggagtaagtcactgcgcctggccaataattaacttttaaacaaagttaatgattatg

SEQ ID NO: 42260 - DNA, 601 bp, Human
ctccttcacaccctgcccaccacattcaaactccaggcagcgccaaggcccaggcccaaggccacctgctctcgctcctccctcctgcccctggacctcagcgatgccccgtcacctgccctggtgctcagtgagcttctgctcttgcctgcagtcgggtaaagcacaggctgtgcactcccaattcagggaaggcagagccctgcaggaagtaaccgctctcaacagctgggggtgatggccactgccccgaatcactaggccctgactctccagttctcacagtagctcaaggggaacytggcacctggcctgccaccatggctaaactcatgtcccaagaaagcaaccagcatcccagccttccaccaaaaccccaagggccaaggaggcctgaggacacctctctagcttccacctggcttcccctcggttccccttccttgctggccactctggtctcttccctgtccacccagcgggcagagccttccccagggcaggccttaccttgatgacgtgcaggggcttgctggggttgtttctgtccagatagttgatgtacccggacagggagacactgagcaggtggtccttctgc

SEQ ID NO: 42261 - DNA, 601 bp, Human
cacgtctagtgaacctttatggttcagccttccccctctcagcagtgctgctgcccccactgccccggcacaaaggaaccgtgactctatgcatgagcgttgaggtgacctggtccgtaggagtcacacacacaacgttaacgaggccccttcctcgtgggcaaactcccatgtagaatggatttggtgattctagcagcccctcctagaagccgtggtgtgaaggagccactgacagcacagcacgggccgagtgcacaggcccgggggctgctccaggctggcccacactagccctgcrgggttcagaccctctgcagaggctggtcccccagagctccacggcagcaggatgcaatgggtgagggaagtgctagggtttgtctccccgagtggcttaaagcaggagcccgagaagggctgctgggatgaagtgcattgtccacctgccttgatattacagcttagaatagcaggaggggtcacccaccctgggccaccagcgctgggggaacctgacttggagttcccagcagatgcagtgtgggaagcaggcgagggcgctgctgtgagaggaggacctgaggatacagaagggacc

SEQ ID NO: 42262 - DNA, 601 bp, Human
gccccagacagttggcagcagtggtattaggaagagcactctcagggcagccctgccaacagaaacgggatggcagacctgagggctgacacctggagaacactgtcggggatggctcatgggaaactgtttttctgggcagtagcgaagccttactcacccgtgtacaatttctcaccatcccacttggaggcccactggagcatggtctcgacaagagccctcagctcccccaggcaacaacctcctcggccccatgctgtgcgtgccttcctttttatactcatcaccctgggctgtragcccagcaaggaggcgctcccgattcccctctatcctcgaggccacgtctagtgaacctttatggttcagccttccccctctcagcagtgctgctgcccccactgccccggcacaaaggaaccgtgactctatgcatgagcgttgaggtgacctggtccgtaggagtcacacacacaacgttaacgaggccccttcctcgtgggcaaactcccatgtagaatggatttggtgattctagcagcccctcctagaagccgtggtgtgaaggagccactgacagcacagcacgggccgagtg

SEQ ID NO: 42263 - DNA, 601 bp, Human
agcccagatcagcaccgaacatcagcatctgcgtgactcacacaggtgtggcatttgagagttgggacatgggggttttgacaactggcccttggggttttggtggaagggtgggatgctggttgcttttttgggacataagtttagccacggtggcaggccgggtgcactggccccagacagttggcagcagtggtattaggaagagcactctcagggcagccctgccaacagaaacgggatggcagacctgagggctgacacctggagaacactgtcggggatggctcatgggaaactrtttttctgggcagtagcgaagccttactcacccgtgtacaatttctcaccatcccacttggaggcccactggagcatggtctcgacaagagccctcagctcccccaggcaacaacctcctcggccccatgctgtgcgtgccttcctttttatactcatcaccctgggctgtaagcccagcaaggaggcgctcccgattcccctctatcctcgaggccacgtctagtgaacctttatggttcagccttccccctctcagcagtgctgctgcccccactgccccggcacaaaggaaccgtga

SEQ ID NO: 42264 - DNA, 601 bp, Human
gctcccaggtggttctaacacgcagcctgggctgatacctgctgctccatcccactgcagcccagatcagcaccgaacatcagcatctgcgtgactcacacaggtgtggcatttgagagttgggacatgggggttttgacaactggcccttggggttttggtggaagggtgggatgctggttgcttttttgggacataagtttagccacggtggcaggccgggtgcactggccccagacagttggcagcagtggtattaggaagagcactctcagggcagccctgccaacagaaacgggayggcagacctgagggctgacacctggagaacactgtcggggatggctcatgggaaactgtttttctgggcagtagcgaagccttactcacccgtgtacaatttctcaccatcccacttggaggcccactggagcatggtctcgacaagagccctcagctcccccaggcaacaacctcctcggccccatgctgtgcgtgccttcctttttatactcatcaccctgggctgtaagcccagcaaggaggcgctcccgattcccctctatcctcgaggccacgtctagtgaacctttatggttca

SEQ ID NO: 42265 - DNA, 601 bp, Human
ggctcaggcccaccttcctgccaaatcagaacgtgcactcggcaagaggccaagagacttgtgtgcaggctcaatgccttgaacttaccagaaacactcctagccatgcccagatgcccacgggtgttccttctggaggcctgcaagctcctgctgccctgagacttccctgtaaacttagtgcctctgggggcgtcagcagccagcgctttttagagctcccaggtggttctaacacgcagcctgggctgatacctgctgctccatcccactgcagcccagatcagcaccgaacatcagyatctgcgtgactcacacaggtgtggcatttgagagttgggacatgggggttttgacaactggcccttggggttttggtggaagggtgggatgctggttgcttttttgggacataagtttagccacggtggcaggccgggtgcactggccccagacagttggcagcagtggtattaggaagagcactctcagggcagccctgccaacagaaacgggatggcagacctgagggctgacacctggagaacactgtcggggatggctcatgggaaactgtttttctgggcagtagcgaagcctt

SEQ ID NO: 42266 - DNA, 601 bp, Human
cccgccgaccagcacccgtcgcggggagccacaagggggtcggtccaggaggacttcgctggccacattcgcttcaggccctggtttgtgaggtttcttctctctccctgcccaggagtgctggccctgctgagggcaggggtctctctgatcactgtaaaagcccaaggctgtccgtgaacgctgacgctcctaccctaacctccctgactgctgcagtggagggcacacaaggctggtccacaaccagacagctgcttccagagggcggcgtttagccccctccatatctgagcctgasacaaaaataacagctagggtgcaggctcctcatgcctttctcctgcaaagggaggccagctcctggctggcccctctcctctgagctcagggcttttccgcaggaattcttgatctctgtggtatgccacatgttgccacaatatggcatagatctttggatgcaggtctccttggagacaggtacacagttaccagtgggactggagaatgggcaacgaatgcagctactttcatcttttccacagagacgtggggaaaaatcatcacatgccccagtaagagacactgagctgggcgg

SEQ ID NO: 42267 - DNA, 601 bp, Human
agtagggccaaggctggcgccaggtgccattggcagaggtagtggcagcccaagctcagggccgttaagccacactctcagggttgcacgacaagaagggactgatcaggtcggagccgcccatggcttttcctcagcataagccctggagttgccaaggacaactccaggggacagttgcctgtccccatgtacagacaggccacccctagaagccacacgggtcagaagagcgtgtggctgtggctgcagctggagccacctggctggcctggcctctggcatcatgggaacaggaaaytcccccctagagccagcggctccggagccagctctttgagtcaaaggatattaatgtgtccgtcgtggctcccagagtaaatgtaggacttgccgccgtttttatgcaccgtcagacactggatcgatttactgtgaccctgtgaaggagacacactgggcgggtaagctgatgacacactgccctgccctctgccacccgctttccaccaacgaagcttctgggtaatggagggggcagacgcccctcaatccatggcagtgcaggtgctctgaggccccagtagccccagctgcccga

SEQ ID NO: 42268 - DNA, 601 bp, Human
acagggattgggatgaggcagaaagggagccgtgctgaaggcctactggggaccagcaagctggggaggctccggcgtctcctctgctactagttatcgggtaggcgcaaccctctaaccccacatttctttatgttttgggggcagagggtggcatgtctgccctcctctcccagcctggggggacctccttgggtcccggacagtccctttgggaggtacagcacatgcggaccagagctgtccacacaaaaggcagtctccaacacagcacggtgctcagggagggcagcagaacaaygcacagcaggtgccatcatcagcaacgtgtgtgggcatccctgcccaggcactctgcagatggtggctccaaggttcaagacacacccgtgagcagggtgtcaccagccccaggccatgcaggaaaaacacaacagaagcccccatcatcagggagaaaccaggactcatttaaagaaacccagacaaggacttataagggggacacaaacacctccagggaacatcaccgaagggccacaaggcacctcgcaggagctccagccctggctctgtggaccacaggctgcatgactctggg

SEQ ID NO: 42269 - DNA, 601 bp, Human
gcgaaggagtcgttctcccccgtctctgaatcccagtaatgtagggtggggttaaggaaaagcccggctcccaggactgctgggtgttctcaggtgtggcttcagtcctaagattctccatttacatcaagaatgagaatctcgccgcaaacggacataaccattccccctgggaagcctgcagtgtccactgttgacacgttcttaggaaggggtatctgaagtgtgggtgcaccacacagggattgggatgaggcagaaagggagccgtgctgaaggcctactggggaccagcaagctrgggaggctccggcgtctcctctgctactagttatcgggtaggcgcaaccctctaaccccacatttctttatgttttgggggcagagggtggcatgtctgccctcctctcccagcctggggggacctccttgggtcccggacagtccctttgggaggtacagcacatgcggaccagagctgtccacacaaaaggcagtctccaacacagcacggtgctcagggagggcagcagaacaacgcacagcaggtgccatcatcagcaacgtgtgtgggcatccctgcccaggcactctgcagatg

SEQ ID NO: 42270 - DNA, 601 bp, Human
atgaggaaagggacacagggagagaccgcagcaggttcctggagaacagggctgtgatctgctgcccctgcttccagggcagagtccacacctggtcgttgtctgtgggcaagagcattacccagaccacctggatctgtaacacagtgctgggctcagggcccaacaacaggagaacaatgctggggacggggtgggagagatgaaaggagcaagtgaggcgtcctccagaacagtaactgctggagggcacaagccctccgaggggagctgaggctcatccggaacccccgcagacccragtgctctcacctgtagtcccgcagcatgaggctggtgtaccgcacggtgtcgtccatgctgcagctgatgagctgccccgactcatccacggtcatcctggacacctggttcgtgtggcctttcccagcgaaggagtcgttctcccccgtctctgaatcccagtaatgtagggtggggttaaggaaaagcccggctcccaggactgctgggtgttctcaggtgtggcttcagtcctaagattctccatttacatcaagaatgagaatctcgccgcaaacggacataaccattccccctg

SEQ ID NO: 42271 - DNA, 601 bp, Human
cctgtgccaggctcacctaatccacaacagcctgaggcaggctccactgtacccgcctttactgatgaggaaagggacacagggagagaccgcagcaggttcctggagaacagggctgtgatctgctgcccctgcttccagggcagagtccacacctggtcgttgtctgtgggcaagagcattacccagaccacctggatctgtaacacagtgctgggctcagggcccaacaacaggagaacaatgctggggacggggtgggagagatgaaaggagcaagtgaggcgtcctccagaacagkaactgctggagggcacaagccctccgaggggagctgaggctcatccggaacccccgcagacccgagtgctctcacctgtagtcccgcagcatgaggctggtgtaccgcacggtgtcgtccatgctgcagctgatgagctgccccgactcatccacggtcatcctggacacctggttcgtgtggcctttcccagcgaaggagtcgttctcccccgtctctgaatcccagtaatgtagggtggggttaaggaaaagcccggctcccaggactgctgggtgttctcaggtgtggcttcagtcc

SEQ ID NO: 42272 - DNA, 601 bp, Human
gctactctcctagctccactgactgccaatcaaaggcccaagaccaaaaacaaacaagacattgtcttttaaccagatcactgtgtgcccatctcacccttgagcagaaggggaatgctgtcttgtactcagcacctgccctgtgccaggctcacctaatccacaacagcctgaggcaggctccactgtacccgcctttactgatgaggaaagggacacagggagagaccgcagcaggttcctggagaacagggctgtgatctgctgcccctgcttccagggcagagtccacacctggtcrttgtctgtgggcaagagcattacccagaccacctggatctgtaacacagtgctgggctcagggcccaacaacaggagaacaatgctggggacggggtgggagagatgaaaggagcaagtgaggcgtcctccagaacagtaactgctggagggcacaagccctccgaggggagctgaggctcatccggaacccccgcagacccgagtgctctcacctgtagtcccgcagcatgaggctggtgtaccgcacggtgtcgtccatgctgcagctgatgagctgccccgactcatccacggtcat

SEQ ID NO: 42273 - DNA, 601 bp, Human
cagcctcctcatctgtaagaggaaccaagatggtgtaaggagacttacatgtacttcctcataatcacctggatctgtgagtgctggggatgggaaactaaggctcagagagggtgaggtaaatgccggaggtcacacagctacaatgcagcagggctgggatgtgaacaggagcaaaggcaggcccaccccacagggtatctcatagactttacaggctgacaggcaggcagcgtggtctgaggcttagagacaaatcccagctctgccctccgaccagctgcggccttggacaaccaayttatccattccgtgcctccatttcttcatctgtacaactgatgtgatggtggtgaggattaaatatgtgagatcccttagtgcagtgcaaatgagcactcaaccaaaacactggctagagcaactgtcaaacgggacatgagtcaaattcagcaagcaggcaccacacagctgcaggctcccacccaaacactaagccaggtccctacctgtccaatgcacacgaccacggcgtatcccccggggccgacggctacgcactttggctgaacgtccagtttcacaactccttgtccgctgt

SEQ ID NO: 42274 - DNA, 601 bp, Human
gtcatctgcccggctctggaggtggccttacctactcacaggtgaagaatgagggcctaagcatttgcctgaagcttcgtccgacatgagacttgaacctggttgtttcctgatctaaaatcccaggcccctcctagcaccctcctaaccctttgactggtgacagggagctctgcagaaaattctgacccagagcaggggttccagatgccctgggaggatcaggtaacagcagatcacagagaaatgccacatgaggaggtgcagagacctggagcctgtcccctgcacaccacaaccytaccggggtcctttctaacctcctgggcagcaggcgccagctgggccagtctgaacatcctctcagcctcaggggaaagggtggcctatgatgaccacaactttacagatgaggaaacctgggtctggagacacagggcacgctgccctaggcctcatcccctcacccacaaagccccatgtgcagaccccttggctgggaagagccctgctgtgcagagataggccacctgccagccttctagaactccgctttgtagcgtttcccccaggccccgaggcgctccatgtgtggattccc

SEQ ID NO: 42275 - DNA, 601 bp, Human
cctcttggaaagtcacttggcctcgatgggaatcaacgttcagggtaagaaaggtactaacaacagtaaacaaaaacagcgacagcccctgggcacgtgccagcgctctgctgtgagtgttccagccccacaaggcagggatcgggttccccgtttcagagaagaaaatggggtacggtgcttatgctgcacgcccaaggctccagttcccacaggctgagccgggactcgcccagaatccaagcctcggcacccgcactgggcctttgcctctggtacatgcagcagaggctctgcagcrggggccttccttccatctcccttccttgtcaattcttccggttctaacttactcaactgctcccagacagtggccttcatctctgagttttgcctttatcccagtgtgcccctacccaagccaccagctgtcatgagggaaggcagcctctgcccctaccgtctgggcttctgtttctgcgtggattgtgggtggatcgcgatgaatggtagcagcaccctgactaaaacctactactgaagaggcacctctgtcatctgcccggctctggaggtggccttacctactcacaggtgaaga

SEQ ID NO: 42276 - DNA, 601 bp, Human
tttcctgacctgctaccctcttgcgctcccctcctgccgccactcatggggctggctctgaggcacagctgtgccctcctcggcactccctctacctcactgtccacagtcttgtgggcacccgggcagtgaggtgggggaagtgccgaggaggggaggggaaggctccagccctgggtggcaggagatggcgtggctgggccccagagcaggtcccacgccccgactgcccccatccttcccctgacccctcgccttccctgagacagccccggtactcacacagctcacactgtccccmaatcacccagataccaaggacagagagcacgggggagaggaaagcgacttaccacacccccaattgccaccgtgtccccgccggggtgcactgccacaacttcgggctcgtagccggggttgtcgatgctgaagcacttcctctgatccttcagcaggacaatctgtggcacacacaggcagctggtcaggcggtccagcccttcgggacaaaaccctcagtggtaggaggggcgcgtccctgtcggggctcactggagctgggtttggctccatacccaacctctttgcagggccacct

SEQ ID NO: 42277 - DNA, 601 bp, Human
gtggtccctgccaaggcctgggggcggaagtcaccttggatcttgactctggtttccgggtcactcagggtccaaacatacaccatcatgtccatgccaccggaggcaaagtgttcattgtctggggaccaggccaggcagacgatttttgcatggtgtccataaaaaacattgttctcctagttgcaggttgaaaacaagagaggtggcaggtcaggttcaggccgcagttgcccatatcacctcgcttatccctcatggcgacaataaggaccgaggtttctcacgcgctaactctatsccagcgacccctgcaaacccactgactcctcagaagcatggcacgaggcacctgctacttgtagaggcaagaaaactacagctcagacaggctcagctcaaggtcaccaagtcacagataacctcccactgccacctgcaccgcccagcacggggacagaggaggagcccgccgccactcaccgagtagccgtcagcaacgctgaacactgtgaccaccttgctggcgtcgcacaccgcgaggaaggcgccgtcgtgggagtaggccacgtcggtcacggggcccttggcctctaggagc

SEQ ID NO: 42278 - DNA, 601 bp, Human
gcgattgccttataaaccaggacggacgttgaaacctgctttgtctctcctcccttccagaccgggctgccttccctctttgcctgtcctgcacctgaagcctgcagctggggaatgggctctgggggtgggctcagacatttttaaataggaaagggccccattaatgtttaacacaaaaggatgtcttcaaggagaatggatgaggggacttgactacacactaggaggagagtggtaggggggcactcggggaggggagggtttggacaacacagagctgccttacaatacgtgcatkgccacgcggggacatcacaaccccctcagggagaaatgatgacatgcggggctaaataaaacctactgttacaaatcatttcacctgtttcttttttaaatgtggctaccaggaaatttcaacgccacatgaggctcacattatacactggacgtggctgtcttagggagggggagaccctggtcccaggtgggatttaaggggtgagtgggggaagtgaagatgtcaaaagtgaggccttcactcagctcagcaggtgtcctgtgcatggggcccccgtggtccctcagtacggccagc

SEQ ID NO: 42279 - DNA, 601 bp, Human
tgcaatgcatattccctcttctcactagtacagaaatgttctgcaggcaggaacatgagccccccggctcattcacctgtacaacctcccctgacagatagtgagagccgcggcggggccaggggctctgtgtgctttggaggctactgcctctggaatgtttcgcattctcaaggtttggttgggctgtgggttttagttatgctccacacattgtttaggtgctcgctttatttttcatgtgcaaactgttactgtctaaagctttcagaagaacgtgtacagacaccctgcagagacragggtcatgactgggccctcctgcctcttgtggtggggtgggggcatgggggcgcgtcacagaaatagagaaatgacatgttccgctgcagttaaactctagtccctgattcggtccatccagaggcgggggtggggctcctcagtaggtgattgtccactccttgacagaggcatcatgggaggtcgtgaccagcgtgtgctcgtccagccaggccaggctgctgacatggtgcagccggtgtgcatctgggaagaaagggtgcaatttaacgaaaagccaaacttctctgcaactatg

SEQ ID NO: 42280 - DNA, 601 bp, Human; identical to SEQ ID NO: 42213

SEQ ID NO: 42281 - DNA, 601 bp, Human; identical to SEQ ID NO: 42214

SEQ ID NO: 42282 - DNA, 601 bp, Human; identical to SEQ ID NO: 42215

SEQ ID NO: 42283 - DNA, 601 bp, Human; identical to SEQ ID NO: 42216

SEQ ID NO: 42284 - DNA, 601 bp, Human; identical to SEQ ID NO: 42217

SEQ ID NO: 42285 - DNA, 601 bp, Human; identical to SEQ ID NO: 42218

SEQ ID NO: 42286 - DNA, 601 bp, Human; identical to SEQ ID NO: 42219

SEQ ID NO: 42287 - DNA, 601 bp, Human; identical to SEQ ID NO: 42220

SEQ ID NO: 42288 - DNA, 601 bp, Human; identical to SEQ ID NO: 42221

SEQ ID NO: 42289 - DNA, 601 bp, Human; identical to SEQ ID NO: 42222

SEQ ID NO: 42290 - DNA, 601 bp, Human; identical to SEQ ID NO: 42223

SEQ ID NO: 42291 - DNA, 601 bp, Human; identical to SEQ ID NO: 42224

SEQ ID NO: 42292 - DNA, 601 bp, Human; identical to SEQ ID NO: 42225

SEQ ID NO: 42293 - DNA, 601 bp, Human; identical to SEQ ID NO: 42226

SEQ ID NO: 42294 - DNA, 601 bp, Human; identical to SEQ ID NO: 42227

SEQ ID NO: 42295 - DNA, 601 bp, Human; identical to SEQ ID NO: 42228

SEQ ID NO: 42296 - DNA, 601 bp, Human; identical to SEQ ID NO: 42229

SEQ ID NO: 42297 - DNA, 601 bp, Human; identical to SEQ ID NO: 42230

SEQ ID NO: 42298 - DNA, 601 bp, Human; identical to SEQ ID NO: 42231

SEQ ID NO: 42299 - DNA, 601 bp, Human; identical to SEQ ID NO: 42232

SEQ ID NO: 42300 - DNA, 410 bp, Human; identical to SEQ ID NO: 42233

SEQ ID NO: 42301 - DNA, 494 bp, Human; identical to SEQ ID NO: 42234

SEQ ID NO: 42302 - DNA, 601 bp, Human; identical to SEQ ID NO: 42235

SEQ ID NO: 42303 - DNA, 601 bp, Human; identical to SEQ ID NO: 42236

SEQ ID NO: 42304 - DNA, 601 bp, Human; identical to SEQ ID NO: 42237

SEQ ID NO: 42305 - DNA, 601 bp, Human; identical to SEQ ID NO: 42238

SEQ ID NO: 42306 - DNA, 601 bp, Human; identical to SEQ ID NO: 42239

SEQ ID NO: 42307 - DNA, 601 bp, Human; identical to SEQ ID NO: 42240

SEQ ID NO: 42308 - DNA, 601 bp, Human; identical to SEQ ID NO: 42241

SEQ ID NO: 42309 - DNA, 601 bp, Human; identical to SEQ ID NO: 42242

SEQ ID NO: 42310 - DNA, 601 bp, Human; identical to SEQ ID NO: 42243

SEQ ID NO: 42311 - DNA, 601 bp, Human; identical to SEQ ID NO: 42244

SEQ ID NO: 42312 - DNA, 601 bp, Human; identical to SEQ ID NO: 42245

SEQ ID NO: 42313 - DNA, 601 bp, Human; identical to SEQ ID NO: 42246

SEQ ID NO: 42314 - DNA, 601 bp, Human; identical to SEQ ID NO: 42247

SEQ ID NO: 42315 - DNA, 601 bp, Human; identical to SEQ ID NO: 42248

SEQ ID NO: 42316 - DNA, 601 bp, Human; identical to SEQ ID NO: 42249

SEQ ID NO: 42317 - DNA, 601 bp, Human; identical to SEQ ID NO: 42250

SEQ ID NO: 42318 - DNA, 601 bp, Human; identical to SEQ ID NO: 42251

SEQ ID NO: 42319 - DNA, 601 bp, Human; identical to SEQ ID NO: 42252

SEQ ID NO: 42320 - DNA, 601 bp, Human; identical to SEQ ID NO: 42253

SEQ ID NO: 42321 - DNA, 601 bp, Human; identical to SEQ ID NO: 42254

SEQ ID NO: 42322 - DNA, 601 bp, Human; identical to SEQ ID NO: 42255

SEQ ID NO: 42323 - DNA, 601 bp, Human; identical to SEQ ID NO: 42256

SEQ ID NO: 42324 - DNA, 601 bp, Human; identical to SEQ ID NO: 42257

SEQ ID NO: 42325 - DNA, 601 bp, Human; identical to SEQ ID NO: 42258

SEQ ID NO: 42326 - DNA, 601 bp, Human; identical to SEQ ID NO: 42259

SEQ ID NO: 42327 - DNA, 601 bp, Human; identical to SEQ ID NO: 42260

SEQ ID NO: 42328 - DNA, 601 bp, Human; identical to SEQ ID NO: 42261

SEQ ID NO: 42329 - DNA, 601 bp, Human; identical to SEQ ID NO: 42262

SEQ ID NO: 42330 - DNA, 601 bp, Human; identical to SEQ ID NO: 42263

SEQ ID NO: 42331 - DNA, 601 bp, Human; identical to SEQ ID NO: 42264

SEQ ID NO: 42332 - DNA, 601 bp, Human; identical to SEQ ID NO: 42265

SEQ ID NO: 42333 - DNA, 601 bp, Human; identical to SEQ ID NO: 42266

SEQ ID NO: 42334 - DNA, 601 bp, Human; identical to SEQ ID NO: 42267

SEQ ID NO: 42335 - DNA, 601 bp, Human; identical to SEQ ID NO: 42268

SEQ ID NO: 42336 - DNA, 601 bp, Human; identical to SEQ ID NO: 42269

SEQ ID NO: 42337 - DNA, 601 bp, Human; identical to SEQ ID NO: 42270

SEQ ID NO: 42338 - DNA, 601 bp, Human; identical to SEQ ID NO: 42271

SEQ ID NO: 42339 - DNA, 601 bp, Human; identical to SEQ ID NO: 42272

SEQ ID NO: 42340 - DNA, 601 bp, Human; identical to SEQ ID NO: 42273

SEQ ID NO: 42341 - DNA, 601 bp, Human; identical to SEQ ID NO: 42274

SEQ ID NO: 42342 - DNA, 601 bp, Human; identical to SEQ ID NO: 42275

SEQ ID NO: 42343 - DNA, 601 bp, Human; identical to SEQ ID NO: 42276

SEQ ID NO: 42344 - DNA, 601 bp, Human; identical to SEQ ID NO: 42277

SEQ ID NO: 42345 - DNA, 601 bp, Human; identical to SEQ ID NO: 42278

SEQ ID NO: 42346 - DNA, 601 bp, Human; identical to SEQ ID NO: 42279

SEQ ID NO: 42347 - DNA, 601 bp, Human
tagtcaaggctatcactgcctattatgtgctaggcattataggagaaatcatggagaacgaattcctcaccttccaatgagctcagtcggccagagggaggaagacacacacacacacacaaacacacacacagacacacacacacacaaacatgtgtgcgtacatactactgggcttcgttagcttagctataaagtagctcgaagtcgcatgccagtttgcaccctaaatgtgttaacgtattggatttggattaggtttggtagtcacaatgtttggccaagtgcttggaactggaaktgaccatagagatcacttctcatgagataaaagtagattgttccttttatttttatgttattttatttttgaggagtcttgctctgtcacccaggctggagtgctgtggtgcaatctcggctcactgcaacctccatctcccggattcaagtgattctcctgcctcagcctcccaggtagctgggattacaggcgcccaccaccacatttggctaacttttgtattttttgtagatacaggttttcaccatgttggccaggctggtcttgaactcctgacctcaagtgatccacccacct

SEQ ID NO: 42348 - DNA, 601 bp, Human
attggatttggattaggtttggtagtcacaatgtttggccaagtgcttggaactggaagtgaccatagagatcacttctcatgagataaaagtagattgttccttttatttttatgttattttatttttgaggagtcttgctctgtcacccaggctggagtgctgtggtgcaatctcggctcactgcaacctccatctcccggattcaagtgattctcctgcctcagcctcccaggtagctgggattacaggcgcccaccaccacatttggctaacttttgtattttttgtagatacaggktttcaccatgttggccaggctggtcttgaactcctgacctcaagtgatccacccacctcggcctcccaaagtgctgggattataggcttgagccaccgcgcccagctgtttcttttgttttggagatgaagtaattcaagactctcccaggtcatacacgctgtgaatggtactgttggcactcaatgccagatcccctgacttgaactctgaggctatttttctcactccacaatggaaaatagcctggaagtgggagagaagaaactcatttcttcatttctggcagcagatcaccag

SEQ ID NO: 42349 - DNA, 601 bp, Human
tgaggagtcttgctctgtcacccaggctggagtgctgtggtgcaatctcggctcactgcaacctccatctcccggattcaagtgattctcctgcctcagcctcccaggtagctgggattacaggcgcccaccaccacatttggctaacttttgtattttttgtagatacaggttttcaccatgttggccaggctggtcttgaactcctgacctcaagtgatccacccacctcggcctcccaaagtgctgggattataggcttgagccaccgcgcccagctgtttcttttgttttggagatraagtaattcaagactctcccaggtcatacacgctgtgaatggtactgttggcactcaatgccagatcccctgacttgaactctgaggctatttttctcactccacaatggaaaatagcctggaagtgggagagaagaaactcatttcttcatttctggcagcagatcaccaggacctgtcgggaggaggggagaaggatggtgctcctttcttctgtctaccattgagttccatttctctgttactctgaaatagaagggagctcgggagcattgatggagtccagcagatttctttgga

SEQ ID NO: 42350 - DNA, 601 bp, Human
ctaagcacttcatatgttattttgcttaattcttctagaatcccttggaggtatatattttctctagatgctgtatagaaaaatatggctcaaagaagttaatttgtgccaggtcacaaagctaataacatgactactaagtgggaggtagagattttaatcaaatcctacagggctcttaagttcacatttgttcccctaagccataccaccctccagaagggagaaattaagactttcccaggccagacgcagtggctcatgccctgtcagcccagcactttgggaggccaaggagctygggacaaccctgggcaacataatgagaccctgtttctacaaaaatcttttacaacttttttttttttttttttggtggggtacagagtcttgctgtgtcacccaggctggagttcaatggcaccatctcagctcactgcaacctccgcctcctgggttcaagggattctccttcctcagcctcctgagtagctaggattacaggcgcccaccaccatgcccagctaatttttgtatttttagtagagatggggtttcacgatgttggacacaatggtctcaaactcctgacctcgcgatc

SEQ ID NO: 42351 - DNA, 601 bp, Human
cagcctagccaacatggtgaaaccccatctctactaaaaatacaaaaattagccaggtgtggtggcgcgcacatatagtcccagctactggggaggctgaggcaggagaattgcttaaacccaggaggcagaggttgcagtgagggagatcgcaccactgcactccagcctgggcgatggagtgagactctgctcaaacaaaacaaaacaatacaaaactgacaagatgtaatgaaagcagtactaagagagaagtggatagttgtaaatgcttacattaaacaagaagaaagatctcaawtcaacatcctaactttacatttcaagggactaggaaaagaagagcaaactcaatcgaaaattagcagaaaaaagcaagtaaagattagaacataaataaaatagagagtagaaaagcaatagaaaaaaatcaacaaaaccaagtttttttgaaaaaaatccataaaattgacagaattttagcagattaagaaaaaaaagagtcggccgggtgcagtggctcacgcctgtaatcccagcattttgggaggccaaggaggacagatcacaaggtcaagagtccaagacctgcctggccaaa

SEQ ID NO: 42352 - DNA, 601 bp, Human
tcaaatttcaccagttgtcccaataacattctttatggcaaaatgactgagttcaaaatcatgtattatcttttattgacatgtcacttttagtgtccttcattctggacagttcctccatcttttcttgacaattatgaatattacagttagttattgtgtaaaatgtccctaaatttgaatatatctgatgtttcttcatgattagatttggggtatgcatctttcacagaaatagtatgcaagtggccaggcatggtggctcacacctgtaatcctagcactttgggaggccaaggcrggcagattacttgaggtcaggagttcaaaaccagcctggcctacactgtgaaaccccgtctctactgaaaatatcaaaaaaattagccaggcatgatgtgggcacctgtaattccagctactcgggaggctgaggcaggagaatttcttgaacccgggaggcacagtttgcagtgagacgagatcgcaccactatactccagcctgggtgacagagggagactccccatctcacaaaaaaaaaaaaaaaaaaaaaaaaaaaaaaggaaacgatgctgtttttcacattgtgttctgtcag

SEQ ID NO: 42353 - DNA, 601 bp, Human
tagtatgcaagtggccaggcatggtggctcacacctgtaatcctagcactttgggaggccaaggcaggcagattacttgaggtcaggagttcaaaaccagcctggcctacactgtgaaaccccgtctctactgaaaatatcaaaaaaattagccaggcatgatgtgggcacctgtaattccagctactcgggaggctgaggcaggagaatttcttgaacccgggaggcacagtttgcagtgagacgagatcgcaccactatactccagcctgggtgacagagggagactccccatctcacaaaaaaaaaaaaaaaaaaaaaaaaaaaaaaggaaacgatgctgtttttcacattgtgttctgtcaggtaacatccaatatcagttcatctaattactaatgatatcacttcattaggtggtgtctgacgggcttttccactgaaagttactttttttccctttgtaatcagtgattattttgtgagaaggtagtttataactagttaaatatccattctcatcacactgtctgatattcatttattattttatatcagtagaaactcatagctttgttttgtttttctattcagtgctgtt

SEQ ID NO: 42354 - DNA, 601 bp, Human
cacacctgtaatcctagcactttgggaggccaaggcaggcagattacttgaggtcaggagttcaaaaccagcctggcctacactgtgaaaccccgtctctactgaaaatatcaaaaaaattagccaggcatgatgtgggcacctgtaattccagctactcgggaggctgaggcaggagaatttcttgaacccgggaggcacagtttgcagtgagacgagatcgcaccactatactccagcctgggtgacagagggagactccccatctcacaaaaaaaaaaaaaaaaaaaaaaaaaaaaarggaaacgatgctgtttttcacattgtgttctgtcaggtaacatccaatatcagttcatctaattactaatgatatcacttcattaggtggtgtctgacgggcttttccactgaaagttactttttttccctttgtaatcagtgattattttgtgagaaggtagtttataactagttaaatatccattctcatcacactgtctgatattcatttattattttatatcagtagaaactcatagctttgttttgtttttctattcagtgctgttgttactttttattattcatattgatgtcc

SEQ ID NO: 42355 - DNA, 601 bp, Human
tcctccttgctcctgaggtgcaggtcaagcccagagcatttggcagtatttgctgtgatgctgggttagacaaaggcaaccgtcccaggagcatctcccactgacccagatttctgtctgtttcagtgaaactgtagatcataaccacactttgtacttaatcacaaaatagttctggtgttttaggaagcttttggcctagaaatgaaaaaatttttatagagcgaaaaaattttatatagcaaaaaaattgttaacagctttcttttataatccaaaatttattttattttatttttakttttattttttgagatgggctgcagtgcactggtacgatcttggctaactgcaacctccacctcccaggttcaagtgatcttcccagctcagcctcccaagtagctgggaccacaggtgcatgccaccacacctagctaattttttgtattttttgtagaggccaggttttgccatgttgcccaggctggtctcaaactcctgagcttaggcaatccacttgccttggcctcccaaagtgctgggattataggcatgagccaccaagcctgggcacgttcttactctgttagatttttat

SEQ ID NO: 42356 - DNA, 601 bp, Human
catttttgtcgttacaggaaaagtcttgcacgaggagcatgttgaactcttgatggaggaattcgctttcctgaaaaaagaagtggtggggaaagacctgctgaaagggtcgctcctcttcacaggtcagtgctacgtgggatcacaggtcacatgtgaggtccaaagaccagccagattctttcctggctctctgggatgggagcttatattcatttctgctcaagactctctgactcagggccacttaattttcccagatgggatttaattccttggtggcccttgggtaaagagtatrttagaaatctcaagcatatttgtgctctgtcccaacctattaactagttggagattatttttcaacaggaagttgtacattaaaactcttttaaaaggatgagaggtgcttggagaggagaacatttttatacttccttgcaaagcaaatataatatgaagagctcccttcctcctctagcaagttacaaggacattggcagcaaccacagtatttatttatttatttataataaataataaatatttacttattctgttcttactctgttgcccaggtcttactctgttgcccaggctg

SEQ ID NO: 42357 - DNA, 601 bp, Human
atacttccttgcaaagcaaatataatatgaagagctcccttcctcctctagcaagttacaaggacattggcagcaaccacagtatttatttatttatttataataaataataaatatttacttattctgttcttactctgttgcccaggtcttactctgttgcccaggctggagtgcagtggtgcaatcatagctcactgtagcctcaacctcccaggctcaagcagtcctcccacctcagccttccaagtagctggaaacacagatgtgcgccacaatacccagctaattttaaaatttktgtaaacagtgtctccctatgttgcccagcctcatctcaaactcctgggctcaagtgatccacctgtcttggcctccaaagtgctgggattacaggcatgagccaccgtgcccagctgaccacagtatctgatctgtatttgtagctgtttacttgatgttggtcactctttgagcagctccgttagcaataggaaatgggcatgcaggaagctcctgctcttgtggccacttttggatgggctccttctctggccgtatcgttgggcacctgggccaccattcctgagggctttcatta

SEQ ID NO: 42358 - DNA, 601 bp, Human
tttgcacggtaaagccactgatacatagtggaacctcatttcaaaatctgtcttcatccttgaaaatggtaatataatgagagtacaaaccattaatttgtacaagaaactgtgttaagttaagtaagttaagtacaagtaactgtgatgtgcattaatccatatgacaatcctataaagtggtattcactacccccattatacagataaactgaagttcagaggcatgagtggcttcacagaggtaacgtagcggtcatgagacagagctggattggagctcagctctctaagtggctgsaactgttgtgggtggctgcttagtattctgtccaaagaactaggctgggcatagtggctcacgcctgtaattccagcacttggggaagctgaggctggtggatcacctgaggtcaggagtttgagaccagtctggccaacatggtgaaacaccgtctctactaaaaaaaaaaaatacaaaaattagtcgggcatggtggcacgcacctgtaatttcagctacttgaaaggctgaggcaagaaaatcgctttaacccaggaggcagaggttgtagtgagccgagatcgcaccactgcacag

SEQ ID NO: 42359 - DNA, 601 bp, Human
tgatacttaggccccagtgatttcaaaccatattgtctatgaaaattctaatttttgtttggttttatatataacttattactttttaagaatatactcattgttattagtcattgttttaagtgaatatcaaggtcataagaaatgttttgtttataatgtaatgtaacagatatgaagtcttttaaacttaggttatgtttaagattttggctggaggcagacgggagcagtatcttgaccaaatggatttctcacaccaatactcttttttatgtttatatatatatatttttttgawatagggtatcactctgtcacccaggctggaatgcagtggtacaattatggctcactgtaacctcgaactcctcaggcccagatgatcctcccaccttagcttcctgagtagctggggctgcaggtgtgcaccacgacacccgcctaattttgtgtgtttttttgtagagacagagtcttgctatgttgcctaggctggtcttgaactcctgggcgcaagcagtctgccagccttggcctcccgaagtgctggtattataggcatgagctactgtacgtggcctttttaggcttactgcaa

SEQ ID NO: 42360 - DNA, 601 bp, Human
cttagcttcctgagtagctggggctgcaggtgtgcaccacgacacccgcctaattttgtgtgtttttttgtagagacagagtcttgctatgttgcctaggctggtcttgaactcctgggcgcaagcagtctgccagccttggcctcccgaagtgctggtattataggcatgagctactgtacgtggcctttttaggcttactgcaacctctgcctcccgggctaaagtgattctcctgcctcagcctcccaagtagctggggttacaggcacccgtcactatgcccgggtaatttttgtatttttttttactagagacggggttttgccatgttggccaggctagtctcgaactcaagtgatccacccaccttggcctcccaaagtgctgggactacaggcgtgagccaccacgcctggccccaatactcttttgagtgtacttttttgttcacaagattaggaagactaagaaaacatttaacattgtatcaattttcttgatattgaaatagctcaaaggtattaccattttctccatagctattataataccttcataccttattgccacttacacatcaggtagttataagaataca

SEQ ID NO: 42361 - DNA, 601 bp, Human
tcacgttgcctgcctaccacataaggcaaggtcccattgtactgatcactcggccacatcttttcacacccccgccacccccacccccctgtcctgctttccacttggcattcctgcttcccagttcccacagcatttgtgatttcccacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtrtgtctggagacagagaagaaaaggtaagtcatgagaagccatgaggaggaggaaatttaaggacatcctagtacatttgcaggtatgatccaaagggagccccgaggggctagaccctcactcccagctccagaagggctgtctgcttctgcagatggagtgctgagattgcacttgtgttgcctcatctcatcctctcagcagccctgtgaggtaaagaagacaaacataatcccatctgccagtcagtagacagaggcttacagaatgccagcaggttgcctaagtcatgcaagtcat

SEQ ID NO: 42362 - DNA, 601 bp, Human
tggaaattacattaccttggctgggcgtggtggctcaggcctataatcccagcacttggggaggccaagggtggtggatcacctgaggtcaggagtttgagaccagcctggctaacatggtgaaaccctgtctctactaaaaatgcaaaaattagccggtgtggcggtgcatgcctgcagtcccagctccttggcaggctgaggcaggagaattgcttgaacctgggaggcagaggttgcagtgagctgagatcaggccactgcatttcagcctgggcaacagagcgagactccttcttgaaaaaaaagaaaagaaaaagaaattatgttaactctgtgacctgatttttttcctgtgttttcttatgaaagttttcgggcatattgtgaagttgaaagaatttttaagtaaacacccatccacctactccctagaccctgccattaacactgtacatgttccccgcagggccacacattcacccctcagtgcagccagagtgtgagggtctgtgtttcagctttagcatcccatcaccctgtcacactgttcccaaaacattctgacttatttctcataccaggtcttttttaacaaaag

SEQ ID NO: 42363 - DNA, 601 bp, Human
cagagcgagactccttcttgaaaaaaaagaaaagaaaaagaaattatgttaactctgtgacctgatttttttcctgtgttttcttatgaaagttttcgggcatattgtgaagttgaaagaatttttaagtaaacacccatccacctactccctagaccctgccattaacactgtacatgttccccgcagggccacacattcacccctcagtgcagccagagtgtgagggtctgtgtttcagctttagcatcccatcaccctgtcacactgttcccaaaacattctgacttatttctcataycaggtcttttttaacaaaagcacattcataattttcctcccaaagcacctgggctctgtaaattatttagaacagtaagggttttagagtgtttctggatgcctttgcagagaggtgggtctcctggtagtaaaagaagcagacattgggtattttaaaaagaaaaaagaatttgagttcctgaatgaagcctgatctagtccattttgaggagtttcttcttcgctaggaaaaggcagagaggcctggcagatgaaagcaaagcacatggaacttggcagtgctccctatggagtgacc

SEQ ID NO: 42364 - DNA, 601 bp, Human
actccctagaccctgccattaacactgtacatgttccccgcagggccacacattcacccctcagtgcagccagagtgtgagggtctgtgtttcagctttagcatcccatcaccctgtcacactgttcccaaaacattctgacttatttctcataccaggtcttttttaacaaaagcacattcataattttcctcccaaagcacctgggctctgtaaattatttagaacagtaagggttttagagtgtttctggatgcctttgcagagaggtgggtctcctggtagtaaaagaagcagacaytgggtattttaaaaagaaaaaagaatttgagttcctgaatgaagcctgatctagtccattttgaggagtttcttcttcgctaggaaaaggcagagaggcctggcagatgaaagcaaagcacatggaacttggcagtgctccctatggagtgaccaacagtggtggcccgggctctggtgtggccatgtgagtgttaggattgcagccgtggtcagacctatacacagacagttgtagcaccctgtaattagaggtaaagatactgtagggtgctgtaggagcacagggaaggggaacctg

SEQ ID NO: 42365 - DNA, 601 bp, Human
aaagcacatggaacttggcagtgctccctatggagtgaccaacagtggtggcccgggctctggtgtggccatgtgagtgttaggattgcagccgtggtcagacctatacacagacagttgtagcaccctgtaattagaggtaaagatactgtagggtgctgtaggagcacagggaaggggaacctggactaggtcagctcatggttctgatgggaggcggtgccttgtttggtcttgaagttgagtagaagtcaatgaggaagcaagatgttggggaggcagaggctgactctctctctcttttttttttttttttatgagacaaagtcttgctctgtcacccaggctggagtgcggtggtgtgatctcagctcactgcaacctccatctcccgggttcaagtgattgtcctgcctcagcctcccgagtagctgggattataggcgcctgccaccacgcccggctcatttttgtattgttagtagagacaaggtttcaccatgttggtcaggatggtcttgaactcctgacctcaagtgatctgctcaccttggcctctcaaaatgctgagattacacgcatgagccactgcacccagccc

SEQ ID NO: 42366 - DNA, 601 bp, Human
tttttttttttttatgagacaaagtcttgctctgtcacccaggctggagtgcggtggtgtgatctcagctcactgcaacctccatctcccgggttcaagtgattgtcctgcctcagcctcccgagtagctgggattataggcgcctgccaccacgcccggctcatttttgtattgttagtagagacaaggtttcaccatgttggtcaggatggtcttgaactcctgacctcaagtgatctgctcaccttggcctctcaaaatgctgagattacacgcatgagccactgcacccagccctgrctctcatttttgcacaggagaggcaagcatcagatgagggattgggacagagagcagttaatataatataatagtaacttcttaaaatcatagtactttccgtgtcccaaattgcatttttaaatttttttatctatttatttatttattttgagaccgggttatgagactggctgattttcgtatttttgggtaagatgggtttttgctatactgtctaggccggtctcaaattcctgggctcaagcgatccacccacatcagcctccacgcctggccacaaactgcatttttatctca

SEQ ID NO: 42367 - DNA, 601 bp, Human
cgttccccagcttgcttgcagctagaatatctttgtaaaatgtcagtctgaccaaattatacccttgcctaaaaccagtcagaggcttcattgcctacagaatataaactaagctgtttaccaatgagatgtcattttgtgcttgagggtgttgcccacactcctccctttgctggcagtgccttgcatccgcctcccttctgcctggtaaactagtgacccatcagaatccttatggggtaccttgttaacctaaagatgcttctttgctgcctttccatcttacgttgcacaaaacacmctgtaacttgtctgttggaatgtcttccactttcactagcctgtaaatctctaggaagttggtgcttggtagtattcagcttcatatctatctgtcaatccttcacactgtctgtcgcatgggatacgcacaacagacaaattccccgagttagctttctagaattgtacagcagatggcactaataggctgcttaacaaatccccttcactaagaatgatttttgtcccaaccttgtctgactttggccttatcctagaagccaatatttatgccattacaggtaaaatctcctgtttc

SEQ ID NO: 42368 - DNA, 601 bp, Human
cagaagggatgcagtgagctcttgaggctgcagtgagctgtgatcataccattgccctccagtctggatgacacagagagacattgtcaaaaaaaaaaaaaaaaaaaaaaaaaaaaggactgggaattttgaaactggaaatgattttataaatcttgtctgtcctctctcagggccatttgtgtcctaagccctactctttcatggtgaacagagctatgaaagggacaaaaattatagactttggagttagacttacttggattgaaatcccatcctttacaggccagctatgcccttrtgcaagtattttaaccttttgaaataatatcagtgtccttgtaaattagatataataatgcttctcttgaaaggttgttttgagctttagaaacaatagttgtcaaaagtcttgcacagtatagctggcacagtatatatagatgcttaattgacaacgcggcatgaaacactgtttctgctaaagggatattagaatatggagaacaggtcagagggaaaatttggagagctcttcctgtacctaaagttacatttctgagggctttttacagttactctgattaatttgatgaaaata

SEQ ID NO: 42369 - DNA, 601 bp, Human
tgtcctctctcagggccatttgtgtcctaagccctactctttcatggtgaacagagctatgaaagggacaaaaattatagactttggagttagacttacttggattgaaatcccatcctttacaggccagctatgcccttatgcaagtattttaaccttttgaaataatatcagtgtccttgtaaattagatataataatgcttctcttgaaaggttgttttgagctttagaaacaatagttgtcaaaagtcttgcacagtatagctggcacagtatatatagatgcttaattgacaacgyggcatgaaacactgtttctgctaaagggatattagaatatggagaacaggtcagagggaaaatttggagagctcttcctgtacctaaagttacatttctgagggctttttacagttactctgattaatttgatgaaaatattgaaacaaacagcatagccatgtatttgtaaattctttttttggtacctaggtcccgaacctcctaggctctgagggaattgtatttatggagaaagccgagaatatttttccttagcttctagaaccttctaatgacattgaaggtttttttgttcag

SEQ ID NO: 42370 - DNA, 601 bp, Human
ctttcaaacccatgaacagtttcagctttgtggtctccagaaaaacagaaaacccccaacaatagttccattcacttttatgtaaatggcactcttcaggaaaacactgggctatttcccagggccccagaacatactcaaacatttgtttgagtgggaggtggggagagagttcttttgagtcaatgaacatctgttcagaactgctgtgctgggtcccaagaaaacagagcttataatctgtctcttccctgccagaggtaccagcagagatttactatactaggtatatgtgcttgtrgtggcattgtactgtgtcagtttagctaagctggattcccagtatccttcctatctgcttccaggtgagggttgtccacaagaaaatttcgtgagagatttggaaagctgaattgaagtagcagccagtacactgtgaaggacagagcagggtctgtacgctgtgaaggacagagcagggtaccaggcatagtggcagtacctgtactttctctctgatctggctcaccttgttggtgaaggtcatcacacagcccccagcacccctagctcctactgaatttcctccttcagctcctct

SEQ ID NO: 42371 - DNA, 601 bp, Human
tataatctgtctcttccctgccagaggtaccagcagagatttactatactaggtatatgtgcttgtggtggcattgtactgtgtcagtttagctaagctggattcccagtatccttcctatctgcttccaggtgagggttgtccacaagaaaatttcgtgagagatttggaaagctgaattgaagtagcagccagtacactgtgaaggacagagcagggtctgtacgctgtgaaggacagagcagggtaccaggcatagtggcagtacctgtactttctctctgatctggctcaccttgtyggtgaaggtcatcacacagcccccagcacccctagctcctactgaatttcctccttcagctcctctgagtcctgggccatgtgtgcagtcagctctgtagcagagggctccggcttctccagatcacctgagtcactgagcttgggaccagtgaaaggaagttgtgggtttcagtttgtcctcatgagttccagttgtccttgtagatcccagtttgttctcagaggttccagtttgtctttgttctcttccacctcacatccagttttcttcccaactgctggcctcacagacttcggg

SEQ ID NO: 42372 - DNA, 601 bp, Human
tggagttcctgtcttaggcagggcactgtgccctctagtcttggatccctaagcttatttaggggttctaacattgattccatgggaccttctagtcttggatccctaagcttatttaggggttctaacattcattccatgggaccctctagtcttggatccctaagcttatttaggggttctaacattccatgggacctgaggcaggagcaaggtaccccacatctataactttctaatgctttttgagcatctttatagggagggcatgggatcagctacctgtttctgcctcaaccayggaccaataatatgagatctttgttcaccagttctacagtgatggggtgcttccttttggcttctggaatggggtaagttcttgacataaatagggagtccaggaaaatagaacaatgaaatagaatagaaaaatgaaagcctaccactttatatatgaatttgtaaactcaaacagggatttcattatacatgctattcagaactgtctccttttcatgtgtctaaaaatttttcttacaagcagtacattaggcttgacctaatttttttttctttttcttttgtttttgagacaagg

SEQ ID NO: 42373 - DNA, 601 bp, Human
acatggctcactgtagcctcaaccttccaggctcaagcaatcttcccacgttggcctcccaagtagctggaagtacaggtgcatgccaccatacctggctaattttttttctattttttgagagacaaggtctcactgtgttgtccggactggtctcaaactcctgggctcaggcaatcctcctgcctcagcctcccagaatgctgggattaaaggctcgagccactgaacccagcctcgacctcattttttttaatgacttcatgctatttcatcatatagatatactgtactttttgcytattcccatattgatggatatttgtttctggctcttttcctttttgatattgcaaacaaagttgtagtgaacattgttatatgtacatcttttttttttttttttttttgagacagagtttcgctcttgttgcccaggctggaattcagtggccccgtctcggctcaccacaacctccacctcccgggttcaagtgattcttctgcctcagcctcccaagtagctgggattacaggcgtgtgccatcacgcctggataatttttgtatttttagtagagacggggtttctccatgttagt

SEQ ID NO: 42374 - DNA, 601 bp, Human
tcactggattgtaggcaaagtacttcctcgtcagctaacttccacttgttaagaaaggacttccccctccttggaaaaatcacttcaaggtctccaatagaaaagtgattccttagagcatgggatgaagaaagttccgaagaataagaaagcagacgtctgaagaaggtcatctcacaccataaaagagcagtattctaaacctgacttgctatacacatggtctgtttcactctctgcagagaagagggaatggaaaggtgggattgctcaaaccccgagaactagacactacctgccytgcacccccttcccaggcatgttaggatattgccaatctccaggcttcctttagcaacacctagaaaagtcactgaatggctgggtgtggtggctcatacctgtaatcccaacactttgggaggctgaggcaggaggatgacttgaggccaggagtttgagaccagcctgggaaatatagtgagaccccatctttaccaaataaataaataaataaataaatagctgggcatggtggcacatgcctgttgttctgaatactcaggaggctaaggtgggaggatcacttgagcccaggaat

SEQ ID NO: 42375 - DNA, 601 bp, Human
agtctctgcccgccacgcacatcaggtagcccccagcagctcccgccctgggcccctcgggctgccctcgcctttccagcctgcccgtccttctcttccaggggcaagtgcagcgtcaccctgctcaacgagaccgagtcgctcaagtcctacctggagcgggaggtgaggcccagcccggcctggtctgccgcagccagtcccgggccactgtttcctctacctatgacctctgctggcctgggcggcggagacgattttccctcctccctctaggcccaggctgttctggggggaagcrgggattgcgtcctgactgtcacttccaggtgtcctggtgtgtggccgcccccaccctacgcgtccagagttgtgggccaggagcttggagctctttcctcttgccactgccacccagacagccagcgaggggaggtccccctggggagggtgtggctgaggcaggtgggggcaggggccacctgagtcttcgcaggagtcttggctggtctctcctgggcggtgggcagagtcctggtaggcccaccttgggggtcactgtgattatacggtgttaccaggtgattcttatctgggggtc

SEQ ID NO: 42376 - DNA, 601 bp, Human
tctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttgtgagtaccgtgggtggcgatgggggagtggctggccatgcccatctccaggtaggctgcgggggtgtgggctccacatcccactctgccctgagggagcctgtcctgcaccctgattccctgtgcggagctgcatgagttcygtctcagctgcgctcggccgccatagtccttcctgtcacactggttcagcagacaggcatgggggcgctggtggggcctgggcatagagagccatgctcctgccaccattgcgtgatgaggataagggttggcccaggtgacggaggccagggtatcctcacggagactttcccttccttgctgccccctccagccccaggcttggttttgctttgtttttgactaagctgaacctcttgactcctcatgtccttgttttctgtctcacgtgagtttagcccagcagcaggcctagagag

SEQ ID NO: 42377 - DNA, 601 bp, Human
cgtctgtactaaaaatacaaaaattagccgggtgtgttgagaggtgcctgtagtcccagctactcaggagacagaggcaggagaattgcttgaacccgggaggcagaggttgcagcgagccgagattgtactactgcactccagcctgggtgacagagcgagactccgtctcaaaaacaaacaaaaaaaaggctgagatggaggctgggttgtcagtgccacctcggcaagatctcgaccttgaccttgtgccagctcctcttcccctggcgtcactgtgttttggcatctggcggggggmcctgcttcatcagctgccctctgcacctgcctgccagcaggggcctggcctccgtgcaccaagcacacctcgccctctggcctcccgccccctctgtggccttctggctgcagccctgcccctgcctgcatggtgtgcctgcctcctgccccttcctgcttgtgtgacacgcctcctcccacccagctcccgtggaagtcgctgaccagcatcattgagtactactacatgtggaagaccaccgacagatacgtgcagcaggtgagcccgcccgccactcagtgcccggggtgtgccgcc

SEQ ID NO: 42378 - DNA, 601 bp, Human
cttggggcccagcctgtagccccactgggagttctgatctcagggagccccacgtcctcctcggtgctgacatggccgagcccagtgagggctcccaggtcaaggcgcaggcagggtcccgtgctcccctgggggtgccccacccctcacaccgtgtggtaccccgcaggcacggcgcggctgcccgaagcctcccagagcccgctggtgctgaagcaggcggtacgcaagccgctggaagccgtgcttcggtatcttggtgagcagccaggcgtgctggggggctcccaatgctgcctgsaggcagcttctcacccaagctcgtgcactggtgctcccagccttctctagctgggagctcctggacagccccccagggcctggaactgtccttttggggtactctgcaccgtgccaggctcaggcagacccactgggacccaggctgctccctgctcctggggtcgtgatggggcccagtgcggagtagcggccgccctgtcttctgcggggccagcctcctcaaggcacacccgggggcttccctgccagtctcgctaccctgttccctgtgttctgatcgtccctggggcctgagggt

SEQ ID NO: 42379 - DNA, 601 bp, Human
gctcgagtgggcttgtgcatctgccctcccgacacagggtgactgtcctgagaaggacattccagagtcatgagccaagtgtgctctgagattcaagtggctttggcattgctccctgtttggggttgtggcccctgtcctgtgggaagaggtggctggtgtcagggctggtcctcagcagctgtgtccctggccaggctggctggatggttggttcgctgtctgacgagcagccagccctccaccagcagctccgggggcctggacgtgggggctgtttaataggcgtgctgtgctcacrggcctgtgtatggatcctgttgtcccggggctgaggggcctggcccccgccaggtggtctccctgctctctggaagccctggggtgcaggactggcccgggcacacgccttgccgagggcttctgggcttctggttctgtggtgacctccccacttccagcccagtcaggatggggcctcgggtgggggccgcatggggcttagttcctgggggtatcccggaaccatgagggctggagcctgggcctgcctgcccctcccctgctgggcagaggcaactcgttctgcctgtgtcattcc

SEQ ID NO: 42380 - DNA, 601 bp, Human
agattcaagtggctttggcattgctccctgtttggggttgtggcccctgtcctgtgggaagaggtggctggtgtcagggctggtcctcagcagctgtgtccctggccaggctggctggatggttggttcgctgtctgacgagcagccagccctccaccagcagctccgggggcctggacgtgggggctgtttaataggcgtgctgtgctcacaggcctgtgtatggatcctgttgtcccggggctgaggggcctggcccccgccaggtggtctccctgctctctggaagccctggggtgcrggactggcccgggcacacgccttgccgagggcttctgggcttctggttctgtggtgacctccccacttccagcccagtcaggatggggcctcgggtgggggccgcatggggcttagttcctgggggtatcccggaaccatgagggctggagcctgggcctgcctgcccctcccctgctgggcagaggcaactcgttctgcctgtgtcattcccggcagagacccacccccgcccccccaagcctgaccccgtgaaaagcgtgtccagcgtgctcagcagcctgacgcccgccaaggtggc

SEQ ID NO: 42381 - DNA, 601 bp, Human
atgtgctagtgaattgtggagttgacttttagtacagtagaatcttttttatttatttatttatttatttatttttgagacggagtctcactctgttgcccaggctggagtgcagtggcgcgatctcagctcactgcaagctccgcctcctgggttcacgccattctcctgcctcagcctcccgtgtagctgggactgcaggcgcccgccaccacgccctgctaatttttttgtatttttagtagagacggggtttcaccgtgttagccaggatggtctcaatctcctgacctcgtgatcygcccgcctcggcctcccaaagcgttgggattacaggcgtgagccaccgtgcctggcccagtagaatcttaagagtagaatttgggagagaggtcattcaatcttggctcctcatttaacagatgagccccagggatgttaaacaacccttccaagtcacatggctggaccacggtgctgggcctgtacctaggtctcctggctcttcccactacagtgtactggctaccacctggaggtacctgaaatacaggtgtgggcagagactctgaggcctgagagacctggcctggattcccag

SEQ ID NO: 42382 - DNA, 601 bp, Human
aaggtggaaatgatgagctgtgctttgaacatgctgaatttgagggagttgtaggatgtgtccactgtaggcctgacattcagagatgaggtctggggcatggagaaagacattgacggaacctgagggcagagaaataacaacacggatttactaaatactttgtacatacaaggtactgcactaaatacatttctttactctcatttaatttggatagcaacccacaaaatagatattgtgatgtctattttaaggatctggctgctgcagccagaaaagtcaaaccatttgcccaggrtcacagagataacaagagctaggctgtcatactattaagttcatggatccatgtgcttttttaaaagcaagagatgtctagagaaagcctgaagcaagcaggcccctgggaccatgtcaggggcctttttatcagcatgctccccagctccatgccccactgctcttcttcctggacataaacccttttaggggagtcacacagtctacaggtgggcccagcagtcttgctttgcagaaggaaaggaagaaagaacacagatttaaatggtcaaaccatcaccctcatcttcctcctaag

SEQ ID NO: 42383 - DNA, 601 bp, Human
caattatttttcgggaatagcatttgcatcatctccattgaaaagagtgagtgaataagctgggtaaaacttacggagaacaattattttaaaaaatgatcccttgtgtgggtcctacatgccttgatagctagtctaaaaggggtttctagaaatcttggaacaagaaaagcatatttgaactacctacaaaggatactaggtagatgcaaaaaaatttgggatgtttatagaaaaaccagttctgttatgtttcagttctgtgtctgggtgttatatctattctataacattattaggytatgtgtttatatttatgataatatgtcattcacaaataatgtgctatgaataaataaaatatgaaagagaaagaaaagactggaatactgctgttcttaccactactgaatactctgtgaaactctaaaattccaatactactacttgggttggggatggttggagaggcattgtgtctatactgtgactaaaaaaaaactggccaatttacaactccccttccttctccattgcccagtttttcccaggttgagttctagatttgttcctgatgcctctcctaactgccctagtgaag

SEQ ID NO: 42384 - DNA, 601 bp, Human
gccaaatctttgtcctttgaaagtcaattatttttcgggaatagcatttgcatcatctccattgaaaagagtgagtgaataagctgggtaaaacttacggagaacaattattttaaaaaatgatcccttgtgtgggtcctacatgccttgatagctagtctaaaaggggtttctagaaatcttggaacaagaaaagcatatttgaactacctacaaaggatactaggtagatgcaaaaaaatttgggatgtttatagaaaaaccagttctgttatgtttcagttctgtgtctgggtgttayatctattctataacattattaggctatgtgtttatatttatgataatatgtcattcacaaataatgtgctatgaataaataaaatatgaaagagaaagaaaagactggaatactgctgttcttaccactactgaatactctgtgaaactctaaaattccaatactactacttgggttggggatggttggagaggcattgtgtctatactgtgactaaaaaaaaactggccaatttacaactccccttccttctccattgcccagtttttcccaggttgagttctagatttgttcctgatg

SEQ ID NO: 42385 - DNA, 601 bp, Human
actttcagtttctaaagagaaaatacatccttacccaaaacttacccgcttctccttgagtgctgggctgtcatccccaagggcaagacgagaagcacagctccggaactcagccaggcccaggattggcagatactcgtgatttaggctattgtcattagcaatcttctgctccactttcttcactactggcaaaacccagggatggcagtcatccgtgcgatatgctggagaatggaaaagagttatacatagtggaggctcatgctgtgtccaagttaagagtttgtaactgtgaacyaggagaatcccaccaccttccggtcaaaacagaacagtgaaggaaattggagaaaagtttgttcacttactgagtacctaatttgagccaagcattgggctaggtgctgggcaaacataagggcagatgtggtccccatccttgtggaacttacagctcttaactatgtgacctccaaaaagtagaatgctgaaataaaactgggacatcacagagcctggtcacatgagaaagtacatagaaaagcactctgcaaagtaaaaagcatcttgcaaatgtcatgtcaatatcactagtgca

SEQ ID NO: 42386 - DNA, 601 bp, Human
cttaaagtataattaaaaaaaatatatatatatatataaaaagaagggctcagagctcaataaccactggtacccacagtgatgtattaatagatgccaagagagtatccaaaaagtatatcttcaaatatttgctgccatgaagatggccttttaaaattgttttatggtcaaaaatataaaacaggagaaactagattaagagggagggctatgttcccagggtcaaggctacaaaaaatagccttaagtcttacagtgtaagtcatcaaatggagatcaatgggcagaggaacagcayctgcccaacatagttaacaactatataagaaatgcagtattagaggaagaaactccccaacatggaatctctgttttcatttgtcagcaacagaattccaactaatttatttagtttcagaagagaggccccagtggcctatgttccccactttcttttttttttttttttcttttcttttgagacagggtcccattctgttgcccaggctggaatgcagtggtgcaatcatggctcactgcagcctccacttcttggggtcaagcaatcctcccacctcagtctcccaagtacctggga

SEQ ID NO: 42387 - DNA, 601 bp, Human
tatgtaacaaacctgcatgttatgcacacgtaccctagaacttaaagtataattaaaaaaaatatatatatatatataaaaagaagggctcagagctcaataaccactggtacccacagtgatgtattaatagatgccaagagagtatccaaaaagtatatcttcaaatatttgctgccatgaagatggccttttaaaattgttttatggtcaaaaatataaaacaggagaaactagattaagagggagggctatgttcccagggtcaaggctacaaaaaatagccttaagtcttacagtktaagtcatcaaatggagatcaatgggcagaggaacagcatctgcccaacatagttaacaactatataagaaatgcagtattagaggaagaaactccccaacatggaatctctgttttcatttgtcagcaacagaattccaactaatttatttagtttcagaagagaggccccagtggcctatgttccccactttcttttttttttttttttcttttcttttgagacagggtcccattctgttgcccaggctggaatgcagtggtgcaatcatggctcactgcagcctccacttcttgggg

SEQ ID NO: 42388 - DNA, 601 bp, Human
gggacatggatgaagctggaaaccatcattctcagcaaactatcgcaaggacaaaaaaccaaatgctgcatgttctcactcataggtgggaattgaacaatgagaacacttggacacaggaaggagaacatcacacacgggtcctgttgtggggtgcggagaggggggaaggatagcattaggagatatacctaatgtaaatgatgagttaatgggtgcagcacaccaacatggcacatgtatacatatgtaacaaacctgcatgttatgcacacgtaccctagaacttaaagtataattaaaaaaaatatatatatatatataaaaagaagggctcagagctcaataaccactggtacccacagtgatgtattaatagatgccaagagagtatccaaaaagtatatcttcaaatatttgctgccatgaagatggccttttaaaattgttttatggtcaaaaatataaaacaggagaaactagattaagagggagggctatgttcccagggtcaaggctacaaaaaatagccttaagtcttacagtgtaagtcatcaaatggagatcaatgggcagaggaacagcatctgcccaacatagt

SEQ ID NO: 42389 - DNA, 601 bp, Human
gatctgaaagtggaaaagtaatacaaggcagtgaggagtctagaaaataggtctcctcaaaatgggtaaaggatctggaaatgttgaatctggagaagaaaaatctaagggaagaaacaattactgttggtttacttgttcactcattctttcatttatgtctcgtctttaagttttggctcaaatgtcatttctatttctatcataaccaccctagttaaaactgtatccactcctagaattcctaacatgccacctcctgctccatttttatagcatttatcatctttagtatactacrtcattttcttactgatatagtcaaaaagattacatttagagtctgttcctctccccgaaactgaatgcaagggcaggggattctgtgtgtttgagtcactgctgtgctccagcatctagaacagtgcctggctctagtagtgggcatctgatgactaaaggaatgaatgaatccaaacctttggaacctgaggtacccggataggagccaaatgctgaaaatctgcaaggtaaataagcaatgatcactctcctggggaaagttagggccttgtgggagatgaagacttataaaattatc

SEQ ID NO: 42390 - DNA, 601 bp, Human
tttttgtgttttttttttgtttgttttttgagacagagtctcgctctgttgcccaggctggagtgcagtggcacgatcttggcttactgcaacctccgcctcctgggttcaagtgattctcctgcctcagactcctgaggagctgggactacaggcacgtaccaccacacccagctaatttttgtgtttttagtacagatggggtttcaccatgttggtcaggctgctctccaactcctgacctcgtgatccgcctgcctcggcttcccaaagtactgggattacaggcatgagccaccaygcctggccaataaaaaagttttaaaactcttcttagagaagaaaagcttcctaaatcttttcaagaacctaacataacattgctgctaaaagacaacaaaagggaaaaaagtagaatgagagacctagatcgtaccttgatactaacttcccaagtaaacattaatgaacaatattaatccagcagtacattaaaattacccccttgattgagagtcatcccatgaatggattataagagatataaaaccaatcatgctgctagatagagaaaacccaaatgatcatcacaacaggtaag

SEQ ID NO: 42391 - DNA, 601 bp, Human
aaactgttaaactgcctagacgttcgatattctattttgctgggaataccttcttgggttttccaacttcatggagaggaagactgggtggggggggaaattggggaaaactaccattcatcgagtgccccctcctgtcttccaggtgttgtgttatgcacgtgtgaggtagatatcagcccctgttttacaaatatctgagagtcaaagaagttaaagtaattttatcctgcttctgccaaaatgaaaggaagagacccagttaaatgtactgggacaattactgttctgcactccccaycccccggcccaccagactgggagccccttaccattcctcaaagagctcagggttagagagggtgctggccacaattcgtgctccctgggcggggggattggaccaagtaatccgcacgatcttctccatctgggaaaggacttgcaggatgctctcaggttcttttccaaccacagtcagattcccgactctctcatctaaagagagggaccagaatcagctgtggctgctgaagcagggagtgatgcgaggaggtggggctgtaactcctcaggagagcactcactgtagagcccgaag

SEQ ID NO: 42392 - DNA, 601 bp, Human
gcaccttgggagaccgaggcgggcagatcacttgagctcaggagtttgagaccagcctgagcaatatggtgagaccccgtttctacaaaaaattagccgggcatggtggttcacgcctgtggtcccagccacttggacactgaggtggaatgatcacctgagcccagggggcagaagttgcagtggcccgagattgcaccgctgtactccaccctgggtgacagagcgagaccgtgtctgaaacaaacaaacaaacaaaaaaggccaggcacagtggctcacgcctgtaatcccagcactktgggaggccaaggcaggtagatcacttaaggtcaggagtttgagaccagcctggtcaacatggtgaaaccctgtctctactaaaaatacaaaaattagctgggtgtggtggctcatgcctgtagtcccagctacttgagaggctgaggcaggagaatcgcttgaatccaggaggtggaggttgcagtgagccaagattgtgccactgcactccagcctgagcaacagagcaagactctgtctcaaaaagaaaaaaaaagttgggaggaaaacaaaacccctgtttttaataagggcaaat

SEQ ID NO: 42393 - DNA, 601 bp, Human
tacatccagggattccaggttaaaagccccattctgacagaaaaaagataacaaaggaagtattgtaatgtgagaattgtagaaactaggtggcggatatataggggttcactgtacaattcctccaacttttctgtatgtttaaaacttttctggccaggtgcagtggctcatgcctgtaatcccagcaccttgggagaccgaggcgggcagatcacttgagctcaggagtttgagaccagcctgagcaatatggtgagaccccgtttctacaaaaaattagccgggcatggtggttcaygcctgtggtcccagccacttggacactgaggtggaatgatcacctgagcccagggggcagaagttgcagtggcccgagattgcaccgctgtactccaccctgggtgacagagcgagaccgtgtctgaaacaaacaaacaaacaaaaaaggccaggcacagtggctcacgcctgtaatcccagcactgtgggaggccaaggcaggtagatcacttaaggtcaggagtttgagaccagcctggtcaacatggtgaaaccctgtctctactaaaaatacaaaaattagctgggtgtggtggct

SEQ ID NO: 42394 - DNA, 601 bp, Human
cctgtggtcccaggtactacgaaggctgaggtgggtggattgcttgggcctgggaggttgaggctacagtaagccatgattgtgacgccgcactccagcctgggcaacagagtgagactctgactcaaaaataaataaataaatttgtatgccttttctcctattaatctgcctcttgtcagctgatttccagcaaactttcagagggcaaagggtaagttttcccttgacccctccaaaccagtgaacaaagaaagcaagcttaagaagaggtttacctgtgtgaattggtcacccaagrggatagagcctcaagccaacacagccctgggtgtgccactctttctaaaagcctgtgccctgaggcagtgattaaatgactcctaccctggcttttggttttgttttagtaaaaatgaggcctttctactttttcagagaagggaagtgtcacagtttgaaaagctagtaaaagttatggactctttccctagagcagggccaaaatacacatatacaattttttaaacatcatttcaggggcttcacagttctcctaaacgtacatccagggattccaggttaaaagccccattctgac

SEQ ID NO: 42395 - DNA, 601 bp, Human
cgctattttctccgagggctgctacctgtcttatctacataatataacaagaccacctttgctaaccaggccttctcttctctgcctgccataatctgttctggcaagctccaagctcccattctttctataaccccaagatggtataaaagcatcaatcatctggccatttatttgagttctattttgtaagacacctgtgcaagttaataaatttgcatgctggccaggcacagtggctcatgcctgtaatccaagtactttgggaggctgaggagggaggattgcttgagcccaggarttgacgaccagcctgggcatcataaggagaccctgtctctacaaaaaaatcttaaaaattagccgggcatggtggcacacacctgtggtcccaggtactacgaaggctgaggtgggtggattgcttgggcctgggaggttgaggctacagtaagccatgattgtgacgccgcactccagcctgggcaacagagtgagactctgactcaaaaataaataaataaatttgtatgccttttctcctattaatctgcctcttgtcagctgatttccagcaaactttcagagggcaaagggtaag

SEQ ID NO: 42396 - DNA, 601 bp, Human
ctcagtgctccttgaaggaaaccaaaatagttcaccccaaaatatactttgacatattttgagatggctgttgagagggcctacatacagaagtagccctgcaaagctgtcttttgtgggagagatctgtatctgtagagaaaatctgcatggctgcagctaggctttctctgaggccctcccttgtccagatctaggggagattaactgagagtgtgatgcctttaaaggtctaaaagaaatagacctttaccgctattttctccgagggctgctacctgtcttatctacataatataayaagaccacctttgctaaccaggccttctcttctctgcctgccataatctgttctggcaagctccaagctcccattctttctataaccccaagatggtataaaagcatcaatcatctggccatttatttgagttctattttgtaagacacctgtgcaagttaataaatttgcatgctggccaggcacagtggctcatgcctgtaatccaagtactttgggaggctgaggagggaggattgcttgagcccaggagttgacgaccagcctgggcatcataaggagaccctgtctctacaaaaa

SEQ ID NO: 42397 - DNA, 601 bp, Human
ctccttaactgcataaagacctgtagctctccttaatgatgaagaaatagggcaatggaaagttgcatagatggataagaaattaaagataatgggactggtttttttattttattttattttattttattttgtaaatcaacatcagaacttcagcatctaagtgagttggtcttttttcaaaacagtcactttgagaggcagtactgtacattcactccaactgccattccattctgctatcgctcaaaatacttggatcccttcatttggaattgccaccagagctgataccacattctttagaatactctcagtggtggcaaatcttattttttgtgggtggattttgtttggggaaatagcaaaaattcatttggagttatgtctggtgaacaagatgtaggtaatagagcctaaaatagcatttggggctttatttttgtagagcccaaagaaaagagatgactgagtgatgacaggtccactaaaaagtttatgtattggtggcactgttggaataaatatctcatcccaaggtgatgtctttgaatgaagcagtactcattttaatgcagaggttctagcatgatttttttgt

SEQ ID NO: 42398 - DNA, 601 bp, Human
ataggtttgtgatctgtttagtttgtttttgtctttttaagtcttgtgcttttagacatggacccacatgaggggcagagaagatggagatatcagaagcactgtctgctctccatcaaagttgagaaaaatatcagtttcttgactttactcttacaggcttaatttttaggtttttggcttaatgtttagctacaaggtaggatcctggagcaattcagcatgcattgtcacattgagcgtggctggagcaaaagcagtttttctggtggtgattttgtgtgaatactttttttttttwtttttggtagagtacttgatgcccaggtgcttaagttatggaatcaggtacttatttatgggatggactgaccatatcctgagacaggcagtatagtctagtgattaagaacttgggctctagagccagagttcctggctctagcttctgccaccaactctgtttcataggggtggtggtgaacattaaataggttactagagagtgcacacgagcactgcacattgtaggcactccataaatgtcagcctttgtaatcatcgcctcagagggcattgggactgtgctttatacctgaaa

SEQ ID NO: 42399 - DNA, 601 bp, Human
attagccaggcatggcagtgggtacctgtagtcccagctatttgggaggcagaggcaagagaatcactttagaacctgggaggcagaggttgcattgagccgagatcacaccactgcactccagcctagttgacagtgaactccatctcaaaaaaaaaaaaaaaaaaaaagtatagctgggcgcggtggctcacacctgtaatcccagcactttgggaggccgaggctggcggatcacaaggtcaggagtttcgagaccagcctggccaatatggtgaaaccctgtctctactaaaaaatmcaaaaattagctgggcgtggtggcgggcaccctgtagtcccagctactcagggaggctgaggcaggagaattgcttgaacccgggaggcggagattgcagtgagccaagattgtgccactgcattccagcctgagtgacagagagagactctgtctcaaaaaaaaaaaaaaaaaagggcacagtggctcaggaggccgaggcgggcaaatcgcctgaggtctggagtttgagaccagcctgaccaacacggagaaaccccgtctctactaaaaatacaaaattagccaggcgtggtggtg

SEQ ID NO: 42400 - DNA, 601 bp, Human
ctgtctcaaaaaaaaaaaaaaaaaagggcacagtggctcaggaggccgaggcgggcaaatcgcctgaggtctggagtttgagaccagcctgaccaacacggagaaaccccgtctctactaaaaatacaaaattagccaggcgtggtggtgcatacctgtaatcccatctactcgggaggctgaggcaggagaattgcttcaatccaggaggcagaggttgcagtgagccaagatcacgccattgcactccagcctgggcaacaagagtgaaattctgtctcaaaaaaaaaaaaaaaaaaaaccctgcacaatatataaggcctacaaaaactataaagaacagttcagtacctgagtacccatctgtagaaatcaagccttgctaacacaggtaaaactttatatagctctctgggatcacttatccctcttggtaagcaccatcctgtatttgacagagcattttgccaatgccctctacctgtgcttgctttttttttgtttgtttgttttgagatgggggtctctctgtcacccaggctggagtgtagtggtttattctcggctcactgcagtctccacctccccaggttcaggtgat

SEQ ID NO: 42401 - DNA, 601 bp, Human
caaaaaaaaaaaaaaaaaagggcacagtggctcaggaggccgaggcgggcaaatcgcctgaggtctggagtttgagaccagcctgaccaacacggagaaaccccgtctctactaaaaatacaaaattagccaggcgtggtggtgcatacctgtaatcccatctactcgggaggctgaggcaggagaattgcttcaatccaggaggcagaggttgcagtgagccaagatcacgccattgcactccagcctgggcaacaagagtgaaattctgtctcaaaaaaaaaaaaaaaaaaaaccctgyacaatatataaggcctacaaaaactataaagaacagttcagtacctgagtacccatctgtagaaatcaagccttgctaacacaggtaaaactttatatagctctctgggatcacttatccctcttggtaagcaccatcctgtatttgacagagcattttgccaatgccctctacctgtgcttgctttttttttgtttgtttgttttgagatgggggtctctctgtcacccaggctggagtgtagtggtttattctcggctcactgcagtctccacctccccaggttcaggtgatcctccc

SEQ ID NO: 42402 - DNA, 601 bp, Human
ggactgacttgctgtcttgcttattgccatagtgcctggcatctggttgcttattgccatagtgcctggcatatagtaggctccaacttactgaatagatgaacctgagcagcatccattatagtgctcattcaggaagtatacatctgacaggagcagcttgactgtattaccagagtcttgctctgtcacccaggctggagtgcagtggcacgatcttggctcactgcagcctccgcctcccgggttccagcgattctcctacctcagcctcttgagtagctgggattacaggtgtgcrccaccactcccggctagtttttgtatttttagtagagacagggtttcaccacgttggccaggctggtttcgaactcctgacctcaagtgatccacccacctcagcctcccaaagtgctgggattataggcgtcagccactgcgcccagcttctgtaacttttcttttgttttttttttttttttgagacagagtctctgttgcccaggctggagggctggagtgctggagtacagtggtgccatctgggctcactgcaagctccgcctcccgggttcaagcaattctctgcctcagcctc

SEQ ID NO: 42403 - DNA, 601 bp, Human
tctgtcacccaggctggagtgcagtggcacgatcttggctcactgcagcctccgcctcccgggttccagcgattctcctacctcagcctcttgagtagctgggattacaggtgtgcgccaccactcccggctagtttttgtatttttagtagagacagggtttcaccacgttggccaggctggtttcgaactcctgacctcaagtgatccacccacctcagcctcccaaagtgctgggattataggcgtcagccactgcgcccagcttctgtaacttttcttttgttttttttttttttttgagacagagtctctgttgcccaggctggagggctggagtgctggagtacagtggtgccatctgggctcactgcaagctccgcctcccgggttcaagcaattctctgcctcagcctccctagtagctgggattacgggcacccaccaccacgcctggctaatttttttgtatttttagtagagatggggtttcaccatcttggccaggctggtcttgaactcctgaccttgtgatccacccaccttggcctcccaaagtgctgggattacaggcatgagccactgcgcccggcccagcttc

SEQ ID NO: 42404 - DNA, 601 bp, Human
gatctgatcttatgggcttgcagataggtaactggggcaatcatgtgataaaactaatgttttacaaaaatgatccattagtttgtagtatgctttgaaaacgggagagtcttaaagcagtggaataagttaaaccgtagaactacttctggcaagaggtatggagttctggtccttctgtctcatttgcatagccacctgctcccacatgtggaacatgcaggaaagaatacaggactgagaataagtgggttctgtgtggtggaatatttaaagattttgattgactggtgggcagggrgagtctcatttttgaggaaaagttaaattccatatttattttgtggaatataatatagtaagatttctgaaaacaaatgtccagtttctagttggagataagaaactgaaacttgggtaagacctgagtctggatacaagtttgcgagttacctgtgtggtagttaatagttaaaccatagaatgaaacaggcctcctaaactggagtttagagatagaagccagatggagctctggacgatgccggaggccatcaggtagaagcagccaacagagagttggagagatcggagaaggacc

SEQ ID NO: 42405 - DNA, 601 bp, Human
atttagcatttgctagacttgtcctaaaaggaatgtcaatggatttccattttacttctgttttcccagacatccctgtgatggaggcacagatgagctgtggaaagagcgagtggtaggaaagatagccaaacctataggacctgcttggaggaactagccaactagggaatcgcctcaaacagtgaaccgttgactagagtttggttatttggttcctgtgtgggatgagagcaagccctgttctgtgtctgtcttcttagaacatactgtcctggtcagtgctaactttaatcagttrgatccttgctactcagtgtggtccattgtctagaagcaccaacatcaccgggaagcttgctagaaatgtagattttcaggccccatcctagatttattggatctaactgttaataagatctctaagtgattcatgtgtctaatggtttagaagcacagagaccctgagagctgagagtaaaattttcaaatgaaatatcaagctggtaggccaggcacggtggctcacacctgtaatcccagcactgtgggaggctgaggcgggtggatcatgaggtcgggagttcgagagcagcctgac

SEQ ID NO: 42406 - DNA, 601 bp, Human
tttacttctgttttcccagacatccctgtgatggaggcacagatgagctgtggaaagagcgagtggtaggaaagatagccaaacctataggacctgcttggaggaactagccaactagggaatcgcctcaaacagtgaaccgttgactagagtttggttatttggttcctgtgtgggatgagagcaagccctgttctgtgtctgtcttcttagaacatactgtcctggtcagtgctaactttaatcagttagatccttgctactcagtgtggtccattgtctagaagcaccaacatcacckggaagcttgctagaaatgtagattttcaggccccatcctagatttattggatctaactgttaataagatctctaagtgattcatgtgtctaatggtttagaagcacagagaccctgagagctgagagtaaaattttcaaatgaaatatcaagctggtaggccaggcacggtggctcacacctgtaatcccagcactgtgggaggctgaggcgggtggatcatgaggtcgggagttcgagagcagcctgaccaatatggtgaaactccatctctactaaaaatataaaaatttagctgggc

SEQ ID NO: 42407 - DNA, 601 bp, Human
agagtttggttatttggttcctgtgtgggatgagagcaagccctgttctgtgtctgtcttcttagaacatactgtcctggtcagtgctaactttaatcagttagatccttgctactcagtgtggtccattgtctagaagcaccaacatcaccgggaagcttgctagaaatgtagattttcaggccccatcctagatttattggatctaactgttaataagatctctaagtgattcatgtgtctaatggtttagaagcacagagaccctgagagctgagagtaaaattttcaaatgaaataycaagctggtaggccaggcacggtggctcacacctgtaatcccagcactgtgggaggctgaggcgggtggatcatgaggtcgggagttcgagagcagcctgaccaatatggtgaaactccatctctactaaaaatataaaaatttagctgggcgtggtggcatgcacctgtgatcccagctactcaggaagctgaggcaggagaatcccttgaacccgagaggcggaggttgcagtgggctgaggtcgcgccactgcactccagcctatgtgacagagcgagactgtctcaaaaaaagaaa

SEQ ID NO: 42408 - DNA, 601 bp, Human
tgggaggcggaggttgcggtgagtcaagattgtgccactgcactccagtctgggcaacaagagcaaaactctgtctcaaaaaaatagaaaaggaaaaatgccatattcagaaaatggactttgccttccgtattctctttggagaaagggaaggagttatgaacagatatgaggttgagatttctagatttctaggcaaagttaatgatactacagcttctggatttagttctgttctccagaaggatataagaagcatttactctgaaaggaagaattctcaaaaactagaatgtcctgwtattccttagtcatcatggatgaactcagttgttgtagtgacagtggctcaccttcacctattcccccttgccttttcttttgctgttggtgcttttctgtccaaaaagatcaaccaaaatccagaaaaccagcccccagatgtttggttgcttagctgtttcatgtctgcccttggggagacttgggtcttttgaacagaaaatgagccaagtccacccagaaatactatctttgtagaaaccactagggtcctttaagccaaggtgagaatctgtttcttcaaacttggcccagaggg

SEQ ID NO: 42409 - DNA, 601 bp, Human
acatactagaaagctgtgatgaaatcgatatgtattctgttgccatccctctggggaccagtgcttggtctcctaatccccctactcgatggcctgaaagtgtttcatcttccctgcctgttatcagcatagaattggttggtattgtgacataatctgattgccttgaggcagagcttacctccaagctgctagcttccttcccatttgacctttcccaaagaagctaagaatccatgccttgttgaaggtgggaactaggggttgaaggcttaatcttgagagtcagcgaacctgtccyttaaggccagctttgatgtgggaagaatattgaatattgtttactgagatggagatgggtggaggtaatttttcctgacattttggggaaggtaagagaaaccaaatttagactgaaagggatcagtggccaggtgtggtggcttacacctgtaatcccagcagtgtgggaggctgaggcagtaggattgcttgaggccaggagctggagaccaccaccctgggcaacacagcaagatccccatctctaccaaaaaaaaaaaaaaaaatagttggccatggtggtgcatgcctgtagtcc

SEQ ID NO: 42410 - DNA, 601 bp, Human
aggcttaatcttgagagtcagcgaacctgtcccttaaggccagctttgatgtgggaagaatattgaatattgtttactgagatggagatgggtggaggtaatttttcctgacattttggggaaggtaagagaaaccaaatttagactgaaagggatcagtggccaggtgtggtggcttacacctgtaatcccagcagtgtgggaggctgaggcagtaggattgcttgaggccaggagctggagaccaccaccctgggcaacacagcaagatccccatctctaccaaaaaaaaaaaaaaaaatagttggccatggtggtgcatgcctgtagtcctggctacttgggaggctgaggcaggaggatcgcttgagcccaggagtttgaggctgcattgagctatgcttgcacgactgcactccagcctgggtgacagagcaagaccctatctgaaaaacaaacaaataatataggtcaatgttcagaggaaccattatcaagaatatttggatttttatccctcttattttctagaacttgattatagctcccttgtgttcagagttgttcttttcaaagtcctttgaggttgtattctggttta

SEQ ID NO: 42411 - DNA, 601 bp, Human
tctgcttgctttctgtgttcctttcctctcactcccctttcctgccctctttactcaagttctaagattatagctgatgatcttcataatagaacaaactctgtttggttgaccttcctaacagggaatgcttggctttgagaaagtagggggttcctaacttctttgccttctctagctttacagtgctcttacttcctgctgggattagaacagccctattccataaatatgcactgctcttggctgctgtaactcaggcccagctctgacccagattcttttttttttttttttttttgtcagatttgagtctattaactagtgaccctcaaaacacttcatacatttttggccaaaaagtggttactgactggataagacagaagcctttggggggcagggtgactggtcgggcaggtaacatggtattatacaggcctgatggggactgtgacaaactgaaaagcagggtttcaaccagttagcggcctatgggagttccagaatcatcatcatcatctttttttttatttttatttttggaaaactctcggccaggcgcagtggctcacgcctgtaatcccagcactttgggagg

SEQ ID NO: 42412 - DNA, 601 bp, Human
ggcttttaaagcctctagaaaggagccttcccgtcttgtagcttggagagtggggtccctaaacaaaacccaaacatcctgcagtttggaagggtggctgcagtgctgggtgaggaggaaagtgtgagggtttgaagtggcctaagaggaggccatctagaggccaggaatatcttgattttttttttctctgtgagccacacccttgtgattgataaaaggcttagaacatattcagtttgaatacccagcagagaccaggctcctaccttcatgggacttctaccttcatgggacttcwgcttgtttccctacattcaaagtcaccctccccacagccctctgtcctcttacacattaagtaccctacagaaaacccaggggtgagaaaaagtactgtaccctttaatttagcatagaaaaattaggttgaagttgaaggttatcagtgaaagggctgatttgaaataaaggctgaaagttatagcaagagtaattaggaaagaggggggccgggcatggtggctcacacctgtaatcccagcactttgggaggccgaggcgggtggatcacttgaggtcaggagttcgagaccaacct

SEQ ID NO: 42413 - DNA, 601 bp, Human
aagtcaccctccccacagccctctgtcctcttacacattaagtaccctacagaaaacccaggggtgagaaaaagtactgtaccctttaatttagcatagaaaaattaggttgaagttgaaggttatcagtgaaagggctgatttgaaataaaggctgaaagttatagcaagagtaattaggaaagaggggggccgggcatggtggctcacacctgtaatcccagcactttgggaggccgaggcgggtggatcacttgaggtcaggagttcgagaccaacctgatcaacatggtgaaacccygtctctactaaaaatacaaaaattagccgggcgtggtggcgagggtctgtaatcccagctactcgggaggctgaggcaggagaatcactagaacctgggaggcggagattgcagtgagctgagattgcaccactgcactccagcctggaggacagggcaaaactccgtctaaaaaaaaaaggacaggggaacacatagcatcacagatttgtagagtttgattatctagtgtaagtctttccttcaataaaggagttaagtgagcctcgtgaggttagccagttgagtcaagtagctaat

SEQ ID NO: 42414 - DNA, 601 bp, Human
aatttctctttcttacatttatagcaaagactaaggagaaaaaaagaacttatgactgaaactttattgtacaagtgttcagtagaggtagtcccttctcctctgctaccctcaacaagttgttgcttaaggaaggttttatgaaaagccaagtctcccaaaaacttatttgccttaagtaattaattttgtctcagtttttcttccttagagtttaaggctattgcctcctctcctaccttttccttttcttcatgggttatgtttcccagtctcttctgtgttcttcaggatttcctcycattcttcagcatgagagcagcctaggggcggggcggggataagggactgacaaattactagtgtagatttggtcattatggaattttttattcaagtattgtcatttaagtggggatggctgagctgcaaggttcccagtgcacacacttactacaggcatgtgcgtaggatttacctggttctcatgacgggtggtttacctgccagtatcagcacaactcagcaaaagcttttcccaactaaatgggtacaagaactccatctgggattccccaaggatttagccagatttatggga

SEQ ID NO: 42415 - DNA, 601 bp, Human
taaacttccctcctctaaccctgatctggtgtcttcctgcttaaaaatattcttcagtgggcagccaattcatcttagaacttgcagttcttcctgtgagagtaccagcacccccaccgtccctaccccacaaaataaggtatggactgtgtgatttcaggcatggttttgttgtggtgtgaagagaaggtgtttagctgctgagttctgtttgttagcagagcctgacaaactcatgctggcactcactagggctgggcaaccaatcacagctgggacggttatcgtcatggagtccctrtgggcttcctctatcaggtcacatcccaaaataacactgggcagtatttcaactgaagaaatgaaggctttcagggctgtagccagcctggagtgtgagattctgtgtgaaatagttggatctgctccagcgcttttgatctgcatggtagatgagcaataaaatgcacaaaacacattggaaacacgtgaggaaattctcctggccctgctgcttccttggaactggtagggcactgagtgggctgatcctcacctcccatctctcagcaggattatacttggaggagaacaaacccgg

SEQ ID NO: 42416 - DNA, 601 bp, Human
tgcttaaaaatattcttcagtgggcagccaattcatcttagaacttgcagttcttcctgtgagagtaccagcacccccaccgtccctaccccacaaaataaggtatggactgtgtgatttcaggcatggttttgttgtggtgtgaagagaaggtgtttagctgctgagttctgtttgttagcagagcctgacaaactcatgctggcactcactagggctgggcaaccaatcacagctgggacggttatcgtcatggagtccctgtgggcttcctctatcaggtcacatcccaaaataacaytgggcagtatttcaactgaagaaatgaaggctttcagggctgtagccagcctggagtgtgagattctgtgtgaaatagttggatctgctccagcgcttttgatctgcatggtagatgagcaataaaatgcacaaaacacattggaaacacgtgaggaaattctcctggccctgctgcttccttggaactggtagggcactgagtgggctgatcctcacctcccatctctcagcaggattatacttggaggagaacaaacccgggaaaagaaatcttcccattaaaggggcattgctacag

SEQ ID NO: 42417 - DNA, 601 bp, Human
tgctgaccagttgccatctaatgaaaatgacagtttgagaggttggcctcaagccaaccaaatcagagagataagaagattaatgctcttccttccctagtatttttctatacccaggcatcccagccaggtgggactactgttgacagtggtttatttagcactttttctccaagaagctcagggcactttaccaaaagtgacagctctcctgaagaaggggaagccacctctttgccagccacagatgcctccagagttctgagaccccagccccaagagctacagaggttttctttargctcctaggatccctcaggtggaccaggggcattctccttttggatctatggtgagcctggttttttaactgaaagtgtggctgaaaggacctcctcagttcttgccctgagctgataggagtggttggtgggttttggttttttggttttttttttttgagatggagtctcgctctgttgcccaggctggagtgcagtggtgcgatctcggctcactgcaacctccgcctcccgggttcacgccattctcctgcctcagcctcccgagtaactgggactgcaggcacctgccaccacac

SEQ ID NO: 42418 - DNA, 601 bp, Human
ctcttgaaatcattctatgctggaacgaattctcattgcatttttaaagtatgctatggcatacctggcctacttcttaccaacaagaaagctagcattttctgacttctcagctaacatggaaagctggacacaggcacaaatgcacacctacctacctgccttcagagcaaactttgtctccaagagctcagcagaaatgctcccagcctaatgaggtacccaagtggtttgtggaaggtccacccagcttggatacttgaaggagagcctaaaagctgccctctgacctccagtgttactgtcagatctcagggtcaaagtcactttcagccgatctttcccgggtgagcttgtttgtgtgagcaggaatagactcaaatcaaaccaacttggatctcctcctccttgagatgtgtggtgttttcggttttgtttttgtgtgtttgtttgtttgtttttgagatggtgttttgctccgttacctatgctggagtgcagtggtacaatctcggctcactacagcctcctcctcctgggcttaagtgattctcccacctcagcctcccaagtagctgggactacagctgcacaccaccac

SEQ ID NO: 42419 - DNA, 601 bp, Human
ttctatgctggaacgaattctcattgcatttttaaagtatgctatggcatacctggcctacttcttaccaacaagaaagctagcattttctgacttctcagctaacatggaaagctggacacaggcacaaatgcacacctacctacctgccttcagagcaaactttgtctccaagagctcagcagaaatgctcccagcctaatgaggtacccaagtggtttgtggaaggtccacccagcttggatacttgaaggagagcctaaaagctgccctctgacctccagtgttactgtcagatctyagggtcaaagtcactttcagccgatctttcccgggtgagcttgtttgtgtgagcaggaatagactcaaatcaaaccaacttggatctcctcctccttgagatgtgtggtgttttcggttttgtttttgtgtgtttgtttgtttgtttttgagatggtgttttgctccgttacctatgctggagtgcagtggtacaatctcggctcactacagcctcctcctcctgggcttaagtgattctcccacctcagcctcccaagtagctgggactacagctgcacaccaccacacctggcttatt

SEQ ID NO: 42420 - DNA, 601 bp, Human
gggctcaagtgatctgcccgcctcggcctcccaaaaggctgggactacaggcatgagccactgcgcgtggcccagtgtgtttctttaagagaactctttatttaccatttaagtatcagggttttcatcctttcttcaattacagttagttcccagcctgaagtaatgttgctagagaatgaacatggggcaggggatggagttagggtacattttctggggtgaatatttttcatattgagctcctgtttgctaatactggagtttgttgacctagagtgaactctttattgattaactsaagacaagcaaagcctacaaacaaataccaagttctcactgaaaaacataaaagctgggaaaaaaacagaatttgttcaattggcaaacatttgttgattactgttatagaccaggtgttaggagtgtagtcccagaccttcttggcagttaagaaattgtctttctcatccaatgtctctctttcttacctcctaccccttatgttgcaaagtatggtgacttggagtgagtccttggcaaatggaggctgtgataatctatagtaataatcatcattgtaatatataatagaaggaga

SEQ ID NO: 42421 - DNA, 601 bp, Human
tcggcctcccaaaaggctgggactacaggcatgagccactgcgcgtggcccagtgtgtttctttaagagaactctttatttaccatttaagtatcagggttttcatcctttcttcaattacagttagttcccagcctgaagtaatgttgctagagaatgaacatggggcaggggatggagttagggtacattttctggggtgaatatttttcatattgagctcctgtttgctaatactggagtttgttgacctagagtgaactctttattgattaactgaagacaagcaaagcctacaaayaaataccaagttctcactgaaaaacataaaagctgggaaaaaaacagaatttgttcaattggcaaacatttgttgattactgttatagaccaggtgttaggagtgtagtcccagaccttcttggcagttaagaaattgtctttctcatccaatgtctctctttcttacctcctaccccttatgttgcaaagtatggtgacttggagtgagtccttggcaaatggaggctgtgataatctatagtaataatcatcattgtaatatataatagaaggagaggggatctataaatgtttccca

SEQ ID NO: 42422 - DNA, 601 bp, Human
tactgggaggtacttggcctcttcatgagccatttctagctctgaattaacttcctagttagaattcccaggcttagccatgatatgcttatgttgttctttgtctggagcaggcaaccagatgccacctcggccacccagtggccagtcggacagcatcatgcatccttccatgaaccaatcaagcattgcccaagatcgaggtgagagcctgggtgttggggaggggcagggagctagggcagacatttgagtgccctatgcagtagcttttggagagctgtttgaccatgaagcttargacaatccctgcagcaaattgtttttatattctttaaaagttgacgtaataattgtactcatttatggggtacataatgatgtttcaatagaagtaacgtatagtgatcagatcagggtaattagcagatatataatctcaaacacttattacttctttgtgctgagacccagcagcaaattgtgaagttagagtgggcttggccgtgttaatgtctccatttcacagtacttgtctgtgttttgatggttgcccccttacattttgcctcatttggtcggcagttgctgaagactcaat

SEQ ID NO: 42423 - DNA, 601 bp, Human
agagcctgggtgttggggaggggcagggagctagggcagacatttgagtgccctatgcagtagcttttggagagctgtttgaccatgaagcttaggacaatccctgcagcaaattgtttttatattctttaaaagttgacgtaataattgtactcatttatggggtacataatgatgtttcaatagaagtaacgtatagtgatcagatcagggtaattagcagatatataatctcaaacacttattacttctttgtgctgagacccagcagcaaattgtgaagttagagtgggcttggccrtgttaatgtctccatttcacagtacttgtctgtgttttgatggttgcccccttacattttgcctcatttggtcggcagttgctgaagactcaatgttcggtcttcactcatcaagtcattcattttggtttttgtcattgttctttgtcttttcaaacctccatttagtagaaacagctggcatgccctggttaatggttcatgtcactctgaaggtgcctaaaatgacacaccactatatagaaaatcagatagagactccatgcaagtggctgctaaagaaaatgtagatggtaaagt

SEQ ID NO: 42424 - DNA, 601 bp, Human
ggaatagatctttgctcaaaattgcagccctaggctgatcaaaagttgagaatcttacacagagcatggaaatagaaaggaagttatcttcttctggaagttgaaatgcctgtgtggcagcaaagccagccttgctctgacctgcctttacatgcttctggaatccccccctttttctcatggcgataaaggctaccatgaagttgatctctttcctaaccaaaatattgaatgacattgtttggtgttctagagttgagagatattagtgagttgctagtgagtgactaaccaagtcttstcttcctcccctcccaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccat

SEQ ID NO: 42425 - DNA, 601 bp, Human
atttatttagagactgtctcactctgttgcccaagctggagtgtaatggcacactttcagctcactgccacctctgctttccaggttcaaccaattgtcctgcctcagcctcccaagtagctggtgttacaggcacccgccaccatgccctgctaatttttatatttttagactgggtttcaccatgttagccaggctggtctcaaaatcctgacctccagtgagctgcctgccttggcctctgaaagtgctgggattacaggcatgatcccaccatgcccggccttttttttttttttttaaatagagatggggtctcagtgtgttgccagggctaaagactgcttattttgatgtgcaaaataagtgttcagagtaggtggtttaacttctatcagtcaactttttggtttccaaaaggattcttaatgatacatatgtcttggatctttggtgttagaaatagcaaatggtaagcttgtggtttgccatttctcctactgttttatgtggtcctacgtgttgactctggtgctagagtacagaaggctcatgtgattaggtttaacaacttctttagccactaaatcttactgagttg

SEQ ID NO: 42426 - DNA, 601 bp, Human
tttatttagagactgtctcactctgttgcccaagctggagtgtaatggcacactttcagctcactgccacctctgctttccaggttcaaccaattgtcctgcctcagcctcccaagtagctggtgttacaggcacccgccaccatgccctgctaatttttatatttttagactgggtttcaccatgttagccaggctggtctcaaaatcctgacctccagtgagctgcctgccttggcctctgaaagtgctgggattacaggcatgatcccaccatgcccggccttttttttttttttttwaatagagatggggtctcagtgtgttgccagggctaaagactgcttattttgatgtgcaaaataagtgttcagagtaggtggtttaacttctatcagtcaactttttggtttccaaaaggattcttaatgatacatatgtcttggatctttggtgttagaaatagcaaatggtaagcttgtggtttgccatttctcctactgttttatgtggtcctacgtgttgactctggtgctagagtacagaaggctcatgtgattaggtttaacaacttctttagccactaaatcttactgagttgt

SEQ ID NO: 42427 - DNA, 601 bp, Human
ctcaaaaaaaaattggccgggcatggtggctcacccctgtaatcccagcattttgggaggctgaggcaggcggataacgaggtcaggacatcgagaccatcctggctaatacggtgaaaccctgtctctactaataaagtacaaaaaattagccgggcgtggtggcaggtgcctgtagtcccagctacttgggaggctgaggcaggagaatggcgtgaacccgggaggcggagcttgcagtgagctgagatcgcgccactgctctccagcctgggcaacagagcgagactccatctcaaamaaaaaaaaaattgaactattgtttgctatctagagcttgaactctcttagtatctttcgtgggaggtagaagataagaaaatctgggtgttggccgggctcggtggctcatgcctgtaattccagcattttgggaagccgaggcaggtggatcacctgaagtcaggagttcgagaccagcctgaccaacatggagaaagcccatctctactaaaaatacaacattagccgggtgtggtggtacatgcctgtaatcccagctatttgggaggctgagaaaggagaattgcttgaacctggg

SEQ ID NO: 42428 - DNA, 601 bp, Human
ctagagcttgaactctcttagtatctttcgtgggaggtagaagataagaaaatctgggtgttggccgggctcggtggctcatgcctgtaattccagcattttgggaagccgaggcaggtggatcacctgaagtcaggagttcgagaccagcctgaccaacatggagaaagcccatctctactaaaaatacaacattagccgggtgtggtggtacatgcctgtaatcccagctatttgggaggctgagaaaggagaattgcttgaacctgggaggctgagattgcagtgagccgagatttcrccattgcactccagcctgggcaacaagagtgaaactctgtctcaaaaaaaaaaaaaagaaaatctgggtgttagctggacatggtggtgcatgcctcatagtcttaggcactcaggaggctgaggaaggcagattgtttgagctcaggagattaaggctgcagtaagctatgatcacaccactgcattccagccagggtgccagagcaataccctgtctcaagaaaataaattaaagaaaaataatatctggatgttgcatagttctagttttggggacccataaatgttttccttttaa

SEQ ID NO: 42429 - DNA, 601 bp, Human
aactctcttagtatctttcgtgggaggtagaagataagaaaatctgggtgttggccgggctcggtggctcatgcctgtaattccagcattttgggaagccgaggcaggtggatcacctgaagtcaggagttcgagaccagcctgaccaacatggagaaagcccatctctactaaaaatacaacattagccgggtgtggtggtacatgcctgtaatcccagctatttgggaggctgagaaaggagaattgcttgaacctgggaggctgagattgcagtgagccgagatttcaccattgcacyccagcctgggcaacaagagtgaaactctgtctcaaaaaaaaaaaaaagaaaatctgggtgttagctggacatggtggtgcatgcctcatagtcttaggcactcaggaggctgaggaaggcagattgtttgagctcaggagattaaggctgcagtaagctatgatcacaccactgcattccagccagggtgccagagcaataccctgtctcaagaaaataaattaaagaaaaataatatctggatgttgcatagttctagttttggggacccataaatgttttccttttaatccttactag

SEQ ID NO: 42430 - DNA, 601 bp, Human
ctctgtgaaaccgtgcctcctatactcaagcattgatagatggggtgtgccatgggcaactagttgctcttctcttcctgaaccttactcatagcagcaggaatggtaccctgtgttctgtaaagaaggagataaggcagatgaggcttgagtccttggcttcccttaggttggtcctgggtgtactgttaggctgtgcggtagtaaagggtcctactcagcatttgggtcatttgtaatatttctgtccttggccatacctcactttccctatctgtatacatagggaaaataaaaatcrtagctgttaattcctgtgagtcttcacctctggctcccagcccttttgaccacgttcctgtcttgtacaggataatatccaaagcccttcaaccaggtgggaaacctttcctttgtttagaagaggcaaagagtttcttttcattttagtccatcccattgcctcaagatcatgttgtgagtttttcgatttctctaaaacatagtacctaagtatgttcaggctcctgggtagtagtgtgggagcagtagtggctttgatgtcaggtggacaaggatttgatactcagcctgccactta

SEQ ID NO: 42431 - DNA, 601 bp, Human
ggcaactagttgctcttctcttcctgaaccttactcatagcagcaggaatggtaccctgtgttctgtaaagaaggagataaggcagatgaggcttgagtccttggcttcccttaggttggtcctgggtgtactgttaggctgtgcggtagtaaagggtcctactcagcatttgggtcatttgtaatatttctgtccttggccatacctcactttccctatctgtatacatagggaaaataaaaatcatagctgttaattcctgtgagtcttcacctctggctcccagcccttttgaccacsttcctgtcttgtacaggataatatccaaagcccttcaaccaggtgggaaacctttcctttgtttagaagaggcaaagagtttcttttcattttagtccatcccattgcctcaagatcatgttgtgagtttttcgatttctctaaaacatagtacctaagtatgttcaggctcctgggtagtagtgtgggagcagtagtggctttgatgtcaggtggacaaggatttgatactcagcctgccacttaaaagctgtgagatcttaggctttgcctcctggtgcctgcttccttatctttaca

SEQ ID NO: 42432 - DNA, 601 bp, Human
aacatagtacctaagtatgttcaggctcctgggtagtagtgtgggagcagtagtggctttgatgtcaggtggacaaggatttgatactcagcctgccacttaaaagctgtgagatcttaggctttgcctcctggtgcctgcttccttatctttacaaatggggataattttataatacctaatatataaaggcatctagcacagcacccagtacataacatatatttagtgttagcttccttcctttataggaaaaaaaaatttggttctcttttggcccttcaaccttatgaaggtaggrcaggtgttagtaaccaccccagagtaagaagctttaacactgctccagtcaagagacttctgagacccttagcacaggctttgaatctgacccattcctatgaattttgacctgaaccttccagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctcta

SEQ ID NO: 42433 - DNA, 601 bp, Human
taagttttaatttttgttgtgcagctgacaacttgccaaatgtttgtaaactggtgaatgggaggggcacaagaggagtcggtggaacttataaatggcagcaaggcagggccatctgggagctttggcctattgatgtcagcaccttagaatgcagctcagactagagccctgaattccccagggagctgagatggtaatgaatgggaaggagggagtggggaagggttatgaatggaactccctgatgggagtggctctgctcaccctcctttctgagaggaggctgaggcctagggtragcctagagagggaagaaggccagggtgcctggaaggtgggtgtaaacacatgtgccctggtgttgacctctgagggtgtaatgagtgcctgagatgactcatcagctggggaggcctcagcagtgggatatctactgctgggaatggtaactattggaaacattaattactagtagttttgtactcatcagcttagaagaacatttgaagttgaggagtgacaccatgctggatgctttagaacaggagctcctagactcctaaaatgcatcccagatttgggacccccttcccaccca

SEQ ID NO: 42434 - DNA, 601 bp, Human
accacgacagcactatccctatggaggtccttatgacagagtgaggtaagcatgaccccagctcctgtccactcccccagcaccctgaagctatagtgggctcaatctgcctctccaattttgtttaggacggagcctggaatagggcctgagggaaacatgagcactggggccccacagccgaatctcatgccttccaacccagactcggggatgtattctcctagccgctaccccccgcagcagcagcagcagcagcagcaacggtgagtaaagcctggtctcggtgctgctatggatyaggcttcgccactgcccaccctaatcctgtgtttctttgcctcctatagacatgattcctatggcaatcagttctccacccaaggcaccccttctggcagccccttccccagccagcagactacaatgtatcaacagcaacagcaggtgaggagggtagctgggaatggactggcatgcaggttcgccttgaaaactagttagtaaactaatctaacgtgttgaagtctaagaagctcactttagatattttggcattcttctctcacctgactggccagtcctgcctgaagagccacgt

SEQ ID NO: 42435 - DNA, 601 bp, Human
tgttccctggaaaattagctccagcaaccctgtggattttttcccttgggctacctctgatagcagcagggtgggccctggaggtgagacagtcccttccatatgcacaaatgacagtatcaggctccaagtgtttcataccttttattacaaaaatcaataacttaattcagttctgtataaagtcgataggacttctggtccaataagcagcctaagctttcattctcatcccaagaagggacaggagtcttggcccagaggctgtggggaccaccaaaagcctcccaggcagctggarcactgtgtccaaaccaaggaagtccaatgtggggtgtggctgagtgaagagctgttcctaaggagccaagtgctgtctatacaggcttgccccctccaggagcattgggtcacctctggggatggccaggctgaatcagcactgccagcctctgcccacctgatctctgcctgggctggaacaggtcacctgagcaaaagcatgtccccaagaaggccagcgatgtcaacatctccaatgatagggcgaaagaagaggtccccaagcaggctggtcggaatggacttgagggtggaggcc

SEQ ID NO: 42436 - DNA, 601 bp, Human
gggctgggcgtggtggctcatacctgtaatcccagcactttgggaggccaaggcaggcagatcacgaggtcaggagatcaagaccatcctgactaacacagtgaaactccatctctattaaaaatacaaaaaattagcccggtgtggtggcgggcgcctgtagtcccagttactcgggaggctgaggcaggagaatggcgtgaacctgggaggcggagcttgcagtgagccgagattgtgccaccgcactccagccttggcaacagagtgagactcagtctcaaaaaagaaaaaaaaaaaagcctctgtattgggtaattgaaaatgtataacctagcaggacagtgaatttagagcatgtgttttgtgatcatctcacagagcttcatagccaactttcctatatcttctgtttccactttcccatctaataataggcttttggagtatttccaattatttttaatacagatgcaagctatcattgtcctcatttaaactacttgataaattcagcatattaagtcaacattttttgtgacattgtaatttgaaatttataacattttccaggtttaaatttggacttggcttttgaaat

SEQ ID NO: 42437 - DNA, 601 bp, Human
aaaacacaggtttattttatggccaaaacttattttaactactccttcctgtttgttttgataaggaaacaattattctccagcctggccaagatggtgaaaccccatctctactaaaaatacaaaaattagccaggcacagtggcaggtacctgtaatcccacctacttgggaggaagcaggagaattacttgaactcggagggcagaggttgcagtgagccaagatcgtgccactgcactccagcctgggcggcaaagtgagattctatctcaaaaaaaaaaaaaattatttttctgtstggcatgtgttcagcatgactggtaaatatccttcaacgtaaagttgtcatttactactaaactggcagtgtttgtgtttctactaaaaatagcagagtatacatgactctttgtagctgttttgttatttgtattctgctgaaattgaaagaaggggattatcatgttacctttgtaatttagtaaaacttcagaaattttattcttcaaaaagagattgggaatttgcggtaaaattgagttatgggccaggtacagtggctcatgcctgtaaccccagcactttgggaggccgaggc

SEQ ID NO: 42438 - DNA, 601 bp, Human
tgactctttgtagctgttttgttatttgtattctgctgaaattgaaagaaggggattatcatgttacctttgtaatttagtaaaacttcagaaattttattcttcaaaaagagattgggaatttgcggtaaaattgagttatgggccaggtacagtggctcatgcctgtaaccccagcactttgggaggccgaggcaggtggatcacctgaggtcaggagttcgagaccagcctgaccaacacggataaaccctgtctctactaaaaatacaaaaaaattaacggggtgtggtggtgcatkcctgtaatcccagctacctgggaggctgaggcaggagaatctcttgaacccagtaggcagaggttgcggtgagccgagatcacgccattgcactccagcctgggcatcaagagtgaaactccgtctcaaaaaaaaaaaaaaaaattgagttacgaatttgaaacatacatttttctttcaaatgtgaaatcaaggctaacaaaatgttacctgctagaaactatttggaagtttcattgtaatgagataggaaactaacttcattaatattctctcaaggctaaactttatgtcagctgg

SEQ ID NO: 42439 - DNA, 601 bp, Human
gccaggtacagtggctcatgcctgtaaccccagcactttgggaggccgaggcaggtggatcacctgaggtcaggagttcgagaccagcctgaccaacacggataaaccctgtctctactaaaaatacaaaaaaattaacggggtgtggtggtgcatgcctgtaatcccagctacctgggaggctgaggcaggagaatctcttgaacccagtaggcagaggttgcggtgagccgagatcacgccattgcactccagcctgggcatcaagagtgaaactccgtctcaaaaaaaaaaaaaaaaattgagttacgaatttgaaacatacatttttctttcaaatgtgaaatcaaggctaacaaaatgttacctgctagaaactatttggaagtttcattgtaatgagataggaaactaacttcattaatattctctcaaggctaaactttatgtcagctggtactccttgcaatcttacaaatttctacaggaaacttttcttccaagttaagcttcaacctcagtaattgtttacatttttattcgttgagaattagtgtcaagtataggtaaattggactttattatggtacaaggtattgtc

SEQ ID NO: 42440 - DNA, 601 bp, Human
ccaaaatactgactggtcctagacataaatcatcttttttggatggtgctagcgaattagaggctaatccccaacatgaggttcttctaatttcttggttgtgatttttcagtgaaagaaattaaaaagaatttgcagattcgtggagacttgggaaggatattaagctgtcttacaaccccaaattcaccaaaaattcagcaaatcactgaatattcataataaaaattgaagtattttcaaacttcagtttttatctcagaggttaacgtcctatgtaatccgaaatctcacgaaaacrtaactgagttaatcaatatctatgcttactaatgaggactgctgaaaaccagctgttgtgctgagaacatcagggccaggagtggagaaggcctgttcatggttcttttcctttctgtcctttagcaatgcaccttgtcagctgggcgtagtggctcatgcctgtaatcccagcactttgggaggctgaggccggtagatcacttgagccccagagtttgagaccagcctgggcaacatggagaaatctcatctctacaaaaaatacaaaaattagccagtctcagatcataacctggta

SEQ ID NO: 42441 - DNA, 601 bp, Human
ttacaggcatgagccagtgtgcctggcctgtaagtttccttttctttgcaaggtactgcgctaggcactgtgagggactcaaaaatgaggcctggtgctgtggctcacacctgtaatcccagcactttgggaggctgaggtgggcggatcacctgaggttggaagttcaagaccaacttggccaacatggtgaaaccccgtgtctactaaaaatacaaaagaggccgggcgcagtagctcacgcccgtaatcccagcactttgggaggctgaggtgggcggatcacaaggtcaggagatcragaccatcctggctaacacagtgaaaccccgtctctactaaaaaaatacaaaaaattagccgggcgtggtggcgggtgcctgtagtcccagctactcgggaggctgaggcaggagaatggtgtgaactcgggaggcggagcttgcagtgagccgagatcacaccactgcactccagcctgggcgacagagcgagactctgtctcaaaataaataaataaataaaagttagcctggtgtggtcacaaatgcctgtaatcccagctacttgggaggctagggcatgagaatcatttgaaccg

SEQ ID NO: 42442 - DNA, 601 bp, Human
gccacgacagcaccgtgtctgttgctgatgcctcaaaaagtgtgcagtgagtatttgcctttcatttggaaggtggggaacaaggggtgggatctctcaccagctgaaccaggactgcccttcctggggtgttagcacagggcacaaacataaaaaccttaatcaggccaggcgtggtggctcacgcctgtaatcccagcactttgggaggccgaggtgggtggatcacaaggtcagcagttcaagaccagcctggccaagatggtgaaaccctgtctctactaaaaataaaaaaaattakccaggtgtggtggtaggcgcctgtactcccagctactcggaaggctgaggcagagaattgcttgaacctgggaggcagaggttgtagtgagccaagatcatgccactgtactccagcctgggcgacagagtaagactccgtctcaaaaaaaaaaaaaaaaaaaaaacacctcaatgaaaactgcaggcaggcaggcctcagtggctcacgcctataatcctagcactttgagaggctgtgggcagatcacctgaggtcaagagttcaagaccagcctggccaacatggtgaaaccccgtc

SEQ ID NO: 42443 - DNA, 601 bp, Human
tggatcacttgaggtcaggagttcgagagcagcctggccaacatggtgaaaccctgtctctacaaaaatacaaaaattagcccagcatggtggcgggtgcctatagtcccagctactcgggaggctgaggaaggagaatcacttgaacccaggaggtgaaggttgcagtgaaccgagatcatgccattgcactccagcctgggcaacagagcaagactccatctcaaaaaaaaaaaggctagtttagtctgttactctgaattccttacaaaatgtaagtgccgttcaccggccttaaattaaataggagatatattcttactgggggaagtcagcgaacgatgacttcattaatttgagccttccattcagtaaggcttaaaaagcattgatgccacttctctgctgtggctggaaggactcgaattacggtggcttctttgtgagtggcgtgtctgttcagccataaagtacttggccagacatcagagttcattttgttcagtatatgttggaggaagagagaagattggaatccttcttcttttataaatctttgttcttccctggtgttccttttccattgatagctaaagggaac

SEQ ID NO: 42444 - DNA, 601 bp, Human
cacagtcagcttttgaatgcatcgtttcttgcatgaagtgaggtgctcctaactcatcagccagtgtgtctgcctgccatatctgtgtaatctctttgccacattcaagagcaaataactacatgcacacacatgtccctgcaggcacacatacacacacatggcccattcgagtgtgagctcctggctaagaccgtttggttcatcttggtagctctagctcctaacacagtgcctggccgtcagcacagatctgtgtggtcacagccctctcggagctccggtgagcacaggcaaggaraaggtcctagcacaggtgtctgctgccaagtcatagtaacaggaagagctctaggagctaagagcagggagaagccactttaggcggaagtggcccgggaaagtggaccgtgggatcatgggggtgatccctttagagctgtgctgggggtggaagggcgtgatgcaaagactgggctttgggaaccagtttgtcgtcagtgggcagggcctcagaaggaggcagagccggaacccagggctgcccctgtcttgagaggcctgcaagttgaggtcaggggctccttttcaacataagtgc

SEQ ID NO: 42445 - DNA, 601 bp, Human
ctgtgtggtcacagccctctcggagctccggtgagcacaggcaaggagaaggtcctagcacaggtgtctgctgccaagtcatagtaacaggaagagctctaggagctaagagcagggagaagccactttaggcggaagtggcccgggaaagtggaccgtgggatcatgggggtgatccctttagagctgtgctgggggtggaagggcgtgatgcaaagactgggctttgggaaccagtttgtcgtcagtgggcagggcctcagaaggaggcagagccggaacccagggctgcccctgtctygagaggcctgcaagttgaggtcaggggctccttttcaacataagtgcccattgatactgcagaagcccctgtgagaatgggtcctttgtgatcatctgtgtctgtaaagaagctaatagtctgttgcatcttgggataacacatgttcttgtgttcagggtctcgactctgaagacagagttcctgccgctcctaagtgtgtcatttgtctcagagaacagcgtcgtggctgctgtgagtatttttcttcattctccctcggggtgcactgtatgtgatgctcagacagggaacaatgtg

SEQ ID NO: 42446 - DNA, 601 bp, Human; identical to SEQ ID NO: 20240

SEQ ID NO: 42447 - DNA, 601 bp, Human; identical to SEQ ID NO: 20241

SEQ ID NO: 42448 - DNA, 601 bp, Human; identical to SEQ ID NO: 20242

SEQ ID NO: 42449 - DNA, 601 bp, Human; identical to SEQ ID NO: 20243

SEQ ID NO: 42450 - DNA, 601 bp, Human; identical to SEQ ID NO: 20244

SEQ ID NO: 42451 - DNA, 601 bp, Human
gctggccatgtggacatgggctcctaattttccatccagggcccagaccctgggcagagcatcagactaggttaggcacaaaggctcggccaaagttcacggtccacgtggcacatattatattctattcagcaaaattaaatatttaataatttcatcaaatcatcccctttctagtgattttgcatgtgattccgcctttgtgtaaaaaaaaaaccccacaaactcattttgtgcttaaatatctgagtttgattgaccaccactgtctcatctcagttatatccagtctgtgatcagwctcacccataaggtgcagcctttgaaggaaaagaaataaagcagaacccctttgttctgtctctcaaagctgcaaaagatgtcatggggagtaagagctggggtagagccatggagataccctcagggaatttagcatttttcggagaggattgaagcaggtgcaaatgacccaaaggtaaatacctgggctccctaataaattgagtttcaaagctgtccagaaggaagggaaaaaaggctactcaagagctcttgctacagagaggaaagtttgactctcatgtacacagataacaag

SEQ ID NO: 42452 - DNA, 601 bp, Human
cattcttgtctcttaattttttatttcatggatagaaagaaaaaagagataattatttttgccaacttggaactggcctatcaagccaacatgcttgaaactttctttcatcttccatagccattttttttataatgagtacttccagcattcatttatgataaaaactcagcaaactagggagagaaaattcctcaatttgataaagagaatctacaaaaaaacagcccacttcatctaaatgatgcttaatgatgaaagaactgaaggcttccctcctaagattaggaacaattcaaamattcaccacatttactcaacattatactgggaagtcctagtgcaatagacaaaagaaaagaaataaaaggcatacagattggaaaggaaataaaagaattgtctctattttcaagtgacataactgacaatgtgtaaaatctcaaggcatatacaaagagacttctagaactactatgtcagttctgcaaggttctaggataccagatcaacacacaaaatcaaagcacatttctatgtaacaacaatcaatatctgaaaatacaagaaaaacataatatcatttacagtcattccaaca

SEQ ID NO: 42453 - DNA, 601 bp, Human
ttttgaggtgaacaaaaactaagatgtgataggccacaatctcatgggatttagcaaaggaagtgctcagagggaaagttacagctgtaatgtctaaatttagaggaacaaaaaaatcacaaatcagtaatctatgttcatgccacaacatagtaaacgaagaagggcaaactaagcctgaagccagcagaagaaagaaaatgatacagactaaagtacaaattcatgaactagagaataaaaaaccctgatgaattaatatcatttctatgaagtgtccagaataggcaaatccatagargcagaaagttgattagtggttgcatatgatgacagggtttgtgacagggggctgatagctaaaaatgtatgaggtctctagattgacaaaaaaagttttaaagtttaaaatgatgatggtcacacatatcttcaaatgtactacaaatcactgaactgtatattttaagtggatgaattacatggtgatttatatctcaataaagcagttatttttaagagagaaagataaataaaaggaaatagtagtccacatacttattgagagaaagaatggatccaaaaaatcaaatcttaaaag

SEQ ID NO: 42454 - DNA, 601 bp, Human
tttggcagaggtctgaaaacagtgtgggtgatatgcacctagtatttggtgttatatttggaaggcaatatgatagtgttttaagactttagctcaggagccagatatcctggttcctagcttggcttcttcaccagttactgcctgactggaacatgagataggtgtggggagagctgagtcagcctgcacagcacacccagggccaggctccgtcagactacagccagaccagagcaagtcctgccaatatcagcagagctcactatccaactatgatgtgtggaggagttatgaagtrgggagacattcgagacggctctcaccccagggactgaaatccttagcataaccgtgtactggtttttctttctcattgaaacaaatgtgactaataggctatgaccactagcatcaaataacatatgagaaagtgattgttacctttcaaaaaaaaaagtcacatgtctgtaaccaagaaaataaaaagagataaaaagagcaaattcctgtgtccatatgtggatacagctaaggggacatcacacaccactatggtgcctgctgcaaacatgtaattcacaaccaaaaccaatgtgaa

SEQ ID NO: 42455 - DNA, 601 bp, Human; identical to SEQ ID NO: 35087

SEQ ID NO: 42456 - DNA, 601 bp, Human; identical to SEQ ID NO: 35088

SEQ ID NO: 42457 - DNA, 601 bp, Human; identical to SEQ ID NO: 35089

SEQ ID NO: 42458 - DNA, 601 bp, Human; identical to SEQ ID NO: 35090

SEQ ID NO: 42459 - DNA, 601 bp, Human; identical to SEQ ID NO: 35091

SEQ ID NO: 42460 - DNA, 601 bp, Human; identical to SEQ ID NO: 35092

SEQ ID NO: 42461 - DNA, 601 bp, Human; identical to SEQ ID NO: 35093

SEQ ID NO: 42462 - DNA, 601 bp, Human; identical to SEQ ID NO: 35094

SEQ ID NO: 42463 - DNA, 601 bp, Human
cttggggctcattttagctgggcactgaatgatgaaaatgagaatggcatcttgccaaatgagttatgcatcttatgtggtgtcttaaaaaaaacattaggctgggcacagtggctcatgcgtgtaatcccagcacttgagaaggctgaggcgacttggaaagctgagatgggaggatcacttgggctcaggaagtcgaagttgcagtgagctgtgactgtgccactgcactccagcctgggtgacagagtgagaccttgtcttaaaaaaaatttttttttgaccgggagcattggctcaygcctgtaatcccagcatgttgggaggccgaggccagtggatcacttgaggtcaggagttcgagaccaacctggccaacatggcgaaaccccgtctctactaaaaatacgaaaatcatgccactgcactccagcctgggcaacagagtgagactccgtctcaaaaaaaaaaaaaaaatttccccatttaaagtccgtatacagtttagtgtcttttggtgtattcacagagccatgcattaccacaatcaattttctttctatttaaaaaatttgcagccaggtgcagtggctcacgcctg

SEQ ID NO: 42464 - DNA, 601 bp, Human
cttgggctcaggaagtcgaagttgcagtgagctgtgactgtgccactgcactccagcctgggtgacagagtgagaccttgtcttaaaaaaaatttttttttgaccgggagcattggctcatgcctgtaatcccagcatgttgggaggccgaggccagtggatcacttgaggtcaggagttcgagaccaacctggccaacatggcgaaaccccgtctctactaaaaatacgaaaatcatgccactgcactccagcctgggcaacagagtgagactccgtctcaaaaaaaaaaaaaaaatttmcccatttaaagtccgtatacagtttagtgtcttttggtgtattcacagagccatgcattaccacaatcaattttctttctatttaaaaaatttgcagccaggtgcagtggctcacgcctgtaatcccagcactttgggaggcttaggtgggcgatcaccttatgtcaggagttcaagaccagcctggccaacatggcgaaaccccatctctactaaaaatacaaacattagccgggtgtggtgacatgtgcctgtaatcccagctactcgggaggctgaggcaggagaatcgcctgaacc

SEQ ID NO: 42465 - DNA, 601 bp, Human
gacagagtgagactctgtctaaaaaaaaaaaaaaaaaaaaaaggagatggggtttcgctctgttgcgtaggttggtctccatctcctgggctcaagtgattctaccaccttggcctcccaaaatgctgggattataggcatgagccaccatgcccagccataatcaatttcagaacattgtcattgtcttgtaaagaaactctgtagtgatttgccatcacttcccaatcccccagctccccgcacccagttatctactttctgtctctatgtatttgtctattctggatatttcctatargttgaatcatataatatgtgaccttttatgactggcttctttcacttagcaaattttcaagtcatctgtattgagcatggatcagtgcttcatttgtttacagacagggtctcactctctcacccagacttcagtgccatggtgccatcatagctcactgcaacctcaaactcgcagagtcaagtgatcctcctgtctcagcctcccaagcagctaggactgtaggcacatgtaaccatgcctggttaattttttatttccttttttttttagagatgggttctcactatgttgcccagg

SEQ ID NO: 42466 - DNA, 601 bp, Human
taaccattaaaaaatctacactttagtggcattaagtacattcacattattttgcaaatatcacccctacccatctcccatctccaaaactttttcaccctcctaaactgaaacccaaatctccattaaacactaactctccattcccactttccgcaggccctggcacccaccatcctactttctgtctctatgaatttgactactccagggacctcatctaggtgaaatcttacatactgtgtagtttttttgttttgttttgttttgtttttgagatggtgtctcgctctgttgcccmggctggagtgcagtggctcaatctccactcactgcaccctccacctcccaggtttgagccattcttctgtctcagcctcctgagtagctgggactacaggcgtatgccaccaggcatggctaatttttgtatttttagtagagatggggttttgccatgttggccaggctggtcttaaactccttatctcagatgatctgcctgcctctgcctcccaaagtgctgggattacaggacactgtatagtttttgtctggcttatttcacttagcataatgtcctcaaggttcatccatgtta

SEQ ID NO: 42467 - DNA, 601 bp, Human
cccatctcccatctccaaaactttttcaccctcctaaactgaaacccaaatctccattaaacactaactctccattcccactttccgcaggccctggcacccaccatcctactttctgtctctatgaatttgactactccagggacctcatctaggtgaaatcttacatactgtgtagtttttttgttttgttttgttttgtttttgagatggtgtctcgctctgttgccccggctggagtgcagtggctcaatctccactcactgcaccctccacctcccaggtttgagccattcttctrtctcagcctcctgagtagctgggactacaggcgtatgccaccaggcatggctaatttttgtatttttagtagagatggggttttgccatgttggccaggctggtcttaaactccttatctcagatgatctgcctgcctctgcctcccaaagtgctgggattacaggacactgtatagtttttgtctggcttatttcacttagcataatgtcctcaaggttcatccatgttacagcatgtgtcagaatttccttccttttaaaggctgtataatattcgactgtatgtatacaccacatta

SEQ ID NO: 42468 - DNA, 601 bp, Human
gggatcatggtgaaacctgtctctggaaaaaaatacaaaaattagccaggtgtggaggattgtgcctgtagtcacagctactcaggaggctgaggcaggagaatcgcttgagcccaggaggcagaggttgcagtgagctaagggattgcatcactacactccagcctgggcaacaggagtgaaaccctgtctcaaaaaaaaaaaaaaaaaaagaaagaaaaagaaaggtctattcaagtcctttgctcattttcttttcttttctttttttttttttttgagacggagtctcgctctgtcrcccaggctggagtgcagtggcacaatctcggctcactgcaaactccgcctcctgggttgacgccattctcctgcctcagcctcccgagtagctgggactacaggcgtccaccaccaagcctggctaattttttttgtgtgtgtatttttagtagagatagggtttcactgtgttagccacgatggtgtcaatctcctgactttgtgatctgcccaccttggcctcccaaagtgctgggattacaggcgtgagccaccgcgcctggcctttttttttgtatttttagtagagacggggttt

SEQ ID NO: 42469 - DNA, 601 bp, Human
ttgagcccaggaggcagaggttgcagtgagctaagggattgcatcactacactccagcctgggcaacaggagtgaaaccctgtctcaaaaaaaaaaaaaaaaaaagaaagaaaaagaaaggtctattcaagtcctttgctcattttcttttcttttctttttttttttttttgagacggagtctcgctctgtcgcccaggctggagtgcagtggcacaatctcggctcactgcaaactccgcctcctgggttgacgccattctcctgcctcagcctcccgagtagctgggactacaggcgyccaccaccaagcctggctaattttttttgtgtgtgtatttttagtagagatagggtttcactgtgttagccacgatggtgtcaatctcctgactttgtgatctgcccaccttggcctcccaaagtgctgggattacaggcgtgagccaccgcgcctggcctttttttttgtatttttagtagagacggggtttcaccgtgttagccaggatggtcttgatctcctgacctcatgatccgcctgccttggcctcccaaagtgttgggattacaggcgtgagccaccacacccagccctttg

SEQ ID NO: 42470 - DNA, 601 bp, Human
agcccaggaggcagaggttgcagtgagctaagggattgcatcactacactccagcctgggcaacaggagtgaaaccctgtctcaaaaaaaaaaaaaaaaaaagaaagaaaaagaaaggtctattcaagtcctttgctcattttcttttcttttctttttttttttttttgagacggagtctcgctctgtcgcccaggctggagtgcagtggcacaatctcggctcactgcaaactccgcctcctgggttgacgccattctcctgcctcagcctcccgagtagctgggactacaggcgtccrccaccaagcctggctaattttttttgtgtgtgtatttttagtagagatagggtttcactgtgttagccacgatggtgtcaatctcctgactttgtgatctgcccaccttggcctcccaaagtgctgggattacaggcgtgagccaccgcgcctggcctttttttttgtatttttagtagagacggggtttcaccgtgttagccaggatggtcttgatctcctgacctcatgatccgcctgccttggcctcccaaagtgttgggattacaggcgtgagccaccacacccagccctttgctc

SEQ ID NO: 42471 - DNA, 601 bp, Human
ttttagaaaatattatcggccgggcacggtggctcacacctgtaatcccagcactttgggaggctgaggtgggtggatcacctgagatcaggagttctgagaccagcctggccaacatggcgaaaccctgtctctactaaaaatactaaaattaggcgggtgtggtggcgggcacctgtagtcccagctactcaggaggctggggcatgagaattgctagaacctgggaagcagaggttgcagtgagccaagattgtgccactgcactccagcctgggtgacagagtgagactgtgtctcaaaaaaaaaaaaaaagaaagaaaatattatcaaataggttcatactttggtggggttttggtttgttttgactaaaacccttcattctctgtactgtatttgaacaatacctattgatggacatttctggtgttttcagtttttgaatttctacacagtcctggaatgaacatttcatttgtatgtctcgctaatttttatactttttgtagagtgctgggattacaggcatttgtatgtcttgtaatttgtatgtcatcttgcaattgtgtactatgtaccttggatgtaccttttaaag

SEQ ID NO: 42472 - DNA, 601 bp, Human; identical to SEQ ID NO: 20617

SEQ ID NO: 42473 - DNA, 601 bp, Human; identical to SEQ ID NO: 20618

SEQ ID NO: 42474 - DNA, 601 bp, Human; identical to SEQ ID NO: 20619

SEQ ID NO: 42475 - DNA, 601 bp, Human; identical to SEQ ID NO: 20620

SEQ ID NO: 42476 - DNA, 601 bp, Human; identical to SEQ ID NO: 20621

SEQ ID NO: 42477 - DNA, 601 bp, Human; identical to SEQ ID NO: 20622

SEQ ID NO: 42478 - DNA, 601 bp, Human; identical to SEQ ID NO: 20623

SEQ ID NO: 42479 - DNA, 601 bp, Human; identical to SEQ ID NO: 20624

SEQ ID NO: 42480 - DNA, 601 bp, Human; identical to SEQ ID NO: 20625

SEQ ID NO: 42481 - DNA, 601 bp, Human; identical to SEQ ID NO: 20626

SEQ ID NO: 42482 - DNA, 601 bp, Human; identical to SEQ ID NO: 20627

SEQ ID NO: 42483 - DNA, 601 bp, Human; identical to SEQ ID NO: 20628

SEQ ID NO: 42484 - DNA, 601 bp, Human; identical to SEQ ID NO: 20629

SEQ ID NO: 42485 - DNA, 601 bp, Human; identical to SEQ ID NO: 20630

SEQ ID NO: 42486 - DNA, 601 bp, Human; identical to SEQ ID NO: 20631

SEQ ID NO: 42487 - DNA, 601 bp, Human; identical to SEQ ID NO: 20632

SEQ ID NO: 42488 - DNA, 601 bp, Human; identical to SEQ ID NO: 20633

SEQ ID NO: 42489 - DNA, 601 bp, Human; identical to SEQ ID NO: 20634

SEQ ID NO: 42490 - DNA, 601 bp, Human; identical to SEQ ID NO: 20635

SEQ ID NO: 42491 - DNA, 601 bp, Human; identical to SEQ ID NO: 20636

SEQ ID NO: 42492 - DNA, 601 bp, Human; identical to SEQ ID NO: 20637

SEQ ID NO: 42493 - DNA, 601 bp, Human
ccagggcaaagggagaaggagacagagacccaggaggctgctggacatgggatacgctggcatgggaggtggaaagaggcccagagacagaaataaagccatgcaggtaaacaacaaaacaaagtcttgtgaaaagcggacggctgggtcaccctggagacaggggctgcctactgaagccagagacttcttgcgcagtgacacccagaaagttatcttttctggagagggcaagggccggagtgaggcagttcggccccatgctatgcacagaggaagggtagggaggaagggagcccasacatggggctgactcactccagaggcgccactgcagctcccagagactggagcttgcccaccttctgcacagggtctgctgtgttccccatcagccccctcccaccctgagctgccgctgggagcagccaagggagctgctcagtgccccatccttgctgagggctcgccctacaggagctttgctgagctcctggagaccaccacagtgattcagaaatgtgcccctccagagcactaaagggatggagtgcaggaacagattccccctccccgcaccctgggagtcagcaagggctgg

SEQ ID NO: 42494 - DNA, 601 bp, Human
gtggggtgggcctggccgaggtggacagtgagcgaggggcctggctggggtggactttgtggtttgtgcctggctggggtggacagtgagggttgggcctggctggggtgggcagtgaggaactggcctggctggggaggactgtgcaggtcaggcctggccagggcaaagggagaaggagacagagacccaggaggctgctggacatgggatacgctggcatgggaggtggaaagaggcccagagacagaaataaagccatgcaggtaaacaacaaaacaaagtcttgtgaaaagcggayggctgggtcaccctggagacaggggctgcctactgaagccagagacttcttgcgcagtgacacccagaaagttatcttttctggagagggcaagggccggagtgaggcagttcggccccatgctatgcacagaggaagggtagggaggaagggagcccagacatggggctgactcactccagaggcgccactgcagctcccagagactggagcttgcccaccttctgcacagggtctgctgtgttccccatcagccccctcccaccctgagctgccgctgggagcagccaagggagctgc

SEQ ID NO: 42495 - DNA, 601 bp, Human
ggcctggccggggtggaccatgaggggcgggcctggccggggtggacggtgtggggtgggcctggccgaggtggacagtgagcgaggggcctggctggggtggactttgtggtttgtgcctggctggggtggacagtgagggttgggcctggctggggtgggcagtgaggaactggcctggctggggaggactgtgcaggtcaggcctggccagggcaaagggagaaggagacagagacccaggaggctgctggacatgggatacgctggcatgggaggtggaaagaggcccagagacagmaataaagccatgcaggtaaacaacaaaacaaagtcttgtgaaaagcggacggctgggtcaccctggagacaggggctgcctactgaagccagagacttcttgcgcagtgacacccagaaagttatcttttctggagagggcaagggccggagtgaggcagttcggccccatgctatgcacagaggaagggtagggaggaagggagcccagacatggggctgactcactccagaggcgccactgcagctcccagagactggagcttgcccaccttctgcacagggtctgctgtgttcccca

SEQ ID NO: 42496 - DNA, 601 bp, Human
gtcggggtggactgtatgggttgggcctggctgggatggacagtgaggatcaggcctggccggggtggatagtgagggatgggcctgaccagggtagacagtgtgggttgggtctggccggggtggacggtgaggggtgggcctggccggggtggaccatgaggggcgggcctggccggggtggacggtgtggggtgggcctggccgaggtggacagtgagcgaggggcctggctggggtggactttgtggtttgtgcctggctggggtggacagtgagggttgggcctggctggggtggrcagtgaggaactggcctggctggggaggactgtgcaggtcaggcctggccagggcaaagggagaaggagacagagacccaggaggctgctggacatgggatacgctggcatgggaggtggaaagaggcccagagacagaaataaagccatgcaggtaaacaacaaaacaaagtcttgtgaaaagcggacggctgggtcaccctggagacaggggctgcctactgaagccagagacttcttgcgcagtgacacccagaaagttatcttttctggagagggcaagggccggagtgaggcagt

SEQ ID NO: 42497 - DNA, 601 bp, Human
ccaggggaaacagggaacccctgggtgtcagtaacgacccttccaggctgggccaggccattggtgacgagggagggccagcaggagctggcacggggcccaaaaggacttcatcggagacatcggggtccaggaaagcaggtgctgcaggtggatggtgaggggcgggcctggcctgggtggacagtgagggacgggcctggatggggtggactgtgcgggttggggctggtcggggtggactgtatgggttgggcctggctgggatggacagtgaggatcaggcctggccggggtggayagtgagggatgggcctgaccagggtagacagtgtgggttgggtctggccggggtggacggtgaggggtgggcctggccggggtggaccatgaggggcgggcctggccggggtggacggtgtggggtgggcctggccgaggtggacagtgagcgaggggcctggctggggtggactttgtggtttgtgcctggctggggtggacagtgagggttgggcctggctggggtgggcagtgaggaactggcctggctggggaggactgtgcaggtcaggcctggccagggcaaagggagaaggag

SEQ ID NO: 42498 - DNA, 601 bp, Human
cccaggcccggctggcgagggcaggaagatgtggatggcacccgccagatccagattccgggaggggtccaggggaaacagggaacccctgggtgtcagtaacgacccttccaggctgggccaggccattggtgacgagggagggccagcaggagctggcacggggcccaaaaggacttcatcggagacatcggggtccaggaaagcaggtgctgcaggtggatggtgaggggcgggcctggcctgggtggacagtgagggacgggcctggatggggtggactgtgcgggttggggctggycggggtggactgtatgggttgggcctggctgggatggacagtgaggatcaggcctggccggggtggatagtgagggatgggcctgaccagggtagacagtgtgggttgggtctggccggggtggacggtgaggggtgggcctggccggggtggaccatgaggggcgggcctggccggggtggacggtgtggggtgggcctggccgaggtggacagtgagcgaggggcctggctggggtggactttgtggtttgtgcctggctggggtggacagtgagggttgggcctggctggggtgggc

SEQ ID NO: 42499 - DNA, 601 bp, Human
ctggctgttaaaactggaattagtcttactggtcaaagttccttttcctaccttgaagtggactcattttggcatataaacgtgaataagatgcgtctaaccaggcaagcgagccccccaaacaggagcgccctggctgacgggaaacactggatctggggagaatcgcgcaaacgtcctctcctcctctccaaaatgacggctgagtcgaagagtccgcctgtcagaacggcgacccggcacgaggccccaggcccggctggcgagggcaggaagatgtggatggcacccgccagatccrgattccgggaggggtccaggggaaacagggaacccctgggtgtcagtaacgacccttccaggctgggccaggccattggtgacgagggagggccagcaggagctggcacggggcccaaaaggacttcatcggagacatcggggtccaggaaagcaggtgctgcaggtggatggtgaggggcgggcctggcctgggtggacagtgagggacgggcctggatggggtggactgtgcgggttggggctggtcggggtggactgtatgggttgggcctggctgggatggacagtgaggatcagg

SEQ ID NO: 42500 - DNA, 601 bp, Human
cctactggctgttaaaactggaattagtcttactggtcaaagttccttttcctaccttgaagtggactcattttggcatataaacgtgaataagatgcgtctaaccaggcaagcgagccccccaaacaggagcgccctggctgacgggaaacactggatctggggagaatcgcgcaaacgtcctctcctcctctccaaaatgacggctgagtcgaagagtccgcctgtcagaacggcgacccggcacgaggccccaggcccggctggcgagggcaggaagatgtggatggcacccgccagrtccagattccgggaggggtccaggggaaacagggaacccctgggtgtcagtaacgacccttccaggctgggccaggccattggtgacgagggagggccagcaggagctggcacggggcccaaaaggacttcatcggagacatcggggtccaggaaagcaggtgctgcaggtggatggtgaggggcgggcctggcctgggtggacagtgagggacgggcctggatggggtggactgtgcgggttggggctggtcggggtggactgtatgggttgggcctggctgggatggacagtgaggat

SEQ ID NO: 42501 - DNA, 601 bp, Human
caccgtgacttgtacaaacttaacatgagatgcttcatttgctttcaagctccctgttttctgactcaaaacaaattttgcaaaggcacctactggctgttaaaactggaattagtcttactggtcaaagttccttttcctaccttgaagtggactcattttggcatataaacgtgaataagatgcgtctaaccaggcaagcgagccccccaaacaggagcgccctggctgacgggaaacactggatctggggagaatcgcgcaaacgtcctctcctcctctccaaaatgacggctgagtygaagagtccgcctgtcagaacggcgacccggcacgaggccccaggcccggctggcgagggcaggaagatgtggatggcacccgccagatccagattccgggaggggtccaggggaaacagggaacccctgggtgtcagtaacgacccttccaggctgggccaggccattggtgacgagggagggccagcaggagctggcacggggcccaaaaggacttcatcggagacatcggggtccaggaaagcaggtgctgcaggtggatggtgaggggcgggcctggcctgggtggacagtgaggg

SEQ ID NO: 42502 - DNA, 601 bp, Human
agaggcgaggtgggggcttctctgctcacctcccgcctggctgttcctatcaccgtgacttgtacaaacttaacatgagatgcttcatttgctttcaagctccctgttttctgactcaaaacaaattttgcaaaggcacctactggctgttaaaactggaattagtcttactggtcaaagttccttttcctaccttgaagtggactcattttggcatataaacgtgaataagatgcgtctaaccaggcaagcgagccccccaaacaggagcgccctggctgacgggaaacactggatctgsggagaatcgcgcaaacgtcctctcctcctctccaaaatgacggctgagtcgaagagtccgcctgtcagaacggcgacccggcacgaggccccaggcccggctggcgagggcaggaagatgtggatggcacccgccagatccagattccgggaggggtccaggggaaacagggaacccctgggtgtcagtaacgacccttccaggctgggccaggccattggtgacgagggagggccagcaggagctggcacggggcccaaaaggacttcatcggagacatcggggtccaggaaagcaggt

SEQ ID NO: 42503 - DNA, 601 bp, Human
cagaccaagaccaaagttctcggggatgatcctcccccagcagaggcgaggtgggggcttctctgctcacctcccgcctggctgttcctatcaccgtgacttgtacaaacttaacatgagatgcttcatttgctttcaagctccctgttttctgactcaaaacaaattttgcaaaggcacctactggctgttaaaactggaattagtcttactggtcaaagttccttttcctaccttgaagtggactcattttggcatataaacgtgaataagatgcgtctaaccaggcaagcgagccccycaaacaggagcgccctggctgacgggaaacactggatctggggagaatcgcgcaaacgtcctctcctcctctccaaaatgacggctgagtcgaagagtccgcctgtcagaacggcgacccggcacgaggccccaggcccggctggcgagggcaggaagatgtggatggcacccgccagatccagattccgggaggggtccaggggaaacagggaacccctgggtgtcagtaacgacccttccaggctgggccaggccattggtgacgagggagggccagcaggagctggcacggggccca

SEQ ID NO: 42504 - DNA, 601 bp, Human
cctcctgctgggtacttggtgggccactctctcccatcgtggcaccgtcctcctcagagttcgtcactcttgtccactcccaaaccacaagaaaggcccacacaacgctcaccccacgcgacccatggtcttcctcatgctctaagaaaaacgccgggtggccccccaaaacctgcctccgccccggctcctcacctccaaggccagtcccggcaatatgcttccatgcccgaggaggaattctagaaccaagcacttgggttctgaatatctgagtgcagagcagtttgagagaccgaaygcctgcccaccatgagaactggtccctttccggcagcatcagccctactttctccaagccacaccctccggcctgcccgaaggctccatctcagccatctctgacaagacccccaggagagggcgaaggtcccttccttgcaggaaaagacctcagtgatgtctgttgatacggttttcagatatagaaagcatctctctgggaggctgtgcgccccgaaggtgcccttgcagaccaagaccaaagttctcggggatgatcctcccccagcagaggcgaggtgggggcttctctgctcac

SEQ ID NO: 42505 - DNA, 601 bp, Human
ggactcatcccgggtgcatcttctctcccacctgccccaccttctgaaaccagccctcctcccatgagcgtcttcctggcgccccagcctggactctctctcctcctgctgggtacttggtgggccactctctcccatcgtggcaccgtcctcctcagagttcgtcactcttgtccactcccaaaccacaagaaaggcccacacaacgctcaccccacgcgacccatggtcttcctcatgctctaagaaaaacgccgggtggccccccaaaacctgcctccgccccggctcctcacctccraggccagtcccggcaatatgcttccatgcccgaggaggaattctagaaccaagcacttgggttctgaatatctgagtgcagagcagtttgagagaccgaacgcctgcccaccatgagaactggtccctttccggcagcatcagccctactttctccaagccacaccctccggcctgcccgaaggctccatctcagccatctctgacaagacccccaggagagggcgaaggtcccttccttgcaggaaaagacctcagtgatgtctgttgatacggttttcagatatagaaagcatctctc

SEQ ID NO: 42506 - DNA, 601 bp, Human
gcacatgcagcccaggcctggggtgctcatagggtgtttaattagggaaatgtaggtgtgaacaggccatccacacgcaatgggagttttctccctcgagaatgttaaaatctacttggacaaatggtgtgactgtgcattatttggacgattttatcatttcccgcttgcctgtcacccacgagagtcctgcccagactctcccacgaccttgcctgcagctgcgcttcctatggcgatgctcgtccaagtgtcttcaggcaaacaaccaggactcatcccgggtgcatcttctctcccrcctgccccaccttctgaaaccagccctcctcccatgagcgtcttcctggcgccccagcctggactctctctcctcctgctgggtacttggtgggccactctctcccatcgtggcaccgtcctcctcagagttcgtcactcttgtccactcccaaaccacaagaaaggcccacacaacgctcaccccacgcgacccatggtcttcctcatgctctaagaaaaacgccgggtggccccccaaaacctgcctccgccccggctcctcacctccaaggccagtcccggcaatatgcttccatgc

SEQ ID NO: 42507 - DNA, 601 bp, Human
gtggggcagctcagcagtcttttctgacttagggcccagaagacatggccagcgtctcacccaggcctcacggttacttcctgaggacctgtagtaaaaacgcacgataaagccctttcagatctactcttgctaacatcttagttgtcaaatttatgacacgtcatgtttcgtacattgtgtaggaaactcaatcccttttgtgtttactgacaaagtcaggcatgcccattatctaggacaaagagctgcactgtcacacatcacagccactctggcctttatggcctttcacagtgasacatccactccctgattacatgcgctggcaggaacccgacatcctttgtccagtgatctgctttataaagcaggtttgaaatccagaacacccctggcagacctgagtacgttatgactgtcctccctgctccccaagagtcactggggcctgtttcaggggaacctcagtcccactggtgggaaaatcaccttcagaaggtgtgggaggagtgccaagcacctcagtgccttgggtcattaatcatttgtgaattgatcttaaaccttctccaactccccacgtctgctcttgagctgc

SEQ ID NO: 42508 - DNA, 601 bp, Human
gggttttgaaatgaaaacacagcatatcaaatgtgtgggatgcagccaatcaataatctccaggttcctacaaggaagggttccttttatttctctccaggaaccatttctgccacctccctctggtgggtgggctgctgcccaagaaggaagtggcaatgcaggaaggctggctgggacccctgggggccaggggtgccagcaactcccacaggatacgtttcatttgccaaccctgaggaacactgggtgtaggagccagcactgcacacggcattcatggcacatggaggaagcaccrttagtggggcagctcagcagtcttttctgacttagggcccagaagacatggccagcgtctcacccaggcctcacggttacttcctgaggacctgtagtaaaaacgcacgataaagccctttcagatctactcttgctaacatcttagttgtcaaatttatgacacgtcatgtttcgtacattgtgtaggaaactcaatcccttttgtgtttactgacaaagtcaggcatgcccattatctaggacaaagagctgcactgtcacacatcacagccactctggcctttatggcctttcacag

SEQ ID NO: 42509 - DNA, 601 bp, Human
ataaacaagtctcaatatattttaaaatattaaagatgtataagcatatcatcttgccaaaacagaattaaattagaaatcaataacaaaaatacctagcaaacttccaaatatttcaaattaaacaacaaacttctaaaaatgccctgttagtcaaatagaaatcaaaagaaagattagggaatactttgaactgaatgaaatgaaaacacagcatatcaaactttgtgggatgcagctaatgcagtccatttgaggcaaattaatagctttaatttataactttataatttatattagkcagtgtcgataagtatttatggaagtggggaaactgtaaactggtcacagttatgtggtcctgtgttggggttttgaaatgaaaacacagcatatcaaatgtgtgggatgcagccaatcaataatctccaggttcctacaaggaagggttccttttatttctctccaggaaccatttctgccacctccctctggtgggtgggctgctgcccaagaaggaagtggcaatgcaggaaggctggctgggacccctgggggccaggggtgccagcaactcccacaggatacgtttcatttgcca

SEQ ID NO: 42510 - DNA, 601 bp, Human
gatggtgtctacaataaatccattttatatataatgacacatatagtttaaaaataaaaggctggaaaagataataccacacaaacagtaatcatacgaaagttggggtggccatattactatcagacaaagtagacttcagaatgagaaatctaacccagaaggatagttcaaatggtaaagcggtcaattcaaagactaataataataaacatgtatgcacttcatagcagagtttcaaaatatgtgaatgaagcaaatactgatagaagtgaaaagaaatagacaaatctacagttayagttgagatttcagtacccctttctcagtaactgatagagcaagtggacagaaaaccagtaaggatgtagaaaacctgaaaaacacagtgacctaacataacctctctgacatttatgcaactttccaaccaaagacagcagaatacatattctttctaggtgcatgtggaacattcaccagtgtaaaccatctagtaggtcataaacaagtctcaatatattttaaaatattaaagatgtataagcatatcatcttgccaaaacagaattaaattagaaatcaataacaaaaataccta

SEQ ID NO: 42511 - DNA, 601 bp, Human
gtttattagctaatagtgttgataaaatgaaagcctaaaaaattaattcaaaacagggaataaatagaggaaacaagaaacaaagaagagagggggcaaaaaattagcacaatgaaagacttaaagccagccatgctgacaattattgaatggaaactctaattaaaaaacagagattgccatattggataaaaagcacaaccaactcgatggtgtctacaataaatccattttatatataatgacacatatagtttaaaaataaaaggctggaaaagataataccacacaaacagtaatsatacgaaagttggggtggccatattactatcagacaaagtagacttcagaatgagaaatctaacccagaaggatagttcaaatggtaaagcggtcaattcaaagactaataataataaacatgtatgcacttcatagcagagtttcaaaatatgtgaatgaagcaaatactgatagaagtgaaaagaaatagacaaatctacagttatagttgagatttcagtacccctttctcagtaactgatagagcaagtggacagaaaaccagtaaggatgtagaaaacctgaaaaacacagtgac

SEQ ID NO: 42512 - DNA, 601 bp, Human
gaaaaagataaatggataaacaaaacatgatatatccatacaatggaattgaaatattatttggccttaaaaaggaatgaaattctggttctgaaattcttcaataaaccttgaagacatatgctaaggaaaataaggcagtcacaaaaaaataagtgattctactcagaggagggacctagagtagacaaattcacagagacagaaagtagaatggtagctgccaggggctgcagtgagggaggatggggacttagtatttaatggggacaaaatttcagctttggaggaggagaaagtwccaatggatgatggtgatggttgcacaacatgtgattgtacctaatgccactgaactgtgcactgaaaaatggctaaggtggtaaaagcaatgctatgtatagcttaccacaatagccccccaagaaggcaaaatacttttgtgtaaagcccaagctgaatcactgccagcaagtctacgctatgagaaatgttaaaggaaattctttagatggaaggaagatggtcttaaatggaaaccccaatctacatacaggaccggacagcactagagatggtgcctatgcaggtaaatataaaa

SEQ ID NO: 42513 - DNA, 601 bp, Human
tgaaagcaacttcagacgcagcaccttgacacactgggtcgagccccttctcgagattagaaagtcactgtgctttgaggttatttgaaaacccacagacaatttagagaaccggacactcctgagtgctgtcaacctgagaagaggggtccccagagctgaccacagcatgggaaccagccatgccaggagcaggggaaagctgtgcgtctcccagcatgtccatgcttctgagggcagggcaggcgagaccatcaaaggacatccgggaaggggcataagtgcaggcctacgtgcaggygtttcataagccataatagttgggaggaccagaaaagtgttggcccaggatgttcaccaggcgtggaaaagacacagcacctcccaatttctactgggctctttttcctggtgaattcctggccatgattcaattgggtgacagtggagccactggtggtgatccaggcatgctcaggcctcccatgcatcattgtgatgacctcacagcagccctctcaccccgttttaccaagagggagccaaggcagtgaggtggtgaaacaagcttccaaaggataaaattgtgccaaagcacgtt

SEQ ID NO: 42514 - DNA, 601 bp, Human
cacctgctcacagcccctgctgctatgaggattccacaaggaacagattcagtggatgactctgctccagcaggaatcactcgcagttccactgttttttgaaggatccctcagaaagggcagaacagagggtgagggatggagctgaccatcggctgtgctccttgccccaggcacaggtcctgggccccctgtctgtgggaactcattccatcctggtgacactctctgtgggagaacatgcaccaggctacatgcagtcagctgcgtcaccactgcagactgtgacttggggccaagrcaactgtaacagccgtgccgctgccaccgtagagtcaggagctgtgacagacagaagccgcgttatgaaaggagctcccactgcccaggtttgcttctgttgtgggtccactgaggtccccaggagataaaacctgacacccatggtggagcccggccgaatgcagccttggggagctttccaccagctgcaaggcattccagggccatgtcccaggaattcggctcttcaaactccagacaccctggctgttgccaacagggaaggccccacgagccctgaaagcgctggacagtgcct

SEQ ID NO: 42515 - DNA, 601 bp, Human; identical to SEQ ID NO: 20638

SEQ ID NO: 42516 - DNA, 601 bp, Human; identical to SEQ ID NO: 20639

SEQ ID NO: 42517 - DNA, 601 bp, Human; identical to SEQ ID NO: 20640

SEQ ID NO: 42518 - DNA, 601 bp, Human; identical to SEQ ID NO: 20641

SEQ ID NO: 42519 - DNA, 601 bp, Human; identical to SEQ ID NO: 20642

SEQ ID NO: 42520 - DNA, 601 bp, Human; identical to SEQ ID NO: 20643

SEQ ID NO: 42521 - DNA, 601 bp, Human; identical to SEQ ID NO: 20644

SEQ ID NO: 42522 - DNA, 601 bp, Human; identical to SEQ ID NO: 20645

SEQ ID NO: 42523 - DNA, 601 bp, Human; identical to SEQ ID NO: 20646

SEQ ID NO: 42524 - DNA, 601 bp, Human; identical to SEQ ID NO: 20647

SEQ ID NO: 42525 - DNA, 601 bp, Human; identical to SEQ ID NO: 20648

SEQ ID NO: 42526 - DNA, 601 bp, Human
tttctatgggttttcatcagagtcagcaatacataatccagataaattctacttcatatgaagaaacttaagagatggaaatatgaaagatgccctgaaatatcaaaaaaggaaactctaccagctcactgaaaaaaggaaaaatgaaccttattgaggaggaaaaatacttctaattatttatttggtcaaaaagtagtaaccagctccataaagccacaatatgtgctcagttatattgagcaaactctgcagaccaatgttctaagttaatttttatgtcaaaatacttcacttgaaycacagagccctggctattcaggtaaagagaagaaagagacagctagaaaggagcgtcttttccaggagtcaaatcaaatcaatcaattaattgaccttctttgacccaaactgaggtatcagtattaccaggaaatctgcaggtaaaaccatacatcagaatgccttaggaataatcaggtccaaagcctagggtatctcttgctaacacaagggaaatgaaaattgtgtggccatatccgaatggtgatttaggttcgtttgcattcactgtgtatatgaatcctctccccctgctgca

SEQ ID NO: 42527 - DNA, 601 bp, Human
tcagtctcctgagtagctgggaatataggcatacaccaccacacctagccattttttttttctatagagatgggatctcactatgttgcttaggctggtcttaagctcctggtctcaagtgatcctcccacctcggcctcccaaactgtcgggattacaggcatgagccaccatgcccagccacatatatcatttttaaaataaaaataattttattaatatgtatcaataataaattttaaaaatcagccaggtgtggtggcatacgcctgtggtcccatctactcaggaagccgaggtrggaggatcacttgagtcagggaggttgaggctacagtgagccatgatagtgccattacactccagtctgggcaacagagtgagaacccgtcacacacacaaaaagacttattatatcaggaagcttcagtgttattaatttatttatatcaaaataaattcattaagttaaaaatattaggccaggtgcagtggctcacatgtgtaatctttatactttgggagactgagacaggaggattgtttgagcccagaagttcaaagccagcctgggcaacatggcaagatctacatctctaca

SEQ ID NO: 42528 - DNA, 601 bp, Human
ttttttaaatatttgttttaaaagttgagaaaaacacaaataatccaaattattacagtaatacaagacagtgaaggaataacttaatttgaaatatttttaaacattcaactaatgtttttggctttaacttttaaaatgtatttatttgttctaagaattattgttttattcaagcatatatgatccacgtgatatctagttgctttcttctcatcgatcaattctcaaagtaaaatttctaataagcttcagacttcttgttatcgaagaagacaaggttatcccctaccaccagggrtggataaaaacataaaaataaagagaaaaaaaaaaagacgacaaggcaaattataagctaggcgtgaagatagagacaatccttgaaaaaatatctactgatgcattattaagatcacttattgacattaacatctactttaatatttacattgaaaactctgccagatatagtgttaaaaacatgtctaacatgctagtttggccataacttcttaccccaaagagctcagctttaaaaaaggaagaataaagtcaatttcctcactgttttcttcttttaccataggatctagaagga

SEQ ID NO: 42529 - DNA, 601 bp, Human
acatagttacatgataaaagactgaagcaggataaaatttagctataaaaaaatgctgaattttgccttcccagtgtagttaattaatttaatttaattttttatctttttttttttgagaaaggggcttgctgtgtcatccaggctggagcgcagtggtgtgaacccagctccctgcagcctcaaacgccctggcaaaggtgatcctcctgcctcagcctcccgagtagctgggacttcaggagtgtaacaccacacccagctgattgggttttttgtgtgtgcatttgttgtagagacrgggttttgccatgttgcccaggctagtctccaactcctgggctcaagtgatccatctgcctcggccccacaaagtgctgggattatagacacaagccaccatgctcagactagttaataaattttaaaagactaaaatcttagaaattgtcccctacttgagagaaagtatactgattaatgtcgaatctgacttcaagcttttttttttttttttttttgagacggagtcttgctctgtcacccaggctggagtgcagtggcatgatctcggctcactgcaacctctgcctcccaagtt

SEQ ID NO: 42530 - DNA, 601 bp, Human
acaagtaaccatttttatattaatatatacttattggccacccttccttcttttgtgaaatgcctattcatttattttgcccattcaaaatttggaaagctcattatgttggtactgttttgtaagggctctctataaaatatattttatttcttttacttttttaataatttgaactttgactttgttttattaatttattaacaaattttaattcaaaataagtgaatattaattccatatctggcaacaggtggactagatgtctggcgaataacacctaatataaaacacctgtcayggtgattgaaaaaaatcaacagctatctcattaaatgcatggcaagtaaaatatatcttctggggccaaaaatagaccagaattatctgctacttgaatgtttggcaaaactctcctagaaaactgagtctgatgtttgatttgtgtaaagacttctttaacttttctaactcaatttttactaagttataggactactcagattttgtttcttttttgctcaattttggtcaattttgtttttgtctatgtcacctaagttttcaaatgtattggcatgaatattttcataatattccc

SEQ ID NO: 42531 - DNA, 601 bp, Human
catgccaccacacctggctaatttttgtatttttagtagagatggggtttccccgtgttggttaggcttgcctcgaactcctgacctcaggtgatccacctgccttggcctcccaaagagctgggattacaggcatgagccacagcacccagcccaaagttactaaaattaaatgagtccattatgaataattcaaatataatcaaatgaactggttaatgaaaactcaattttgacttctgtacttctgacattttggggttttttaatgcatagctacgacacatattttttgaattascttttaaatattcaaaatatttttattttaaacacgaactttaaaggtttaagtgtaatactatgtcacttgtaatagtagctgtacttccaaaacagaatctgttacttacagctcagcaaaattcttccagtcatcttcactaatggatggtcttgtgtgaccaagtgcagtcattaaatgtgactgactaatagccagtctggttttgattggtcctggttggttcatggattcgtcctccttaagtaaaaaaagaaattgacgaagagttaaattaaggatgtaaaaaaaaatgtg

SEQ ID NO: 42532 - DNA, 601 bp, Human
gtactgcaaaattagataacaaaaggtagcagcttctaaagaccaggaataaacatctcttaaattgaatcacactgaatcattgacctagaatggttcccagtccatgggtctcagatgcataggtggccataaactcaattgcaaggatcctttaaatccaatgtataacaaatgtggtccacaaatgaataaatctgaatgtatttaaatgttcttgaggtcaataaaatattaatataaattattttgaaggcaaaacaggtatttttataacaaaattttataaactatacattasaatcactttcaacttttaattttccttcttatttcttcgaagttactaaattttttttttttttttttgagacacagtctcgctctgtggcccaggctggatggagtgcagtggtgcaatctcggctcactgcaacctccacctcctgggttcaagcaattctcctgtctcagcctcccaagtagctgggactacaggcgcatgccaccacacctggctaatttttgtatttttagtagagatggggtttccccgtgttggttaggcttgcctcgaactcctgacctcaggtgatccacc

SEQ ID NO: 42533 - DNA, 601 bp, Human
gttactttctgtccaggtcgaaacattgttccactttgattttttctcctctttggattttgaaagctttcatatctgaaaaaagaaagagataatttaatatgtataaatactaccattacaaaacaaaagataatggattgttggcaaacacaattatattttaagaaatgaacgggaaataacaaactagaaaaaaaaattccagtcacagaaattaaaaagaattcttacaaataaagttgcactccaatagaaaacggagcaaaggggatgaagagacaagttagaaaagataaaatacaaatgacaatgaataatatgaaaaattataacttctacactttaatcaaagaaatgtaaattattgatatcatttttctaaaatcaaaagggccaagtttagaaaaatactgcaacacacaatgttagtgatggtgcagtatatctggcaggcaatttggcaatacatttcaaaagccttaaaaaatgtgagctccctgttatacaattccacctctatcctagtgaaacaattagatatgtgcatatattcagctgcaagaatgttcattaccacattgcctgggagcaatttaaa

SEQ ID NO: 42534 - DNA, 601 bp, Human
caggtaggtgccatcatcaccttaacacgtaaaaataattttagaaaacaatgcctttgtcttcagttcataagaatatcctcctgaaattcacagtacagaatccaagtcatgggtcagttagaaacgtctagaaacacatcaatctcaggaggataaatcaagagaataggatggatcagacaaaatctacaagcacaatggcagaaagtgtgcctctggtataagaatggcgtaagctttgtaaacaatagtgttatacaggggtgcctctgtagtacctctacgtttggaaggacaytattcattcatatacatgataagcacccttaactggatactccataggtaacagacaaaataaaacaagaacttccgtcttaaaattgtagtggtggaattcatccttcgggatgtattaggtgattcccctaggacgacagctgagttacagggggctaaatataccctccccttttccctccaatatcacaaagagccccaaaaacggattttgttgtttttaacaaataaaatacacatgaaaaaaagtcatctataggtttttatatataatctcatcttctaaaacactcattct

SEQ ID NO: 42535 - DNA, 601 bp, Human
ttctaggattggattggtaccaccgagtcagtcacattcatacagctctccttgaaatcagttccatcactttgagtcagtcaatacttgagtagtaatgtctgtgaaacagacttcttcccttcacaaaactttagctgagaaccaagtggcatcagttctcatctaatcagctagaagttaaatagccactgattaagtttcatgggcttaaaataatttgtaagaattagcagaatgttaccactcttcttttgagtcttaatatgtaaaaaaaaaaaaaaaaaaaaaaaaaaagtcmtttcaaagaagctatgttctcccaggtcaagggaacttacataatttgaatgtatttcattcatgatcagcactgggagtcccttctagccccaatctccaaacctgtctcttggtttctcaaggttcaacaagaaaatatcccattttaacccaagattatttaataactttttaaagtgattctacatggttgaaatgtatactatatcagctaaaactcccaacttgaaacgactcagacagtctcttgggttcttctaaaaagttttaaaatgtactggtctgagtaaactaaact

SEQ ID NO: 42536 - DNA, 601 bp, Human
actcaaaaaaacaaaacaaaacaaaacaaaacacttaaaaggtacctaacttcagagacatcacttaatatgtgtcctaattttacaaatgaagacattgaagcttagaggtaggaagcataatggggttaagacacatagtcatgtggcagaactggaatgtgaacccacatttgacctcctctcttaggtaatcaataatatccaataatcaataagtaatagtgtttgttatttctgaggcccatgtgtagcttcagacttttaatttaaattttctcattcaattttttttttttttgagacagggtcttgctctgtctcccaggttggggtcaagtggtgtgatcatggctcactgcagcctcaaactcctaggctcaagccttgatcttcccacctcagcctccagagtagccgggaccagaggtgagtgccactatacctggctaaattttaggaaatattttttgtagaaatgaggtctcactacgttgcccaggctggtctcaaattcctggcctcaagcaatcctcccacctcagcctcccaaggtgctgggattacacacatgagccactgtgcctggcccacactcaaa

SEQ ID NO: 42537 - DNA, 601 bp, Human
ggtatggggtttctttgagggagaatgaaaaggttctaaaatcagactgtttaacaatggttgcacaaccctgtaaatatagtaaaaacactgaatcaagcgctttaaatgggtgaattgctttgcatgtcaagtatgtctcaatagagctgtttaaaaaaatcaaggcaagagtcagtttcaagaagaaagaagtggtcaatggtgtatataagataaagaagtgtgttctgctctttaaaatccttctattgtcttttatccactggacaaagtagcagaagaaatagctaacacttaytgagtgcttactgtgtgtcagacacaatgctaataattttgttttatgtatttaaatctctttaccctataatacaggtaccatcatctctttcacagatgagaagaattaaggtatagaagtttagtaaattgcccagcatcctaaagactgtaaatgagagagccaggatttgtactcagaaaaccaagcaagagaaccctcactcttaaacactgcataccccatcccatggcttattaggtcactcgtgatcttgccccactcgccactccatcctcatcttttattggatcctaa

SEQ ID NO: 42538 - DNA, 601 bp, Human
ggatgcagaagagggccagaacaagggacagtgggcaagagattccggaagacattatttccacacctgggcccagtgtgtttgatctacccctggatttattaattatgtgagtcactaaagtcagtgttttgcttatccagcttgagttgggtttttattacttgcaacaaaaaattgtcctaagacatctataaatattttgaaatgattaaatgacttaaaaatgtcaatatctggcctcaaatacgtcttacagagtagacacaatgagtgaagctcaagcacaaaagaagtagcmgtgtcctcaaagtgactgtcccagttctctgacttggctgggaatctattcaccttaaatggctcctccattcgcatgtccactgggcaaaagtagccgacagcagagaaccagatcaatccatccttcccaaggagccaggcagcttcctctcagaccctacttgaggttcctgatctgaccatagagacactggatggaggaaagcacagaaggaagaagacagatggacaagtttatcacaaacaggaatgtaaaacatagagtagaaaagaactcaatggtaagaggaagcaagga

SEQ ID NO: 42539 - DNA, 601 bp, Human
tattattaacttcattcaggaaatggagcatattagagacttctcagacattcacaaagggcatcaagggacatcagagtcctaagggtgcctgtaggatactctcttttttggctccagtgctggctagccatccacatcctacagacctagtactccatggaagacatctggggaaatattgctcttcccaaaactatgaaattttgtctgacttaaattatgtctgattaatggttagtaaacattgtactaaaaattaacagttatattagtcacaatgggtaggaaatgcattttsaatcaatggttgtaaacattaatcttagaaatgctagactataatatttatgatgcttttttttgtctacaatgactccctctggaattgccccaaatcaaataatagtcactttggtgggcaataaagagaaaacagaaactttatttttattcttatttttcttttaagatggagtctcactctgttgtccaggctggagtgcagtggtgcaatcttggctcactgcaacctcctgggttcaagtgattctcctgcctcagcctcccgagtagctgggactacaggcatgcaccatca

SEQ ID NO: 42540 - DNA, 601 bp, Human
gccagatccaagcttctttttaattatgggcagtttggggtgaattatacaactccattaaaattaaccagaatccattgaaaattttttcctcacatttatctacttctaaacattctggtttttaagttttaatatccattcctaaacttaatattttcccctaatgttacttattctggaaaattattccaataaagtaaaaactcttaacagatttattaaagatagtaccataaatcatattaagtctcacactctaaaaatatgattgctatcatgcatggatttaatatgtggraaatttatcaaaacagttcttttgccttgataattcaagataactacaactattcacaggcttttttaagccagcttattgctattaaatccacatacttggacaacttcactcttttcttcctattgaaaaagaaaatggagttccacaatccccaactttctttatatctgttgcttgtatttttgtaataaaataaaagagcagtgaaccaaaaatggcatgtccctaaagtcaaatacaaacacagagctgtttcatactatgaccatttcagttgtgtttctgaaacattacttt

SEQ ID NO: 42541 - DNA, 601 bp, Human
aagtcattttaaaaataattttgaaaatacttacatctaaagaaagcttgacaatgtgtcttatttactttgtacctatgtgtataaatcattgtgtaagacactgtcaggacatgaggatgactgaatacatgagatatgtacattaaaaaatcccaattaaaggcagaaaacaagataaagaggtagagatatgcagaacaagtgttataaggcatgtgagattacatctagctataagagttgatcaaatggcttttgagacggcacttgaaaaatttaggtagatagcctggtgagmaggagcaaaagaaatggcatgagaaggaaggccaccaaggtggaaaatcacagatcataccaagagaatgatgagcagtccaatttgcctagaaaactgtataagaaaaaggactatgccctgctctgcatgctgaacacagggtttctgacaaactcataaaggagagaactaaagcttcaggggtggaatagaatgccagaggaaagaggggtgcacagacagaagatggccaagaacaggtaactatcaggcatacctacatttggagggccttaatgtccttgaaactgctcagga

SEQ ID NO: 42542 - DNA, 601 bp, Human
aaagtcattttaaaaataattttgaaaatacttacatctaaagaaagcttgacaatgtgtcttatttactttgtacctatgtgtataaatcattgtgtaagacactgtcaggacatgaggatgactgaatacatgagatatgtacattaaaaaatcccaattaaaggcagaaaacaagataaagaggtagagatatgcagaacaagtgttataaggcatgtgagattacatctagctataagagttgatcaaatggcttttgagacggcacttgaaaaatttaggtagatagcctggtgakaaggagcaaaagaaatggcatgagaaggaaggccaccaaggtggaaaatcacagatcataccaagagaatgatgagcagtccaatttgcctagaaaactgtataagaaaaaggactatgccctgctctgcatgctgaacacagggtttctgacaaactcataaaggagagaactaaagcttcaggggtggaatagaatgccagaggaaagaggggtgcacagacagaagatggccaagaacaggtaactatcaggcatacctacatttggagggccttaatgtccttgaaactgctcagg

SEQ ID NO: 42543 - DNA, 601 bp, Human
gaaagtcattttaaaaataattttgaaaatacttacatctaaagaaagcttgacaatgtgtcttatttactttgtacctatgtgtataaatcattgtgtaagacactgtcaggacatgaggatgactgaatacatgagatatgtacattaaaaaatcccaattaaaggcagaaaacaagataaagaggtagagatatgcagaacaagtgttataaggcatgtgagattacatctagctataagagttgatcaaatggcttttgagacggcacttgaaaaatttaggtagatagcctggtgmgaaggagcaaaagaaatggcatgagaaggaaggccaccaaggtggaaaatcacagatcataccaagagaatgatgagcagtccaatttgcctagaaaactgtataagaaaaaggactatgccctgctctgcatgctgaacacagggtttctgacaaactcataaaggagagaactaaagcttcaggggtggaatagaatgccagaggaaagaggggtgcacagacagaagatggccaagaacaggtaactatcaggcatacctacatttggagggccttaatgtccttgaaactgctcag

SEQ ID NO: 42544 - DNA, 601 bp, Human
ttgaaagtcattttaaaaataattttgaaaatacttacatctaaagaaagcttgacaatgtgtcttatttactttgtacctatgtgtataaatcattgtgtaagacactgtcaggacatgaggatgactgaatacatgagatatgtacattaaaaaatcccaattaaaggcagaaaacaagataaagaggtagagatatgcagaacaagtgttataaggcatgtgagattacatctagctataagagttgatcaaatggcttttgagacggcacttgaaaaatttaggtagatagcctggkgagaaggagcaaaagaaatggcatgagaaggaaggccaccaaggtggaaaatcacagatcataccaagagaatgatgagcagtccaatttgcctagaaaactgtataagaaaaaggactatgccctgctctgcatgctgaacacagggtttctgacaaactcataaaggagagaactaaagcttcaggggtggaatagaatgccagaggaaagaggggtgcacagacagaagatggccaagaacaggtaactatcaggcatacctacatttggagggccttaatgtccttgaaactgctc

SEQ ID NO: 42545 - DNA, 601 bp, Human
ggtttaaaaattctatgcatgggtatctctttcactctttcttgcacatacaagtgcacatacaaacacacacacaaaagaacctcatgttcaagcccattaattgcccacaacgttttgcaaggttggagaatctgccccaaccttggcaaagtccactttctccctttaatataataagggatcaaactcagctggcggtcacttaaaaaggtggctctgttatagattaggccctgctgatttaggcacagatgagtgaatagaggcatgtaaaattgtaaaaaaaaaaagaaaaaaagacccagcaaaaaactcacctaactatgatcttgtgtacaactcaaaagtcaagtttaaggagaaaagggggaaaggtgtaatgggaaaattacattggtaagatttttacaacaaatttgggaagccctaaggccatttcaaaaaggcacaacaaacaggctcctcaattttgtggctgggcatggcatgtagtgaaattttgctgctctgaagtagtggagaagctcataaaaacaagaatctatttaattcactttttcttctattcaaagttttaaccagttgatgtgaatcggct

SEQ ID NO: 42546 - DNA, 601 bp, Human
gctgcccggtttaaaaattctatgcatgggtatctctttcactctttcttgcacatacaagtgcacatacaaacacacacacaaaagaacctcatgttcaagcccattaattgcccacaacgttttgcaaggttggagaatctgccccaaccttggcaaagtccactttctccctttaatataataagggatcaaactcagctggcggtcacttaaaaaggtggctctgttatagattaggccctgctgatttaggcacagatgagtgaatagaggcatgtaaaattgtaaaaaaaaaaaraaaaaaagacccagcaaaaaactcacctaactatgatcttgtgtacaactcaaaagtcaagtttaaggagaaaagggggaaaggtgtaatgggaaaattacattggtaagatttttacaacaaatttgggaagccctaaggccatttcaaaaaggcacaacaaacaggctcctcaattttgtggctgggcatggcatgtagtgaaattttgctgctctgaagtagtggagaagctcataaaaacaagaatctatttaattcactttttcttctattcaaagttttaaccagttgatgtga

SEQ ID NO: 42547 - DNA, 601 bp, Human
ttgctgcaggactccaatctccaaagtgcattagatataaaaagtattcctcttccaaagcctcctaaggtataagttggggtgcggataccattcaggcaaaagggaaccacatgagatttatctccaaggagtcttttccaacagtcagcttccaggaaggtctgggagccaacagggtatctcttgcctctagctaactaccacagagctgcccggtttaaaaattctatgcatgggtatctctttcactctttcttgcacatacaagtgcacatacaaacacacacacaaaagaacytcatgttcaagcccattaattgcccacaacgttttgcaaggttggagaatctgccccaaccttggcaaagtccactttctccctttaatataataagggatcaaactcagctggcggtcacttaaaaaggtggctctgttatagattaggccctgctgatttaggcacagatgagtgaatagaggcatgtaaaattgtaaaaaaaaaaagaaaaaaagacccagcaaaaaactcacctaactatgatcttgtgtacaactcaaaagtcaagtttaaggagaaaagggggaaaggtgtaat

SEQ ID NO: 42548 - DNA, 601 bp, Human
gagtgcagtggtgccatcatatcatagctcactgcaacctctaattcctaggttcaaacaatactcctgagtagctgggactacaggtgtgtgttaccatgcctggctactttttaaactttttgtagagacagggtcttgctatgttgcccaggctggtcttgaattcctggcctcgagccatgaatccttccgccttggcctcccaaagtgctgcaattacaggtgtgagccactgcacctggcctgggccttattttctcattacaagaaagtatgattatttccaaaagacactaaraacacccaagtcatatcataagtcacagaatgacaactttaaatagacaattctggatatagggatatatcttgtgatatattcacatcctcaaagttttagcaccaaaaatgtataatcctcagtttatttaaaaattaaaaacaggacatatccaacttgtaggcaaagataatctatttttctccttatactctgtaaacctcagtcttttcaaatttgttattcaagttttcacagaactctctccatagtggtttgtctgtttcctatgaagtgtgttagaggaggccacagact

SEQ ID NO: 42549 - DNA, 601 bp, Human
cagtataagtagttttacataatatacataaacctgtaaagtcttttaaaatgcatcttaatctagtaaatcatattttaaatgcataggcagcttttgaaaaactttgccaaagcccatatgcaaattacttgattttacatatttgatttttaaaacatttatgcagttttattaaagctatattggttttttgaacccaagatttggtttctattacaactccattaaaaatgttccctgacttaaattaatattgataaattagtcatttaacattaaaagtggttatgattagaaygagtatcactgattaagcttccatttactctgttgctctgtactgaaagctgaagaaatataactttaaataccaagtcaatttgttttaagtcctcaaaatttaaaaaaagtaaaaaaaaaaaaaaaaaaaaagaactagtatcactgagatcttgtgcactcttgacaatatccaaccagctgactagtcatgcatttgtgtaaaatgcagtaactttggttttccagaatatcttctaaatataaacacaagattttagcaatgaaagtgactaacaaaataagtttaattcttggt

SEQ ID NO: 42550 - DNA, 601 bp, Human
aagaagtcgttatagaaataaagatagaacaataaatacaaagaaaagataaagacaagattttatttcaacttgtgtaaaattgctgaggtcactcttgaaagcttttcttactttaaatggactattcaatcttgtcaaaatcttaaatattgtgctacatttttaacatctacttgccaataaaaggcatgacagtggacagtttgggtataagaacatgtgagtttctctcttctttagacattaatcctatgtatgtatgtatgtatgtatgtatgtatgtatgtatgtatgtatgtatttatttgagatggagtctcactctgttgcccaggctggagtgatcttggctcactgcaacctccgcctcctgggttcaagcgattctcctgccccagcctgtagctgggactacaggaatgcgccaccacacctggctaatttttgtattttttcagtagagacggggtttcaccatattggccaggctgctctcgaactcctgacctcatgatctgcctgcttcagcctcccaaagtgctaggattacaggtgtgagccactgcgcccggttgacattaacactttacaattcaca

SEQ ID NO: 42551 - DNA, 601 bp, Human
caagaagtcgttatagaaataaagatagaacaataaatacaaagaaaagataaagacaagattttatttcaacttgtgtaaaattgctgaggtcactcttgaaagcttttcttactttaaatggactattcaatcttgtcaaaatcttaaatattgtgctacatttttaacatctacttgccaataaaaggcatgacagtggacagtttgggtataagaacatgtgagtttctctcttctttagacattaatcctatgtatgtatgtatgtatgtatgtatgtatgtatgtatgtatgtagttatttatttgagatggagtctcactctgttgcccaggctggagtgatcttggctcactgcaacctccgcctcctgggttcaagcgattctcctgccccagcctgtagctgggactacaggaatgcgccaccacacctggctaatttttgtattttttcagtagagacggggtttcaccatattggccaggctgctctcgaactcctgacctcatgatctgcctgcttcagcctcccaaagtgctaggattacaggtgtgagccactgcgcccggttgacattaacactttacaattcac

SEQ ID NO: 42552 - DNA, 601 bp, Human
cccaaagtggtggaattacatgcgttaaccaccacactggtggaatgttcaaattttaaaataattttagcaatgaacaaagaatgcagacaaaaaaactgaagaaggaaccgtgacactttgggaggctgaggcgggcagatcacgaggtcaggagatcgagaccatcttggctaacacggtgaacccttgtctctactaaaaatacaaaaaattagcctcctactcaggaggctgaggcaggagaatgctgtgaacccgggaggcagagcttgcagtgagccgagagagcgccactgcagtctggtctgggtgaaagagcaagactccgtcccaaaaaaaaaaaaagaaccatgagagtttaagggagcggggactcgcatatacaaatgctacaaagggaatgtggaagaacctgcaaaaaatgccactggatttggtgaactctatcttataaatggggctatttctctctaaaaaattgtctactaagaccaaatttctaaaaacaaaattactgagtaaatgcatgtgaattaaaaataaagcaattgatgaatatcttatttttctaaaatattatgggactaacaatacttga

SEQ ID NO: 42553 - DNA, 601 bp, Human
ttttcccaatattcggttatcggaaccaagatgataccatcaagcaacagcaccaattgcagaattacctatctccagacttcttatatcagatttaaacgttattattattcaagacactttgattggatattttgtacttgtaactaaatatatgatgctataaatgggtccagaaaaaaatctgaagattctagctttggtgattaccagtaatgaagttaaacaaaggagaccaaagcagaattgcctaggaaaggagaagctgatgagtgatctttttgttatgatctgtttctaytgccatggaacaccagatggagaggtggggaaaagcagagatgagggctgatactcagaggagacccgggcagacggatgacttggacacctctgcacggagatgaaagttacagccatggacctgagtcagacacagaaagggctgaagtcagaacatgctggatgctttattagaggacaggaagagcagaaagcgccagcaaaggcaatggccagaggcactcaggagagacaaagcagtgagctctctcacattcagttaaggagtgcaggagtaggagctgaaacccttttggag

SEQ ID NO: 42554 - DNA, 601 bp, Human
aaagagcttttggaaaagattgtcttccctgattaaagagacaataaaaccctttttggcccctgcttcctcacctactgcttagaatactgttgtatgtgatataatgcttttgaagttgtggcagccatcttgaggccctgagggatgacactctcaactaaccaaagaagaaggaatggtattttcccaatattcggttatcggaaccaagatgataccatcaagcaacagcaccaattgcagaattacctatctccagacttcttatatcagatttaaacgttattattattcaagrcactttgattggatattttgtacttgtaactaaatatatgatgctataaatgggtccagaaaaaaatctgaagattctagctttggtgattaccagtaatgaagttaaacaaaggagaccaaagcagaattgcctaggaaaggagaagctgatgagtgatctttttgttatgatctgtttctactgccatggaacaccagatggagaggtggggaaaagcagagatgagggctgatactcagaggagacccgggcagacggatgacttggacacctctgcacggagatgaaagttacagc

SEQ ID NO: 42555 - DNA, 601 bp, Human
gtcagcacagtgctggtggaagtgaattcctggaggccatttctacacgggggtagccaggcataactatgttaaggggtttctcaatctgggcacttttggcatttggagccaggcaattctctactgcagggggctgtcctgtgtattgtaggatgtttaatggtatccctaggcttccatccactggatgtcagtagcaacatccctctcccccatattgtaacaacccaaaatgtctccaggcatcgatgagtgtcccctgggggataaaatcatccctaatcgagacccactgatrtatatgtaaccagtgaaccccatatagagcttataaaacccaaatgaactcaacatccccttagccagatctcaaaaatgcccatggtcactccattgccacctgacacgagaactgtgatgggtgaggtggaaggttaatcagctgcatttaaaatagctcacctccacaattaaaaaaaaaaacaccagatgaccatattgctagagcctctcccataaccttggtatgcgatgggagctgaaagtgaggagctctgaagcttaaaactcattagacacagataaatccacttctgat

SEQ ID NO: 42556 - DNA, 601 bp, Human
atgtacaggctatgtgccatagggcaggacctttgaggaaggcagaggtgggcaatcagtggagaggagtgagagacgtggaaggaaaagcaggataccacgatgtcacagaagtcaaggtggatatttacaagaaataacgaatagagaagcatgcatgtacccgaagatgccaaacaaggtgaggtctttagaatatccactgcggtaacatgatggcagcagaaggctgcctgcacaaaattgaagggttaatgacatccagagtgaagtccttagttacagaagaaaagaggcagaygacagagacaactgaagctgctctctctgcctaccatgcctttcccacttgcctctaactctgcccagaacctctggcccctttaaggcttctttggaaaatagtgggtacagactgtgcttgaaggcatgggggcagcaaagacatgatggaaccaggatccggagaggatcaaagtggatgggatcaagcgcccaggtagtgagattagaagagcactgactccaaggctacagactcagaagtgaagatgagcacagaaaaatatagattaatttgcaagtatatgttgtagagatg

SEQ ID NO: 42557 - DNA, 601 bp, Human
gggatctcaatgaaaaggctgcaatgatccagatgctctgggaggaagatgtataaaaccacagcagtaggagaggaaaggcaggaagaataactttaaacgagtcaaatgaaggagaaagaaagattaactgaatctaggataagtcccaggtttctggcctgggtggccaggtagatggtgaggccatcagcctgaatagggacccagaagggaatgactggaaggcttgctacttaggatgatattcagaaagatatttgggtctggggctcaagggagtggaccgagttggacatasatgagttccctgcctccaggattacctccacagcggaggagactgttgaaggagatagcatgtacaggctatgtgccatagggcaggacctttgaggaaggcagaggtgggcaatcagtggagaggagtgagagacgtggaaggaaaagcaggataccacgatgtcacagaagtcaaggtggatatttacaagaaataacgaatagagaagcatgcatgtacccgaagatgccaaacaaggtgaggtctttagaatatccactgcggtaacatgatggcagcagaaggctgcctgcacaa

SEQ ID NO: 42558 - DNA, 601 bp, Human
gactccgttttctgaagcagcttctatgaactaataacctaacagctctccatgaactttaattattgcaatagaattattaggcaccaccagttacaactgaactcctccacacacagtataaagttaaaactgtacaaatgaagccaaaatatgcacagctaaaaggaatgttacaggggggcctctcttagcgaacaaagcaagctcagtttggctctttttccctcgcgctaccacatccgcacatcgttagctggaaaattcctgatatatgctgtaattttttgtgctttttttycccccagtacacttgaggctttaatgtccagatgccattttcccccttatctgtccctgtttggggttctgccagctatggtcaacaattaatacagccgaagaaaaaatacagtacgctccctggcaactggtacagccttgcaggaaataccaaataaaaacttgattatgtattgtttaaccattttgtttgcctgtaggccaccctgtcgtcggtgtaattcagacgagcatgcttcatctggacggtctgtgcactgcaccattgttcccagagtctgtcacgcacaatcactgg

SEQ ID NO: 42559 - DNA, 601 bp, Human
cttgacatttacagaaatcaaactttaaccaagaggaaaactgaaagaacattaataattactcaatataatttgtgattccataaagcaaaattggaattccagaagagcctgtgaagaacctttaagagttatttagcctgagtggcaaaaggcaaagccacatatcacttatcaatgtagctacaggctagagaacaatcatgtctgcatgtcatgtaacatgggagaggctgttgtctgtctcgtgttcttttcagaatcaagcatcattgttcaaacagaaatgtgtagtgattgygcttcattaggtaagcatccaaatttattacaaaatatgctcagagtggccatttcagaagacatgtctgtctctgaaatagaaaattatatatatataaaaagaccacagcaaaaaggaatgacatgggatataatttttctgttcctacctattgaaatatatctctggttcgtgtctttagaaattaccaaagagaaaaagatgatctcaaatgactgaaattacttatagacagaaggatattaacctcctacgacatattaaaaagtttgggagggagaaatttaagctacacat

SEQ ID NO: 42560 - DNA, 601 bp, Human
tttatgtatttatttatttttgtacatgagtaagttctttagcggtgatttctgattttggtgcacccatcacttgagtagtgtacactgtacccaatgtgtagtcttttatctctcaccctcctcccgccccttccctgaatccccaaagtccactgtatcattcttatgcctttgcatcctcattgcttatgagtgagaacataccatgtttggtttaacgttcctgagttacttcacttagaataatcgtctccaattccatccaggttgctgcaaatgccattattttgctcttttyatggctgagtagtatttcattatatatataatgaaatatatatataccacattttctttatccacttgttgactgatgggcatctgggctggttccatatttttgcaattgtgaactgtgctgctataacatgcatgtgcaagtatttttttcgtacaacttattttcctttgggtagatacccaggaatgggattgctagatccaatgatagatctacttttagttctttaaggaatctccacactgttttctatagtgatgtactagtttacattcccaccaacagtgtaaaagtgtt

SEQ ID NO: 42561 - DNA, 601 bp, Human
gagatctttaaactaaatttgttggaatcacagaagtgatcacagtgatatctaagaaaaacatgtattacatattttaactatcttttagtaactgaaagtacttttttctcatttatgtatttatttatttttgtacatgagtaagttctttagcggtgatttctgattttggtgcacccatcacttgagtagtgtacactgtacccaatgtgtagtcttttatctctcaccctcctcccgccccttccctgaatccccaaagtccactgtatcattcttatgcctttgcatcctcatygcttatgagtgagaacataccatgtttggtttaacgttcctgagttacttcacttagaataatcgtctccaattccatccaggttgctgcaaatgccattattttgctctttttatggctgagtagtatttcattatatatataatgaaatatatatataccacattttctttatccacttgttgactgatgggcatctgggctggttccatatttttgcaattgtgaactgtgctgctataacatgcatgtgcaagtatttttttcgtacaacttattttcctttgggtagatacccag

SEQ ID NO: 42562 - DNA, 601 bp, Human
gctaattttttttgtattttagtagagacggggtttcaccatgttgctcaggctggtctcgaactcctgagctcaggcaatctgcctgcctcagcctcccaaagtgataagattacaggcatgagccactgcgcctccccctttcttctttttttttttttttgagttcttcaactaatcctcacccttggctatgtttgaacaccactagattatgcaagcatatcccatcgctcttgtctccatgcttttgtttatatcattttcctagcctgggcaactcttctttctcctctccacrtatgtaaatttcacctattctacaaggcctagcctagatgccagcaccaccctgttgcagcaccagctgctatctgaaaatcataccttgtaacatagctcataatatggtttgttcctgaggacatggccctgccttaatctatgtttatatctgtaaatgcctatcacagtactgtaaacacaacaataagggcttatacacctatcaaattaatccttttaaggcaatcattcctagaaagataactgggcaaaattcaatgaccagtcatttccaaaagggaaggtattgtttttg

SEQ ID NO: 42563 - DNA, 601 bp, Human
tttctttttgagatggagtcttgctctgttgcccaggctggagtgcagtggcatgatctcagctcactgcaacctccgcctcccgggttcaagcaattctcctgcctcagcctcctgagtagctgggactacaggcgcacgccaccacacccggctaattttttttgtattttagtagagacggggtttcaccatgttgctcaggctggtctcgaactcctgagctcaggcaatctgcctgcctcagcctcccaaagtgataagattacaggcatgagccactgcgcctccccctttcttttttttttttttttttgagttcttcaactaatcctcacccttggctatgtttgaacaccactagattatgcaagcatatcccatcgctcttgtctccatgcttttgtttatatcattttcctagcctgggcaactcttctttctcctctccacatatgtaaatttcacctattctacaaggcctagcctagatgccagcaccaccctgttgcagcaccagctgctatctgaaaatcataccttgtaacatagctcataatatggtttgttcctgaggacatggccctgccttaatctatgt

SEQ ID NO: 42564 - DNA, 601 bp, Human
cctcccatagaacttccatagcctttatatcctagtcacatctatactgcaccactggtttttaaccctgcctgttcatcaaaatccccatggggttttagaaaaacttaggtgtataggtcttatcttgtgccactgaattagactttctgtgggctgaactttttgggttggagttttcctcttttgttccttcctttttttttttctttttgagatggagtcttgctctgttgcccaggctggagtgcagtggcatgatctcagctcactgcaacctccgcctcccgggttcaagcarttctcctgcctcagcctcctgagtagctgggactacaggcgcacgccaccacacccggctaattttttttgtattttagtagagacggggtttcaccatgttgctcaggctggtctcgaactcctgagctcaggcaatctgcctgcctcagcctcccaaagtgataagattacaggcatgagccactgcgcctccccctttcttctttttttttttttttgagttcttcaactaatcctcacccttggctatgtttgaacaccactagattatgcaagcatatcccatcgctcttgtctc

SEQ ID NO: 42565 - DNA, 601 bp, Human
gaatttgcatttccagcaaggtgcctggtgatgctgaggttcctggttcagggaccatactttcaaaatcactaatttagcctgtttggcaaacactgcagctgatttcagtattactttttctccccgctccttgggaaaaaagcaacaccagaatagaacttgcaagcttcctttggactcatacccctgctacttcttagctgcctaatgttagacaaataaatgtaccactccatctcagtttgttcttattggtaggactaagaaaggtagcataaaagaagaggtttgacactayacttggcacatggtatggctgcattaaacatctgtttactctgatctccttgtgatgatctcctatcctatgagccacagatgaatttgctgagtactagcaacagttccaaaaatttgttacatgcacaaaactttgtttggttaaaaccaaccaaacaacaagcaagcaatggctgaccacttcttttccttgtgagctaccatggagctacattttaaagatacaatgggaatatactgtttcctaacttaccttttcccatggaaataaaaatagaaaagaaaaaaaagattagat

SEQ ID NO: 42566 - DNA, 601 bp, Human
tctgtctccacgtatttgcaaaacacttctgtcagtaacatttactcttactctgtagtgactctttgctggaaaatcatgggtcctgaaaatctccaggtcatgccattaggactggggagacaggagtgtaagaggattgcaaagagaagttgggaggctttggcggaactgtgcccccaagaagcagatagctaaaaacactgcaattcccttcttgaggggatagagcacctacagaaaaaggccgggttttagttaccttgaagaagattgtgagtaaaagtttggggaagaaagraacttcttcctatgtgacaaggattccaagagtcagatttgaaaggagtaacagaagtagagagtcagcgaggggaggtattgggggctaagaacagggatgggaacatgggaagaagtaataaaccagcagttgttagtaagagggaagcaatggcttgggaagtaagagggaagaaagaatggtagagtggtatatgatatgtgatagaatggttagaagaagactaagcagataaaatctggtttgtggtaaagatcacagaacaggcagacctaggatatgagaatggaggtgccc

SEQ ID NO: 42567 - DNA, 601 bp, Human
actgactaaagattagactggtaagaactgactttccatccaggacacaattttcctttagagttggccataaaactttcattccagaggtgcccaccctacacctggaggataggagcattcttatctctgaagacccggggacacagaatgcacctgaacaagcaggccttgccaggtttcccccagtttattaccattagatcatacccttggtcttccggccacacttctgcatgactgtccataaaaatgcacagttgtctctgtttctttgggtcttcatttctgaaggctcccrtgtcacataaaacatattaaataaatgtgtatgtttttctcttaaaaaaaaaaagaattggctttcaatgtataaaatagtgactgtctctgtgttttataatcaaaagtgggtggcttctggacctcaagctgaatattttcatctgactcaatggctgaaagatgtgaccaggtagacctgagactttatgaccaggtagacttgaaactactagtttgattattttcctattgtaagcagctgatggaaaagcttctagagttattccaaggagtagacctagaaggcatccaaagt

SEQ ID NO: 42568 - DNA, 601 bp, Human
aaaacagataaagcaattggcttccaaattacttctgaatattgaaatattagcatgtcaaattattacaattaaatggttgggcaacacagtgcaaacacatttggcacgctcttgttgcccaactttcaaagtattggatctcctcccaagttttagactgggaatgtccagcaaactctgtgccagtgataagagaagagctggtagtatccagttcagttcatggtaaaatctaatctccactagaaatctgccatcttgaattgtcccttgcaatgtttcaattagcaagtaagtrcaatccatatgtctgcagctgtctgtcacacctttctttttcctgttataaaagtgcatgtatgtgcatttgcacatacacacacgctcctaagcagccaacaactcttaaacaatcctatctatgagtacattctaatacctgtaaatttaatttggcaagcaaaactggagcaataaatcacaaacccaattctatcatgtatttccagagaaggttaaaggcgaaagaccatgcggaatgctctatatttcctatggttaaagtgggagggagagaaggacaaagggagagagggaa

SEQ ID NO: 42569 - DNA, 601 bp, Human
atgttagagaaatggagctgcagcttctggattaagccaaccctgatgctcacctatctctggaatcaccgtttatgtgagtcaacaagttttttattctttagtggatccagaatgagttttctgtattcacagccctgagcatctcaagtactaatgtctctttttaatgattttcccccaaatattacaggatcttttaatttgtgtactcaagtttttcctcagtttaggaacatgtttctttaattatggcttttattactgcattttaagaccatcaatttcctttctcttttcktatttagagacagggtctcaccgtgttgtccaggctggtttcaaactcctgggcttaagcaatccccctgccttgacctccaaaatgctgggatcacaggtgtaagccactgcacccggcctcaagatcatcaatttcttaggccagatttctattctttatccttcatgtttgtcagtttctcaccattttataaatcttttttccttttttctcagtattttgtgagaacttccaatatcatcctttatgtcaatggttccatttcctacagtattaattctatgttttactgcttcc

SEQ ID NO: 42570 - DNA, 601 bp, Human
ggttttaccatgttggccaggctggtctcgatctcctgacttcaggggatcctcctgccacggcctcccaaagtgttgggattacaggcgtaagccacggtgcgaggctagttctgtttttaaaggactcatgtgattaggttgggccccctcagataatccagaataatctccctatggtaaggttcataaccttaattacatccgcaaaatcccttctgctatgtaatgtaacaaattcatagtgtttagggtgtagatatattaggggaccattctgggtaccacttcaggtgaacayttctgtgccaagatggctaacaggggtgaatgataatgctaaatctgccccaaaacaacaaacaacaacaacaacaaaaccaaaagaagaatttcactgacattaaattctaaattttacccatttccagaagcctttaaggtccaagaaacaggataaagatcagaagtgagttagggactaggagtagaaggtctttgatattataaggagcataatgaattgctctagaccagcatttgtgcaagtggtagctggaagaaaccactgccagaaacagagtgacttcagggggcttaa

SEQ ID NO: 42571 - DNA, 601 bp, Human
atactgactttaagtaaacaaacaagaagctacaaacaatacacccaccctcttttaattacagcactacaacaaggccactttgttaaaatggttcatctctaaaatatttttcttaccaaaaatgatacacagatacatacacactcatgtttccccctaaaaccccaatcctttttgtatgttgtgagtggagtgcagagaataaagctcctactgagtgcttttggccttcagatttggtgctcattactgtgtagacattctcagccagagcgcgacaacaggcattcagaactgygttttctgcaatgtttattgtttattccacgatcttttgttgtttttttttgttgttgctgttattttacatgttggcatattaatttctattgctgttgtaacaaattaccaccaatttagtggcttaaaaaaacaacactcatgtatcatctcacagctctgtaggtcaaaagtccaagtatggcatggctcagctggttctctgttagagttgtacaaagctgacatcaaggtgtcggcagagctgtgttccattctggaagttctggggctaaatctgcttccaatctcatacgtg

SEQ ID NO: 42572 - DNA, 601 bp, Human
cccagacagtctggctccaacatcaactcctgtgcttaactacctttggaattacagcatatgtcagcaaacttccacattaccagtgtaattcataccacaaagcaattcactttaccttctagttgggttgagcctaggtaagtagccttcagagcttaggaaccataaataacaaccagaccttgtgctaacacatcttgaaaagcttgtctaagctttacaattgtaccagaagaagtaaaatacaaataggacagcatgtaccattgccaaaacaatctcccctttgtatagtttyttcttctcaccaatttgttactatatgcaatactgactttaagtaaacaaacaagaagctacaaacaatacacccaccctcttttaattacagcactacaacaaggccactttgttaaaatggttcatctctaaaatatttttcttaccaaaaatgatacacagatacatacacactcatgtttccccctaaaaccccaatcctttttgtatgttgtgagtggagtgcagagaataaagctcctactgagtgcttttggccttcagatttggtgctcattactgtgtagacattctcagc

SEQ ID NO: 42573 - DNA, 601 bp, Human
ttccccatggaattgtcatatcagctttaggaaagatgatgaaagaaaagaaatgggcccagagggacctaaggaaaccaggccaaacttgctgttcacgtggacccttacagggagaatggaaggcaaaagcagagaactgggtccaattttctttctcagtgctatctgtgcagtggtcagatgtggcactcacaaccaaaaggcttttgaaacagcactggtgagtcctgacctaccttcttcaaatttctgaaaatgatacattttattatctcatgagtagagatactggagattmctcttaaggcaggaaggggagacctagggtccctttctttgctataattaactgcattttctctgggagaacagaagctccccatggatatatggggttgggacaagtggctatttacagctaagaagggaatatttttgaggtttagagaattcaaatcacgattactatctcatgttcaaagactgaaataaaaatggctgtgtactctcttcatggagcaatttgatgttctgaggccctctactccctggcttctggaaatctatttttccctccatcacaatatttcctttaact

SEQ ID NO: 42574 - DNA, 601 bp, Human
ggctctgtaactgattaacaaataaatcccagagtgcaggcaggccacttaatctctgctcatctgctaaaaaacagatatcacagcttctgtcgtactccatatcatggaagaaaataacacaaaataataaaccatgtgaatgaagcagttaaaactgctgagaaataaaattaacctgctcagtaaaagtaaggctaccaatcaagaacaaatagaatgaactgttactcgttccaaagttatttatttttgcttaatactgtatttccttctcctttttctctgtcctgtggtttcytttccttgtttcattatgactaaatatgcaaggaaaattcaatgctgttattttggtcctatctttggcccaaatctctagatttaatttacccatgataccgtgctgtgctatttaaaaagatcactaagaaaactttatagatgatgaagttaggaaaatgacaaataaggggataaatgcgtttccttatttaggtgaggactatggctgagaagattctgtaacttagacatagtcagggacgtgataagagcaggagctgtaatcagttttgctaatcatgatttctaaacaata

SEQ ID NO: 42575 - DNA, 601 bp, Human
ttatattttgaatgattcatcatgggtactgttaaaaataacaaattattgcatacctatatcaaaacatctcatgtaccccatatatatctactatgtatccacaaaaattaaaaataaaaaatttaaaaagtaacagattatcttgattataaaatatatacgcattgtggaaaatttggaaaatagagtaaatagatgaaaataaattacacagcatcacttccattcttttctctttttatatacaaatggatatgatggtatctctaaagatctttttttttttttttttttttttccaaacaagctaagatggcaccaatcccagggcaggatctgagtcttgactatagtccttagttttgaacaagtacagggtgacaagaaagtgcataacaaagctatgactgaataaaactcaaatcttggtgaagaaaagaaatcaaggacacattaaaaaaactatgggtacacacattttcacttcttagtttatatcttatggcagggagcaggagtaatcttttctttttcctttatgaatggtaaagacaactggtatcctgtctgaatataatatgcctatccagcacacttt

SEQ ID NO: 42576 - DNA, 601 bp, Human
gctataattcacaagggtgaagactttatattagtattattaaaaaattggaggcaagtcaaggatatggtacccccatggaatcactcctgtcactatgggcttctttaatagtcagatatcgcaggctcaacactccggggaatactgtcttctgtctcttcatataaccacagagcttggataacccttctgctcccttgtggaaattctagctttaatactcactatagtttaaattgggcttagcattgaaaaactttaatgacaacatgctggaaggtcatttggagcaagggtratggtgtggtgtggagacagaatagatgattagagacgatcagggacacctggcaaaatgagtgccactgattaattagtgaggctctgattattaactgggctcagggcttatcaattgccttcactctgcagcagaactctgaactagagatatcactcgaccaaattagaacctcaccataccacataataaacttattctgtctcacaactcccagtcttgctttatactgtgccttcctgggagagaaggaaaagctttaccagggaattcgttcatgagtaggaaccttagcac

SEQ ID NO: 42577 - DNA, 601 bp, Human
gtgaattgtgtggttatatcaattatattttgatagagctgttaaaaaaggtggttaagaaattatatttccaagcaaacattacggattcaggaggagggtaaaaaaactgctaaatatttggaaaccatccacatacacacaaaaataaattaaaaaaaaaactgctaggaaaactgttaggtctacatatatgaaaggctttaagcatgcggtattaaagtatagtgacaaacattttaccatatattcaatcaagtacttgtctggagacatgtgctccgcaagttttgataatctrttgttatgatctgaatctttccaaacacctgatttatcagattagggttaaataataaaccaaaaatgtctatgcatgcaaaaaaaggcactggtatgaaactattatcttatacttcactttggatggtgagatgatgaatgatttgctttctgcatttttctacttttctatactgcgttttatgagtgttagttttaaaatcagaagaaaaaaaaacccgacaacattgcctcttgccatacactgcacatatatgatctgttcacctcacttcttcattccctactttaatactaa

SEQ ID NO: 42578 - DNA, 601 bp, Human
gaggagaagcatgattttaagtttgtattatattattagtaaagtctggcagaatgagatagatggaggtggtggggagaggagattagaaggtaactgatttagttttaaatattttccttgtataataaaattatataaaacatttcactgaaattggagaatgaataatatgcaaaaaaggtagtttggcatacctatgtatatacccaaaagcattaacatacaggtccacataaaaacttgtacatgaatatttatagcagcattattcataatagccaaaaagtggaaacaatcytaacgtccatcaactgataaatggataaacagaatgtggtatggacttacaatggaatatcactgagtcataaaaagaatgatatactgagactacctggaggacccttgaaaccattatgctcagtaaaagaagccagtcacaaacaaccacacataatgtgattccatttatatagacaatgtaaatttatacgaacagaaagtagactggtggttgcctgggactaggggatttgagggaactgactgtatacagactgaaggtctgtgcccctgaaaatttcctgtgttgaaatcc

SEQ ID NO: 42579 - DNA, 601 bp, Human
tgatcagaacttgatggaaatgtgaacatgacttgagaggagaagcatgattttaagtttgtattatattattagtaaagtctggcagaatgagatagatggaggtggtggggagaggagattagaaggtaactgatttagttttaaatattttccttgtataataaaattatataaaacatttcactgaaattggagaatgaataatatgcaaaaaaggtagtttggcatacctatgtatatacccaaaagcattaacatacaggtccacataaaaacttgtacatgaatatttatagcmgcattattcataatagccaaaaagtggaaacaatcctaacgtccatcaactgataaatggataaacagaatgtggtatggacttacaatggaatatcactgagtcataaaaagaatgatatactgagactacctggaggacccttgaaaccattatgctcagtaaaagaagccagtcacaaacaaccacacataatgtgattccatttatatagacaatgtaaatttatacgaacagaaagtagactggtggttgcctgggactaggggatttgagggaactgactgtatacagactgaa

SEQ ID NO: 42580 - DNA, 601 bp, Human
cactaaatgtaagggatgatgtagaaatagaaaatatattaccaggcagtaagctctgacttagtgacaaagcaggacttattgtattcagaggagacccatactggtacatatcttcctttatgtccaagaatgctttttgtgttttgatcgaacaccccagtattgacatgattttatgatgctcatccaacatggtttattaacatatcaatttggttgcatttttggttaaagagcaattccctacatattaaatatatacattagaatcagaaggaaaaatgaggctaaaacgtgytagtcctgcattatacaaacatgattttataaaaggaagtctgtggtattccaaagtgagcaaacagtaaattaaaagactattatttatatttcccctgaaaaccattctgggatcagaaatgtggaaagaacagcaagtgataagcacaggcttcggaaataggcagatttgggttcaaatcctgcacctgccacttactggcaggtaaggacaaattacttaacatctatgacccttagtgtctttatgtatacaatgataataacttacagttgtaatgaggatcagttatacttt

SEQ ID NO: 42581 - DNA, 601 bp, Human
caaattacttaaagtagcatgaaactgtaagaaaggaaacataatatttacttctaaagaaacatatgtcaaagtgaatcgagaggcttctaaacctgcattgaaataaacattcaaagatggcagatttaaaaaaatgtggatcagaaagacattccagaatcaaaagccaccagctgctacaagtgtgaaaatgaaacctctggagggactgttgcctcctgctccatgtggctgtggcatgtgatgcctatagcagctactgaactgatatttgtgcccaccacccagtctgggtagrgcaggtgtctcactggcacagtgcagacgagcttgacatcagaaaaacttaccagaagtaggtctttgcctagttcatcgatatctgttacaaacttctcaattggttgggcagattttgaatgaaaagcctgcctgggaagggcaacatctctaggccagtcttcttctcctgggagtccaatcacgctacaaaagaaccacacatggacataagcattagctactatgcagaagctgttttctcatcaatttccagagaaaggcaaaatctaagggggagacatggggggcagagtcc

SEQ ID NO: 42582 - DNA, 601 bp, Human
cctctcaccatagggggagcattctttcctccattcaagttggccttaggcatggaacttgctttggccaatggaacatgggcagagtggcgggtacttcttccaagtatggaccttcaggggcattgcatatttctgcttgcccttctggagcatcgataccttctatcatgagaaaaacatgccccagggagctgctgcctctctggcatgggccccagcatgagacacatggagaagacctgtgcttcacccacgggcagaagcagatatcaaaggctgttaattcaggaggtaaagsagacactcattactcactgggtttcagacatcaagaacagcccaacaggtacacttttctacctattgttctggcctccaagtataggaaattatgtatatggttgagcattaagagtctcagagcacagaagtccttattttcagtgaggtattttatatgtccctggcacactaaatacttattaaataaatcagcaactagaagaagtattgctatatagttcttttggaaaaacatctccccaaagttgtgaatgtttaagaaaaggcacgttaaaatgacaaacaaattacttaa

SEQ ID NO: 42583 - DNA, 601 bp, Human
gtccaaggaagagaggcctgctttcagagccaattcctgggtgcaatccaattttggacccatttcttgcatttcttttcttcccagactcccctcccgcagaaagcatttgtctgtagacagcctggggttctgaggtaccatatccttatggaagtgagcagagagagaaggaacgacaggcgttttacagaaaaagctgtcaccaaaggagaagcaacatggctgctgcagtcccacacaatgatttaatcaccaacaaactggagaacaaaagcatttttggcgacaacatattgtratggcaaaaaccgcagttactcttgcaccaacctaatagtatcataccagaaaatagcattgttggaaggggaacaagagaaatatctcagcctctaaaggaaaaatagtgaaatatttcgattatgtggttgcatatttttctccctgtttagatggcttctgtgattccgccacatgttacatgagacatccgccagtcaccaatcttagatttatgcaatgtgggcttagatttatgcaatatgggctcattctgccccttggtccaaaagggccactctgctgtgaggaaaccctt

SEQ ID NO: 42584 - DNA, 601 bp, Human
gggaacagcatgtgccaagccctcgaggtgagcgtgtgcttggcgtgttccaggaagagcaaggagctcctgaggctggagctagaggagagagagtcttaggagatgacgaggttgggggtgtccgggagccagttcctgcagggcctcgtgggccatgtgaggctttgtggaacttgaggatagacgaggacattactgaccacagtttcaaaggctccctctggtacaatgttgtggaccgggctggccacggcaagtgtggcaacagggtccggttccgaggtgagtgcagtcatcygagggagagaagatgctggcttggcccagggtggtggcagtggaagtgttaagtggctggattctgactacactggggaagtagtgcccacaggatctgcgggcagattacgcgtggcaggggtgggggtgtgaaagaaacggaagtctgaggctggggcaactgggaggatagagctgccatttgcggggcgggcggaaggggaagaaggtttcagcgaagacaagggatttggggaggatggggaggaggatgatctgtttgggacataatgaatttgagacgcctaggggacacccc

SEQ ID NO: 42585 - DNA, 601 bp, Human
gggcgaccaactaataatctcacagatacacccatctagagggcaccgttcaccccattatagttatcttcaggagtgtggggagccccaatccaagtttagactcttcacatcccctggaagttcctatggggagatagattcaagattgtgccatctgattgaagacctgttttacttgcattctctcattcaaacaccaatcgtggagcttgcctaggtcaaatgtgctacagtcaccatcaccaaaaaaaatactttttttttttttttttttttgagacagagtctcgctttgtcrcccaggctggagtgcagtggtgtgatctcagctcactgcagcctctgcctcctgggttcaagcgattctcttgcctcagcctcccaagtagctaggattacaggtatgcaccactatacctggctaatttttgtatttttaaagtggagacagggtttcaccatgttggcgaggctggtctcgaactcctgacctcaagtgatctgcttgcctcggcctcccaaagtgttgggattacaggcatgagccaccatgcccagccaaaatatatttcaaaatacatttaaaaacaaagtgata

SEQ ID NO: 42586 - DNA, 601 bp, Human
atagtggagagaggagaacacttaagctaaaagaatttctaattttagaacttcaagctcatgacagctgtgtaggggagacagctttggggaccagggtcaatatcacatccctcaaacacatgactcttctctctctcttttttttttttttttggtgggggggacagggtctctgtctgttgcccaggctggagtgcagtgatacgactatggctcactgcagcctcaacctccagggctcaagcgatcttcccaccttggcctcccgagtagctgggactgcaggcacatgccaccrtgccccccccatctagagatggggtttcgtcatgttgcccaggctgcacatggccctttcttgaagtatcaaactagattgggtcgatgaagccaatccacataaacaatgtcttttcaatttcttcttagacagaacttacttggaatggaattccaggaggtctcatgtctctagtgaaaagaacattcgttaccactgaatggtaaatttctctaaggtggagacaatgccttcatttctgtctccttgtcagtgcctgacacatcataggcacatgttgaaagatgggtgaattga

SEQ ID NO: 42587 - DNA, 601 bp, Human
gaggcaggagaattgtttgaacctgggaggtgggggttgcagtgagccgagatcacgctactgtactccagcctgggagacagagtgagattccgtctcaaaaaaaaaataaaaaaataaaaaaagaacaaaacccaaaaaatagtggagagaggagaacacttaagctaaaagaatttctaattttagaacttcaagctcatgacagctgtgtaggggagacagctttggggaccagggtcaatatcacatccctcaaacacatgactcttctctctctcttttttttttttttttggtkggggggacagggtctctgtctgttgcccaggctggagtgcagtgatacgactatggctcactgcagcctcaacctccagggctcaagcgatcttcccaccttggcctcccgagtagctgggactgcaggcacatgccaccgtgccccccccatctagagatggggtttcgtcatgttgcccaggctgcacatggccctttcttgaagtatcaaactagattgggtcgatgaagccaatccacataaacaatgtcttttcaatttcttcttagacagaacttacttggaatggaattccag

SEQ ID NO: 42588 - DNA, 601 bp, Human
ttgcaatatgttaccagcccaaggctgtgtatatttcatattctagcctttttactttagtggctactttctgagtttgtaggcaggcttataaagaatgcagatctaaagaaacacagaattcagggactttcttaacacaagattccagacagatgtgaatagtgttatgcatagatattagacttgaatatatgtgacaatatagtagagtacagaagaaaatatgtagaataatatttctggaagaatggatcataagctcaagcatcatatagaatagaaaatctagaatcaaaakgaaccattagcaaaccagtagatttcttatacttttgataatttccctaccctattttttgctctcagagtgccggggtaatcttggctcaacggtggaagagacagagcttttagtatttttaatagcattaaagtgaagattaggaggccagaatgcatgtggccttctgctccgtggggggcccgggcattagccagagtgcacctgctagcgctcctggcagctctgagtgaccccgctgtccttctgtgctttccagggttctctttcttcgtgagacacgttatgagggaagcc

SEQ ID NO: 42589 - DNA, 601 bp, Human
tttttaacaagccaacttttgaaagtgcaccttgaaaaccttggcctgccagggaagacattctttctgtgggctggggatcccgaggactgagtgcctgcggactcgagggctcctcccccacccgcgacacccctccagctgggaagacaagcccgagcgatcagggggaggggcacaaggccaggtggcagggatttttcatgggcaaaattctaaccttgggtgtctctgaggcccctccactttgagcatttgatgactgaacctcctttttgttttccacccccacccgccgccrccgccccgctcagggctactagctctgagagagtaggcagaggggaagggaaaaagccagtgccacctctcccagtcaccttattcttggcactttgctcttcttcatctgtttccccttcacatctcttttgccatttcttcccaaatagctcatctaacactccagagcggtctgtagccctgcaggggtacctggccagggccaatggccttgacagcctgggagggcctgtccaggcagcagagaatgtgtggctcactctgcgatctaaagacccgtgtgtccagacgtggatgc

SEQ ID NO: 42590 - DNA, 601 bp, Human
atcctgccacctcagccttctgagtagctgggaccacaggtgcacaccaccacacccagctaatttttgtattttttgtagagacaggattttgccatgttccccaggctggtcttgaactcctgggctcaagggatccacctgcctcggcctcccaaggcactagggattacaggtgtgagccatcacacccagcctccccttctttttgactaaagagctctccttttattgggagcagcaatgtagccagctgaataaagggcctttcccagcctcctttgcagttagaagtgcccasgtgacataacttctgaccagtgagacataaagactgcctgctgggatttctggtcaggttttgcttgccccttcttttttcctgttgcctagatcacatctgatagttggtgtgacagtaaccatcttgcaccatgtgggtaaggccgagagaactgcagaggctgagtgcagtggctcatgcctgtaatcccagtgctttgggaggatcacttgagcccaggagttcaagaccagcctggggcaacatagggagaccccatctcgtggctcacgtctatagtcccagctaccggggagg

SEQ ID NO: 42591 - DNA, 601 bp, Human
gctgatgaatggaacttttaagtgagcaagaaacacacttctacattaagtcactgtactttggtgctctttgttacaacagcatgaacatgtatgctaactaatacgcactcagggtcctcccattatccctacagtacggaccacagtcattaacgtggcttctaaggtcctgcaccatctgacctccgcttgcctctccaccttgtctcacttgtgcttcaggcttgctgccctgcttatgttccccatccacaccctggaggtatcatcccgactcagggcttttgcacctgctgtrccccacgcctcttcccctccctcacctggccaacttcaagccacaggtcaaatatgttttccttagaaagccttccctggctgcatggatgaggtctttcttccttcatctctcccccagcactcataagtacattctgtgtcatttgtttattagagaggcctatattttttttcatttttgagacagggtctcactctgtcgcccaggctgtagtgcagtggtgtgatctcggctcactgtaacctccgcttcccaggttcaagcaattctcctgcctcagcctcctgagtagctggg

SEQ ID NO: 42592 - DNA, 601 bp, Human
gtgagctgattaaacctcttatctttataaatacctggtctcaggtatgtctttgtagcagtgtaagaatgaactgatacatccccaaatctcagctactcactcacttcaactgtatttatttattataaccaataaccacaacctctccataaatgcagtttcaagaatcccactctcttaaccatcaccttctaggctctgcaacttactcctactagtgatttgatggggacaatcattccacttcattaggactggcagtacattgatcctcccacttttttttttttttttttttgaggcagagtctcattttgtcgcccaggatggagtacagtggcacgatctcgggtcactgcaaactccacatcccgggttcaagtgattttcctgcctcagcctccctagtagctgagactacaggcacctgccaccatgcccagctaattttttttttccaagaggagtcctgctctgtcgcccaggctggagtgcagtggcgcaatctcggctcactgcaaacctcgcctcccgtgttcaactgattctcctgcctcagcctcccaagtagctgggattataggcacgcgccaccacg

SEQ ID NO: 42593 - DNA, 601 bp, Human
gggcgactgagccagactccgactcaaaaaaaaaaaaaaaaagaaaaaagaaatcttccctgctccttacttgcactttcagattattctcctccattcccctctcaaaattcccagccttgaaaatcctgacaaaaagtagccaggcatggtggtcagcacctgtagttccagctacttgagaggctgaagtgggagaatcccttgagcttgggaggaggttgtagtgagccgtgatcgcgccactgcactcccacctgggcaacaaaaagaggccctgtctcggggggggggaaaaaaagaaagaaggaaaatcttgtcaccagactcacagtctattatcgtttcctattgcagtcacctacagcctaccgagtcactcttcctcattccttaatgtttacatcgcagttctctctccaacactactcctgtcataatttttggtgatttaaatatccatgtagatgatcccttcaattaccctatatttgcaggtctctaaactcctctccaccacaatcttgtacatcctctgatgtggtgcagctctgtgttcctacccaaatctcatgctgaattgtgatccccagtgttggag

SEQ ID NO: 42594 - DNA, 601 bp, Human
tgctctggctggcgcggtggctcacgcctgtaatcccaagcgctttgggaggccggggtgggcggatcacaaagtcaggagattgagaccatcctggctaacacggtgaaaccccgtctctactaaaaatacaaaaaaacaattagctgggcgtggtggcgggcgcctgtagtcccagctactcgggaggctgaaggaggagaatggcgtgaacacgggaggcggagcttgcagtgagcggagatctcgccactgcactccagcctgggcgactgagccagactccgactcaaaaaaaaaraaaaaaagaaaaaagaaatcttccctgctccttacttgcactttcagattattctcctccattcccctctcaaaattcccagccttgaaaatcctgacaaaaagtagccaggcatggtggtcagcacctgtagttccagctacttgagaggctgaagtgggagaatcccttgagcttgggaggaggttgtagtgagccgtgatcgcgccactgcactcccacctgggcaacaaaaagaggccctgtctcggggggggggaaaaaaagaaagaaggaaaatcttgtcaccagactcacagt

SEQ ID NO: 42595 - DNA, 601 bp, Human
ccacgagacagccgcacgaaaactgcccagcacggctctcacaaattcctaacccacagaaacaatgagagataataaaatgttctttgttgtttcaagccactaagttttggcagattcgttacacagcaacggcagccagaacggaccaccaggactgcctttatatctgattctcagtcatttccagtagctcagatttctcaaattattcccaacaccctgccatcttctaccttctcctaccacttcctgaaacttccactgtgctcccttgagtaattcataaaatccactctttaacctctgaatcatcccttcatttcttgctctaagtaaaatctagctccctgaggatgccttttcctttcgcagccatctcaaatgatagatgtttcctcttttctcctccacacacttcatatcactgtacctactggagatgtggggaagaaatcttccctgctctggctggcgcggtggctcacgcctgtaatcccaagcgctttgggaggccggggtgggcggatcacaaagtcaggagattgagaccatcctggctaacacggtgaaaccccgtctctactaaaaatacaaaaaa

SEQ ID NO: 42596 - DNA, 601 bp, Human
tcagtaattccaaaaggtagtagggtgtgatgagacatgtccaactcccccttcccatcatggcttgaactagtttttcaggttaattttggaatgcccttggctgagaggatgggtccattcagttggttgtgcaggggcggggggggcctataattttatttttggtttacaagacataccctgaagcaatagtaattaaaagtgtagtactgacatcaatatacactaatagacaatgtaacagaattgagagtcagaaatagccctgtgatatatgtgactgattttaactaaagtyacaaatgtggtttaatagagaaagcatagtagtttcaagaaatggtggtaaaactattggaaatccttatgcaaaaacaaaccaaatttccacctacactgagccacatataagaattaatacaaaatggattacagacctaagtgtaaaactaaaactctaaactgtgtaaaaaaaaaaaagagagaaaaatctgtgatcatggattgcctataacaaaagaacaaactgaaatggccttgttgcctggggtggcacccgaggttcttggtctcacgctgaggaaatcaaggacgctga

SEQ ID NO: 42597 - DNA, 601 bp, Human
gtgtattaaattgaaaagctgattctaaaatttatatggaactactaaggacaaaaataaaccaaagctggacaatttacattatctaactttaagactgtaaaccagaagtagctaagacaggtttcaatcaatttagaaagtttattttgccaaagttaaagacgctcctatgacacagccacaggaggtcctgatgacatgtccccaaggtggtggggtacagctttgttttatacattttagggagacatgaggcatcaatcaatatatgtaagatgtacatgagttctgtcaggaraggcaggacaactcaaagtgggggtagggaggtttctaggtcataggaagatttaaagattttctaattggcaactagttgaaagagttattatcaacagaaaggaatgtttgggttaccataaggggttgtggagaccaaggttttatcatgcagatgaagctcccaggtagcaggcttcagagagggtaggttgtaaatgtttcttttcagactttaagagtctgttctatcagtaattccaaaaggtagtagggtgtgatgagacatgtccaactcccccttcccatcatggcttga

SEQ ID NO: 42598 - DNA, 601 bp, Human
cagcctcccaaagtgctgggattacaggcatgagccaccgcacccaggcttgtcattttcctgttaatctccgttatatagagacaaatgtattccaatataaaatgtcaatcttgctgtatgataaaaagtacttaataatcccagcctgggcaacatggcaaaaccccatctctacaaaaagtacaaaaattagctgggcgtggtggttcacatctgtagtcccagctacccagaaggctaaggtgggagggccgcttgaaccagggaagaggagattgcagtgagtggagatcagagwtcgtgccactgcactccagccagggtgacagtgagaccctgtctcaaaaaaaaaaagtacttaagatcattaagtcactttgcagataagaaaagtaatcacaaagaggttaactgacttaaggttacattcgcacttggaagggaagatattccttggagatttggtaaaaggaataaaaacaggctgggtccagtggctcacacctataatctctgtctcgaaagaaaaaaaggggggtaggggggaggctgggcacggcagctcattcctgtaatcccagcactttgggatgcagag

SEQ ID NO: 42599 - DNA, 601 bp, Human
tgtcattttcctgttttttttttgttttgttttgttttctcttgagacaagagtctcgctatgccacccaggctggagtgcagtggcatgatctcggctcactgcaacctctgccgcccaggttcaagtgattctcctgcctcagtctctcaaatagctgggattataggcgcccaccatcaagctgggctaatttttgtatttttagtagacatgggctttcatcatcttggcaaaactggtctcgaactcctgacctcaagtgatcctcccacctcagcctcccaaagtgctgggattrcaggcatgagccaccgcacccaggcttgtcattttcctgttaatctccgttatatagagacaaatgtattccaatataaaatgtcaatcttgctgtatgataaaaagtacttaataatcccagcctgggcaacatggcaaaaccccatctctacaaaaagtacaaaaattagctgggcgtggtggttcacatctgtagtcccagctacccagaaggctaaggtgggagggccgcttgaaccagggaagaggagattgcagtgagtggagatcagagatcgtgccactgcactccagccag

SEQ ID NO: 42600 - DNA, 601 bp, Human
taggtagacaaaatagaacgcattccaagtaagagcatgaacaacaacaaaaaaggcatggaagcaaaaataacactaactataagaatttatttatgtaaggtaactaagtagtcaaatttatagaattagaaagaatgggccaggcgcagtggctcacgcctgtaatcccagcactttgggaggccgaggtgggcagatcacctgaggtcaggagttcgagaccagcctcaacatggagaaaccccttctctactaaaaatacaaaattagccgggcgtggtggtgcatgactgtaatyccagctactcgggaggctgaggtagaattgcttgaacctgggaggcggaggttgtggtgagtcgagattgcaccattgcactccagcctgggcaacaagagtaaaactccatctcaaaaaaaaaaaaaaaaaaaaaagaatgatgattaccaagggctaagtgtaaggagaaatgggaatttgctaatgggtagagtttcaggttgcaagacgaaaaacttccgaagatctattgcgcaacaacatgaacatacttaatattactgaactatatacttaaaaatggttaaaatgacaaat

SEQ ID NO: 42601 - DNA, 601 bp, Human
tcacttgaacccgggcggcagagattgcagtgagctgagattgtgccactgcactccagcctgggtgacacagtgagactctgtctcaaaaacaaacaaacaaaaaaaccaaatttagctgggcatggtggcacatgcctatagtcccagctacctgcaggggctgaggcgagaggatcacctgggcccaggaagttgaggatgcagtgagtggagatggcgccgctgcactccagcctgggtaacaaattgagaccttgtctgggaaaaaaaaacaaaaaaaaacaaaaaaaaccccccmaaaaaaaaaaaaacccaacaggatgtgcataggtagacaaaatagaacgcattccaagtaagagcatgaacaacaacaaaaaaggcatggaagcaaaaataacactaactataagaatttatttatgtaaggtaactaagtagtcaaatttatagaattagaaagaatgggccaggcgcagtggctcacgcctgtaatcccagcactttgggaggccgaggtgggcagatcacctgaggtcaggagttcgagaccagcctcaacatggagaaaccccttctctactaaaaatacaaaatt

SEQ ID NO: 42602 - DNA, 601 bp, Human
tgcttgggaggctgaggcaggagaatcacttgaacccgggcggcagagattgcagtgagctgagattgtgccactgcactccagcctgggtgacacagtgagactctgtctcaaaaacaaacaaacaaaaaaaccaaatttagctgggcatggtggcacatgcctatagtcccagctacctgcaggggctgaggcgagaggatcacctgggcccaggaagttgaggatgcagtgagtggagatggcgccgctgcactccagcctgggtaacaaattgagaccttgtctgggaaaaaaaaacaaaaaaaaacaaaaaaaaccccccaaaaaaaaaaaaaacccaacaggatgtgcataggtagacaaaatagaacgcattccaagtaagagcatgaacaacaacaaaaaaggcatggaagcaaaaataacactaactataagaatttatttatgtaaggtaactaagtagtcaaatttatagaattagaaagaatgggccaggcgcagtggctcacgcctgtaatcccagcactttgggaggccgaggtgggcagatcacctgaggtcaggagttcgagaccagcctcaacatggagaaacc

SEQ ID NO: 42603 - DNA, 601 bp, Human
ggtaagaaccttgtgtctactaaaaatacaaaaattctggccgggcgtggtggctcatgcctgtaattccagcactttgggaggcagaagcaggcagatcacgaggtcaggagttcgagaccagcatggccaacaaggtgaaaccccatctctactaaaactacaaaacttagctggcgtggtggcagtcacctgtaatcccagctgcttgggaggctgaggcaggagaatcacttgaacccgggcggcagagattgcagtgagctgagattgtgccactgcactccagcctgggtgacasagtgagactctgtctcaaaaacaaacaaacaaaaaaaccaaatttagctgggcatggtggcacatgcctatagtcccagctacctgcaggggctgaggcgagaggatcacctgggcccaggaagttgaggatgcagtgagtggagatggcgccgctgcactccagcctgggtaacaaattgagaccttgtctgggaaaaaaaaacaaaaaaaaacaaaaaaaaccccccaaaaaaaaaaaaaacccaacaggatgtgcataggtagacaaaatagaacgcattccaagtaagagcatgaa

SEQ ID NO: 42604 - DNA, 601 bp, Human
ctacttgggaggctgaggcaggagaatcacttgaacctgggaggcagaggtggcagtgagccaagatcgcgccactgcactacagcctgagagacatagcgagactctgtctcaaaaaacaaacaaaacaaaacaaaacaaaataaaacaaaacaaaacaacaggatttaggccgggcatggtggcttgtaatcccagcattttgggaggccaaggcaggtgaattgcttgagtccaggacttccagaccagcctaggcaacagggtaagaaccttgtgtctactaaaaatacaaaaattytggccgggcgtggtggctcatgcctgtaattccagcactttgggaggcagaagcaggcagatcacgaggtcaggagttcgagaccagcatggccaacaaggtgaaaccccatctctactaaaactacaaaacttagctggcgtggtggcagtcacctgtaatcccagctgcttgggaggctgaggcaggagaatcacttgaacccgggcggcagagattgcagtgagctgagattgtgccactgcactccagcctgggtgacacagtgagactctgtctcaaaaacaaacaaacaaaaaa

SEQ ID NO: 42605 - DNA, 601 bp, Human
gccaggaataaatgttttaaattttatttaaattgcctccacaaaggatgacatatataggctatcaacttctaaaggaggatatcacctgatttaactaactcatactaccatctaatcttcaaaatgaaaactgaataacatgtactttaacactttatcgtatgttatcaattcctttccaaatgaataacgagaaaataagaaaacgactaagcaagcatttcataccttaaatgaagccacagctttatcatatgcttttatcagtgctgtatcatcccaaatgtcagaatcatcrctctggaaagggtaagaaataaaaacaactcatgttcagataggtttaatcagaaaatgtatgttagtaccaagagtcatcttaatccacacataacaaaattacactgaaaatgagtatttaaaatcctaaataaagccacaggaaacttacctggttagaggttatgtgactttactccaaaagctagacataggtaaatgttctaagaatgaatgccatcaagtgaatgcccctacaatttaattcctatccacataccatgagtagatttgttcaaggccagctatatttatttca

SEQ ID NO: 42606 - DNA, 601 bp, Human
actacatttcctaaaagaactgtatattcctacccaataggaacacttgaattgatacccaacttacaggatttgggatgattagagtaatttaatatatgaaacgcacacagagcactgtcagcatgctacaaatattaattgctgtactaatgctatttatcttcatcattattttactacatgcttgttaaatgtttaaaattataattcagattgtctttttcttattaatctcaattagaggacttccatagtttgatacaatgtaaaaatactaaaaggaatacattgtttgttsgttttctgagatggagtctcactctatcgcccaggctggagtgcagtggtgcaatcattgcaacctctgccccccaggttcaagcaattctcctgcctcagtgtcccaagcagctgggattacaggcacgtgccaccatgcttggctaatttttgtatttttagtaaagacggggtttcaccatgttggccaggctggtctcaaactcctgacctcaggtgatccacccgcctcagcctctcaaagtgctgggattacaggagtgagccaccatacccagccaggaataaatgttttaaa

SEQ ID NO: 42607 - DNA, 601 bp, Human
aagctattaatccagctgtgacttttctcaatctaacatttccaatgatcaatttcacatcttaattcatacctcaaactcaacctcaacttaattcatattcaacctcaacttaattcaaattcaatctcaacttaattcatactcaaactcactactaaaactatcgttttcccaaatcagttcttttcctcctttactcagattacttctccctgcaatatcaccaacccatcccacatcgagccccatttcaatctctattttatagaattctcttggtaattctttagtcgacttstagtttcagtgtatactggaaagcacatttaaaaatctaggccgggtgcagtggttcatgcttgtaatcccagcactttggaaggtcaaggcggagggatcttttgagctcaggagttccaggccagcgtgggcaacagggtgagactgcatctctacaaagaatacaaaaatgagctgggtgtggtggcacacacctgtggtcccaactactcaggaagctgaggtaggaggattgtttgagctcatgagttgaaggctccaatgaggcatgatcacgccactacactccagcctgggt

SEQ ID NO: 42608 - DNA, 601 bp, Human
tagcagaaataatctacctagacttctgggttccttggaattaacagttttagagtttttaaagaaaaaggggaaaaaaaaatctatctctcagcttaagatgtaaaacactgccaattcagcttacggctcttgggtactccttccaaacggcaccttctccctgccttccattcacaaatggaacacatgtcctgattttagcatttatcattcccatctaattctttatactttcatgactaatatgcatgttcctaaataacagaaaatttaatagttgtttttgaagttgtataaktatatgtcaatagaaacactgtactaatcacttaagttaaagacattttacactattaaataaggactaatgagacatcctttgaagttaaatctcaacattttaaaataacctgttgtaaggaagctgcagtattcttcttttggcttttattcttcttagcaggttttcttttaggtgtggtttttggtttacccgaagtttcacaaatgtcaccattctttagagcatgctacgaaaataggaataaaaatgtacatgttacagggtggtgcacagaataaaagtcacgacataacc

SEQ ID NO: 42609 - DNA, 601 bp, Human
tagtttccccatcttattagatggctataatataaactacctcccatatttgttgtgaatagcgggagggagataaaatgcgtatggtgcccagcactctggactggcctagagcaagtgctcatcaactgttagctctcttcccccttggtaatgatgaaactaaagttggctcaaaagacaccaaaatattcagctttcaggactactgcttttaactagcagaaataatctacctagacttctgggttccttggaattaacagttttagagtttttaaagaaaaaggggaaaaaaaaatctatctctcagcttaagatgtaaaacactgccaattcagcttacggctcttgggtactccttccaaacggcaccttctccctgccttccattcacaaatggaacacatgtcctgattttagcatttatcattcccatctaattctttatactttcatgactaatatgcatgttcctaaataacagaaaatttaatagttgtttttgaagttgtataagtatatgtcaatagaaacactgtactaatcacttaagttaaagacattttacactattaaataaggactaatgagacatcct

SEQ ID NO: 42610 - DNA, 601 bp, Human
tataatcatggacaagtttctgaatctctttgagtcttagtttccccatcttattagatggctataatataaactacctcccatatttgttgtgaatagcgggagggagataaaatgcgtatggtgcccagcactctggactggcctagagcaagtgctcatcaactgttagctctcttcccccttggtaatgatgaaactaaagttggctcaaaagacaccaaaatattcagctttcaggactactgcttttaactagcagaaataatctacctagacttctgggttccttggaattaayagttttagagtttttaaagaaaaaggggaaaaaaaaatctatctctcagcttaagatgtaaaacactgccaattcagcttacggctcttgggtactccttccaaacggcaccttctccctgccttccattcacaaatggaacacatgtcctgattttagcatttatcattcccatctaattctttatactttcatgactaatatgcatgttcctaaataacagaaaatttaatagttgtttttgaagttgtataagtatatgtcaatagaaacactgtactaatcacttaagttaaagac

SEQ ID NO: 42611 - DNA, 601 bp, Human
gcaaactatcatctcgttttgatcagtggggaggtgaaggatagagggtagagatttggaaggcaaaatgatgtaatgagaaaggcttggggtctaaatacataaatctgaattccaactctcttacatttataatcatggacaagtttctgaatctctttgagtcttagtttccccatcttattagatggctataatataaactacctcccatatttgttgtgaatagcgggagggagataaaatgcgtatggtgcccagcactctggactggcctagagcaagtgctcatcaactgttrgctctcttcccccttggtaatgatgaaactaaagttggctcaaaagacaccaaaatattcagctttcaggactactgcttttaactagcagaaataatctacctagacttctgggttccttggaattaacagttttagagtttttaaagaaaaaggggaaaaaaaaatctatctctcagcttaagatgtaaaacactgccaattcagcttacggctcttgggtactccttccaaacggcaccttctccctgccttccattcacaaatggaacacatgtcctgattttagcatttatcatt

SEQ ID NO: 42612 - DNA, 601 bp, Human
tggcatggggggtggtggagggagaaaagagttccatggagcagatttgggcttgatgttatctgatttatttccaggagacctggagttctcactttcatctgttgaaacttggctttcattttcattctttaaaaagaaaaaatatgcaggtttttgttataagggtgtgattaagaaaaaattaatgcctcggtggatcaaactgacaactgtgtatactgtttaacagtttctcatctagtctctgcttccagaaattgaatttttttttttttgtatccttacctcttgagcattytgttctatattattagctacttcacagattggggaaagtagatcggacagattttgctcctctctatttccatatccagtgtaaaccacaacacaggtttctctcttaaaatcaattgaagcaatggtagctgggtaaatgcaaccgtcttctgaccaaatggcagaacatttgtccccaactttccactacaaaagaaatcaaagatatatacatgcacacatttcttttgaagagggcaaactatcatctcgttttgatcagtggggaggtgaaggatagagggtagagatttggaag

SEQ ID NO: 42613 - DNA, 601 bp, Human
tcaaacagactcataagtcaaatgacaacctctggatttttctcatttcctttctatgtagacattaaggaagtaaaacaaaataagagtggtgattacctaataaatcagagacagtctatttagcaaaattatttcaatcataaaagactatatcccaaatttcattaactaaattgtatatttttatgaaagcctgtttagctatacatgccaacttagaggacatattgtgaaaactagcaaatctctccttataaaaatcagccccctgagaccaatgaagcatgatgtatatatyctaagagggtacatcattttagattcaagaaactgtaatataatgtaagcctcaataagaacattatcacagaaaatcttaaaacttttggtgagtcatgcttgttttttgaaaatgactgcctaggctaggcgcctgtaatcctagcactttggaaggccaaggtggggagatcacttgaggtcaggagttcaagaccagcctggccaacatggtgaaaccccatctctactaaaaatacaaaataagccgggtgtggtggcgggtgcctgtaatctcagctacttgggaggctgaagc

SEQ ID NO: 42614 - DNA, 601 bp, Human
aagaaatccagtttacatcagaagctaacatccaactatacctagaagggcaaacactaattccttatataaggtataattaaatcccttctaacaggaactacctccttatggcatagacaccaacttctgccaggaaagaaggcaacctagagcttagacttgggactacaagagcactgcatctgggtaacagaaaggcattaaaaacaaacaaaacccagaggtttagttcaaatttctacccattagaatctggcccaagggatgttctacaatgacattttacaatcctctattstgctaattatcaaattgtatgtgaaagcaaaatctaacctatactcttttttacttactggtggtccagaaggaaatggaggcagccagcatgatagtaagtggggtggtggtggtggcggtggcggtggtgggccattgaattttagacctggctataaggaatatttcaaaggaaaattaacttaccaatttcaatatgataggaataaaaaggactcaaaaccaaaaggataaaaataattacccagaatatttgttttatacatatcaaaaagattaagtgaaatttcatgtacca

SEQ ID NO: 42615 - DNA, 601 bp, Human
ctcaagtgatcctcctgcctcagccttctaaaatgccgggattacaggcatgagccactgtacctggccttaaatttcttaacatagctagcatttggagaaaaccaaccaataacaacaaaagaccaacaaaattaaatttaacgaggacgaaaagacagcaagtgacataaaaagtttaaacattttgatttagactatgtatctgttccactatgaagctatgagtaaaaaaaaaaaatcaagcataaatactttcatgcttttccttaatacacacacacacacacacacacacaccgctcacatagcatttcgagggcgattttaagtaaatgtcttgggtagaacacctgttctaaccccatcccaatacacagtatgccaaaaagtatctttttatctattgttaatacctaaaaatctaccattagaaatccagtttacagctgggtgcggcagctcacgcctgtaatcccagcgctttgggaggccaaggcgggtggatcacctgaggtcaggagttcaagatcagtctggccaacatggtgaaaccccatctctactaataaaacaaaaattagccgggtgtggtggcagt

SEQ ID NO: 42616 - DNA, 601 bp, Human
ctcagacagttgtatttttttatttttattttttagtaatataaagagagaagcaagtagtattttataaatttacaaaacaaagtcacataactacaaaaaaattgtcaggaaaagatgctgagtgattacttaccatataatagccagtatgatagccactcatgtaccatgaaattaacatacttcccaaagcatcagcatcatcaagagaatctggacatatgggaggtggtgggggaattatctggagacagaaaaagatattgtttatatccagtaaacaaaaaagtaaagtctrgagatttatattatatagtgaatgctggaaattaattgtatttttgcttatataatctcctacttaaatttcttttttttcccctaaacaaagacgaggtcttgctatgttgcccagactggtctcaaactcctgagctcaagtgatcctcctgcctcagccttctaaaatgccgggattacaggcatgagccactgtacctggccttaaatttcttaacatagctagcatttggagaaaaccaaccaataacaacaaaagaccaacaaaattaaatttaacgaggacgaaaagacagca

SEQ ID NO: 42617 - DNA, 601 bp, Human
tctcaaaaaaaaaaaaaaaataaaataaaataaaataattttaaatgttctgactaaaatacaatagaacatgtccgtaggagactaacgtataaagtgacaagtttgaagccatactccccaaggttcaatgtggtacacattaccccagatctttgtgcattaaaaaaatttcatttctcttggaaggccgaggcgggtggatcacggggtcaggagattgagaccatcctggctaacacagtgaaaccctgtctttacaaaaaaatacaaaaaattagacaggcgtggtggcaggcamctgtagtcccagctacctctgaggctgaggcaggagaatggcgtgaatccaggaggcagagcttgctgtgagccaagatcacgccattgcactccagcctgggcaacagagcaagactccgtctcaaaaaaaaaaaaaaaaaaaaagaatttcatttttcatttatgaaaaattatcccatcttttccattccctacaatcaatttcaaatcagagattaaaacattatttagaaaaagtataatttcaattcaaaagtgtataatcaaaataatctaacaatagcatgaaagcttttta

SEQ ID NO: 42618 - DNA, 601 bp, Human
aagtactgggattataggtgtgagccaccgtgccaggcctttttctttttttgagacggaatctcactctgtcaccaagggtggagtgcagtggcacaatctcaactcactgcaacctctgcctcccagattaaagcaattttcctgccacagcctcccaagtagctcggattacaggcatgtgccaccatgcctggctaaattttttttggtatttttagtagagacaaggtttcatcatgttggccaggctggtctcaaactcctgacctcaagtgatctgcctgcctcggcctcacaractgttgggattacagttgtaagccaccatgtctggccttaacttttaaataagaatattaatgggggcacacacagatgatacatttaaaaacatacacctttaagtcagttgtttcttctatattaatttactaaaaatacaagtgcctacaatatcacatcataattttagcagggcacaagagcttacttttaaaaataattttaggccgggcgcggtggctcacgcttgtaatcccagcactttgggaggccgaggcgggtggatcacgaggtcaggagatcgagaccacggtga

SEQ ID NO: 42619 - DNA, 601 bp, Human
ttccctccgcaaattctcactctgttggccaggctagagtgcagcggtgtgatcttggctcactgcaacctctgcctcccaggttcaagtgattctcctgcctcaacctctcaagtagctgggattacaactgcccgccactgggctaagttttgtgtatttagtagaaatggagtagtcaccatgttggccaggctggtcctgaactcctaacctcaagtgatccacctgcctctacctcccaaagtactgggattataggtgtgagccaccgtgccaggcctttttctttttttgagayggaatctcactctgtcaccaagggtggagtgcagtggcacaatctcaactcactgcaacctctgcctcccagattaaagcaattttcctgccacagcctcccaagtagctcggattacaggcatgtgccaccatgcctggctaaattttttttggtatttttagtagagacaaggtttcatcatgttggccaggctggtctcaaactcctgacctcaagtgatctgcctgcctcggcctcacaaactgttgggattacagttgtaagccaccatgtctggccttaacttttaaataagaa

SEQ ID NO: 42620 - DNA, 601 bp, Human
aattatttctcaagaaagttatttagaacataaattataccaatactttatatatacattatgtatttttttcaaatatttcataatttaaaaaacacaaaagcctacagtgttacagtcagataactgatctcaaaacaaattacaagctgttgatttattactttttggtcattaaaatgaggaattcatgatacatacaatataccaaggttatactacaacaactgaagcgtgacttttttttccctccgcaaattctcactctgttggccaggctagagtgcagcggtgtgatctyggctcactgcaacctctgcctcccaggttcaagtgattctcctgcctcaacctctcaagtagctgggattacaactgcccgccactgggctaagttttgtgtatttagtagaaatggagtagtcaccatgttggccaggctggtcctgaactcctaacctcaagtgatccacctgcctctacctcccaaagtactgggattataggtgtgagccaccgtgccaggcctttttctttttttgagacggaatctcactctgtcaccaagggtggagtgcagtggcacaatctcaactcactg

SEQ ID NO: 42621 - DNA, 601 bp, Human
cgccttctcggttcaagcaattctcctgcctcagcctcccaagtagctgggattacaggcatgcgccaccatgcccggctagttttgtatttttagtagagacagggtttctccatgttggtcaggctgatctggaactcccgacttcaggtgattcgcctgccttggcctcccaaagtgttgggattaccggcgtgagccactgcgcccagctgatttttcttctttcagtatgtccaatgatgttcctgagcccgcttataccttatttttttttttttgagatggagttttgctcttrttgcccaggctggagtgcaatgaggtgatctcggctcaccgcaacctccacctcccaggttcaagcaattctcctgcctcagcctcctgagtagctgggattacaggcatgcaccaccacgcccgcctaattttgtattttttttagtagagacggggtttctccatgttgaggctagtctctaactcccgacctcaggtgatccgcctgcctcggcctcccaaagtgctgggattacaggtgtgagccaccgtgcccggcctataccttattttcatcaaataaaatatatgaccttaa

SEQ ID NO: 42622 - DNA, 601 bp, Human
agggcaaaactccatcttaaaaaataaataaactaattaatttaaaaaaatatttttcttccttttttttttgagacggagtttcgctcttgttgcccaggctggagtgcaatggtgcaatcttggctcaccgcaacctccgccttctcggttcaagcaattctcctgcctcagcctcccaagtagctgggattacaggcatgcgccaccatgcccggctagttttgtatttttagtagagacagggtttctccatgttggtcaggctgatctggaactcccgacttcaggtgattcgccygccttggcctcccaaagtgttgggattaccggcgtgagccactgcgcccagctgatttttcttctttcagtatgtccaatgatgttcctgagcccgcttataccttatttttttttttttgagatggagttttgctcttgttgcccaggctggagtgcaatgaggtgatctcggctcaccgcaacctccacctcccaggttcaagcaattctcctgcctcagcctcctgagtagctgggattacaggcatgcaccaccacgcccgcctaattttgtattttttttagtagagacggggtt

SEQ ID NO: 42623 - DNA, 601 bp, Human
gacagggcaaaactccatcttaaaaaataaataaactaattaatttaaaaaaatatttttcttccttttttttttgagacggagtttcgctcttgttgcccaggctggagtgcaatggtgcaatcttggctcaccgcaacctccgccttctcggttcaagcaattctcctgcctcagcctcccaagtagctgggattacaggcatgcgccaccatgcccggctagttttgtatttttagtagagacagggtttctccatgttggtcaggctgatctggaactcccgacttcaggtgattcrcctgccttggcctcccaaagtgttgggattaccggcgtgagccactgcgcccagctgatttttcttctttcagtatgtccaatgatgttcctgagcccgcttataccttatttttttttttttgagatggagttttgctcttgttgcccaggctggagtgcaatgaggtgatctcggctcaccgcaacctccacctcccaggttcaagcaattctcctgcctcagcctcctgagtagctgggattacaggcatgcaccaccacgcccgcctaattttgtattttttttagtagagacggg

SEQ ID NO: 42624 - DNA, 601 bp, Human; identical to SEQ ID NO: 42592

SEQ ID NO: 42625 - DNA, 601 bp, Human; identical to SEQ ID NO: 42593

SEQ ID NO: 42626 - DNA, 601 bp, Human; identical to SEQ ID NO: 42594

SEQ ID NO: 42627 - DNA, 601 bp, Human; identical to SEQ ID NO: 42595

SEQ ID NO: 42628 - DNA, 601 bp, Human; identical to SEQ ID NO: 42596

SEQ ID NO: 42629 - DNA, 601 bp, Human; identical to SEQ ID NO: 42597

SEQ ID NO: 42630 - DNA, 601 bp, Human; identical to SEQ ID NO: 42598

SEQ ID NO: 42631 - DNA, 601 bp, Human; identical to SEQ ID NO: 42599

SEQ ID NO: 42632 - DNA, 601 bp, Human; identical to SEQ ID NO: 42600

SEQ ID NO: 42633 - DNA, 601 bp, Human; identical to SEQ ID NO: 42601

SEQ ID NO: 42634 - DNA, 601 bp, Human; identical to SEQ ID NO: 42602

SEQ ID NO: 42635 - DNA, 601 bp, Human; identical to SEQ ID NO: 42603

SEQ ID NO: 42636 - DNA, 601 bp, Human; identical to SEQ ID NO: 42604

SEQ ID NO: 42637 - DNA, 601 bp, Human; identical to SEQ ID NO: 42605

SEQ ID NO: 42638 - DNA, 601 bp, Human; identical to SEQ ID NO: 42606

SEQ ID NO: 42639 - DNA, 601 bp, Human; identical to SEQ ID NO: 42607

SEQ ID NO: 42640 - DNA, 601 bp, Human; identical to SEQ ID NO: 42608

SEQ ID NO: 42641 - DNA, 601 bp, Human; identical to SEQ ID NO: 42609

SEQ ID NO: 42642 - DNA, 601 bp, Human; identical to SEQ ID NO: 42610

SEQ ID NO: 42643 - DNA, 601 bp, Human; identical to SEQ ID NO: 42611

SEQ ID NO: 42644 - DNA, 601 bp, Human; identical to SEQ ID NO: 42612

SEQ ID NO: 42645 - DNA, 601 bp, Human; identical to SEQ ID NO: 42613

SEQ ID NO: 42646 - DNA, 601 bp, Human; identical to SEQ ID NO: 42614

SEQ ID NO: 42647 - DNA, 601 bp, Human; identical to SEQ ID NO: 42615

SEQ ID NO: 42648 - DNA, 601 bp, Human; identical to SEQ ID NO: 42616

SEQ ID NO: 42649 - DNA, 601 bp, Human; identical to SEQ ID NO: 42617

SEQ ID NO: 42650 - DNA, 601 bp, Human; identical to SEQ ID NO: 42618

SEQ ID NO: 42651 - DNA, 601 bp, Human; identical to SEQ ID NO: 42619

SEQ ID NO: 42652 - DNA, 601 bp, Human; identical to SEQ ID NO: 42620

SEQ ID NO: 42653 - DNA, 601 bp, Human; identical to SEQ ID NO: 42621

SEQ ID NO: 42654 - DNA, 601 bp, Human; identical to SEQ ID NO: 42622

SEQ ID NO: 42655 - DNA, 601 bp, Human; identical to SEQ ID NO: 42623

SEQ ID NO: 42656 - DNA, 601 bp, Human; identical to SEQ ID NO: 42592

SEQ ID NO: 42657 - DNA, 601 bp, Human; identical to SEQ ID NO: 42593

SEQ ID NO: 42658 - DNA, 601 bp, Human; identical to SEQ ID NO: 42594

SEQ ID NO: 42659 - DNA, 601 bp, Human; identical to SEQ ID NO: 42595

SEQ ID NO: 42660 - DNA, 601 bp, Human; identical to SEQ ID NO: 42596

SEQ ID NO: 42661 - DNA, 601 bp, Human; identical to SEQ ID NO: 42597

SEQ ID NO: 42662 - DNA, 601 bp, Human; identical to SEQ ID NO: 42598

SEQ ID NO: 42663 - DNA, 601 bp, Human; identical to SEQ ID NO: 42599

SEQ ID NO: 42664 - DNA, 601 bp, Human; identical to SEQ ID NO: 42600

SEQ ID NO: 42665 - DNA, 601 bp, Human; identical to SEQ ID NO: 42601

SEQ ID NO: 42666 - DNA, 601 bp, Human; identical to SEQ ID NO: 42602

SEQ ID NO: 42667 - DNA, 601 bp, Human; identical to SEQ ID NO: 42603

SEQ ID NO: 42668 - DNA, 601 bp, Human; identical to SEQ ID NO: 42604

SEQ ID NO: 42669 - DNA, 601 bp, Human; identical to SEQ ID NO: 42605

SEQ ID NO: 42670 - DNA, 601 bp, Human; identical to SEQ ID NO: 42606

SEQ ID NO: 42671 - DNA, 601 bp, Human; identical to SEQ ID NO: 42607

SEQ ID NO: 42672 - DNA, 601 bp, Human; identical to SEQ ID NO: 42608

SEQ ID NO: 42673 - DNA, 601 bp, Human; identical to SEQ ID NO: 42609

SEQ ID NO: 42674 - DNA, 601 bp, Human; identical to SEQ ID NO: 42610

SEQ ID NO: 42675 - DNA, 601 bp, Human; identical to SEQ ID NO: 42611

SEQ ID NO: 42676 - DNA, 601 bp, Human; identical to SEQ ID NO: 42612

SEQ ID NO: 42677 - DNA, 601 bp, Human; identical to SEQ ID NO: 42613

SEQ ID NO: 42678 - DNA, 601 bp, Human; identical to SEQ ID NO: 42614

SEQ ID NO: 42679 - DNA, 601 bp, Human; identical to SEQ ID NO: 42615

SEQ ID NO: 42680 - DNA, 601 bp, Human; identical to SEQ ID NO: 42616

SEQ ID NO: 42681 - DNA, 601 bp, Human; identical to SEQ ID NO: 42617

SEQ ID NO: 42682 - DNA, 601 bp, Human; identical to SEQ ID NO: 42618

SEQ ID NO: 42683 - DNA, 601 bp, Human; identical to SEQ ID NO: 42619

SEQ ID NO: 42684 - DNA, 601 bp, Human; identical to SEQ ID NO: 42620

SEQ ID NO: 42685 - DNA, 601 bp, Human; identical to SEQ ID NO: 42621

SEQ ID NO: 42686 - DNA, 601 bp, Human; identical to SEQ ID NO: 42622

SEQ ID NO: 42687 - DNA, 601 bp, Human; identical to SEQ ID NO: 42623

SEQ ID NO: 42688 - DNA, 601 bp, Human; identical to SEQ ID NO: 42592

SEQ ID NO: 42689 - DNA, 601 bp, Human; identical to SEQ ID NO: 42593

SEQ ID NO: 42690 - DNA, 601 bp, Human; identical to SEQ ID NO: 42594

SEQ ID NO: 42691 - DNA, 601 bp, Human; identical to SEQ ID NO: 42595

SEQ ID NO: 42692 - DNA, 601 bp, Human; identical to SEQ ID NO: 42596

SEQ ID NO: 42693 - DNA, 601 bp, Human; identical to SEQ ID NO: 42597

SEQ ID NO: 42694 - DNA, 601 bp, Human; identical to SEQ ID NO: 42598

SEQ ID NO: 42695 - DNA, 601 bp, Human; identical to SEQ ID NO: 42599

SEQ ID NO: 42696 - DNA, 601 bp, Human; identical to SEQ ID NO: 42600

SEQ ID NO: 42697 - DNA, 601 bp, Human; identical to SEQ ID NO: 42601

SEQ ID NO: 42698 - DNA, 601 bp, Human; identical to SEQ ID NO: 42602

SEQ ID NO: 42699 - DNA, 601 bp, Human; identical to SEQ ID NO: 42603

SEQ ID NO: 42700 - DNA, 601 bp, Human; identical to SEQ ID NO: 42604

SEQ ID NO: 42701 - DNA, 601 bp, Human; identical to SEQ ID NO: 42605

SEQ ID NO: 42702 - DNA, 601 bp, Human; identical to SEQ ID NO: 42606

SEQ ID NO: 42703 - DNA, 601 bp, Human; identical to SEQ ID NO: 42607

SEQ ID NO: 42704 - DNA, 601 bp, Human; identical to SEQ ID NO: 42608

SEQ ID NO: 42705 - DNA, 601 bp, Human; identical to SEQ ID NO: 42609

SEQ ID NO: 42706 - DNA, 601 bp, Human; identical to SEQ ID NO: 42610

SEQ ID NO: 42707 - DNA, 601 bp, Human; identical to SEQ ID NO: 42611

SEQ ID NO: 42708 - DNA, 601 bp, Human; identical to SEQ ID NO: 42612

SEQ ID NO: 42709 - DNA, 601 bp, Human; identical to SEQ ID NO: 42613

SEQ ID NO: 42710 - DNA, 601 bp, Human; identical to SEQ ID NO: 42614

SEQ ID NO: 42711 - DNA, 601 bp, Human; identical to SEQ ID NO: 42615

SEQ ID NO: 42712 - DNA, 601 bp, Human; identical to SEQ ID NO: 42616

SEQ ID NO: 42713 - DNA, 601 bp, Human; identical to SEQ ID NO: 42617

SEQ ID NO: 42714 - DNA, 601 bp, Human; identical to SEQ ID NO: 42618

SEQ ID NO: 42715 - DNA, 601 bp, Human; identical to SEQ ID NO: 42619

SEQ ID NO: 42716 - DNA, 601 bp, Human; identical to SEQ ID NO: 42620

SEQ ID NO: 42717 - DNA, 601 bp, Human; identical to SEQ ID NO: 42621

SEQ ID NO: 42718 - DNA, 601 bp, Human; identical to SEQ ID NO: 42622

SEQ ID NO: 42719 - DNA, 601 bp, Human; identical to SEQ ID NO: 42623

SEQ ID NO: 42720 - DNA, 601 bp, Human; identical to SEQ ID NO: 42592

SEQ ID NO: 42721 - DNA, 601 bp, Human; identical to SEQ ID NO: 42593

SEQ ID NO: 42722 - DNA, 601 bp, Human; identical to SEQ ID NO: 42594

SEQ ID NO: 42723 - DNA, 601 bp, Human; identical to SEQ ID NO: 42595

SEQ ID NO: 42724 - DNA, 601 bp, Human; identical to SEQ ID NO: 42596

SEQ ID NO: 42725 - DNA, 601 bp, Human; identical to SEQ ID NO: 42597

SEQ ID NO: 42726 - DNA, 601 bp, Human; identical to SEQ ID NO: 42598

SEQ ID NO: 42727 - DNA, 601 bp, Human; identical to SEQ ID NO: 42599

SEQ ID NO: 42728 - DNA, 601 bp, Human; identical to SEQ ID NO: 42600

SEQ ID NO: 42729 - DNA, 601 bp, Human; identical to SEQ ID NO: 42601

SEQ ID NO: 42730 - DNA, 601 bp, Human; identical to SEQ ID NO: 42602

SEQ ID NO: 42731 - DNA, 601 bp, Human; identical to SEQ ID NO: 42603

SEQ ID NO: 42732 - DNA, 601 bp, Human; identical to SEQ ID NO: 42604

SEQ ID NO: 42733 - DNA, 601 bp, Human; identical to SEQ ID NO: 42605

SEQ ID NO: 42734 - DNA, 601 bp, Human; identical to SEQ ID NO: 42606

SEQ ID NO: 42735 - DNA, 601 bp, Human; identical to SEQ ID NO: 42607

SEQ ID NO: 42736 - DNA, 601 bp, Human; identical to SEQ ID NO: 42608

SEQ ID NO: 42737 - DNA, 601 bp, Human; identical to SEQ ID NO: 42609

SEQ ID NO: 42738 - DNA, 601 bp, Human; identical to SEQ ID NO: 42610

SEQ ID NO: 42739 - DNA, 601 bp, Human; identical to SEQ ID NO: 42611

SEQ ID NO: 42740 - DNA, 601 bp, Human; identical to SEQ ID NO: 42612

SEQ ID NO: 42741 - DNA, 601 bp, Human; identical to SEQ ID NO: 42613

SEQ ID NO: 42742 - DNA, 601 bp, Human; identical to SEQ ID NO: 42614

SEQ ID NO: 42743 - DNA, 601 bp, Human; identical to SEQ ID NO: 42615

SEQ ID NO: 42744 - DNA, 601 bp, Human; identical to SEQ ID NO: 42616

SEQ ID NO: 42745 - DNA, 601 bp, Human; identical to SEQ ID NO: 42617

SEQ ID NO: 42746 - DNA, 601 bp, Human; identical to SEQ ID NO: 42618

SEQ ID NO: 42747 - DNA, 601 bp, Human; identical to SEQ ID NO: 42619

SEQ ID NO: 42748 - DNA, 601 bp, Human; identical to SEQ ID NO: 42620

SEQ ID NO: 42749 - DNA, 601 bp, Human; identical to SEQ ID NO: 42621

SEQ ID NO: 42750 - DNA, 601 bp, Human; identical to SEQ ID NO: 42622

SEQ ID NO: 42751 - DNA, 601 bp, Human; identical to SEQ ID NO: 42623

SEQ ID NO: 42752 - DNA, 601 bp, Human; identical to SEQ ID NO: 42592

SEQ ID NO: 42753 - DNA, 601 bp, Human; identical to SEQ ID NO: 42593

SEQ ID NO: 42754 - DNA, 601 bp, Human; identical to SEQ ID NO: 42594

SEQ ID NO: 42755 - DNA, 601 bp, Human; identical to SEQ ID NO: 42595

SEQ ID NO: 42756 - DNA, 601 bp, Human; identical to SEQ ID NO: 42596

SEQ ID NO: 42757 - DNA, 601 bp, Human; identical to SEQ ID NO: 42597

SEQ ID NO: 42758 - DNA, 601 bp, Human; identical to SEQ ID NO: 42598

SEQ ID NO: 42759 - DNA, 601 bp, Human; identical to SEQ ID NO: 42599

SEQ ID NO: 42760 - DNA, 601 bp, Human; identical to SEQ ID NO: 42600

SEQ ID NO: 42761 - DNA, 601 bp, Human; identical to SEQ ID NO: 42601

SEQ ID NO: 42762 - DNA, 601 bp, Human; identical to SEQ ID NO: 42602

SEQ ID NO: 42763 - DNA, 601 bp, Human; identical to SEQ ID NO: 42603

SEQ ID NO: 42764 - DNA, 601 bp, Human; identical to SEQ ID NO: 42604

SEQ ID NO: 42765 - DNA, 601 bp, Human; identical to SEQ ID NO: 42605

SEQ ID NO: 42766 - DNA, 601 bp, Human; identical to SEQ ID NO: 42606

SEQ ID NO: 42767 - DNA, 601 bp, Human; identical to SEQ ID NO: 42607

SEQ ID NO: 42768 - DNA, 601 bp, Human; identical to SEQ ID NO: 42608

SEQ ID NO: 42769 - DNA, 601 bp, Human; identical to SEQ ID NO: 42609

SEQ ID NO: 42770 - DNA, 601 bp, Human; identical to SEQ ID NO: 42610

SEQ ID NO: 42771 - DNA, 601 bp, Human; identical to SEQ ID NO: 42611

SEQ ID NO: 42772 - DNA, 601 bp, Human; identical to SEQ ID NO: 42612

SEQ ID NO: 42773 - DNA, 601 bp, Human; identical to SEQ ID NO: 42613

SEQ ID NO: 42774 - DNA, 601 bp, Human; identical to SEQ ID NO: 42614

SEQ ID NO: 42775 - DNA, 601 bp, Human; identical to SEQ ID NO: 42615

SEQ ID NO: 42776 - DNA, 601 bp, Human; identical to SEQ ID NO: 42616

SEQ ID NO: 42777 - DNA, 601 bp, Human; identical to SEQ ID NO: 42617

SEQ ID NO: 42778 - DNA, 601 bp, Human; identical to SEQ ID NO: 42618

SEQ ID NO: 42779 - DNA, 601 bp, Human; identical to SEQ ID NO: 42619

SEQ ID NO: 42780 - DNA, 601 bp, Human; identical to SEQ ID NO: 42620

SEQ ID NO: 42781 - DNA, 601 bp, Human; identical to SEQ ID NO: 42621

SEQ ID NO: 42782 - DNA, 601 bp, Human; identical to SEQ ID NO: 42622

SEQ ID NO: 42783 - DNA, 601 bp, Human; identical to SEQ ID NO: 42623

SEQ ID NO: 42784 - DNA, 601 bp, Human
atcgcgccattgcactccagcctgggtcacaagagcgaaactccgtctcggaaaaaaaaaaaaaaaaaaatcaaatacaagattgggagcaacttaacctctccaaaatcgtttaatatgactacgcttgaaaataaatatggagaagtggggtaggttgcagaaatatgaaatactgaagacagaaaatagggactaaaagtgaccctgtatcccaccggagactaagttagcacagtatttaacaagcaacagtttgtgaggacaaggctaaggggtggcctgtcacatctccgtcctsaggaggacgctgaatagagggaagataaaacagaatggatttcaactggacataaggaacttctgtagccaaaaaaaaaaaaaaaaaagtgataaaactagccctgctcaccaaagactagagctaccatttcgacatttgaaaagggtaaatcagtcaagatctttaggtcattctcttgggttgaaatcaggtagccgaggtacttgttgcctataacgtgattattcagggactactatttccaaatagttgccaataagtacttacttgactgactagggaaggctcacccaagag

SEQ ID NO: 42785 - DNA, 601 bp, Human
ttccaaaccacaaagctgtttcattttccccctatgatctttcacatgcctgtgatcccatccctcttattaactgtatgtaagaggcttatatatgacaaccagcttttaattatggtctaatggtaaactaggttaccaaagctctctgtacaggtaaaatcccagtgaaagatgtaccaggctgaagacagtttacgtaacactaccattttaacttaagttgagttacttcctatcgcgggactactccgttgtggtagaaataacggaatgtcagggagctggtacttttggccaycacggcaacagttaatacaaagcactccctgaaagccagactcccagagttataggtgacgtgtccttaaaagctttaacattgtaaataccaggaaaagtacaggggactggcagggagaattgtatagactacctgagaattatattttacctattggtagttctgacaacactcaaaaaaaaagaaaaaaagaaaacggaaagccaagtagtgggctgggtgcagtgactcatgcctgtaatcccagcacttagggaggccgaggcaggtggatcacgaggtcaggagttcaagacc

SEQ ID NO: 42786 - DNA, 601 bp, Human
accagcttgggcaacaaagcaaggttcccacctctacaaaaaaataaaaaaactagctgggtgtgatggcgcacacctgcagtcctagctactcgggaagctgaggcaggaggatcacttgagtccaggaggttgacactgcagtgagccatgatagctccactgcactccagcctgggcaacagagcaagaccctgcctcagaaaagtaaataaataaaaaataatagccaaaaaaaaaaagaaagaaaagaaaccacccacatatccaattgacaaatgcatagaaaaaatgtggtatrctcacatgacagaatattagtcagcactaaacaggaagaagcgacatatgctacaacatgaacgaaccttgaaaacattatactaagtaaaagacgccagccccagaagaccacatatgtatgttcttatttatatgaaatgtccagagtaagtaaattcatagaaacagaaagattagtggttgccaggggctgacagggaagcaggatggagagtgactgctaatgagtacagagtttctttttggggtgatgaagtacagagagatataacccatatggacagcaaaataacatttg

SEQ ID NO: 42787 - DNA, 601 bp, Human
tttgaaggacaccatcgagaaggtaaaaggacaacccacagacaggagaaattatttgcaaatcctatgataccacttcacacccaataggatggctaaaatgaaaaaggcagtgtaacaattgttgacgagaatgtggagaaaattaaaccctcatacattgctgatgggaatataaaattgtgcagctgttctggaaaaaatctgacagttcttcaaaatattaagcacagagttaaccataatgacccagcaattccactcctaggaatgtacccaagagaaatgaaaacatgtctayataaaagcttgtacaggaatgttcaaaacattattattcatagtagccagaaagtagagctccaagtggtgtctcacacctgtaatcccaacactgggagactgagaccagaggattgcttgaggtcaagagttcaagaccagcttgggcaacaaagcaaggttcccacctctacaaaaaaataaaaaaactagctgggtgtgatggcgcacacctgcagtcctagctactcgggaagctgaggcaggaggatcacttgagtccaggaggttgacactgcagtgagccatgatagctcca

SEQ ID NO: 42788 - DNA, 601 bp, Human
taaccacaaatagatcacagatctaatgtaagagttaacaggataaaatatctagaagaaaatatagtagtaaatctatatgaccttggattaggcaatggcttctaagatgtgacaccaaaagcataagtggcaggagaaaaatagatatatcggccttcaaattaaaaactttctgctttgaaggacaccatcgagaaggtaaaaggacaacccacagacaggagaaattatttgcaaatcctatgataccacttcacacccaataggatggctaaaatgaaaaaggcagtgtaacaaktgttgacgagaatgtggagaaaattaaaccctcatacattgctgatgggaatataaaattgtgcagctgttctggaaaaaatctgacagttcttcaaaatattaagcacagagttaaccataatgacccagcaattccactcctaggaatgtacccaagagaaatgaaaacatgtctacataaaagcttgtacaggaatgttcaaaacattattattcatagtagccagaaagtagagctccaagtggtgtctcacacctgtaatcccaacactgggagactgagaccagaggattgctt

SEQ ID NO: 42789 - DNA, 601 bp, Human
aactggccacttttatcatggaatgccttttttacttgcaagaatgatgacaaactatcattattgcaaatgtgaatagctggcagacattttcttggaaattaaagaaacaaaacagtcaattcaagtaaaaactggtagcatgttgccaaggaaattatttgaactcaaggaggaaattagaattttggaaaacttgcaccactcatagcgaacagtgttctaaaacttaagactttgcagagattggtggtgatattaacaaatgtgatttttaaaaatgcttgtataataaaatgtrtcaacatgtggaagatctgcgtaacgatgaacaaatattttccaaatgaccagtaacgctacaaaaccaggcatggtagaagatccattccaagtataaagcagacctgcggagttgggcaaattcatcaatatgatttcagattgcatagtgtaactattctttgcaaactatcacttatgaagtttcggtatcaaagaatattcaactacctgaaaaactattcaagtactccttacttcattaaaataacgttaagggaatgaattcaggagcagagatgagaatccagctgttaag

SEQ ID NO: 42790 - DNA, 601 bp, Human
tttaaaaactatattattagtatatgggtctctggtatcctgctactctttgcaattttcactactctctgggagcctcgccatcaccaggtccaaacacaactcatccaaaaatgcaacacaatcagaggccaaaccaataggcacacagatatcataactctcctgatgttctctggcctccctcgtgcttccttccattctaaccacgccaagttctttcctgccttgccatctttgtctctcacaacgctacagggcctctcctaggaggctcttctaacactgtgggaaccatatygctgtgaacagcatttaggatgcagtcactgtcaattcgattttgcacagcagtgaacaagatcctagcttacaacagtttaatggttctcaaagggtggtctgtggacctctaaggggtttaccaaaatcttttcaggggtctcatgaggtcaaaacgatattcatagcaatattaagttatcatttgccttttccacaaagttcccatttgtactaagggtgcaaaagcaatggtagggaaaactgctagctcggcaccccttggcatgaatcaaaaacagtagttacaaactgagtg

SEQ ID NO: 42791 - DNA, 601 bp, Human
cattctcacagttagcaagaatgacgtgacgaagatagaccgtgagtactgtatcaatgttaagatttcatttggtacttcagaataaattagaactaagaatgaaggttccttcaagtatgatccctaaagatttcataatactctcacttgcacaatcatgtgcaagttcagttctgatttattcaagtaactaagaacaatccagccatggacactattacagttgtttgcgaacttgttattctgaatcttcacccaagaaaagcattgtgcatctctgaccttccacaatcacagrtagaggtggcagtgtctcattctgtgataaagttgctatttttacttgtgtactcctccccaccttcatcctgatactcgtatttaaaaactatattattagtatatgggtctctggtatcctgctactctttgcaattttcactactctctgggagcctcgccatcaccaggtccaaacacaactcatccaaaaatgcaacacaatcagaggccaaaccaataggcacacagatatcataactctcctgatgttctctggcctccctcgtgcttccttccattctaaccacgccaagtt

SEQ ID NO: 42792 - DNA, 601 bp, Human
gtcttagaaaagcatttcatctcataaaactgtattaactgtaaaagcccatatttgcatccccattcacaaattatgtactatgccatcaggtagttattaacattcaactctcaatcctgcaaaaggtgggatggtgtatcttgctaaaacaccaacttctctttcaaatgtccatgaggagtccttctgcaaacatgtaagcacaacaaaaagagaaatgcgggagagaaagactcaattctactacagataagacgcaaaccaagcaagcatgacacttcggagtgaattctatcamtatctttaaactgccctgctttcttaacttgcccataagagcacaacgtaaaggcttttctagcacttcctgttctaaactaataccagtttagatttaaagctccaatcctacaggaactccttttttttttttaataaccagaagcccaacatatattgaagaaaattaaaatactaaaatagtattccagaacctttaaaatgttagatttctttttttttttttgagatggagtcttgctctgtcgcccagtggcgcgatctcgactcactgcaacctcccccttcgggttcaagt

SEQ ID NO: 42793 - DNA, 601 bp, Human
tggcacacacccatagtcccagctgctcgggaggctgaggcgggaggatccttgaggctggaaggttgaagctgcagtgtgccgagatcgcgacattgcactgcagcctggatgacacagtgagactccgtctcaaaaaataaaaaataaaaaaaaaaataaagctagcaaaataggcagacacatttatatctaagacacagaagtcttagaaaagcatttcatctcataaaactgtattaactgtaaaagcccatatttgcatccccattcacaaattatgtactatgccatcaggtarttattaacattcaactctcaatcctgcaaaaggtgggatggtgtatcttgctaaaacaccaacttctctttcaaatgtccatgaggagtccttctgcaaacatgtaagcacaacaaaaagagaaatgcgggagagaaagactcaattctactacagataagacgcaaaccaagcaagcatgacacttcggagtgaattctatcactatctttaaactgccctgctttcttaacttgcccataagagcacaacgtaaaggcttttctagcacttcctgttctaaactaataccagtttaga

SEQ ID NO: 42794 - DNA, 601 bp, Human
ccagcaaaccctcagaaccctacttgtaggcacagccacctgtcttcgggaccatgggaactgtgccctgtgtgggtggtcgctagggcctctgtggccagaaagcaaggaaagtgtgtggatctggcaggtgcataaataaatctggtccaccccttaaacttgctcctgttccatcatttctgattttagccaatggcaacatgacctactcaggcactcacatgagaaatctgaaggctacttcacagcttccacattggtcttgcccattctccctctaaggaaatctcccatgtgygtcctcttcatctcatctactctgcgccttggctggtcttcccatttctactcccttaccacccctcccacttcacagaacagcaggaggatggaagccaggatcagcacactacagaccaggggccaaatttggcctacagcctgttttggttttgtacagtctatgagctaaaaatgtttttttcatctttaagtggttggaaaaagaaacagtatttcatgatactgaaaatcagatgaagttcaagtgttatatccataaataaagttttactagcacacagccacacccactcgt

SEQ ID NO: 42795 - DNA, 601 bp, Human
ggatcatattatttgtataaatttagctccctaaatttgtgctccagaaatacttccatagaagtctaaaaaaattggaaggtaggctcattttgtgtacagctcaattttttaggacactgctcatacagaaacatggttagattaagaaagcaatttattattataaaacatattcacacatttttgtagcactcttatgcagaatgaaaagatctagagaaagagtccaactccccctcccagcaagcaggaatgacaaacatccttgtagtaagacactgcctgcctgagtgggcarcgtgagcgtgtggggccacccgggcccagcaacctcatttgtctctggggcaacaatcctgcggtgtgagggtatgcttggtcaaatccttgggtgacacaaggacccagggccagcaaaccctcagaaccctacttgtaggcacagccacctgtcttcgggaccatgggaactgtgccctgtgtgggtggtcgctagggcctctgtggccagaaagcaaggaaagtgtgtggatctggcaggtgcataaataaatctggtccaccccttaaacttgctcctgttccatcatttctgatt

SEQ ID NO: 42796 - DNA, 601 bp, Human
ttcttaaaatctgcgctgacctcattatcaacaccaattcactcctcacagtatctgggctgtctaatatggcagccagtagccatacatggacagtaagtacctgaaatgtgctcagttccgactgagatgtgtcacagtgtaagtatgacaaatgtacaaatatcaacaatatccatcacatgttgaaataacattttggacatactgagctaaattaagtatattaatttcacttatttctttttacttaatatgcctactggaaaaatctaaaattacattaggttatatttttagtttttttttttttttgagacctcagcctcccacttttgtagagacagggtttcgctgtgttgcccaggttgttctggagctcctgagctcaagtggtcctctcaccttgggtcccaaagtgctgggattctaggcgtgagccactgcaccaggccagattgtttccattgggcaaggctgctctgtacccttgtttaagggaataggatcatattatttgtataaatttagctccctaaatttgtgctccagaaatacttccatagaagtctaaaaaaattggaaggtaggctcattttgt

SEQ ID NO: 42797 - DNA, 601 bp, Human
gtccttttccttatctgtaaatggacatcataatggtacctatcctataacgtgctttgtgaggattaaatgaaaatgtataccaaacatctggcatgtagcaagtgctcagcaaatctcattattattaatattagtaatactattagtaactgctcttaggcagaaataatccgcttaggataaaaaaagtattttcggaattatatctaataaattaacctgaaagatgacatacagtaactatttcaactaaagcctcaaaataacacaagcaaaataacaaacatacatatacccytaaagcagaaaattactgtttcatttacccacagctgagtgactgacaccacccatttcatgtgctcatggttctacagtcaacgctgggctcacttttagtttactctttggggggcctttatctggtgggctggtggtgctacacagctgggaaggcggggcattctccctttctctgtgtctcctcctaacatctactgcacatcacttgaggctcccaagaacacaaaagcagaagctgccaacttcttagggcttaaagcctggaactggcacatcaccatctctgctgcattct

SEQ ID NO: 42798 - DNA, 601 bp, Human
agggggctaactagaaacaggcacagggcgctttttgggttgatggattgttctacagcctgattctggatgtagatgactgcagacttgccaaaacctgttgaatgctacctcaaaaaaaaaaaagaaattttctcaaagttttaaatgttatttttcctttctttttacaggtgtgggacctcaagttttttaaaaaatcttcacccttacctcatacataaaaactaactagaaatggatcagagacctaaacataaaagctaaaactacaaaacttctagaatatgaaaaaaaaaamccaaaaaacaaaactttctcaagtccaacagagcttaaaagtgaaaacaaaaaaaaaaacaactttatgatcttcaggtagacagattcctgacacgatacaaaataaacaaaacaaaaaaaaaaacgaaaaagtgaaccgagtttcatcaaacttacaaacttcttctgttctctgaaacacaggaacaacaaaaaagtcacactaggagaaaatattcattaaatacacatctgaaaaaggacttttattcagaatatataattcagtaagaagaatctgataatctaggcaaaagac

SEQ ID NO: 42799 - DNA, 601 bp, Human
gataaaaaccacaaaggggtagggggctaactagaaacaggcacagggcgctttttgggttgatggattgttctacagcctgattctggatgtagatgactgcagacttgccaaaacctgttgaatgctacctcaaaaaaaaaaaagaaattttctcaaagttttaaatgttatttttcctttctttttacaggtgtgggacctcaagttttttaaaaaatcttcacccttacctcatacataaaaactaactagaaatggatcagagacctaaacataaaagctaaaactacaaaacttytagaatatgaaaaaaaaaacccaaaaaacaaaactttctcaagtccaacagagcttaaaagtgaaaacaaaaaaaaaaacaactttatgatcttcaggtagacagattcctgacacgatacaaaataaacaaaacaaaaaaaaaaacgaaaaagtgaaccgagtttcatcaaacttacaaacttcttctgttctctgaaacacaggaacaacaaaaaagtcacactaggagaaaatattcattaaatacacatctgaaaaaggacttttattcagaatatataattcagtaagaagaatc

SEQ ID NO: 42800 - DNA, 601 bp, Human
ggaaaagcgacataactatgttcagaaagtagcagagactgctgtgcagctatttctggggacaaagtgaatgtggctggtctagttttagctggatctgctgactttgaactaagtcaatctgatatgtttgatcagaggttacaatcgaaagttttaaaattagttgatatatcctatggtggtgaaaatggattcaatcaagctactgagttatctactgaagtcctctccgaagtgaaattcattcaagaaaagaaatcaatagaacgatactttgatgaaatcacccaggacacgygaaagtactgttttggcgttgaagatacactaaagactttggaaaagggagctgtagaaattctaatggtctatgaaaatctggatataatgagatatgttctttattgccaaggcacagaaaaggagaaaattctctaactccaaagcaagaaaaggataaatctcatttcacagacaaagagaccggacaggaacatgagcttatcgagagcatgcccctgttggaatggtttgctaacaactataaaaaatttggagctatgttggaaatgatcacagataaaatgcaagacgggtc

SEQ ID NO: 42801 - DNA, 601 bp, Human
gcatattgattaggctcccctttgctctcagtgttacagggaactcttgctggatgctgcagtagttgggtgccacacacttgaccatgaagatgaatgcaccttacagaaaatgatctcagccacttacagctccattttactcacctaaattaaatgtgcccatggggatgcacctgtgcgccctgcagaactataacaccactcacaacaggtgcgtaggtcctggcttgaggaaccttcaaggaaaaggtcaggtaaatagagtttaaagtactggaggcaattaaggaagaggaasagaagcagctctctaactttaggggaaacatcaatgaaagaaatcaaacatcaatgcaacctgcagaatagaactcaatgagtaccactgaattgaaaggatacagtagctgtaatcctagcaattttggagactgggctgaggctggcagatttcttgggcctaggaattcaagaccagcccgggcaacacagtgagacccccccagtctctataaaaaaaatacaaaaaaaaattagcagggtgtggtagtgcacgcccatgctcccaggtacttgggaggctgagatgggaggacca

SEQ ID NO: 42802 - DNA, 601 bp, Human
atgtgtgtttatcctcaaacacaaatcactcatttaatgacataaattactataaatggtttaaaaggcagtatctcaattcctacaattaactgtcaaatactcttcctccaaaccaaaacccaccttaacttttaaaaataaaaattattttaaaaaattcttctgagcttttatcagggaacagcattgtattattttttccaatgataaaatggcacagtgagtttctcagctggtattttcactacagaaggtgtactttcaggggtgttgactcaatcttatacctcatgattaytgcaaaataggcactgtttacagaattattttaagttttcagattaatattgactttgttatcatgcttattctcctaaaaaataacttattagcccggtgtggtggctcatgcctgtaatcccagcactctgggaggctgaggccggtggattgcttgaccccaggagtttgagaccagcctggacaacgtgataaaaccctatctctacaaaaaaaatataaaaattagctgagtgtggtgatgtgtgcatatagtctcagttactcaagaagctgatgtaggaggatcgcttgagcc

SEQ ID NO: 42803 - DNA, 601 bp, Human
atttgtatcacaatgggcatacactatttgacaggctaaattaacatttcacttgaaaacataagtaatcattccggtaacagacaatgtagtctaaccaaaatcacatcgcaggttgacagccaactgttgttttcatgaatagtaaactgggataccagaatttaaaacgtattcctccagggtggaaactggattttcaatcagactggccctaggagaaaggtactgttcattagcagaagtggcactggagaaaaactacgtttcccttgggtctctcctccctggggctctcccrccaaggtgaggtcattaattatttaactaatccagaagggataggaaggctatatttgctaacatgctgttttttgccatttccattaaaaagtgctattattaactagtgttgaaatcttgacaagtcagcattaaatgctaatgaatcttcataaataaaccccaccgctcattttcaagtgttctcagttccagttgtaatttctggctttaaggagtgtcttctggagacgtagttcagatcttttggttaggtttttctagtttgtttgcaaccacaaaaaggcattggtgatct

SEQ ID NO: 42804 - DNA, 601 bp, Human
ttaagaattccacaaatttaaaatgaattgtgttgaaaagaaaccatgttatatatgctagcctgtaaaggagaatttaactcaaaatacagcagaactacttcaggtaacaaaaatagcaagaagaaaactcctctcatgttattgaaactgaaaaattagaaggagtaaaaaaaaaacaaactgttatttacactgaatgctactgcttaaagaaatgaaatttaattagaaagaaagaagggaacaaacttcttaagggcttttgcaaggtacttctaaggactccagtgggcttttyatacccttatgtgggtaggataagggtttgtggggtttttgttttgcttacaaatggaaagaaaggaaagaaagcgatcattttctccctaaagatatgggcaagagttacaaagaaaaaaggaaataatataattaaaaagatttttgcaacattttgtgtagtagaactggactaaaaatagtgaaagaggggctaagtatgatacatgggataagctccccaagcactgggcaaccaggaacccctggatcagacagtcctctgaactggcactggccaagtctcgacaacctgact

SEQ ID NO: 42805 - DNA, 601 bp, Human
aacgaaattaaagcgtagatctccaaaggtcactcttagccatttagatactacaaaagatctcaattttatacaaatgaaatacaaaacacagttcaacagaaattaagaaacaattcaattagtatttattggtacctaatcacaggcttgcctgtgatataggaatacaatagtttaagaattccacaaatttaaaatgaattgtgttgaaaagaaaccatgttatatatgctagcctgtaaaggagaatttaactcaaaatacagcagaactacttcaggtaacaaaaatagcaagragaaaactcctctcatgttattgaaactgaaaaattagaaggagtaaaaaaaaaacaaactgttatttacactgaatgctactgcttaaagaaatgaaatttaattagaaagaaagaagggaacaaacttcttaagggcttttgcaaggtacttctaaggactccagtgggctttttatacccttatgtgggtaggataagggtttgtggggtttttgttttgcttacaaatggaaagaaaggaaagaaagcgatcattttctccctaaagatatgggcaagagttacaaagaaaaaagg

SEQ ID NO: 42806 - DNA, 601 bp, Human
tttaaaaagagtaatccggccaggcaccatggctcacgcctgtaatcccagcactttgggaggctgaggcagacggatcacctgaggtcaggagtttgagaccagcctggccaacatggcgaaatcccgtctctactaaaattaacaaaaattagctgggtgtggtggcgggcacctgtaatcccagctacttgggaggctgagataatagaattgcttgcccccaggaggcagaggctgcagtgggccaagattgcaccactgcactcaagcctgggcgacagagcaagaccctgtgtcaaaaaaaaaaaaagggtaatctgaaaatatgtaacataagtctttatcttaaaaactcctttgaagctagaaatcctatgtcattcagtatgaaaggcctagcagtatctagaaattaagaaatgttatggatttcacaaaatcgccaataattgaacttgtatgttaataaatcaacaactagagccttagcttctcactcttctgctacctaaaatgtctactggaggactttagaacagggtacatgccctgtgaagaaatcgcatgagatgcatagttcagatgactttatcaccag

SEQ ID NO: 42807 - DNA, 601 bp, Human
aaatcctaaattgctttgtatagcaaatattaaggtccaagatgatgattttcttatgttcttattccagtggacagaaaaccgagcttgttcatccagcactcacattaatctgctcctcacacttgcttactattatataatgaccagctagacaaatcataggatgtaatcaggactcctccctgtagatacccagaggttactttcaaatataacatcttgaaaggttactttcaaaaatattcctggagttagtttatcaaccaacaggtttccttctctgctaccagcacactgsaacacaaaggacagccaaatattttaagcgaggggtgagcaaactttttctgtaaagggccagacagtaccagtaaatattttaggctttgtaggccacctggtctctgctcttactattcaacaactctgccattgtacagcatgtaaaggacaacatgtaaaggaacaagcatggctgtgtatcaataaaactttatagaggttaacatttgaatttcatataattttcacatgccagacattattcttctttggacttttatatattatgcttaaatggaaaaacctttcttagctc

SEQ ID NO: 42808 - DNA, 601 bp, Human
atattattctcctacacccctactgttaaagatgacacagtcccagaatttttgctcaccatgacacttcactgaaatgtgtcaccactgagtgtttgctataacagcttgttctaatattataaagtgtaaaataactactaaattatttccagatctacagagcagttttttaaaatcatgaaaccacccacttatttatcttgctagcaacaagttcatgataaccttttcttttctttctaattcattgttatcactgaacaatgtttttctaccaaacagtggaggaaagggtggrcgaagggctcctgccctgtgttaggttatcagaagtgtggtaagtagaatataatgtctgaacatgcctcacgaacttttaatggatacatattcatatttatttctgctcctgcctacagactttaataaacaagtactctgaattcatttttgaggtaaagaagtcttcattattgaactgtaagatgagaaaaaatttaaaatatgaccaaagatgatgttgatagcctcaaaaaagtagggtcatattactctgtttctgagataacatcaagttacataagttggactttcttct

SEQ ID NO: 42809 - DNA, 601 bp, Human
aatgctactaaccacggtcatagaggtttccaaaatttggtgttcacaaagcaagatttgtgttactaaagtgtggtgagggctcttcattcataccctactgagaagtccacacccaggacgcagtgccttgagaatgctgcaacacctaagtgcaacctcccaactttctggaaggcgctttgtcattcactaacagtgctaccttgagatggcagaagtcggaaattgctgctatgcttgctttttagttataaactaccactagcttaatttcagcctatcaatttagtttgtattragttgttagattaacactacagtagataatgaagtacacttgcataagtagtacttctgctttaaaatttccccaaactagaaaatatgtggttttattaatattattctcctacacccctactgttaaagatgacacagtcccagaatttttgctcaccatgacacttcactgaaatgtgtcaccactgagtgtttgctataacagcttgttctaatattataaagtgtaaaataactactaaattatttccagatctacagagcagttttttaaaatcatgaaaccacccacttattt

SEQ ID NO: 42810 - DNA, 601 bp, Human
gtctctcattttaacctcatgtcaaagtggaaagctggctttcttctgacatcactctccttgagcccctttctccctgcctctttgaatcaccagagaatccatttccaacctaaacccctgaaattctcctaagtagactaatagctatttactagtaaatgctactaaccacggtcatagaggtttccaaaatttggtgttcacaaagcaagatttgtgttactaaagtgtggtgagggctcttcattcataccctactgagaagtccacacccaggacgcagtgccttgagaatgcygcaacacctaagtgcaacctcccaactttctggaaggcgctttgtcattcactaacagtgctaccttgagatggcagaagtcggaaattgctgctatgcttgctttttagttataaactaccactagcttaatttcagcctatcaatttagtttgtattgagttgttagattaacactacagtagataatgaagtacacttgcataagtagtacttctgctttaaaatttccccaaactagaaaatatgtggttttattaatattattctcctacacccctactgttaaagatgacacag

SEQ ID NO: 42811 - DNA, 601 bp, Human
aaaatgaaaaagaccttccatcttgctgtcataggaaaactgccagttttttactatagaaaaaagggaggtataataagagataggatagactcggaaataattctactgtctctcattttaacctcatgtcaaagtggaaagctggctttcttctgacatcactctccttgagcccctttctccctgcctctttgaatcaccagagaatccatttccaacctaaacccctgaaattctcctaagtagactaatagctatttactagtaaatgctactaaccacggtcatagaggtttcyaaaatttggtgttcacaaagcaagatttgtgttactaaagtgtggtgagggctcttcattcataccctactgagaagtccacacccaggacgcagtgccttgagaatgctgcaacacctaagtgcaacctcccaactttctggaaggcgctttgtcattcactaacagtgctaccttgagatggcagaagtcggaaattgctgctatgcttgctttttagttataaactaccactagcttaatttcagcctatcaatttagtttgtattgagttgttagattaacactacagtagataat

SEQ ID NO: 42812 - DNA, 601 bp, Human
acaaaaatggaaaaactgctccagcgtggtggctcacgcctgtagtcctagctacttgtgaggctgaggaaagatcattttaagcccaggtattcaaggttacagtgagctatgatcatgccactgcactcctgcctgaaggacagagtgaaagaccttgtcatgtagaataaaataaattataaaataaagcccagagctggggggagaggttgcggctgagaatacacactggtgagtcaatagcaaattgaagagaggggaagattacttgagagcaagtgcagaggaaaggcctgarccagggcaccccatgttgccaagtcaaaaaaatgcagaagattcggccaagaagactgagatgtcattgtacatagtgtataaaagaaaaaaaaaaaaataaacatttgcatctatctttgcatgtaaaaagaatgtaacttgtcctacttgtagcagtaaaatgaaaaagaccttccatcttgctgtcataggaaaactgccagttttttactatagaaaaaagggaggtataataagagataggatagactcggaaataattctactgtctctcattttaacctcatgtcaaagtgga

SEQ ID NO: 42813 - DNA, 601 bp, Human
ttcttgcttcactaaggcatcacactttccttctatgtttacttcaaaatgcaaagcagagggaattcattccaaacccacaggacaggtcatattattctgggtctactccaatttccccagattccagaaaaatagcccccatttaacacagcaaaccagatcacactacactcaccctcctgctactcttatcctttgattataagttgcaagggcgggccaggcatggtggctcatgcctgtcatcctagcactttcagaggccgaggcaggtgaatcacctgaggtcaggagttcragaccagccaggccaatatggcgaaaccccgcctctactaaaaatacaaaattagccgggtgtggtggtgtgcctgtaatcccggctacttgggaggctgtgccaggagaattgctttaactcaggaggcacaggttgtagtgggatagcaccactgccttccagcctgggtgacagagcaagactctgtctcaaaaaaatgttgcaagggcaggagttaggagctgaaatcccagcttctttacattcctcaccctccagtgaagaagggtaaattcagtcttacagaatagtttctag

SEQ ID NO: 42814 - DNA, 601 bp, Human
tgaccttgagcagtaggatataaataactcccacaagcttaacgttccaataatgtaacaccaggcataaataggttaatatagaagaggctacttttttttttttttgatacttcacattcttaccccaaaattcatttagggtatatgttctcaccctaaaattgggcaaaaccaaaatatttcatgcaatctaaaaataatctgtatttaaccatgttcatcatcattcctaggtgggcaattaaaccactattaaaccatagtggtatggatgtaccgacataaactactaagtagwaaatagaacttgctaacaaataccgctatgcagcaattcactgcgtgcaatttcactcctgaaatgtggaagccagtgaacaaatttactatagattacttttaaaagaatttgccccttaatcattttaccctactactaccagtcttaatcctagaaccagcccccgtatgcatccaatttataaagcagctcttggagcagtaaacacctgagtttgttatcatccagttttcaacagaatgaagggtgaaaccacggcaggacatgcctgtgtgccaccatcctgagctgtaaata

SEQ ID NO: 42815 - DNA, 601 bp, Human
aaaggaaaaaaaacaaaacaaaacccaagcttaaaactatatttgcatattcatgtatcaagtatcctagaggcatatactagaaactggtaaatgtggttgctggtgggggtggggggttagatagctagggtaggaacgtcttaagttttactatttacaccttttggcactatttatttttgtaccatgcgcattacacctattttttaaaaattaaactcaattttcaaaaaagcaaatttggttacattataagatggattgtcattgaatcaattttaattattattaattattwttttttttttttgagacagagtttcactcttgttgcccaggctagagggcaatggtgcaatcttgggttactacaacctccgcctcctgggttcaagcaattctcctgcctcggcctcccaagtagctgggattataggcatgtaccaccatgtctggctaattttgtagttttagtagagacagagtttcaccatgttggtcaggctggtttcaaaatcctgacctaaagtgatccacccgccttggcctcccaaagtgcggggattacaggtgtgaatctaagttattaacccattta

SEQ ID NO: 42816 - DNA, 601 bp, Human
acccctcaaataaaaaccataaataaaagacaaactgaaaacaaaactgtgcatctcagatcatatacaaaacgctaattttcttcacatatcaaggggaatctcacatcaacacgcaaagaccaaccacccaatagaaaaaaaatggccaagtacacagacaggataattcatagggggaaaaatacaaacatcttctaacataggaaaaatcaaagcccctcctaagaagaaaagtgcattattaaaagtacactgcatttttaaaagtacactgctttttctcacctatcagattggyaagtaccaaaacgtttgctaacacatagtgctggtgagggtgtagggaaatagacactctcattcactgctggcaagaacatgaactgtaaccctatgatagcccacatccaggaagttttcctatgtgcattattaccctatgtctaaaacaacgtccgggatgttcattaagggactgctgatggtagcaagaccagcaacagtctaactgttgatcagcagttaacttaggatatatatcccaacaactggatattacgcagccttgggggaaaaggaggccataggtattgatatg

SEQ ID NO: 42817 - DNA, 601 bp, Human
tctttagttttataaagcagcgttatgacactttgctttatatacgtattaaagcatacagaaagttctgatgtcagtgcagttttcaacagcacgcgccactgtctggtacgaacgtttcattcttagttgaaactaaattgtcaacataacacatgtcctaagcactattatggaaaaatcacatcatggtaccagaagattaagcagcagtctattatttttgtaaacttatagtatggttataaccactgtttatgacagcccagaattactgccctatggtaaagttctttaaagaaaaaaaaaaaaagaaaagaaaaattaagttttattataaattctttgatataataaataagattaaaaacaaaatcccaaatgattttaatcactagctcagctagagtaggttcaaagttaaaattctgttttccctaaagggaaactgtggaaacatagaaaaaagaagttatgtctaagaagcactgagtaaaaaactaccagttagaaggtataatggaggaaagagcccccagctgatataattctgatttttttttttgagacgtagtttccctcttgttgcccaggctggaat

SEQ ID NO: 42818 - DNA, 601 bp, Human
cgcaacagcacagtagtctttagttttataaagcagcgttatgacactttgctttatatacgtattaaagcatacagaaagttctgatgtcagtgcagttttcaacagcacgcgccactgtctggtacgaacgtttcattcttagttgaaactaaattgtcaacataacacatgtcctaagcactattatggaaaaatcacatcatggtaccagaagattaagcagcagtctattatttttgtaaacttatagtatggttataaccactgtttatgacagcccagaattactgccctatgrtaaagttctttaaagaaaaaaaaaaaaagaaaagaaaaattaagttttattataaattctttgatataataaataagattaaaaacaaaatcccaaatgattttaatcactagctcagctagagtaggttcaaagttaaaattctgttttccctaaagggaaactgtggaaacatagaaaaaagaagttatgtctaagaagcactgagtaaaaaactaccagttagaaggtataatggaggaaagagcccccagctgatataattctgatttttttttttgagacgtagtttccctcttg

SEQ ID NO: 42819 - DNA, 601 bp, Human
tacctattacgcaacagcacagtagtctttagttttataaagcagcgttatgacactttgctttatatacgtattaaagcatacagaaagttctgatgtcagtgcagttttcaacagcacgcgccactgtctggtacgaacgtttcattcttagttgaaactaaattgtcaacataacacatgtcctaagcactattatggaaaaatcacatcatggtaccagaagattaagcagcagtctattatttttgtaaacttatagtatggttataaccactgtttatgacagcccagaattacygccctatggtaaagttctttaaagaaaaaaaaaaaaagaaaagaaaaattaagttttattataaattctttgatataataaataagattaaaaacaaaatcccaaatgattttaatcactagctcagctagagtaggttcaaagttaaaattctgttttccctaaagggaaactgtggaaacatagaaaaaagaagttatgtctaagaagcactgagtaaaaaactaccagttagaaggtataatggaggaaagagcccccagctgatataattctgatttttttttttgagacgtagtt

SEQ ID NO: 42820 - DNA, 601 bp, Human
attattggtacactaaatttgttctggacaaggccttacacgtggcagtatatacattttaaaaatatacaactgaaattaaaaaaatctttgtataaaaatggccaatagttttactatttaaagtgctcttataagtcagtaagaaaatgatcatgtttccaaatactaagtacacagtggttttaagcataaaatccaatccaagcattgctttcagtgacaatataaataaatacattaaacaggaagagagatatccatctatcattgaacatgaaatattataaagccatttacyatttcaaatactaggtaatatggaaaaatatatattacatggtaagtaaaaatataaaaacatggaaaatataaaccataaaacagcattcagagagcaaataaaaggatgttaaaacaatccatgcagactaaaacaaagaccagaaaaaacatataccaagatattaacagtatctatgcttaggtaattagattaagaatgattaccctcactttctatttttcacagttcctcaattttccttaaggaacacataattctggtacttggttttgattcaggtgtaaactttctcgg

SEQ ID NO: 42821 - DNA, 601 bp, Human
gttcaagagattctcctgcctcagcctcccgagcagctgggattacaggcacccgccaccacacccgggtaatttttgtatttttagtagagatgaggtttcaccatgttggccaggctggtctcgaactcctgacctcaaatgatctgcccacttcggcctcccaaagtattgggattacaggtgtgggccactgcgcctggcccttaactaatgttttaaagtaagtaacccggctgcctcagataggagagatctactcctatatcaatatacccaatttacaggcgacaaaggtackgtgaagtaacttgtccaaagttgttagtggggataaatgaaaacccaaatctcacatctctcaactgcaggtttcttttttccatttctagaaattatgaaataggatgtattttcgctttatttactcagaaagagcaattctacaggggttttatgatataaaggaataatgtgagacttctgttttatttcacaaacaatgaaaatggttattatttagatagaggttaaattcaataaaaaggattagacaattctgatcaacaaactggttgattcagaaagttttactgacata

SEQ ID NO: 42822 - DNA, 601 bp, Human
gccagcaaggaactaagaagctcagtccaacaacttgcaagaaactcaaccctgtcaagagccacgtgaacacgctgggaaacatcttcccccaggcaagccttcagatgggactgcagcccctgctgatacccacactgtggctctgagagactgaagcagaggacacagctaggccacacccagattcctgacccacaaaaactgtgagatcataaatgtgtactgttctaagtggctaaatttcttgagatcactgattttctgaatcaaactggttgattcggaaagttttactgaygtatttcttggatattcataaatatttgtgtattcagcatacagatttctaaaaaacaaaacaccactcttctcatactccctcatgtctcaaatttgagaatgctgattaaactacgagctactagaaaaaaaaggcattatttaaaacagccccatttgttcccaaacccacttatgccagttaaattcatcatagtcataatttatgttgcaaacttttgaagtatgtgtagacagagttttgtttgtctgaaaactagaagttgaatactgtgagttgatctactaaaaacggtgc

SEQ ID NO: 42823 - DNA, 601 bp, Human
cagcatggtcacagacatcctatctcgcatgtgtgtcgttttactgtttgtctcccacaccagaaataataggtccgcaagggcagggatttgtctgctttgttcatgattgcatcacaagcttcagaataagttagcttgttgaatgaattacacactgtgctattttaaacgatgtgtgctgtcatttgataaaaacaaaaatgaaatttaacccccctacaagctcgctgtgggtcaacaaatgggatatgggtgtcctaaggacctgcggttgcattacagaaccacggtttcctcygcatgctgtatttgcctatctttaaaagtgtcgccacttgggcaaaaatacagtaccctgtcacgtgagaaacagctgaaagaactaggactgtgtggcaggcagcttggagccggctcccagatctcctgctctcctagtggccacactgtgtgtcatctccctgcatggacctagtgacgtgcgtctaatgaacagaatatggcaaaggtgatggaatgtcccttttgcggttaggttataaaagacagtggcttgtcatgcaggaaattccctggctctcttgtgcacctgccccaa

SEQ ID NO: 42824 - DNA, 601 bp, Human
ctttttagaatttgctttatgcaaagtggcagataacctaaaggtagtttcctataaagtttgctctctcttttctagaggaatgtgagatttctattccacttttgcttctgctgcacacgaccataacacctctgaacggataaaaatgctacagctaaaaatattcttgacatcagaacaataattaaaatgatacttcagtgactaaatcatcttagatttgactttataaaagctacatacctttccatatgcaggtctttcttattcccaaccaacataataggtattctatttrtaagaaaaaaaagacaaaccagtaagtgccagattgtattgctcagaagatactattaaaagaagtttctctaacaagcagataaaatggtactacttactgtactttccccaccatatccaacaatttgccatggataactttaatcacttcaaaactataaaacaaaaagtataaattagacatccattttaatgttgaagtttttaaatgtatgttatgttgccagctggaaaaatgtaaaatgtcacagactcaccattttaacataacataaaatgaacacaaagaactcctgtt

SEQ ID NO: 42825 - DNA, 601 bp, Human
tccctccatatcccaacacaggacaaagccaatttgactatcacaggatacttgggctgacggataacccactgtgctaaacattatgaaggatatttatataaatgatactgactcagatctcagaacaaattaagagggctaagagaagaaaccacaatttctttcagctggatggatccagagggggtcaacaagaaggtgaaatctaggtggggccttgaggactacaaacctccgtgctgcggagaggggcggggcagggaaggaagagtgccaaggctgctggcgcccggccctcccagggaggaggcaccaccctactatactagagtttcctcagagaaatgaaaaccaagtcatcttacctgaggatcaaacaccaccacatgttgaaaacacattcaaaatataaaaccccacatgaacctaagtagatacttagagaagggctattttaaaccggaggggagcatgaggaaaggtgagacattttgaaagtggggtggacaggagatggtgtgtttaaggaagggagcagtttgatgtgatggaaagtacaagaacgtggtgagagaagaaactagaaaagaacaaatta

SEQ ID NO: 42826 - DNA, 601 bp, Human
tggatgagatctacaattcagtcctagttcttataccacgtaaggtagtgggtgatcttagaaaagtcatttaacttctctgaaacttaatttcctcacttctaaaatgaggcggtttaactacatgatctgaaggatacagtccataggcactcaatggatttaattcaatttttaaaatataggtatctcttaactatctcaattcttatttgaattctgtgtatactcagaaactgagctgacttcgataaatcccttgctatctggaacttgggaacgaattacacacatctgtttmatcagtttttttcatccgcacataagaggacataaccacatggattcactatccctccatatcccaacacaggacaaagccaatttgactatcacaggatacttgggctgacggataacccactgtgctaaacattatgaaggatatttatataaatgatactgactcagatctcagaacaaattaagagggctaagagaagaaaccacaatttctttcagctggatggatccagagggggtcaacaagaaggtgaaatctaggtggggccttgaggactacaaacctccgtgctgcgga

SEQ ID NO: 42827 - DNA, 601 bp, Human
caccaggacaacaggcctgagccaccgtgactcccagaccctgtccttgaaatgcagtcctgtggtcatgaaaaactgcccctgttctcagaagccccacaggaagtaccctgttctcctaatcaccaagaatccccctcccccatcactccagtgacttccactatcccacgaaaccagaacacaccaactgccagcgtcccaccacaccaccttcccagctctttctctagctatcctgaagcaacaattctcagccccacaaggggcctgatttgttgaccctattattacatctccyctgtcccttaaccacttcttgctgctcctttccctctcggtcagctcagactcagcaggccaccatggcgccactgtacttcaactcccttccctaccaactgtcgctggcacggtgcccgcggccacaccgtaaacgctgcccagggaaaacacacaccgctcactgctgacctcacacccatgaccaggaacctggcgcagacacttggtgctgcctagccacccgcctgcatccctggatctgggcactccccagagaaagcatccacgccttgtcccttctcctcaaatgttcccc

SEQ ID NO: 42828 - DNA, 601 bp, Human
aatcaaaacactgatatatgttcttttcttttcttttcttttctttttttcctcactgcctgtataatcaggtctttattcaaaagaagctgtccaaaatgatttgacctttatggaataatcaaatttaagagtttatgcagcaggcttcttttcctctgtagtaggtttcttttctgcaggcttcttttcaggggctggtttcttggtagctgctgccttttttcccaccagaggcttcttctgcttcttaacaccaacagcagccttctttcctttcttacctaccacaggcttcttrcctgcaaccgccgccttttcatctgatttggctggtagtgctgctgctgcagcagctgccttatccacccggagcttgtgattcctggcctggcgaagaatggtgttccggcgcatggtctttgcatatgggtttagcttcaacatgattctcaagtttttcagtgggttcttctttaggactctgcgatgaatcttcttgcgtggtgctcaaagggctctttggatctctgggcttttcaagattctgctaagatctgtattaatcaacttgtgcatgggaagattgtagttactcttg

SEQ ID NO: 42829 - DNA, 601 bp, Human
tcttcacatagccttgcccagtttcccttagggaaagtgcatttgttcttgactctatttcaaaacaactgcttgtattcactatacagatcagtgaacccattcttagatgttagctatcttctccactacatgcaaaagtggggaccaggtttgttctctatatgccactatttcatacataatgcactggtcttccactgcactcttcacatagtaggtatgcttcttgcattatattttcttaacctactaaagataactcacatcctcccaaattttaccacagcttgcctccaartctgcacttcagtctttcagaatggtcagtcagaaatacaagagtgaaggttgggtacacacacattaagaagtgaggagaaatgttatatgttgacaactgattattttaatatatgctagaccctataagtggctatcattattcatgctgtgcatttcaaatataatttgaaaacaggtttccacctttagtcatttaatctcaaagcatatttattagaaagaggccaaagctttgagaaaaacaaagattattctctcaataacaaccaaaatagaaataaatttttttatagca

SEQ ID NO: 42830 - DNA, 601 bp, Human
taataaaggaagcaaaaagttttgttttatttagtatgttcataattaaatcaaagaagaattctccatattttttagagaaattaagatcgtatggctaaaaatatatttatccatgtagacaggacaaaaataatttgtgaaggctttgtgggtgagcagaaaagcaacaaaaatatttcaaaggtaaaaagacatgtagaaaaaatttaaatattcatgtatatataatatatatttatgataatgggctctgtaatatagtatgaaaaaagatccaagaatgttatggaactgttcrtgaagatatcagctaatgggctgctgcagcatataaaaatactgcaaatatgaatataaaaatactttaaatgtgagaggggaaggtgctctaccctttaaaaaaattatgatatgcctgtaactgattgctaaaaatagttctagtcattgtgccttaggaaagccttaataggctagaagtggatggatatatgtttatgtaaaaaggtatattatatataattgttatcattactatcataagcaaacaaattctatcatgtaaaggaaaacatgtaaaactctttaaggctgtaaa

SEQ ID NO: 42831 - DNA, 601 bp, Human
tgaccataagggtcaaaatgtaaaagacaaaatggaaggaaaaaatagccttgacagtggttggaattattaagggaaagaacagggactgagaaaataagagatgtaaaagagaactgagatgttcatttaaatggtgcacagtaaaaataaataaataaataaatagaactaaaaacccaccatagttaatgagtaaacataaaaaggaagtaccaatggaccatgctgctgaaatgataaataagattgttattaatacttgccctttgtattttgcaacccaagtcactggaggccwtggtaaggacagtcacggtggaagcatgtgagcagcagctagatccagtgagttgaaaaggaatgtgagttgtttagcccaggatctacacccagcaggcacacaagaaatattatcaaatgaaaatatgaaatacaactcaaaagtatgaagtaaagaagacagaaaatatgtctaccaggggagtacatagaggttcaagaaaagtttacgttgcttttaggtagagaagacttgcatatatttaaatgctaagacagccaggcacagtggcttacacctgtaatctcagcactttgg

SEQ ID NO: 42832 - DNA, 601 bp, Human
gggaatatttattatcacctacattttttccaaagcagaaataacccacaggggttaggtaatttgttcaaggtcatatctgaggaagaataggaattcaaatctaagtattttatttgaggtgcttcctacatcaccatagcttgataattgacttaaatggaattctgtttttattatatagtgtgatctgtgtaactcataaaacttgttcaacttcttcaattatatattctttttcaattgtatttttataactcttttctgtataaaagcaaaacccatcttaattcacatcacyaccagtttaaccttcattagtcccaagagtgaagttgtaacctactatggataaggcaaaatcaaagacataaaaataaacaaaacataaaacatgattcacaaagaatattacaatctagtagaggcaataaagtgttgctgtggcagttaagggcctccatgttgtaaagaaagagatatgctcaggttagcctagttcaaggagagcaaactcaaatagcagacagattacaaaaaaacacaatgggctggagggcgaacgcagtagttgatagcccttcccaggaaggagccaaca

SEQ ID NO: 42833 - DNA, 601 bp, Human
atatccagccaggtggggtggctcacgcctgtaatcccagaactttgggaggctgaggtgggtggatcacttgaggccaggagttcaagaccagcctgggcaacatggcaaaactccatctctacaaaaaatacaaaaaattagccagatttgatggctaatttggtgtctgtagtcccagctacttgggaggctgaggcataagaatcgcttaaacccaggaggtggaggttacagtgagccaagatcgcaccactgcactccagcctgggcaacagagtgagactctgtctcaacaacaaaaaaataaagtctttaaaataatacctataaaaatattaacattttaaaagcattgccatatccagacaatattttatatttcatctaatacccacaacatacagggaatatttattatcacctacattttttccaaagcagaaataacccacaggggttaggtaatttgttcaaggtcatatctgaggaagaataggaattcaaatctaagtattttatttgaggtgcttcctacatcaccatagcttgataattgacttaaatggaattctgtttttattatatagtgtgatctgtg

SEQ ID NO: 42834 - DNA, 601 bp, Human
gatggatgcaagatgaagggccagtgtaggctaggaattttaatgacacctttgttactccataatcagtcagaaacagaacatcagtccacttcttttaacgtacatcctaggttaaataaaacattgccaagaggccttcacctttctagatgggcatcatttgttagttccctttttctatggcttggagtaaatgaggtaatgattagaaatgtatcccttacagtagtctgtacagcagattttactgcaaaacctgtggctgtgcagcagacttctttaaattctcttgctaaasttgtgctagataataaaattgctctagattacctacaggctgaacagggagaaatctgtgcagtggcttacacttcttattgtacatgaataaatacactgggttttgtagagattcagttacaagagattaatgaacaggctgcttaattaaaacatgtagacttttcatctggcttattctttgatctatttaactttagttgattaataggaactaataggaaccttggctaaggagcatactccaaattcttggtatgctcctgccagtcactatagtagtcattatcattatcat

SEQ ID NO: 42835 - DNA, 601 bp, Human
tatctttgattttgagcctttgaattctgaggcctggagaggtggtcatggtgaggcctggagacgtgtatgtccactgtacctgggccactagcagcaggacacagccaagcccactatggccctgcccttcctcctccagctttgcctgctggccatgctgagaggggttggatcctccagacatccttttcatagctctgtcctcagtccttgactctacacctggtgtgtaaattagggacccagatgggccctggccttcctagccatcctaggtgccactcaggacattagggaraatacctacgttattttttcaaaattattttcagaaacttaaaatcttaaagctgcgttaaattcagaaatagggaaaggagcaatggctcattcctataatccaagcactttgggagactgaggtgggagcatcacttgaccccaggaatttgagaccagcctaggcaacatggtgagatgcaactctacaaaatatataaaaattagctaggcacggtggtgtgtgcctgtagtcccagctactcgggaggctgaggtgggagaatgacttgagcatgggaggcaaaaattgcagtga

SEQ ID NO: 42836 - DNA, 601 bp, Human
cccaaagtgctgggattacaggtgtaagccactgtgcctggcttttagatttgcttttgtaactaatttccagcattttaattcaagtgagttttaaccaatacactcatgtaccaaaatagttacatcactattaataagccagaaacttagaataataggattttacttttagaaaaggcaagacatcttccattgcaacccctctattttccagatgaacagcctaaagggtaaagaaaactacaaagtattttataaaagataggtataaaaatctttgtaagtgttctgactcccrggctagtattcctcaaccaacattacattctctctaattcaaatacagacttagggttagtggctagaaccacataccagtttgttccagaatccttaccagtaaatccttaccagagtttgggttaaattcacctccaggaacattggttgttgttctggggggcaaaggttttatcactgttgtctcatcctgagagtccttgtcatcatatgacagatgagactcagcagagccaggtcccatgataggtttgcttgtgttccctaatttgtggcacaccatttggtttctgatcct

SEQ ID NO: 42837 - DNA, 601 bp, Human
ctttgggaggccgaggcaggtggatcacgaggtcaggagttcaagaccagcctgacctacatggtgaaaccccgtctctacaaaatgtttttaaaaaaactagccaggcatggtggcattcacctgtaatcccagctactcaggaggctgaggcaggagaatctcttgagcctgggaggtggaagttgcagctccaccaaggagctgagatggtgccattgtactccagcctgggtgacagagtgagactccatctcaaaaaaataaataaataaataaataaataaataaataaataaataataataatattcattcactcatcatagatatttttcatcatcacatactattcatactgaacgtgtacctaggaatcagccagaaagagccctaccctcatagaactttatattatgatgtggggcaagtatagataataaacatgccatcaaatacaagggtgggataaattcacacagtgaaagggctggaaaaaaaaaaaaccataatcacctgaagtattaattgtatgaaacttgatcacaacatggacagctctaacccttgattaattttgaagtctccaagttgccctgtg

SEQ ID NO: 42838 - DNA, 601 bp, Human
ggctgggtgcagtggctcaagcctgtaatctcatcactttgggaggccgaggcaggtggatcacgaggtcaggagttcaagaccagcctgacctacatggtgaaaccccgtctctacaaaatgtttttaaaaaaactagccaggcatggtggcattcacctgtaatcccagctactcaggaggctgaggcaggagaatctcttgagcctgggaggtggaagttgcagctccaccaaggagctgagatggtgccattgtactccagcctgggtgacagagtgagactccatctcaaaaaaaaaaataaataaataaataaataaataaataaataaataataataatattcattcactcatcatagatatttttcatcatcacatactattcatactgaacgtgtacctaggaatcagccagaaagagccctaccctcatagaactttatattatgatgtggggcaagtatagataataaacatgccatcaaatacaagggtgggataaattcacacagtgaaagggctggaaaaaaaaaaaaccataatcacctgaagtattaattgtatgaaacttgatcacaacatggacagctctaac

SEQ ID NO: 42839 - DNA, 601 bp, Human
ataatatttggctgggtgcagtggctcaagcctgtaatctcatcactttgggaggccgaggcaggtggatcacgaggtcaggagttcaagaccagcctgacctacatggtgaaaccccgtctctacaaaatgtttttaaaaaaactagccaggcatggtggcattcacctgtaatcccagctactcaggaggctgaggcaggagaatctcttgagcctgggaggtggaagttgcagctccaccaaggagctgagatggtgccattgtactccagcctgggtgacagagtgagactccatctcaaaaaaataaataaataaataaataaataaataaataaataaataataataatattcattcactcatcatagatatttttcatcatcacatactattcatactgaacgtgtacctaggaatcagccagaaagagccctaccctcatagaactttatattatgatgtggggcaagtatagataataaacatgccatcaaatacaagggtgggataaattcacacagtgaaagggctggaaaaaaaaaaaaccataatcacctgaagtattaattgtatgaaacttgatcacaacatggac

SEQ ID NO: 42840 - DNA, 601 bp, Human
aataatatttggctgggtgcagtggctcaagcctgtaatctcatcactttgggaggccgaggcaggtggatcacgaggtcaggagttcaagaccagcctgacctacatggtgaaaccccgtctctacaaaatgtttttaaaaaaactagccaggcatggtggcattcacctgtaatcccagctactcaggaggctgaggcaggagaatctcttgagcctgggaggtggaagttgcagctccaccaaggagctgagatggtgccattgtactccagcctgggtgacagagtgagactccatctcaaaaaaataaataaataaataaataaataaataaataaataaataataataatattcattcactcatcatagatatttttcatcatcacatactattcatactgaacgtgtacctaggaatcagccagaaagagccctaccctcatagaactttatattatgatgtggggcaagtatagataataaacatgccatcaaatacaagggtgggataaattcacacagtgaaagggctggaaaaaaaaaaaaccataatcacctgaagtattaattgtatgaaacttgatcacaacatgga

SEQ ID NO: 42841 - DNA, 601 bp, Human
aacatagattaagtagattttaagtatgaagcatgggaaaaacaaattactgtttccacatatgcaaatatattagtgataatgtgctatcactgatacatttggctactctgaaactccggaggctttataactaccttccatttaaaacaaacaattaaactgtagcaattaaagtatttcatgctaaattaaccttgctgtattcccaacctacactgaaatattgggtgttcagcccaagatgaagaatgctccttaaaacaaaatgtataggcattttaaaatatggaaatttggrtcaggcatggtggctcactcctgtaataccagcaggagtgaggtgggcagatcacttggggccaggagttcaagaccagcctgggccagttcaagaccagcctgggcaacatagcaaaaccccatttctactaaaaatacaaaaatttgctgggtgtggtgtcatgcgcctgtagtcccagctactaaggaggctgaaacacaagaatcgcttgagcctgggaggtagaggttgcagtgagcaaagatcgcgccactgcactccagcctatgcaacaaagagggactgtcttaaccaata

SEQ ID NO: 42842 - DNA, 601 bp, Human
tgagttacattaaaattctcatgataaactttttctctagctaaactcaaggaataaaagtgttttttgtatgtgggatattgaacaaaataatgaaaaatattttcagtagcagttggataaaaaaaagtatgcagaatttttctctttatgtcaattatatcaatccttagcaagtataagcagcatactgttttatttttgtaaaaggattccactgagaaactagagtaatgtcctatatatggacttttaggtgccattagtaaaataaatgattaaaatttgacaaaaactgaayagcaaacagttttacattgagctctggcaagtagttaaagtgccagttacttttccttatgattgaaagagactcatttgaattacattctgggcttgtccacaagaaaatcctcattttttataaaaattaaacaacatgtattcttgcctgaatgacaaggaaacaatatctgcaagcaggtccaaataattccttaagaaacaagtttgaatctgttagaattatttaaaaagagtttttgaagatgtccagttttccccaacatgaaacaaatttaaaaattagaatctgatgtta

SEQ ID NO: 42843 - DNA, 601 bp, Human
tttattcttttcttggacatagagaatgcaaactactctctattagttacgggaagtatatgaatatatgttaatatattcatgataatatattgtcttaagtagtgtttatagatataaagcactggaacaacttcatcttcaatatagatcactatggacccaataaaatttttgcagaataacttaaatccttatcacaaatgaaacttggaccatagtaaaggtcatcttttgaaataagccaagaattagttatgagtcctgtagcaatatatcataatttggctagatcagatayagaaaaagcctacattattgcatataatttaaataaaaatctgcccttttgattgatagaacagagataatataagttggttgtaagacttaaaccttaaaacaccacacacacatgcaatgtttaggttactttgcacaaatgaatcttttttttttttttttgagatggaataaggtacacacacacacacacgatatttaggttactttgcacagatgaatcttttttttattttttattttttgagatggagtttcactctttttgcccaggctggagtgcaatggcgcgatctcg

SEQ ID NO: 42844 - DNA, 601 bp, Human
tttttttccctgatttatttaaaaaaaaaaaaacgtgaggagagaaatcacagagacctatagagttctgctttgaaatcacacaagcctgagtgctggaaagaacctttttagctccaccacacccccatgcactcctttctcccattcccccaattccttctttctcaaatttcccctccctcaatcgtattttgctaccataaaagtacttggaagattcattcctcctaaggagaggcctgctagatctggccacatagtaaacctttgtgttgcctcattttgttcagtcgtgaarcgactgggctgctgacagccttgtggggcttccccagagggggagggaaaaaaaaagcctggctgcggacagccacagccaagaagtgcagcagctgaggcctctccgactggtgtgactcagtgtttgctcaaatagcctgtcgtccattttctaacgccttccatcttctctcagtgtcactgcaaggaatcaacacccgaaaagccttcagaagttccaccattcaagaccagaagctttttgacagaaactctctcccagtgcctgtcttagaaacatacaatacctgtgatactc

SEQ ID NO: 42845 - DNA, 601 bp, Human
tttctatcccagggacgatggaaaagaggcactcaaattctacacagacccttcatacttctttgatctttggaaggagaagatgctgcaggacaccaaggatatcatgaaagagaagagaaagcatagggtgaggggaaaggggcctctgttctccacatcagtaggcacgattgtggagggggataaaaaggaagccagtgttatgtgaagtaatcatttcaagtggctgcttgcttggatgccaggtgaaactcttaaaaaaatgtgtccacaccaagcacaaccaagatgaaagtayaaatcataccaaaaatgtgtttgttccccccagtgctattaacaattgagtatattcaggctgagttttagaaattgacttttctattcaccatttatttctcttgcaatttgcacctgactctgctggacactcaagctaggctagtcccttctccactagttttgcagctcatttctcagagatcagcacaaggttctgcagtgtttgatttgcaacaggagcagtttaatgccttcgctacgggctgggcggggctagggtggggggatatatgtaggttttgaagattctccctcc

SEQ ID NO: 42846 - DNA, 601 bp, Human
cttctctcccctcattcttcttggccctagaaaccattaatcccaaatctccttctgcttcccaaatcacttcctgctggtggccctgtcagatgcagctaaggctggaaggtctgtggaaaattccaaaatggctgcttttctaaggagtagctgttagtgcagggtagatacaaaggtggaaaaagaaaaccttcagcttcacacatggcctgagaccttgcagctgcagccgagcaaatctgatcccaggagaggtgtagctttaatcctctttcaggcctgggtcaggagtctggtrgcacattcatttcccatctctgcagattctcggattgagattcattctctctcaagatttccccacatgagcactgaagatgcattcacctaaatctatatcccactcaggtgtggtcagcctggcttgggtttcctgccctctccaatgctggtgaatgttaatagcctgagaaacagagcctagtgtgtgggtggtgtttgaatttttattccagttctttcttgcatgcacccttaaactggctccaggattaaactagcaactgccatggaccatccttcttagggaaggggaggg

SEQ ID NO: 42847 - DNA, 601 bp, Human
ctcctccttctattcccagggcctggcaccacctcttccagcctttctgggactggaagaatttgacctgccttcccagggaacaataaacagaagtagggcattgcgcccactgtcctcaaggcagctgggaagtgaatgaaaaatgctgacagttccttcagtaaggaagaagacagagtctgagggagagttaagatatctggagtcaagggcagagtggaaggggaggggaacgtagatgggtgtagtccaaatggaagctaaagtttcaaagtcccatgaagccttacaaggtcayagagacaagagaatagcttttagatcccaacctcagtttcctcatcggcaagatgggtgtgatagttactataaggatcgaatgacataatggattcaaagcactttgccaactgaaaataaactgtatttctcctgaggcataagtatttctaaaaaggaggctacaggagttacgggctcagtaataacaggaagtggtatctgtgcaaaggcttaaaactgttgagccccaccagggctatgtggtggaggcctcgctcaggggacacggagggcatttgtgtaaggggtgccgctc

SEQ ID NO: 42848 - DNA, 601 bp, Human
tgcatcccggggctgggagccccacccaggacttcacctggtagacatgccctatggtgccatctgtccctacagtaaactctgggtgaaaccagcctcctcctccttctattcccagggcctggcaccacctcttccagcctttctgggactggaagaatttgacctgccttcccagggaacaataaacagaagtagggcattgcgcccactgtcctcaaggcagctgggaagtgaatgaaaaatgctgacagttccttcagtaaggaagaagacagagtctgagggagagttaagatayctggagtcaagggcagagtggaaggggaggggaacgtagatgggtgtagtccaaatggaagctaaagtttcaaagtcccatgaagccttacaaggtcatagagacaagagaatagcttttagatcccaacctcagtttcctcatcggcaagatgggtgtgatagttactataaggatcgaatgacataatggattcaaagcactttgccaactgaaaataaactgtatttctcctgaggcataagtatttctaaaaaggaggctacaggagttacgggctcagtaataacaggaagtggt

SEQ ID NO: 42849 - DNA, 601 bp, Human
ctgcatcccggggctgggagccccacccaggacttcacctggtagacatgccctatggtgccatctgtccctacagtaaactctgggtgaaaccagcctcctcctccttctattcccagggcctggcaccacctcttccagcctttctgggactggaagaatttgacctgccttcccagggaacaataaacagaagtagggcattgcgcccactgtcctcaaggcagctgggaagtgaatgaaaaatgctgacagttccttcagtaaggaagaagacagagtctgagggagagttaagatrtctggagtcaagggcagagtggaaggggaggggaacgtagatgggtgtagtccaaatggaagctaaagtttcaaagtcccatgaagccttacaaggtcatagagacaagagaatagcttttagatcccaacctcagtttcctcatcggcaagatgggtgtgatagttactataaggatcgaatgacataatggattcaaagcactttgccaactgaaaataaactgtatttctcctgaggcataagtatttctaaaaaggaggctacaggagttacgggctcagtaataacaggaagtgg

SEQ ID NO: 42850 - DNA, 601 bp, Human
actgggacgcctcgccagacatggagcctgcatcccggggctgggagccccacccaggacttcacctggtagacatgccctatggtgccatctgtccctacagtaaactctgggtgaaaccagcctcctcctccttctattcccagggcctggcaccacctcttccagcctttctgggactggaagaatttgacctgccttcccagggaacaataaacagaagtagggcattgcgcccactgtcctcaaggcagctgggaagtgaatgaaaaatgctgacagttccttcagtaaggaagargacagagtctgagggagagttaagatatctggagtcaagggcagagtggaaggggaggggaacgtagatgggtgtagtccaaatggaagctaaagtttcaaagtcccatgaagccttacaaggtcatagagacaagagaatagcttttagatcccaacctcagtttcctcatcggcaagatgggtgtgatagttactataaggatcgaatgacataatggattcaaagcactttgccaactgaaaataaactgtatttctcctgaggcataagtatttctaaaaaggaggctacaggagt

SEQ ID NO: 42851 - DNA, 601 bp, Human
cttcaccccagtgtaccctagaacctgttctcaacctctgtgccatgaccctgtccaccccccgcccccgatctctcactgcagcacccactctctgccccaccttgcttggcaccattttcctgatcctcacaccaccgtcccagactcttgtcctgcactgggacgcctcgccagacatggagcctgcatcccggggctgggagccccacccaggacttcacctggtagacatgccctatggtgccatctgtccctacagtaaactctgggtgaaaccagcctcctcctccttctattyccagggcctggcaccacctcttccagcctttctgggactggaagaatttgacctgccttcccagggaacaataaacagaagtagggcattgcgcccactgtcctcaaggcagctgggaagtgaatgaaaaatgctgacagttccttcagtaaggaagaagacagagtctgagggagagttaagatatctggagtcaagggcagagtggaaggggaggggaacgtagatgggtgtagtccaaatggaagctaaagtttcaaagtcccatgaagccttacaaggtcatagagacaagagaat

SEQ ID NO: 42852 - DNA, 601 bp, Human
gcacataaataataacataaacgatgacgcactacaggctgcacatccacatacaagggaatgtcccagaagtcacttctgggacagtggcagcaggtaagacttccagctaaagtctgctcatactctgcgtgaacaatgtgttgcacgcttggaccgacactcctatgcacagcagctagagcagcaacacttggaggaagcgccacacaaaacagacctagacagttcacagtcgtgcgtctgatcttctctgcagtcaaccaaacgcactgcacagaccttggcctgacacagaagkcatttccttggctgctctgtgctgtctgggtgccaggtcctgagagccagggcttcatgtcgatgcttcaccccagtgtaccctagaacctgttctcaacctctgtgccatgaccctgtccaccccccgcccccgatctctcactgcagcacccactctctgccccaccttgcttggcaccattttcctgatcctcacaccaccgtcccagactcttgtcctgcactgggacgcctcgccagacatggagcctgcatcccggggctgggagccccacccaggacttcacctggtagacat

SEQ ID NO: 42853 - DNA, 601 bp, Human
caaaagtagggcaattccaaaataagcagagagcacctcctgactacctgtttcccaaaagatgacggaaagacactgagatgctgccctcagacccaagcacagagcccagaagattcagggaaaagtcgcctccggttatttcctgcagaaatactgctggttacatcatcctggagacagacactgaaaggtgtcaataagattatattcgagtcatcacaaagtacatagaagcaaaagggagaaaaaaaaaagataacaatagcctaggcaggctttgggggacagatgaaatcamtggcccaggtcctcctccagcagcacccttgcaaggcacactccatttctgggagcagggctccaggtctgctgatttaaggtttcccccctcacccctgctgtggaagaggtggatgagaaagctttctgcaaggcacaaagtcttcctctgataggagatctctgcttcctgcctgcagaactgcccgccactctcccagcctgggctgagtccctttgcccttctcttcccctctcctcctccagccctgcccagcaggacccctgaggttgctctgctgccccctcagctctcggc

SEQ ID NO: 42854 - DNA, 601 bp, Human
aataatattccgcaagcgtccagtgcgctaacctacctacagggatgtcaaccctgcttaagaagaactggcgtggtccctgcgcattcttaactcctgggtcttgtcctggtgtctctgcttttgcaaaccttttacccaaatgacagagatgctgtgcttcccaggggaaagatgtgttgactgctgtcttgttgcattaagagggagggatggagggaatatgccatgaaagagccaagggtgccacagaggaagagatgaggctcacctggaagggaagggaaagaggcacggagamggagtaggagaggggagacaagagaaacaaaagccctggcagaaaagaaaacaaaaggaggactttgttgagtgagaagctcaccttctcatctgctcagctcttccaaaacaacaaagcatgaagggcaggggacacgggttggagaaataaccctggtgggctgggaaaatggagcgaaaatcaaagtgaggggaagagaccaaaagtagggcaattccaaaataagcagagagcacctcctgactacctgtttcccaaaagatgacggaaagacactgagatgctgccctcagaccc

SEQ ID NO: 42855 - DNA, 601 bp, Human
aagcctcagtttcctcatctgtggaatggggatgtggaaatgatatgatcgttgggaggataaaatggaattgtgcatatagaacatttggctcatattaacaagtaaaaaaagaactgcctcatgaacaagcctgcctttggatgacaaccaaggttttaggaaaagaaacgttctttttccactgcaacttgacctcatgagcccagtaatatatgatatgtaacaggtaccgaaaaattatttccaacaaacatgtgaatggcaatgtggaaataatattccgcaagcgtccagtgcsctaacctacctacagggatgtcaaccctgcttaagaagaactggcgtggtccctgcgcattcttaactcctgggtcttgtcctggtgtctctgcttttgcaaaccttttacccaaatgacagagatgctgtgcttcccaggggaaagatgtgttgactgctgtcttgttgcattaagagggagggatggagggaatatgccatgaaagagccaagggtgccacagaggaagagatgaggctcacctggaagggaagggaaagaggcacggagaaggagtaggagaggggagacaagagaa

SEQ ID NO: 42856 - DNA, 601 bp, Human
atgtgcacatttctatgtatgtgaaattttctagaataattattttaaagaggcctgttgttcttggggtgggaataccaagtaaggtaataactgtgaacacggggtcagagcagggtagatctgggctcaaatcacggtactgccatctcctaacagtgtgaccttaggcaagctattgagtcttgaagcctcagtttcctcatctgtggaatggggatgtggaaatgatatgatcgttgggaggataaaatggaattgtgcatatagaacatttggctcatattaacaagtaaaaaargaactgcctcatgaacaagcctgcctttggatgacaaccaaggttttaggaaaagaaacgttctttttccactgcaacttgacctcatgagcccagtaatatatgatatgtaacaggtaccgaaaaattatttccaacaaacatgtgaatggcaatgtggaaataatattccgcaagcgtccagtgcgctaacctacctacagggatgtcaaccctgcttaagaagaactggcgtggtccctgcgcattcttaactcctgggtcttgtcctggtgtctctgcttttgcaaaccttttacc

SEQ ID NO: 42857 - DNA, 601 bp, Human
gaagagtcatgcttttctaaagacaaatactgacacatttacaggtgaaacgtcatgatgtctggagtttgcatcagaatgacagaggagaagggagtaggtgggaatacagataaaataatgttagccatgagttgctaattgttgaaactggacaatggtacatggcagtttgtcacatgtgcacatttctatgtatgtgaaattttctagaataattattttaaagaggcctgttgttcttggggtgggaataccaagtaaggtaataactgtgaacacggggtcagagcagggtagrtctgggctcaaatcacggtactgccatctcctaacagtgtgaccttaggcaagctattgagtcttgaagcctcagtttcctcatctgtggaatggggatgtggaaatgatatgatcgttgggaggataaaatggaattgtgcatatagaacatttggctcatattaacaagtaaaaaaagaactgcctcatgaacaagcctgcctttggatgacaaccaaggttttaggaaaagaaacgttctttttccactgcaacttgacctcatgagcccagtaatatatgatatgtaacaggtacc

SEQ ID NO: 42858 - DNA, 601 bp, Human
agtttagttttaagaagagtcatgcttttctaaagacaaatactgacacatttacaggtgaaacgtcatgatgtctggagtttgcatcagaatgacagaggagaagggagtaggtgggaatacagataaaataatgttagccatgagttgctaattgttgaaactggacaatggtacatggcagtttgtcacatgtgcacatttctatgtatgtgaaattttctagaataattattttaaagaggcctgttgttcttggggtgggaataccaagtaaggtaataactgtgaacacggggtsagagcagggtagatctgggctcaaatcacggtactgccatctcctaacagtgtgaccttaggcaagctattgagtcttgaagcctcagtttcctcatctgtggaatggggatgtggaaatgatatgatcgttgggaggataaaatggaattgtgcatatagaacatttggctcatattaacaagtaaaaaaagaactgcctcatgaacaagcctgcctttggatgacaaccaaggttttaggaaaagaaacgttctttttccactgcaacttgacctcatgagcccagtaatatatgata

SEQ ID NO: 42859 - DNA, 601 bp, Human
atggaagctgcagtgaaccgtgatcatgccactgtactccagcctaggcaacagggcaagactctgtcttaaaaaataataattttttttaggtatgataatggtatttatagtttagttttaagaagagtcatgcttttctaaagacaaatactgacacatttacaggtgaaacgtcatgatgtctggagtttgcatcagaatgacagaggagaagggagtaggtgggaatacagataaaataatgttagccatgagttgctaattgttgaaactggacaatggtacatggcagtttgtyacatgtgcacatttctatgtatgtgaaattttctagaataattattttaaagaggcctgttgttcttggggtgggaataccaagtaaggtaataactgtgaacacggggtcagagcagggtagatctgggctcaaatcacggtactgccatctcctaacagtgtgaccttaggcaagctattgagtcttgaagcctcagtttcctcatctgtggaatggggatgtggaaatgatatgatcgttgggaggataaaatggaattgtgcatatagaacatttggctcatattaacaagtaaaa

SEQ ID NO: 42860 - DNA, 601 bp, Human
cacttgaggccaagagatggaagctgcagtgaaccgtgatcatgccactgtactccagcctaggcaacagggcaagactctgtcttaaaaaataataattttttttaggtatgataatggtatttatagtttagttttaagaagagtcatgcttttctaaagacaaatactgacacatttacaggtgaaacgtcatgatgtctggagtttgcatcagaatgacagaggagaagggagtaggtgggaatacagataaaataatgttagccatgagttgctaattgttgaaactggacaatgstacatggcagtttgtcacatgtgcacatttctatgtatgtgaaattttctagaataattattttaaagaggcctgttgttcttggggtgggaataccaagtaaggtaataactgtgaacacggggtcagagcagggtagatctgggctcaaatcacggtactgccatctcctaacagtgtgaccttaggcaagctattgagtcttgaagcctcagtttcctcatctgtggaatggggatgtggaaatgatatgatcgttgggaggataaaatggaattgtgcatatagaacatttggctc

SEQ ID NO: 42861 - DNA, 601 bp, Human
aaattaggctgggcacactggctcaggcttgtcatcccagcactttgggaggtcaaggaaggaagacagctggagcccaggagttggagaccagcctgggcaacatagtgagaccttatctctatgaaatttttaagaaaaattagccaggtgtggtggcgtgcacccgtggtcccagctactcaggaggctgaggcaggaggatcacttgaggccaagagatggaagctgcagtgaaccgtgatcatgccactgtactccagcctaggcaacagggcaagactctgtcttaaaaaataayaattttttttaggtatgataatggtatttatagtttagttttaagaagagtcatgcttttctaaagacaaatactgacacatttacaggtgaaacgtcatgatgtctggagtttgcatcagaatgacagaggagaagggagtaggtgggaatacagataaaataatgttagccatgagttgctaattgttgaaactggacaatggtacatggcagtttgtcacatgtgcacatttctatgtatgtgaaattttctagaataattattttaaagaggcctgttgttcttggggtgggaata

SEQ ID NO: 42862 - DNA, 601 bp, Human
atggctgtcaacatcacaaaaagacaagtaagcacacgtgtctcctaatggaagtgcagaacaccacctaggaatgtggagaccaaaacaatgacaacaacaacaacaacaacaaaaattcaaacctgagcctgatgaaacactgaggaagtgtgcagaccctcctaccaatccacaggaattacaatagaaaaaaaacatgttacctgaaaccacacagaagtaatcagcagtattcaggccctggaaaaccccataggacaaataacccaatttcttcaaaataaattgcaagggaaaraaagaaagagaatagagttttctgggggaaaatctatagactaaaagtgacttaaaagatttatcagccacctgctgagtaggcctcatttatagctaattcaagcatacatattgaaaagtacacatcccatttatgagataagtggaaatctgaacacagactgggtatttaacagtattaggaaattaggctgggcacactggctcaggcttgtcatcccagcactttgggaggtcaaggaaggaagacagctggagcccaggagttggagaccagcctgggcaacatagtgagacc

SEQ ID NO: 42863 - DNA, 601 bp, Human
gcctgagaatggactaatagagttagcgttagatgttagtgatccaatatcaagcacttatttctcttttactatacaggctggaccactgggaaaccagggagtagatgaggggaagtgtctctttataaaagtatttcctataataaattaggacaccaccatttggcaacctctaacaaatcaatggatataggcaatgatcatcaatggctgtcaacatcacaaaaagacaagtaagcacacgtgtctcctaatggaagtgcagaacaccacctaggaatgtggagaccaaaacaaygacaacaacaacaacaacaacaaaaattcaaacctgagcctgatgaaacactgaggaagtgtgcagaccctcctaccaatccacaggaattacaatagaaaaaaaacatgttacctgaaaccacacagaagtaatcagcagtattcaggccctggaaaaccccataggacaaataacccaatttcttcaaaataaattgcaagggaaaaaaagaaagagaatagagttttctgggggaaaatctatagactaaaagtgacttaaaagatttatcagccacctgctgagtaggcctcattt

SEQ ID NO: 42864 - DNA, 601 bp, Human
gccacaaaacaattattagatataataagtgagtcagccaggtggcaggacacaagatcaacatgtaaacatactgaccaaaacttattaatgcattaatggaaaactgtttagatctaaataaagaatgtgacttagtgaatagctttgtactaatgttattttcttggtttttgaaaattatagtgcagttaaatgttaaaattaaaagaaggtgggtaaggggtatgcatctgtactatttttgcaacttctctgttaagtctaaaatgatttcaaagtaaaaagcttaagaattttrgaaagctaactggttactgatatgggttggctctctgtccccacccaaatctcaccttgaattgtaataatccccacgtgtcaagggcaggaccaggttgaggtaactgaatcatggaggcggtttcctccatgctgttctcgtgctaatgagtgagtctcacgagatctgatggttttacaagcgtctggcatttcccctgcttgcactcattctctctcctgctaccttgtaaagaggtgccttctgtcattattgtaagtttcctgaggcctccccagccatgcagaactgtgagtc

SEQ ID NO: 42865 - DNA, 601 bp, Human
agtatacaaatcaataagaaagaaaaacagctgttctaagaattctagttcatcaatagagaaggaatggggggaaagaaaatccctattagaccacactacaataattactacagacttcatggaaatagaaaggattacaagtgcataccaagtgcatatgacaacaaattatgtgactcaaagaaatggacaacttcctagaaagatacaactatcacaactgacttgagaagaaatagtaaatctgaaaggagtcataacaagtaaatgggttgcaatagtaatctttaaaactccrcacaaagaaaagcccaggctcagactgaagttgtcttccatgttgaattcttccaaggatttaatgaaggattaataccaaatcttcacaaaatcttccaaaaaagaaaacaggccgggcgcagtggctcacgcttgtaatcccagcactttgggaggccaaggaggatggatcatctgaagtcaggagttcgaggccagcctcatcaacatggtgaaacccagtctctactagaaaaatacaaaaattagccaggcattgtgatgcctgcctgtaatcccagctattcggaggctgagg

SEQ ID NO: 42866 - DNA, 601 bp, Human
gtcatggagtatacaaatcaataagaaagaaaaacagctgttctaagaattctagttcatcaatagagaaggaatggggggaaagaaaatccctattagaccacactacaataattactacagacttcatggaaatagaaaggattacaagtgcataccaagtgcatatgacaacaaattatgtgactcaaagaaatggacaacttcctagaaagatacaactatcacaactgacttgagaagaaatagtaaatctgaaaggagtcataacaagtaaatgggttgcaatagtaatctttamaactccgcacaaagaaaagcccaggctcagactgaagttgtcttccatgttgaattcttccaaggatttaatgaaggattaataccaaatcttcacaaaatcttccaaaaaagaaaacaggccgggcgcagtggctcacgcttgtaatcccagcactttgggaggccaaggaggatggatcatctgaagtcaggagttcgaggccagcctcatcaacatggtgaaacccagtctctactagaaaaatacaaaaattagccaggcattgtgatgcctgcctgtaatcccagctattcggag

SEQ ID NO: 42867 - DNA, 601 bp, Human
aaaagccacagcctggaacagtgtgagcaaaaggatcaattacattaatatccactgatcatccccagaataaaacaaatttccagtagactacaatgacatcagtcatggagtatacaaatcaataagaaagaaaaacagctgttctaagaattctagttcatcaatagagaaggaatggggggaaagaaaatccctattagaccacactacaataattactacagacttcatggaaatagaaaggattacaagtgcataccaagtgcatatgacaacaaattatgtgactcaaagaaayggacaacttcctagaaagatacaactatcacaactgacttgagaagaaatagtaaatctgaaaggagtcataacaagtaaatgggttgcaatagtaatctttaaaactccgcacaaagaaaagcccaggctcagactgaagttgtcttccatgttgaattcttccaaggatttaatgaaggattaataccaaatcttcacaaaatcttccaaaaaagaaaacaggccgggcgcagtggctcacgcttgtaatcccagcactttgggaggccaaggaggatggatcatctgaagtcaggag

SEQ ID NO: 42868 - DNA, 601 bp, Human
tccaaaatacagtatccccagtggaaaaataaccacaaggtatgtgcagggtaattcatacaaactgcactccgggaaaatgcaaaacaagtaaacatagaaagtcaggctaagagtcttctaaaaaagcagaaatcaaaatagctcttcatgcttcctgtaagttctgtcagtgtgctaaatatggcaaggtgagtcttgtacaaatgtgcacagtgggctcccctgctgcaggagttcaacaagaagctgaagcaccatgttgtgaccagcaggagtctaacagtcacccagccccttytcaaccttcccaaaacgtggggaagccctgtctttaaaaggttcttccaaacatgcttctcagtgaaggcctgactggcctttgggaaagggtagtcaatggggcaggaccttcctgggcaggtggggccatcacatgtcagccagtaaccccggttgtgagtaccagtgccagggacactgccagtcactgtgattgttaaatgtctaccaacacgtcgggaaggaagtactcccccccagatgagacccctgaccccttacttgcaggaaggatggaacctgagaattgacaatcacc

SEQ ID NO: 42869 - DNA, 601 bp, Human
tatacagctaaatgacacctaaaattctttgggcttggaggcacaattcagtgtcttagcaatgtggacaggccaggtgcggtctcagtattttgggagctgaggtgggatgattgcttgaggccaggagttcgagaccagcatgggcgacactgcaagacctcatctctaaaaataaaactgttttagaaatttaaaaaaactgaggaagtttattttgatcaaaagatcttaatagcaataatgacagcagttgtaacaggaatactaatgagttgcaactaaacttttcaaattcttmcctgcctgcctgcctggcactgtagcccaccctctctgcattatttcatgtattcctcacagcacaccagaagctgctatcttctctcttcccctccctccaatttaatgccatcctccctcctattgaatgccaccctccttccaatttaatgttatcctctctccaatttgatgccatcctccctctatcctccctcctgttaagtgccatcctccctcctattgaatgccatcctccctcctgttaaatgccatcctccctccaaagtaatgttatactccctcctattgaatgcca

SEQ ID NO: 42870 - DNA, 601 bp, Human
cttctagtgaggtacatttttcagaagacatttgagccaacagagggtatctctggatccttagtggtcctcaaaattctcagtggggatcggatctattcccaatatttcaaaattctttccaaaagctgtccatttcctcatggtacaagtatacagctaaatgacacctaaaattctttgggcttggaggcacaattcagtgtcttagcaatgtggacaggccaggtgcggtctcagtattttgggagctgaggtgggatgattgcttgaggccaggagttcgagaccagcatgggcracactgcaagacctcatctctaaaaataaaactgttttagaaatttaaaaaaactgaggaagtttattttgatcaaaagatcttaatagcaataatgacagcagttgtaacaggaatactaatgagttgcaactaaacttttcaaattcttacctgcctgcctgcctggcactgtagcccaccctctctgcattatttcatgtattcctcacagcacaccagaagctgctatcttctctcttcccctccctccaatttaatgccatcctccctcctattgaatgccaccctccttccaat

SEQ ID NO: 42871 - DNA, 601 bp, Human
tgccatttcgttaacccctcgtgtactggattcttttagaagcagtggtttccatgccagacatcacttcttgggggaagcaaagcaaacagaggctggggaggggtgagtggggatctcggggactccgccgaacttggggagggagccttgtcaagtctggcctggcccacgctgaggtccgttcgcaccccaggacctttctagaaaagtcctagattactatacaacaggcagatctgatgctgaaacagaaataaggcaggtctctgagcggatctaaagttccctactatgcaaragctcacgggcctccaaagcacctactaagcacctttctgagaagacttgcatggagggctctgttccaaggctctccattcgtggcctaggttgagtttccttttgaaaaccaagacttactttaggtttttttttttaattattattgttataactgttgataagcaaaaatcaatcaaagacatcgttaaatgggccaatgaatttacttcattttatgttttcaaaacaaaccttccccctaaaaggttattaccaaatccaatttcatttacaatatacgccacattgccattta

SEQ ID NO: 42872 - DNA, 601 bp, Human
cccttttggactgaaacctccctctctgggctcccatttcctcacaggaacaatgaagaatttataagctcttcacagagctagctaagaatggtaccatacaaattcataaaaattcaggcaagtatatggtgctagagaaatacgtgaagttttatcactaagtatttgaacaacaattttaaaaagcaccttttttccaccgtatcatgatctttgcgggtcacggggtcttcatgatcccactaagcaatttggagctattccatatattcctagctaattcaaacagctacagccytttttttttttttttttttttttttttttttgagatagagtctcactctgtcacctgggctggagtgcagtagtgcaatcataatcacgtctcacagcactcttaaccttctgtgctcaaacaatctcagtcccgcaagcagctgggactacaggcatgcaccaccatgcccagctaatttttcgtattttttgtagggatgaggttttgccatgttttccaggctggtatccaactcctgagctcaagcaatccacccaccttggcctcccaaagtgctgggattacagatgtgagcca

SEQ ID NO: 42873 - DNA, 601 bp, Human
cactttgggtgcacatgcccactttttactgatagaggtgtgagatcaaaaacatctgaagactgtggctgtaatgaaccagctacactaaaaaggatcaataacatatacatttttctaaaaagcatccatagagcatctttgtcagctatccttgttaaattctgggtattggcttttatcaggataactatctggtgttagacactttctcaaaagccagaaatatttaaacaacttgatctcatccacacacatcaaagatcaaagggacacaggaggctctgactgagcagcacgcgcaggcactcagccagtggccctgagtaacatctcttgggaccccagagccccagggccacctgttctgctcccaggctctgccccttttggactgaaacctccctctctgggctcccatttcctcacaggaacaatgaagaatttataagctcttcacagagctagctaagaatggtaccatacaaattcataaaaattcaggcaagtatatggtgctagagaaatacgtgaagttttatcactaagtatttgaacaacaattttaaaaagcaccttttttccaccgtatcatgatctt

SEQ ID NO: 42874 - DNA, 601 bp, Human
aaagtggttctccacaaatcccccccaaacaccaggagaaagtgtgtgatgaggtggacactcaccaagcaagacctcgcctctcacagagcccctctggctggtgcctcttgggaactgcggggagcgctggcaggcagcttctcactgctgactgccaggaatctgggcacgcacaagggacacagactgaatgtattaacgaaggtggcagtgacatattcaacaaaaggccaagaagaccaagtgaagccttcaaaatcaggaaatcagcacggaccgtttgtgtgtttgtgtgtgtgtgtgtgtgtgtgtgtgtgtgtgtgtcaggccacctgggtgatggccgaagttaactgtgataaggcccggccacctccaccaacatacacactgagcctccccggaactgttttgcatactctgcctcgagctcacagtcatgtccctgttaccagagagcagggccttacaagaagtgtcaaggttgagagaaagtgtgggatgacatctaggcaacaagaccacagacagggcacccgaccccacccatgctgacagcaactctcctgggctccctggccaaaggactacagggagg

SEQ ID NO: 42875 - DNA, 601 bp, Human
gacctggctgtgcacgagctgccaaacagccagcacttgtggaccctgtggcttgccgtctggggacatgcttagcccctgtctgcaaaatgagacaaggaggggctggcagcctgcaccggcacatgaggtggcttcagcttgtcttaaatgacaggtttcaggcatggctgttctccctgtccctcccatccccagtcactgtgtgcttctgattttatccaaggggcacaggcctgaacaagggccatagcaaagggatgaatgaaaaggttttccataaactcctaccaaatacccrgagaaagtggttctccacaaatcccccccaaacaccaggagaaagtgtgtgatgaggtggacactcaccaagcaagacctcgcctctcacagagcccctctggctggtgcctcttgggaactgcggggagcgctggcaggcagcttctcactgctgactgccaggaatctgggcacgcacaagggacacagactgaatgtattaacgaaggtggcagtgacatattcaacaaaaggccaagaagaccaagtgaagccttcaaaatcaggaaatcagcacggaccgtttgtgtgtttgtgt

SEQ ID NO: 42876 - DNA, 601 bp, Human
cagggaaactcccatctgagctatctgggaaaatcatgccatgcccacagctcccgtcgcagaccccactaactctagaagctatttttggatgcactttccggttaacacaagaaactaagttcaagaacacggaccaggcactggaagggctggagtctcccttttagccgatttcctgcttcccatggtctcgcggagctgttttagagtgcttgtctgaaatgacactatcacccaccgccaaaactgagacagcgcccaccacagtggatacctgtgttcaagacaaatcgaatasagagatcacctgattttactgtcaccccaagaacatgaaggagtcaaaatttcagaaactaatgatacaaggccacaaagcacacggtattaaaacatacctctgtcatacactttgctcgcatatttgttatttacaaggggtatgtgtcacaacactgcaatttgaacattttcataaagacgaggggagaatctgccattcagtagaagggaccctgagggaacaggtggtgcgtttctctccacggcacgtctttgccagctggagcctctacgaaagggaggactcataaactgc

SEQ ID NO: 42877 - DNA, 462 bp, Human
cccaccgtcccggggtgtgatctcggcactccacctatcaccacccaaacccacatcagtgtgtgcagaggctcccaggagcacagctccacatatgtcaaagttcagagatggaaggaaactcctcagtgcaagtggagagagacagatgtgatttaaacrgggagtggggagcatcataaattcaccaagaatctggctgaactgtgcctctgtatagacaggatgatagattttcccaaaccagagcccagacttggtgcagaaaagagttactcctctctgtgcaggaattcatcatttgcatcccgcatcacagcaaaagcaggcacagaggcttagagccctcttagacacctatgagtgaatacagcttcttataaacatccctcccagactccatctactcagagtttatccaggcatccagagtagaaaaggtcctttgggggtattcaaggg

SEQ ID NO: 42878 - DNA, 601 bp, Human
ttttctaccgtgtttcagtgcactgcctagaaaataaaacactgggtttcatttccttgtattttgggggatatttctataggagccaaatgattttcatactaggatgaatagaatgaatatgtcaacagtcttttaggtctcagtcataaacattatctctgattgtatagataggtaaacgtctttgactccataatcaagcagactttttttttttgagatagaatttcactctgtcactcacagttcagtggcacaatcatagctcactgcaaccttgaactcctgggctcaagcrgtcctcccacctcagcctcccaagtcgctgggactacagatgcacatcaccacaactggctatttatgtatgtatacattttatagaaacggaatctcactatgttgcccaagctggtctcaaacttctggcctcaagcaatcctcctatctcagcctcccaaagtgctaggattccaggcacaagccatggtgcctggccaagcaggcttacttaaatatcaaaatgatcaccctccattatccagaatttcaaaacctattgttctgagtggctgccaggaggtgccaacagttggca

SEQ ID NO: 42879 - DNA, 601 bp, Human
caggccttcctgtgcccacactggaaggatacaggagataaaacagaagtccagggtctcatggtgttgctaccccctcatgtcctgaggccccagtcagtctgcctgcttttagtttccagcgtccttttactgtttcttgttaaattatttacttgtaatcacggggaggagcagggaaaaatgaatctacgccatcttgttctaaaaccagaagcccctgtttttaaagttttctaccgtgtttcagtgcactgcctagaaaataaaacactgggtttcatttccttgtattttgggkgatatttctataggagccaaatgattttcatactaggatgaatagaatgaatatgtcaacagtcttttaggtctcagtcataaacattatctctgattgtatagataggtaaacgtctttgactccataatcaagcagactttttttttttgagatagaatttcactctgtcactcacagttcagtggcacaatcatagctcactgcaaccttgaactcctgggctcaagcagtcctcccacctcagcctcccaagtcgctgggactacagatgcacatcaccacaactggctatttatg

SEQ ID NO: 42880 - DNA, 601 bp, Human
ggttctggttacaggccttcctgtgcccacactggaaggatacaggagataaaacagaagtccagggtctcatggtgttgctaccccctcatgtcctgaggccccagtcagtctgcctgcttttagtttccagcgtccttttactgtttcttgttaaattatttacttgtaatcacggggaggagcagggaaaaatgaatctacgccatcttgttctaaaaccagaagcccctgtttttaaagttttctaccgtgtttcagtgcactgcctagaaaataaaacactgggtttcatttcctygtattttgggggatatttctataggagccaaatgattttcatactaggatgaatagaatgaatatgtcaacagtcttttaggtctcagtcataaacattatctctgattgtatagataggtaaacgtctttgactccataatcaagcagactttttttttttgagatagaatttcactctgtcactcacagttcagtggcacaatcatagctcactgcaaccttgaactcctgggctcaagcagtcctcccacctcagcctcccaagtcgctgggactacagatgcacatcaccacaact

SEQ ID NO: 42881 - DNA, 601 bp, Human
cactagtccattgtggggatacagaaatgcagtcaattcatagccacggatcttgtatcctgtcattgtaatgagctcatttttcagttgtaagaggttttgttttgggttttgtagaatcagtctttcatcctcaactgtgaaattggttgtaggttttttgtaaatgctctgtataaaggagtggaaggcagttccctgggccacctgttgctgtggtgtgggtggatgggcaaaagcccctgggtctgggtctcctggagccaccggatagggagtggtccacacagcagcatcaggytgtccactggtggcttgggtgtggagcgggccttgggctcccactaggtctcactgagcttcccctttggcctgacagagccttttggttttgctttattttgttttctctatacctgttggcggttctggttacaggccttcctgtgcccacactggaaggatacaggagataaaacagaagtccagggtctcatggtgttgctaccccctcatgtcctgaggccccagtcagtctgcctgcttttagtttccagcgtccttttactgtttcttgttaaattatttacttgtaatcacg

SEQ ID NO: 42882 - DNA, 601 bp, Human
cttatatgtaagtattttattttcttggtgcaactgtaaatggtattatgtttgtgatttcagttttcactagtccattgtggggatacagaaatgcagtcaattcatagccacggatcttgtatcctgtcattgtaatgagctcatttttcagttgtaagaggttttgttttgggttttgtagaatcagtctttcatcctcaactgtgaaattggttgtaggttttttgtaaatgctctgtataaaggagtggaaggcagttccctgggccacctgttgctgtggtgtgggtggatgggsaaaagcccctgggtctgggtctcctggagccaccggatagggagtggtccacacagcagcatcaggctgtccactggtggcttgggtgtggagcgggccttgggctcccactaggtctcactgagcttcccctttggcctgacagagccttttggttttgctttattttgttttctctatacctgttggcggttctggttacaggccttcctgtgcccacactggaaggatacaggagataaaacagaagtccagggtctcatggtgttgctaccccctcatgtcctgaggccccagtca

SEQ ID NO: 42883 - DNA, 601 bp, Human
attatatgacaattctatttttagttttgtgaagggactattttccagagtgggtatgttttacattcccacagcaacgtaggagagatcccatttctcacaccctcagcagcgtttggtggtatcactctttttatttgtgccattctgatagatgcgcagtggtatctctgagtggctttaatttgcatttccctgttttgtaaagatgttgaacatcttttcatgtgcttacttgccatctgcataccttcttcagtgaatgtctcatgtcttgcccatttttaaacaggattcattkttttgttaatgttcaattttgagagttctttacgtattctagatattagtgctttgttgggtatgtgatttgcaaatattctctctcgtctggaatttctctgctctttttcattggatctttcccacagcaaaggataatgcttttggtgtcaagtctatgaattctttgtctagtcttagatcccaaaaatgttttatgttttcttttagaagttttatcgttttacatttaaatctataatctttaacaagttaatttttatatgaggtatgtgaggtttagggttttttttttttc

SEQ ID NO: 42884 - DNA, 601 bp, Human
ttcctttttactactgactagtattccaccgtatggagggatcacagtttctttaaccacttaccttttgaggaacatctaggttatttccagtgttgggttattatttaaaaaaaaatgctgcgatgaacatttctgcaaagcttctctgtgaatgtaagttctcatttatctggggtaaatgcccaggagtgcaactggtggattatatgacaattctatttttagttttgtgaagggactattttccagagtgggtatgttttacattcccacagcaacgtaggagagatcccatttstcacaccctcagcagcgtttggtggtatcactctttttatttgtgccattctgatagatgcgcagtggtatctctgagtggctttaatttgcatttccctgttttgtaaagatgttgaacatcttttcatgtgcttacttgccatctgcataccttcttcagtgaatgtctcatgtcttgcccatttttaaacaggattcattgttttgttaatgttcaattttgagagttctttacgtattctagatattagtgctttgttgggtatgtgatttgcaaatattctctctcgtctggaat

SEQ ID NO: 42885 - DNA, 601 bp, Human
tatccttttgaaattaggttttcctaacttttattttaggtttgggggtttgttacacaggtaacaaacctatgcacatgtgaaggtttgttacattggtaaactcacgttataggggtttgtgtacagattatttcatcacccaggtattaagcctagtacccaacagttatcttttctgcttctctttctcctctcaccctccaccctcaggtagactccagtgtctgttgttcccttctttctgttcataattctcatcatttagctcccaggctttttccattcaccgaaatctccytgaggcccatgcaagttgctgtgtttatcaacagtctgttcctttttactactgactagtattccaccgtatggagggatcacagtttctttaaccacttaccttttgaggaacatctaggttatttccagtgttgggttattatttaaaaaaaaatgctgcgatgaacatttctgcaaagcttctctgtgaatgtaagttctcatttatctggggtaaatgcccaggagtgcaactggtggattatatgacaattctatttttagttttgtgaagggactattttccagagtgggtatg

SEQ ID NO: 42886 - DNA, 601 bp, Human
cgcagcatatatccttttgaaattaggttttcctaacttttattttaggtttgggggtttgttacacaggtaacaaacctatgcacatgtgaaggtttgttacattggtaaactcacgttataggggtttgtgtacagattatttcatcacccaggtattaagcctagtacccaacagttatcttttctgcttctctttctcctctcaccctccaccctcaggtagactccagtgtctgttgttcccttctttctgttcataattctcatcatttagctcccaggctttttccattcaccraaatctccttgaggcccatgcaagttgctgtgtttatcaacagtctgttcctttttactactgactagtattccaccgtatggagggatcacagtttctttaaccacttaccttttgaggaacatctaggttatttccagtgttgggttattatttaaaaaaaaatgctgcgatgaacatttctgcaaagcttctctgtgaatgtaagttctcatttatctggggtaaatgcccaggagtgcaactggtggattatatgacaattctatttttagttttgtgaagggactattttccaga

SEQ ID NO: 42887 - DNA, 601 bp, Human
attaataactcaatggtcatattttaagctttttatttcggaataattacagattcataggaagttgcaaagaaatgtacagggaggtcccatgcacccttcacccagcctcccctaaggccaccatgccccaaaaccagaggacaaaatcaaaaccgggaaattggcattggtacagccgacaaagcttattcagatttctctagctttaagtgcattcgtgtgcgtgtgtgtgcgcatgtgcatctgtgcagtttctcaaccacaaccgaaatagtacccacacacaatcaagatggcrccaatgggacaagacccctcatgctacctctctggggccacgttcaccccctcctgcatccctaacccctggcaaacactaacttgtccctcatccccctaagaatgttatttcacaaatgttctataaatgggatcacgcagcatatatccttttgaaattaggttttcctaacttttattttaggtttgggggtttgttacacaggtaacaaacctatgcacatgtgaaggtttgttacattggtaaactcacgttataggggtttgtgtacagattatttcatcacccaggtattaa

SEQ ID NO: 42888 - DNA, 601 bp, Human
gacagccaagtctccttagaggccaggtctgggggaaaaaaagcaacattctcccactctccctcaagttactcataaatcttaatgcttatcttcatacccgtgagagatgccgttgaccaagatcttcatctctgctggaaagagggtaaatctacactagccctccttagcaaggcggcaggctcgtcctctctcccgctctgcagagcatgctgggtcctgaaaacctcacattcccaccactgggcactccgttggcaggagccccacctgggcaacatgtgcactgggcacaccraatttccatgtcttcttcttatgctgactccttaccattaataactcaatggtcatattttaagctttttatttcggaataattacagattcataggaagttgcaaagaaatgtacagggaggtcccatgcacccttcacccagcctcccctaaggccaccatgccccaaaaccagaggacaaaatcaaaaccgggaaattggcattggtacagccgacaaagcttattcagatttctctagctttaagtgcattcgtgtgcgtgtgtgtgcgcatgtgcatctgtgcagtttctcaacc

SEQ ID NO: 42889 - DNA, 601 bp, Human
ccctttataactagacagccaagtctccttagaggccaggtctgggggaaaaaaagcaacattctcccactctccctcaagttactcataaatcttaatgcttatcttcatacccgtgagagatgccgttgaccaagatcttcatctctgctggaaagagggtaaatctacactagccctccttagcaaggcggcaggctcgtcctctctcccgctctgcagagcatgctgggtcctgaaaacctcacattcccaccactgggcactccgttggcaggagccccacctgggcaacatgtgyactgggcacaccaaatttccatgtcttcttcttatgctgactccttaccattaataactcaatggtcatattttaagctttttatttcggaataattacagattcataggaagttgcaaagaaatgtacagggaggtcccatgcacccttcacccagcctcccctaaggccaccatgccccaaaaccagaggacaaaatcaaaaccgggaaattggcattggtacagccgacaaagcttattcagatttctctagctttaagtgcattcgtgtgcgtgtgtgtgcgcatgtgcatctgtg

SEQ ID NO: 42890 - DNA, 601 bp, Human
ggtgaagggctgtgatattcccaggatcaaggctgggataatatgtaactccagcgtatgtgcgtcggcgcatccctgccaactgtaattatccaaattgctcataactacaagaacaagtacattaaaataaagtacttttggtatttccaggagttaatgtaatctcatcttccagagcattttatgtaccctttataactagacagccaagtctccttagaggccaggtctgggggaaaaaaagcaacattctcccactctccctcaagttactcataaatcttaatgcttatcttcrtacccgtgagagatgccgttgaccaagatcttcatctctgctggaaagagggtaaatctacactagccctccttagcaaggcggcaggctcgtcctctctcccgctctgcagagcatgctgggtcctgaaaacctcacattcccaccactgggcactccgttggcaggagccccacctgggcaacatgtgcactgggcacaccaaatttccatgtcttcttcttatgctgactccttaccattaataactcaatggtcatattttaagctttttatttcggaataattacagattcatag

SEQ ID NO: 42891 - DNA, 601 bp, Human
caggtgaagggctgtgatattcccaggatcaaggctgggataatatgtaactccagcgtatgtgcgtcggcgcatccctgccaactgtaattatccaaattgctcataactacaagaacaagtacattaaaataaagtacttttggtatttccaggagttaatgtaatctcatcttccagagcattttatgtaccctttataactagacagccaagtctccttagaggccaggtctgggggaaaaaaagcaacattctcccactctccctcaagttactcataaatcttaatgcttatctycatacccgtgagagatgccgttgaccaagatcttcatctctgctggaaagagggtaaatctacactagccctccttagcaaggcggcaggctcgtcctctctcccgctctgcagagcatgctgggtcctgaaaacctcacattcccaccactgggcactccgttggcaggagccccacctgggcaacatgtgcactgggcacaccaaatttccatgtcttcttcttatgctgactccttaccattaataactcaatggtcatattttaagctttttatttcggaataattacagattcat

SEQ ID NO: 42892 - DNA, 601 bp, Human
ttcaggaatatcccatagcagtatagtatttatttctctttggtgtccatttctcataactgtgttacaaaggcatgtttacctaggtgacagcaatgacttaacagcgggcttgtatccaatacccattctgtttagaagacactggctacaccttagctccagtttaaactccagtgtcacaggtgaagggctgtgatattcccaggatcaaggctgggataatatgtaactccagcgtatgtgcgtcggcgcatccctgccaactgtaattatccaaattgctcataactacaagaamaagtacattaaaataaagtacttttggtatttccaggagttaatgtaatctcatcttccagagcattttatgtaccctttataactagacagccaagtctccttagaggccaggtctgggggaaaaaaagcaacattctcccactctccctcaagttactcataaatcttaatgcttatcttcatacccgtgagagatgccgttgaccaagatcttcatctctgctggaaagagggtaaatctacactagccctccttagcaaggcggcaggctcgtcctctctcccgctctgcagagca

SEQ ID NO: 42893 - DNA, 601 bp, Human
ccttagtacttatttcccctgagaaaatggggaaaggacgggctttactccagggtactactgcaatgttagaagcagcctttctttatggtgagcgagcagtgtgtttgcagaagcatttcctattgagagcttccttgtcttcccatataactgcaagacacctgccccgagttcactgtaaacttgtctggtggagcaatgcgtctaaccacaagctgggtcattcaggaatatcccatagcagtatagtatttatttctctttggtgtccatttctcataactgtgttacaaaggcrtgtttacctaggtgacagcaatgacttaacagcgggcttgtatccaatacccattctgtttagaagacactggctacaccttagctccagtttaaactccagtgtcacaggtgaagggctgtgatattcccaggatcaaggctgggataatatgtaactccagcgtatgtgcgtcggcgcatccctgccaactgtaattatccaaattgctcataactacaagaacaagtacattaaaataaagtacttttggtatttccaggagttaatgtaatctcatcttccagagcattttatgta

SEQ ID NO: 42894 - DNA, 601 bp, Human
gcaaggtgacagtgacaccttcacatccccagcaaagccacccttggcaacctccctaaccacactgttaatatgaaagcctaaggggcctctcccaccatagaattacaacctcagggcttggctgggagctgaggtgtcgccctttaatctccatcctagaatcatattttagtaatccagcaacggagtgttattactcaagtgcagatgaagttttgattttctgcatctttaaactcactatgcaacagagtccctcggggctttttaagagaagcagccctttgagagttgtggygcttgatgataatatcgcatgtggcacttccttagtacttatttcccctgagaaaatggggaaaggacgggctttactccagggtactactgcaatgttagaagcagcctttctttatggtgagcgagcagtgtgtttgcagaagcatttcctattgagagcttccttgtcttcccatataactgcaagacacctgccccgagttcactgtaaacttgtctggtggagcaatgcgtctaaccacaagctgggtcattcaggaatatcccatagcagtatagtatttatttctctttggtg

SEQ ID NO: 42895 - DNA, 601 bp, Human
gtgaaaacacccaaaatctactcttttagccaatttccggtatataatacaagagtaactaccatattagcttcagtcctcatgctgtgcattagaccttgaggcttatttttcctacctgcccctcaacagggttcacaacagcattattcaaaagaaccaggatacagaagcaacctaagtgtccaatgaggaatgaatggataaagaaaattgtatatacacacaattcaatactatgcagccttttaaaagaaggaaatcctgccatttgcaacgatgtggatgaacctgagggacytgaagtgaaataagccagacacagagatgctgtgtgatctcacgctaacaaacaatctcaaacacacggacagagtagaaaggaggctcccggcgcagggagtgggagaaatgcggagacggtagtcacagggcaggaagtttcaaggctgcaggacgcataaacctagggctttccatgtagtagatgttgatgctgactggtcctgctgacctgaagatcaaagccgaaagtgtctttcagccctcagaggatttcccatctaacatgaacgagcgccactgggtaatggaccagaag

SEQ ID NO: 42896 - DNA, 601 bp, Human
tttctaacctttcctctttgctaattctcttctctttccaacttcctttccgcgggttgtctgaaccaaccatcctacaggtccagcttggcaagagaaacacacccaacaacagagtggcaacactggctgcaaaatgagaagcatttaaggctcacggtgcaggctgaacaccaaagccaggcaatcacgcacgtcgatttcatcaaactcctgtctacccaagtgaacatcaaggctggacaggcccagcaccttctgaagggtgtcttccaggcagcgcggccagagctgagcagcytccctgttccctcaggcagctttgtccctacctctagcaaacacacacacagtgccaaccatgtgccaggagccatcctgaatcctttgcagctattggctcatgggcaccagtgcccatagcaaccctaggaagtgggcactatcgttactgtcggttcacagtaggagatgagggctgaagtcacttgcaaaagtctccgatccagcaagaccgtctatgcatgtgctgtccctctccctggcctgcaagtctctcgaaggcaagacccagtatttaccttcaggtccacacaccacc

SEQ ID NO: 42897 - DNA, 601 bp, Human
cttgggcacagcctcctccctcccaatcagtattccacttttatattttctttaagagactgggtcatattctgtcacccaggctggagtgcagtggtactatcattgctcactgaaccccaaactcccgggctcaagcggtcctcccacctcagcctcccaagtagctggaattacaagctcgtgccaccacgcccagctaattttttattttatttatttatctatttatttttgagacggagtctcactctgtcgccaaggctagagtgcagtggtgcaatctcggctcactgccagmtctgcctccggggctcacgccattctcccgcctcagcctcccgagtagctgggaccacaggtgcctgccaccacggccggctaattttgtgtatttttagtagagatggggtttcaccgtgttagccaggatggtctcgatctcctgacctcgtgatccgcccacctcgggctcccaaagtgctgggattacaggcatgagccaaagcgcctggcctaatttttcaatttttagtagagacaagatctcactatgttggccaggctgatcttgaactcctcacctcgagtgatcatcttg

SEQ ID NO: 42898 - DNA, 601 bp, Human
taagatgtgacttcacacccgatagatggctagagtctgaaacagacaggtaagcattggaggatgtggagaaagtggaaccctcggagaactgctggtgggaatgcaaacagctctccagttaaacctcaggggtatcgtgtgctccagcaagtctcctcctagggacatacacaagagaaatgaaaacacacgtctatacactaacttgtacacaaatgttcacagcagcattattcatagtagccaaaagtagaaacagcccaaatgtccatcaatgacaaatggataaacaagatgyggtacatccatacaatgggataccatttaacaatgaacaaaaatcaagtactgatacaggctacaatatgaatgagcctgcaaacatgctatgtgaaggaaaccagttacaaaggaccatgtattacacatgatccatttttgtgaaatgcgcagactaggtaaatctgtggaggattaggaggtgacagctaaggaatatggggctcatttttctgctaaaaatgtgctaggccaggtgcagttgctcacacctgtaatcccagcactttgggaggccgaggcaggatgatcacttgag

SEQ ID NO: 42899 - DNA, 601 bp, Human
cctgggcaacagagggagactgtgtctcaaaaaaaacgaacaaacaaaaaaaaaacaaactactctctcagcaagtatacaatacattgtcattatttattattatgctattatatgctattaactactaactatgtgtgttattaactattcattactccacaatgtatatatatttcaaaacatcatgttttacaccataaatatacacaattttttgtcaattaaaaataataatttaaaaagtctgtgcttcaaagggcataatcaaggaagcaaagagacaacctgcagaatgggraaaagtttttgcaagtcctattatctgactggaacttgtatctactaaaaactgcaactaaataataaaaggctgaatttaaaaatgggtgaaagatttgactagacaattccccaaagatgatacataagtggccaataaacacatcaaacatcatgtacttaacatcagtagccatctggaaaatgcaaatccaaaccacaataagatgtgacttcacacccgatagatggctagagtctgaaacagacaggtaagcattggaggatgtggagaaagtggaaccctcggagaactgct

SEQ ID NO: 42900 - DNA, 601 bp, Human
cacctgtggtcccagctacttgggaggctgaggcaggagaaaggagtgaacccgggaggcggagcttgcagtgagcccagatggcgccactgcactccagcctgggcaacagagggagactgtgtctcaaaaaaaacgaacaaacaaaaaaaaaacaaactactctctcagcaagtatacaatacattgtcattatttattattatgctattatatgctattaactactaactatgtgtgttattaactattcattactccacaatgtatatatatttcaaaacatcatgttttacaccawaaatatacacaattttttgtcaattaaaaataataatttaaaaagtctgtgcttcaaagggcataatcaaggaagcaaagagacaacctgcagaatggggaaaagtttttgcaagtcctattatctgactggaacttgtatctactaaaaactgcaactaaataataaaaggctgaatttaaaaatgggtgaaagatttgactagacaattccccaaagatgatacataagtggccaataaacacatcaaacatcatgtacttaacatcagtagccatctggaaaatgcaaatccaaacc

SEQ ID NO: 42901 - DNA, 601 bp, Human
gacttgggcttctttacaccttccttcctttccaaagaaaaccacgccacaagttcaagaatttggagattcctgaacaggctctcaggaggagacccagaccctttctctccgggggggtcctgtgtccctgcactggccacatgatctcttaacagcccagttcgccacggcccccttccgtcttccctcactgtggctctgggatcttcagtcccaaactcagaggtgacaacttatttctgtccccctgcattgtcccatgaggtcatgacattttaagatggtctatattaaaccygtttcaaaagaaacaagtggctttagtaaacgtgccacctgatgaggctttcagcacttacctgctcctgggaatcactgtttcaaacctaaggacttcatttcctcagactttgaaaggaagccaggaaaatgattcactgaactatgttctcagagtgggacggcaatacttcccaggcttcagagctttggctgtgccgggcctcccttcatctggctgcttcgctacatgattcaaagccaaaattatatttggggcaaatgatgagtctgcaatgaaatgcaaacaaaagtccca

SEQ ID NO: 42902 - DNA, 601 bp, Human
ccgtatttgatatcatttgtattgctttatccagtcataagcatttccatgtaaccagaaagtatcttaaaatataatttaataaatacacagtattccagtaagtgaaccatgatatctaattattatatggatttggcagcactcatgctgtgttttacatgtgctgttgtaaaaactgactatcctcgggcactgtgatctttgactgcatcaaagattatcttcccaggatagatttatagaaatggaattgttcactcaaaaaggtaggcatttctatggctggtgattcctggcaaccttattaataaagctttgctccacatcatgcataacgctggaacatgtgcgagaaaggagggggtaacagacacacaactccagtctgtttgcaagaaccaacatggagtaaggaggcggaaagtcgatgcaaattttatttccttctttcccatttttctggtaataacacaagtgtattaaaataatgtggtgaaaagtgcctctttacagacaaattttcataaagcctggtcacatctgtctgggagaaagggggaaggttcgttcaaacctctccatggctggctggtgatgt

SEQ ID NO: 42903 - DNA, 601 bp, Human
gttcccaaaacaaatgaagcagaaaatgacagaactgaaggatgaaatagacaatttaacaataacagagaatccagtgccccactttcaacaataaatagaactagcagaaattaacaaggaaatagaagacttgaaaaatattataaatgaactagacctgacagacaactgtagaatactctgcccagcaacagtagaataaactttcttcttaagtgcacgtggcgtgtcctgtattacagaccataagctaagccatagaacaaaactcagtaagtttaaaggatcgataccataytaagtaggcttttggaatgaacttagaaatgaaatcaataactgaagcaaatttgagaaagacatacatacgtggacattaaacaatccactcttaaataaccaatggatcacaggggaaatcacagggaaattaggaaatactttgagatgaacgcaaacaaaaatccaacacaccaaaacatacgggatgcagctaaagcagggcttagagggaaatttaacatcccgtatttgatatcatttgtattgctttatccagtcataagcatttccatgtaaccagaaagtatcttaaaat

SEQ ID NO: 42904 - DNA, 601 bp, Human
aaaaaaggtcaatccatcagaaggccataacaattataagcaaaaataaagctaactgtaagttcccaaaacaaatgaagcagaaaatgacagaactgaaggatgaaatagacaatttaacaataacagagaatccagtgccccactttcaacaataaatagaactagcagaaattaacaaggaaatagaagacttgaaaaatattataaatgaactagacctgacagacaactgtagaatactctgcccagcaacagtagaataaactttcttcttaagtgcacgtggcgtgtcctgtaktacagaccataagctaagccatagaacaaaactcagtaagtttaaaggatcgataccatattaagtaggcttttggaatgaacttagaaatgaaatcaataactgaagcaaatttgagaaagacatacatacgtggacattaaacaatccactcttaaataaccaatggatcacaggggaaatcacagggaaattaggaaatactttgagatgaacgcaaacaaaaatccaacacaccaaaacatacgggatgcagctaaagcagggcttagagggaaatttaacatcccgtatttgata

SEQ ID NO: 42905 - DNA, 601 bp, Human
actcattcctcttccttacatttttaacattctcactttttttgtggtttttttttttgcattttaacgaaacacatttaatatcctatgtcagtgaagtcagtgaagatggtggagtgaaggacctccaaaaattatctccttcataaaagcagtgagaaagaacaatggcaaaataccgtcaaaatcaacttttttcaggtctctgaaaattaatcaaatattagcaacaatccaaaaacatttattcaagaaaaatggctgaaactcagtaagaacagtgagctttgtagcgttttaygtttccgtatttcctactctcctcactgcagctccaaggtagcctttaaaaccagccactaggccaggtgctgtggttcatgcctgtaatcccagtgctttggaaggctaaggcaggaggttcgcttaagcccaggagtctgaggttgcagtgagcaccactgcactccagcccaggtgatagaacgacaccttcactctgggaaaaacaaaacaaaacaaaacaagaaaccagctaccgaagggcaaaatacgaggttggagctccttcaaagtccataccagagaactatcattagtt

SEQ ID NO: 42906 - DNA, 601 bp, Human
tggaagcagaagggttgcttgagcccaggtggttgaggctacagagagccatgatcacaccactgcactccagcctggacaagggagcaagaccctgtctcaaaaaaaaaaaaaatagaaaaaagaaaaaacatttctcaactcattcctcttccttacatttttaacattctcactttttttgtggtttttttttttgcattttaacgaaacacatttaatatcctatgtcagtgaagtcagtgaagatggtggagtgaaggacctccaaaaattatctccttcataaaagcagtgagaragaacaatggcaaaataccgtcaaaatcaacttttttcaggtctctgaaaattaatcaaatattagcaacaatccaaaaacatttattcaagaaaaatggctgaaactcagtaagaacagtgagctttgtagcgttttatgtttccgtatttcctactctcctcactgcagctccaaggtagcctttaaaaccagccactaggccaggtgctgtggttcatgcctgtaatcccagtgctttggaaggctaaggcaggaggttcgcttaagcccaggagtctgaggttgcagtgagcacca

SEQ ID NO: 42907 - DNA, 601 bp, Human
taagaactattgatgcttctgcaatgtacaaactttcagaaattaactattcaaagaagcaacattttttaaattaaacttttattgtttttgaaaaaaatctcaagagtgaaacagaaactggggtttgggcttggaaagcacacagtgtttttaaattaatggagggtttaatattttaaagaatctggcttcaatggtatggctaatggcattagcaacagaaaaaaacctcttctgcatcttgattacacattaacaacagtatcgatgatagtaatagtacagacaattgttcaaytcttatagatcatgaggaatattcacacacaacctcatttaattcatacaatgttttcagaagagttatattacacccatttaatagaggataaaattgagaccagaaaaacaaagtggcctgcacaagttcaaataacaactgaaaacttgaggacgtcccccaggtgcccttctgtgggttcagtgcccttacacaggcattcctcctgcttttgagtcagatacccactatgttgtatttcaaatgctaagatttaagtgactggaccaaattgtttctaaatagaagtcttccaag

SEQ ID NO: 42908 - DNA, 601 bp, Human
atctaaataacaactctttttttttcaaggacatgaaaaaaataagaactattgatgcttctgcaatgtacaaactttcagaaattaactattcaaagaagcaacattttttaaattaaacttttattgtttttgaaaaaaatctcaagagtgaaacagaaactggggtttgggcttggaaagcacacagtgtttttaaattaatggagggtttaatattttaaagaatctggcttcaatggtatggctaatggcattagcaacagaaaaaaacctcttctgcatcttgattacacattarcaacagtatcgatgatagtaatagtacagacaattgttcaactcttatagatcatgaggaatattcacacacaacctcatttaattcatacaatgttttcagaagagttatattacacccatttaatagaggataaaattgagaccagaaaaacaaagtggcctgcacaagttcaaataacaactgaaaacttgaggacgtcccccaggtgcccttctgtgggttcagtgcccttacacaggcattcctcctgcttttgagtcagatacccactatgttgtatttcaaatgctaagattt

SEQ ID NO: 42909 - DNA, 601 bp, Human
ttagactttccatctaggattgtaaattctaccttcactaaattgtgagtcatttaatctaaataacaactctttttttttcaaggacatgaaaaaaataagaactattgatgcttctgcaatgtacaaactttcagaaattaactattcaaagaagcaacattttttaaattaaacttttattgtttttgaaaaaaatctcaagagtgaaacagaaactggggtttgggcttggaaagcacacagtgtttttaaattaatggagggtttaatattttaaagaatctggcttcaatggtayggctaatggcattagcaacagaaaaaaacctcttctgcatcttgattacacattaacaacagtatcgatgatagtaatagtacagacaattgttcaactcttatagatcatgaggaatattcacacacaacctcatttaattcatacaatgttttcagaagagttatattacacccatttaatagaggataaaattgagaccagaaaaacaaagtggcctgcacaagttcaaataacaactgaaaacttgaggacgtcccccaggtgcccttctgtgggttcagtgcccttacacaggca

SEQ ID NO: 42910 - DNA, 601 bp, Human
gtaagtcaaagttttagccaaatagaattgctaatttcaacctaaaataaaaacaagctagattcctatgtaatattttttcttagactttccatctaggattgtaaattctaccttcactaaattgtgagtcatttaatctaaataacaactctttttttttcaaggacatgaaaaaaataagaactattgatgcttctgcaatgtacaaactttcagaaattaactattcaaagaagcaacattttttaaattaaacttttattgtttttgaaaaaaatctcaagagtgaaacagaaaytggggtttgggcttggaaagcacacagtgtttttaaattaatggagggtttaatattttaaagaatctggcttcaatggtatggctaatggcattagcaacagaaaaaaacctcttctgcatcttgattacacattaacaacagtatcgatgatagtaatagtacagacaattgttcaactcttatagatcatgaggaatattcacacacaacctcatttaattcatacaatgttttcagaagagttatattacacccatttaatagaggataaaattgagaccagaaaaacaaagtggc

SEQ ID NO: 42911 - DNA, 601 bp, Human
tgaatcaatgtttaactgcagtaagtcaaagttttagccaaatagaattgctaatttcaacctaaaataaaaacaagctagattcctatgtaatattttttcttagactttccatctaggattgtaaattctaccttcactaaattgtgagtcatttaatctaaataacaactctttttttttcaaggacatgaaaaaaataagaactattgatgcttctgcaatgtacaaactttcagaaattaactattcaaagaagcaacattttttaaattaaacttttattgtttttgaaaaaaayctcaagagtgaaacagaaactggggtttgggcttggaaagcacacagtgtttttaaattaatggagggtttaatattttaaagaatctggcttcaatggtatggctaatggcattagcaacagaaaaaaacctcttctgcatcttgattacacattaacaacagtatcgatgatagtaatagtacagacaattgttcaactcttatagatcatgaggaatattcacacacaacctcatttaattcatacaatgttttcagaagagttatattacacccatttaatagaggataaaattga

SEQ ID NO: 42912 - DNA, 601 bp, Human
ccccagggtcctgacacacctttgcctatcgcacaataaggctacatgaggcaagtaatactcccagtttacagaggagcacaaggcctaagtgtcgcacccaaattgacacaatgagcttctaagcagagtggaaacaaaaccctgacctgtctcactccaaggacaaacctagtcacataccctctgtacccctctctctctcacacacatacagaacctgctgcttagaaaataattattagagaaaattaccttagagataactatttcccctcaccttttataccttatacaaagyagtatatcatcaattcaccgttgaatcaatgtttaactgcagtaagtcaaagttttagccaaatagaattgctaatttcaacctaaaataaaaacaagctagattcctatgtaatattttttcttagactttccatctaggattgtaaattctaccttcactaaattgtgagtcatttaatctaaataacaactctttttttttcaaggacatgaaaaaaataagaactattgatgcttctgcaatgtacaaactttcagaaattaactattcaaagaagcaacattttttaaattaaac

SEQ ID NO: 42913 - DNA, 601 bp, Human
ggcaggccccagggtcctgacacacctttgcctatcgcacaataaggctacatgaggcaagtaatactcccagtttacagaggagcacaaggcctaagtgtcgcacccaaattgacacaatgagcttctaagcagagtggaaacaaaaccctgacctgtctcactccaaggacaaacctagtcacataccctctgtacccctctctctctcacacacatacagaacctgctgcttagaaaataattattagagaaaattaccttagagataactatttcccctcaccttttataccttatrcaaagtagtatatcatcaattcaccgttgaatcaatgtttaactgcagtaagtcaaagttttagccaaatagaattgctaatttcaacctaaaataaaaacaagctagattcctatgtaatattttttcttagactttccatctaggattgtaaattctaccttcactaaattgtgagtcatttaatctaaataacaactctttttttttcaaggacatgaaaaaaataagaactattgatgcttctgcaatgtacaaactttcagaaattaactattcaaagaagcaacattttttaaa

SEQ ID NO: 42914 - DNA, 601 bp, Human
tgtttagagaatgacgacaagaaaaaaaggtctgtatgtgttcagtatagacccagtgatttttgtctttaatacttttagatctgaatccagggatgcagaacccatggatacggagggctggctgtgtgtgttatttacaaatatatgttgtaggatgccaagttgttcggtagtacttctgaaaacacaaataatggtaaataataacctatgttttttcagcatttcattaacattctagactggatatgtaactttgggacaggtgtgaattttattgatctgacctatgctttgycctcccatttctgctggcctaatgatcagagtggcaggcaggccccagggtcctgacacacctttgcctatcgcacaataaggctacatgaggcaagtaatactcccagtttacagaggagcacaaggcctaagtgtcgcacccaaattgacacaatgagcttctaagcagagtggaaacaaaaccctgacctgtctcactccaaggacaaacctagtcacataccctctgtacccctctctctctcacacacatacagaacctgctgcttagaaaataattattagagaaaattacctt

SEQ ID NO: 42915 - DNA, 601 bp, Human
gttttcttccacattactctagggtccaaatgatctacaggaaatactgtgtaccttttagaattatgaaaattcagtcaaccctccagtatggaatcctgtgggaaactggttctaggagtcccccataccaaaattcacagatgcggaagtttctgatctaaaatggcatagtgtttgcatataatctatacacatcctcccacagactttcaatcatctctagatgcttataatacctaatacaatggaaatgccacgtaaatagttattatattgtattgtttagagaatgacgacmagaaaaaaaggtctgtatgtgttcagtatagacccagtgatttttgtctttaatacttttagatctgaatccagggatgcagaacccatggatacggagggctggctgtgtgtgttatttacaaatatatgttgtaggatgccaagttgttcggtagtacttctgaaaacacaaataatggtaaataataacctatgttttttcagcatttcattaacattctagactggatatgtaactttgggacaggtgtgaattttattgatctgacctatgctttgccctcccatttctgctggc

SEQ ID NO: 42916 - DNA, 601 bp, Human
cgtaggaaacataatactgttgggacaaacatgggacacaaaactacagctatgccaaattggtaacagctctgaatggcaaagaatcctgcaaatgatggctgttttcttccacattactctagggtccaaatgatctacaggaaatactgtgtaccttttagaattatgaaaattcagtcaaccctccagtatggaatcctgtgggaaactggttctaggagtcccccataccaaaattcacagatgcggaagtttctgatctaaaatggcatagtgtttgcatataatctatacacaycctcccacagactttcaatcatctctagatgcttataatacctaatacaatggaaatgccacgtaaatagttattatattgtattgtttagagaatgacgacaagaaaaaaaggtctgtatgtgttcagtatagacccagtgatttttgtctttaatacttttagatctgaatccagggatgcagaacccatggatacggagggctggctgtgtgtgttatttacaaatatatgttgtaggatgccaagttgttcggtagtacttctgaaaacacaaataatggtaaataataacctatg

SEQ ID NO: 42917 - DNA, 601 bp, Human
tggaaacaaaaagatgtcatttttgcctgccttaaaggaaagatcaaatttaagggggtggcccagtgtcagtgagagttggggaggggcctctctgggtgagcatttcaactgtggcatccaattttggaaggggttttgcttgaaatcactggaaaagtgcacaaatttgtctacaaggatctatgcccaggtcaaaacaaataatgaagtcaatggtcacactctttagagcagaaacattgtagtctttagaaatcatatttttgcagaatatttcatggcgtaggaaacataataytgttgggacaaacatgggacacaaaactacagctatgccaaattggtaacagctctgaatggcaaagaatcctgcaaatgatggctgttttcttccacattactctagggtccaaatgatctacaggaaatactgtgtaccttttagaattatgaaaattcagtcaaccctccagtatggaatcctgtgggaaactggttctaggagtcccccataccaaaattcacagatgcggaagtttctgatctaaaatggcatagtgtttgcatataatctatacacatcctcccacagactttc

SEQ ID NO: 42918 - DNA, 601 bp, Human
taatcaaaacagcacaatattggtacaaaaatagacacacagaccaatggaatggaagagaacactgatacattcaactgatctcacaaagtcgacaaaaacgtaacaccaggaaaaaggacacccttttcaataaatggtgctggggaaattggattgctacatgcagaagaatgatctgggacccctatctctcactctatacacaaatcaagatagattaaagacttaactctaagacctgaaactataaaagtattagaagaaacccgagggaagactgctggacgttggtctaggyaaagaattcatgacgaagacctcaaaagcacaagcaacgaaaacaaaaatagagaaatgggacttaaactaaaaaagcttctgcacagcaaaagaaataatcaacagagtgaatagacagcctgcagaataagagaagacatttgcaaactatgccgctgacaggggattaacatccagaatttacaaggaactcaaacaaatttacaaaaaccaagtaactccattaaaaagtgggcaaagaacatgaatagacatttttcaaaactagacatataaatggccaacaagcaagtgaaaa

SEQ ID NO: 42919 - DNA, 601 bp, Human
atttaatcctatgaaagggtctaaataagattgataaaataatttacagaagtgcagaaaacaactgctcaaatgcgcacaaattattctttcctttcccccaaatctctagtctactctgattatagctgggaggacactgatcaccaccatggttcaaaagaaataacaaggttcaattgtcagttcagctcaatacatggatatccacctctacacattatttaacctttcctggggtcagatttcttgtctctaaaatgggaacaatacaacacggggctcttgtgaagatgaaacrgtttaaagaatttgaaagattacatgtaataatatgatgatgataaaattctgtttgcaatgtacattcctttaaagagaatatacaaagttgtattcatttttggttttcactagaaattagttttagtattctagttaatttttggctggtcagatggtagtgggttatcagaacttattaacattgctgtcactatacaatccccccactgctaaattttactagcttttaaaaaattatttttaaaaaaagcaatttgcatggaaattgtttgaaacatctgggatataaattcac

SEQ ID NO: 42920 - DNA, 601 bp, Human
aagttagtgaacttaaagacaaaccaatagaagctatccaatatgaaacagactttttttttttaaagataaggaaatgaaaagtacatcagtaatctatgggacaacttctagtagcctaatctatctgtaaattcaagtttggggggcggtgggaaacagagaaacatgcttaaagaaataatgatcaaaatgtttccacatttactgaaaaccatacagccacagattcaaaacactcagtaaaccccaagcacaggaaacaagaagaaaactacacccaggctcaccatattcaaaytgcttaaaatcaatgataggaaaaatcttgaaaactgagaaaaaaatattaataccttatatatacagagaagtaaaggtaagaactataacaaatgtcccattggaaacaatgaagcaaaaagacagaggagcatcatatgtcaggaagtgaaagaaaactgcccgcctagaactctgcactggtgcaaatgtattttaaaaacgtaggaaaaataaagacttgctcagacttaaacaaagacattcatcatgggcagacctgtaccatggcaaatgttcaacgaagtccttcaggcag

SEQ ID NO: 42921 - DNA, 601 bp, Human
taatttatctacaatcgacctgacttaaacacaaaggaaaaaatactcattttgttctactttaaattaaaacaagctatttttgttgttgttgttactgggctgtctctgtttttctctgaacgcaggggaatacagtattctgaagcactgcatgattattctctcttggctgtggaagggtggccaagcacactattgatctctgagtgggattgttagaaggacaaagtgtgatttcactttgaaagtgattacaaacctctacttctcactaagatagaataaaagtgcagtgcargatttactcttctgcatcaaataagtaagaaatgcatgttaagaaatgatttttagacacaggaatgaaggacaattatcctataataaggcaaaacaaggtgagctctctgtcccagttcatcatctgaggagccaggcagagcctgcaggcgccctgaatggagccccacggagacacgggcagatgaagtttgtaaggcagtgccccagaaggagagctctagttgtctctggagggtacccttgagattgtggctgaggcttgatcagtacatgcatgtgaggagacttccccaag

SEQ ID NO: 42922 - DNA, 601 bp, Human
ctaaatacacccacaaaccttttccaagaacacttgcatttgttcctgagctggtaagaatgctttgctgatgatatcaaagccctttaatttatctacaatcgacctgacttaaacacaaaggaaaaaatactcattttgttctactttaaattaaaacaagctatttttgttgttgttgttactgggctgtctctgtttttctctgaacgcaggggaatacagtattctgaagcactgcatgattattctctcttggctgtggaagggtggccaagcacactattgatctctgagtggsattgttagaaggacaaagtgtgatttcactttgaaagtgattacaaacctctacttctcactaagatagaataaaagtgcagtgcaagatttactcttctgcatcaaataagtaagaaatgcatgttaagaaatgatttttagacacaggaatgaaggacaattatcctataataaggcaaaacaaggtgagctctctgtcccagttcatcatctgaggagccaggcagagcctgcaggcgccctgaatggagccccacggagacacgggcagatgaagtttgtaaggcagtgccccaga

SEQ ID NO: 42923 - DNA, 601 bp, Human
acaggtcctggacgattcagcgcgaggtgggacacaacagggagggagaagtcagtatccaggggcactgcccggacccagaaggcggaggctgggatgtccccagcagaaacggacttccctggactccagcaggctctctgcggataagggattggagtgagtgagaggaaagaggaggacagaggcaaacttttctttctgcccagttctaggccatcaagggagtgaaggatccccaaagacataaggcagagctgggagaagaaaggagaggaggaaacaaaaaaaggaacaagargtaaggatgaggagacaaaacaaatggcatggaacatgctagaagccttccaatgacttccccatgtggaaactgcacacccgggcatccctcccggctttctgtggatgggcccatccaacgcagctcttgttagaggagtgcacactcccctctactatttggtaagtgtttgtagcaagaccagtgcataggtgggacgtgatctgaaagtttacaagaaggaagtgaaaaaccacttgtgagattgtggggagaaaacgctgggagcccagagacaccacaggcgtcaagagtcca

SEQ ID NO: 42924 - DNA, 601 bp, Human
caggacgaggagcccagggctgcccaggttctaaaagtaaaagcctcccacggaaaatagcacgccagggattccaacacgaggaatcgaggtggttagtgactcattttcagagccaggaaggtgaggtgcagccaagacccaagcaccatcaactacgtctgacagctaagaggagggcagccgagatcctcaggtgtaaccacagccttataaaggcacacaaagccaggacggtctgatctgagagtcagcagaagcctagctttacatataatgaagctggggctggaaggaggcsggaggatcatgttacatggcggggtctcccccagatgaccttaagggcagcttggcaggaattttacttccttgcattgattaaagcccatgaacagccttaagtccccagacaaaatagcaaaacaggtcctggacgattcagcgcgaggtgggacacaacagggagggagaagtcagtatccaggggcactgcccggacccagaaggcggaggctgggatgtccccagcagaaacggacttccctggactccagcaggctctctgcggataagggattggagtgagtgagaggaaaga

SEQ ID NO: 42925 - DNA, 601 bp, Human
tttacctcatacctgcctacaaaaggcacaagatcaacaaggcctgtttgtaccacggtctgaaaaacgagccagcaccgccctgggcaggacgaggagcccagggctgcccaggttctaaaagtaaaagcctcccacggaaaatagcacgccagggattccaacacgaggaatcgaggtggttagtgactcattttcagagccaggaaggtgaggtgcagccaagacccaagcaccatcaactacgtctgacagctaagaggagggcagccgagatcctcaggtgtaaccacagccttayaaaggcacacaaagccaggacggtctgatctgagagtcagcagaagcctagctttacatataatgaagctggggctggaaggaggccggaggatcatgttacatggcggggtctcccccagatgaccttaagggcagcttggcaggaattttacttccttgcattgattaaagcccatgaacagccttaagtccccagacaaaatagcaaaacaggtcctggacgattcagcgcgaggtgggacacaacagggagggagaagtcagtatccaggggcactgcccggacccagaaggcgga

SEQ ID NO: 42926 - DNA, 601 bp, Human
tgctgttccccacagacgggctgggaagcaggaagacaaccccactcctgcatttaatctctggtctccagcaacatactgtaacttaagcatgggaagatcctaaaacacatgacaggtgaggaagggactggagacacctagtcctgtttcccacaaccttcattttcagttccaccttggaccactgctgcctgggtcacccatgaagaagtggcctgccctggtagtcacaggttccaagtcgcccaagctggagagctacaagcacttccagaaaatctgggacatgcatggtgarccatccaaacgggaagaaggtcattacaaaaaaaaaaaaaaatgacggaacgtccatagtggaacctagtcttacacattaggctcatcacctagcaactagaacccttgctgagggtttccacatcacttcctgatcactcccagtgacccacagtggggacgtgttggggagatgatggatgcggggctagagcaggaaaaccattctcatgctcctcatttccccccagaccttctaataagatctgctgtcagaaagcccaagggcctggcttaagatcccctaacgttccctgtc

SEQ ID NO: 42927 - DNA, 601 bp, Human
tacattattcaatttctgctttaaacccttcgtttttattcattttccttttcttcttgagaaaatctcaaactcactcatggttccatatatgtactacgtgcctgagaacagtgctgttccccacagacgggctgggaagcaggaagacaaccccactcctgcatttaatctctggtctccagcaacatactgtaacttaagcatgggaagatcctaaaacacatgacaggtgaggaagggactggagacacctagtcctgtttcccacaaccttcattttcagttccaccttggaccrctgctgcctgggtcacccatgaagaagtggcctgccctggtagtcacaggttccaagtcgcccaagctggagagctacaagcacttccagaaaatctgggacatgcatggtgagccatccaaacgggaagaaggtcattacaaaaaaaaaaaaaaatgacggaacgtccatagtggaacctagtcttacacattaggctcatcacctagcaactagaacccttgctgagggtttccacatcacttcctgatcactcccagtgacccacagtggggacgtgttggggagatgatggatgcg

SEQ ID NO: 42928 - DNA, 601 bp, Human
atcaaaaatttgctgtgagcttttaagaataaacagggcaaatttactttattcaagaatgatattctttttgtaaagcctatcttcaaagtaatacattattcaatttctgctttaaacccttcgtttttattcattttccttttcttcttgagaaaatctcaaactcactcatggttccatatatgtactacgtgcctgagaacagtgctgttccccacagacgggctgggaagcaggaagacaaccccactcctgcatttaatctctggtctccagcaacatactgtaacttaagcaygggaagatcctaaaacacatgacaggtgaggaagggactggagacacctagtcctgtttcccacaaccttcattttcagttccaccttggaccactgctgcctgggtcacccatgaagaagtggcctgccctggtagtcacaggttccaagtcgcccaagctggagagctacaagcacttccagaaaatctgggacatgcatggtgagccatccaaacgggaagaaggtcattacaaaaaaaaaaaaaaatgacggaacgtccatagtggaacctagtcttacacattaggctcatcacc

SEQ ID NO: 42929 - DNA, 601 bp, Human
aaaccttaatttaagaaatccatctgcttcatcaaaaatttgctgtgagcttttaagaataaacagggcaaatttactttattcaagaatgatattctttttgtaaagcctatcttcaaagtaatacattattcaatttctgctttaaacccttcgtttttattcattttccttttcttcttgagaaaatctcaaactcactcatggttccatatatgtactacgtgcctgagaacagtgctgttccccacagacgggctgggaagcaggaagacaaccccactcctgcatttaatctctsgtctccagcaacatactgtaacttaagcatgggaagatcctaaaacacatgacaggtgaggaagggactggagacacctagtcctgtttcccacaaccttcattttcagttccaccttggaccactgctgcctgggtcacccatgaagaagtggcctgccctggtagtcacaggttccaagtcgcccaagctggagagctacaagcacttccagaaaatctgggacatgcatggtgagccatccaaacgggaagaaggtcattacaaaaaaaaaaaaaaatgacggaacgtccatagtgg

SEQ ID NO: 42930 - DNA, 601 bp, Human
aaatcacagagaaggaaaaaatcaaatggagtatcaaaccttaatttaagaaatccatctgcttcatcaaaaatttgctgtgagcttttaagaataaacagggcaaatttactttattcaagaatgatattctttttgtaaagcctatcttcaaagtaatacattattcaatttctgctttaaacccttcgtttttattcattttccttttcttcttgagaaaatctcaaactcactcatggttccatatatgtactacgtgcctgagaacagtgctgttccccacagacgggctgggaagcaggaagacaaccccactcctgcatttaatctctggtctccagcaacatactgtaacttaagcatgggaagatcctaaaacacatgacaggtgaggaagggactggagacacctagtcctgtttcccacaaccttcattttcagttccaccttggaccactgctgcctgggtcacccatgaagaagtggcctgccctggtagtcacaggttccaagtcgcccaagctggagagctacaagcacttccagaaaatctgggacatgcatggtgagccatccaaacgggaagaaggtcattac

SEQ ID NO: 42931 - DNA, 601 bp, Human
agatgaaggtggggcatgtggagaagccaggtacaggcagtaagggtctaatggaagaggggccacagggttgggagaggggacatgatgcctaagtgagaatgtccctcttgtgtccctgaaacctgagccctgcagatgcttcctgaaggatggaagagtctacactgtgggtcagggctccccagtggccgcagatgggatgaagccaccaccagaaagagcccaactgagtatggggtggggtgggccctgcaggatgtcacatgaagagcccatgagatgggagagaggagcataygtcgggcggggtgagacatgacccaggcatgcactccccaaaccttcagacacggcttactgcatggtggaggaatggagaacatgcattttactctgattttctctaaggaataaattttattttaaaatcacagagaaggaaaaaatcaaatggagtatcaaaccttaatttaagaaatccatctgcttcatcaaaaatttgctgtgagcttttaagaataaacagggcaaatttactttattcaagaatgatattctttttgtaaagcctatcttcaaagtaatacattattcaatt

SEQ ID NO: 42932 - DNA, 601 bp, Human
ccccaggctttgagggaagactggacgtagttgggagggtgtgatgctctcactgtgtggccacgagatgaaggtggggcatgtggagaagccaggtacaggcagtaagggtctaatggaagaggggccacagggttgggagaggggacatgatgcctaagtgagaatgtccctcttgtgtccctgaaacctgagccctgcagatgcttcctgaaggatggaagagtctacactgtgggtcagggctccccagtggccgcagatgggatgaagccaccaccagaaagagcccaactgagtrtggggtggggtgggccctgcaggatgtcacatgaagagcccatgagatgggagagaggagcatatgtcgggcggggtgagacatgacccaggcatgcactccccaaaccttcagacacggcttactgcatggtggaggaatggagaacatgcattttactctgattttctctaaggaataaattttattttaaaatcacagagaaggaaaaaatcaaatggagtatcaaaccttaatttaagaaatccatctgcttcatcaaaaatttgctgtgagcttttaagaataaacagggcaaat

SEQ ID NO: 42933 - DNA, 601 bp, Human
tatctttgtgccagtataccaactttatgccaaatgccatacattctttgagggaacctggagcagctccttgagtgaggtgggatttgagtttaggattagagggtggggaaggtggacaggcattaacattagagcaaggttccccaggctttgagggaagactggacgtagttgggagggtgtgatgctctcactgtgtggccacgagatgaaggtggggcatgtggagaagccaggtacaggcagtaagggtctaatggaagaggggccacagggttgggagaggggacatgatgcytaagtgagaatgtccctcttgtgtccctgaaacctgagccctgcagatgcttcctgaaggatggaagagtctacactgtgggtcagggctccccagtggccgcagatgggatgaagccaccaccagaaagagcccaactgagtatggggtggggtgggccctgcaggatgtcacatgaagagcccatgagatgggagagaggagcatatgtcgggcggggtgagacatgacccaggcatgcactccccaaaccttcagacacggcttactgcatggtggaggaatggagaacatgcattt

SEQ ID NO: 42934 - DNA, 601 bp, Human
aactactgattcccaactcaggtatttttaccccactcttttcccccattgggtggctgacctggatctatgttatctttgtgccagtataccaactttatgccaaatgccatacattctttgagggaacctggagcagctccttgagtgaggtgggatttgagtttaggattagagggtggggaaggtggacaggcattaacattagagcaaggttccccaggctttgagggaagactggacgtagttgggagggtgtgatgctctcactgtgtggccacgagatgaaggtggggcatgkggagaagccaggtacaggcagtaagggtctaatggaagaggggccacagggttgggagaggggacatgatgcctaagtgagaatgtccctcttgtgtccctgaaacctgagccctgcagatgcttcctgaaggatggaagagtctacactgtgggtcagggctccccagtggccgcagatgggatgaagccaccaccagaaagagcccaactgagtatggggtggggtgggccctgcaggatgtcacatgaagagcccatgagatgggagagaggagcatatgtcgggcggggtgagaca

SEQ ID NO: 42935 - DNA, 601 bp, Human
gtgcctggctgagaacagttttataagtaactactgattcccaactcaggtatttttaccccactcttttcccccattgggtggctgacctggatctatgttatctttgtgccagtataccaactttatgccaaatgccatacattctttgagggaacctggagcagctccttgagtgaggtgggatttgagtttaggattagagggtggggaaggtggacaggcattaacattagagcaaggttccccaggctttgagggaagactggacgtagttgggagggtgtgatgctctcactgygtggccacgagatgaaggtggggcatgtggagaagccaggtacaggcagtaagggtctaatggaagaggggccacagggttgggagaggggacatgatgcctaagtgagaatgtccctcttgtgtccctgaaacctgagccctgcagatgcttcctgaaggatggaagagtctacactgtgggtcagggctccccagtggccgcagatgggatgaagccaccaccagaaagagcccaactgagtatggggtggggtgggccctgcaggatgtcacatgaagagcccatgagatgggagag

SEQ ID NO: 42936 - DNA, 601 bp, Human
actcccaacctcaggtgatccacccgcctcggactccccaagttctgggattacaagcgtgagccacggtgcctggctgagaacagttttataagtaactactgattcccaactcaggtatttttaccccactcttttcccccattgggtggctgacctggatctatgttatctttgtgccagtataccaactttatgccaaatgccatacattctttgagggaacctggagcagctccttgagtgaggtgggatttgagtttaggattagagggtggggaaggtggacaggcattaacaytagagcaaggttccccaggctttgagggaagactggacgtagttgggagggtgtgatgctctcactgtgtggccacgagatgaaggtggggcatgtggagaagccaggtacaggcagtaagggtctaatggaagaggggccacagggttgggagaggggacatgatgcctaagtgagaatgtccctcttgtgtccctgaaacctgagccctgcagatgcttcctgaaggatggaagagtctacactgtgggtcagggctccccagtggccgcagatgggatgaagccaccaccagaaaga

SEQ ID NO: 42937 - DNA, 601 bp, Human
gtgtgagaacagttttgttttgttttttgagataagagttttgctcttgtttcccagactggagtgcaatggcacaatctcggctcactgcaatctccgcctcctgggttcaagctattctgcttcctcagcctccggagcagctgggattacaggcatgcgccaccacgcctggctaattttgtatttttcctagagatggggtttctccatgttggtcaggatggtctcgaactcccaacctcaggtgatccacccgcctcggactccccaagttctgggattacaagcgtgagccacrgtgcctggctgagaacagttttataagtaactactgattcccaactcaggtatttttaccccactcttttcccccattgggtggctgacctggatctatgttatctttgtgccagtataccaactttatgccaaatgccatacattctttgagggaacctggagcagctccttgagtgaggtgggatttgagtttaggattagagggtggggaaggtggacaggcattaacattagagcaaggttccccaggctttgagggaagactggacgtagttgggagggtgtgatgctctcactg

SEQ ID NO: 42938 - DNA, 601 bp, Human
aacgtccttaattttgcaatatgaaaacagcattgccatgaatcttccctgttcctcaaggttattttctgggtctaaggcttgttctcattgttgcatttgtcttttgtcaaggtctcatcatgggtttactatcctgcagggaattttagattaagcagctggccataaattaatggtcacatgaggaagagcaaggaaggattacctcaacacaagtcacaacagctctcatagaaacatgctccagtttacctcattttgcaggtgtgagaacagttttgttttgttttttgagataagagttttgctcttgtttcccagactggagtgcaatggcacaatctcggctcactgcaatctccgcctcctgggttcaagctattctgcttcctcagcctccggagcagctgggattacaggcatgcgccaccacgcctggctaattttgtatttttcctagagatggggtttctccatgttggtcaggatggtctcgaactcccaacctcaggtgatccacccgcctcggactccccaagttctgggattacaagcgtgagccacggtgcctggctgagaacagttttataagtaacta

SEQ ID NO: 42939 - DNA, 601 bp, Human
aaagaatatttaaagttaaatctgtcatatttacttttcaaaagtgacacacgtatcactggctgatagaacacacctcgagatttaactctttgttttcatgctggacgtaataaacgtccttaattttgcaatatgaaaacagcattgccatgaatcttccctgttcctcaaggttattttctgggtctaaggcttgttctcattgttgcatttgtcttttgtcaaggtctcatcatgggtttactatcctgcagggaattttagattaagcagctggccataaattaatggtcacatraggaagagcaaggaaggattacctcaacacaagtcacaacagctctcatagaaacatgctccagtttacctcattttgcaggtgtgagaacagttttgttttgttttttgagataagagttttgctcttgtttcccagactggagtgcaatggcacaatctcggctcactgcaatctccgcctcctgggttcaagctattctgcttcctcagcctccggagcagctgggattacaggcatgcgccaccacgcctggctaattttgtatttttcctagagatggggtttctccatgttggt

SEQ ID NO: 42940 - DNA, 601 bp, Human
aaccccgcctcctatgaaaaatacaaaattagctgggcatggtggtgcacacctgtaatcccagctactcgggagtctgaggcaggagaattgcttgaatctgggaggcagaggttgcagtgagctgagatggcaccaccgcactccagcctgggtgacaagagtgaaactccatccccccggccaaaaaaaagaaaaagaaaaaaaaaacccaacatgtattggtgacaaccggggctctgaaataacttccttatgaattctgcagctgttttgtagtggaggtgaaggtcaattgaaygatttctttgaggaagaccacagtagaacataccagtaggaaaaaaaaaacaataagcaatcatgaaagaatatttaaagttaaatctgtcatatttacttttcaaaagtgacacacgtatcactggctgatagaacacacctcgagatttaactctttgttttcatgctggacgtaataaacgtccttaattttgcaatatgaaaacagcattgccatgaatcttccctgttcctcaaggttattttctgggtctaaggcttgttctcattgttgcatttgtcttttgtcaaggtctca

SEQ ID NO: 42941 - DNA, 601 bp, Human
aaaggttaacacccttaagcattttcaaaagtcagctgtacatttacttctcttcctctccaccataaatgttgacttacttcaaactataactccttccctttctccagaaactgaagggaatgtatttttctctagtatgtggagatcacaccattctgacctcagcttacgcttccactcacacgtgtgtttccatcaaacgcaggggcatccaccgggctggaaagagcagctttggaggagcaataacagagcacaagcacgaggagtgagaagttcatggcttttaaggaatggytgtgatggctgtgagatgaggaaaacatccttcactcttttctcccctggtggcatccttacgtttttcaagcatctgctccaatgtcatccactctcctccctggagcaccactggctgctcgaccctgtcctgagcaccccaccccaggcaggtggggcagccagcagggtggccccccaccagcccaggggccttcctgcccacccttctgcggctaggggctggcttcaggccatctgcctctgtgtccagccacaggggcctcgagatatattaaagtgagcttcgctagctcaa

SEQ ID NO: 42942 - DNA, 601 bp, Human
tatataatgcatctaacgtacaaaatatgagttaatcgactgtttatgtgattggtaatgcttccggtcaacagtaagctatcagcagttaagtttcagggactcaaaagtcaaacacaggttttcggctgtgcagggagttaaaggttaacacccttaagcattttcaaaagtcagctgtacatttacttctcttcctctccaccataaatgttgacttacttcaaactataactccttccctttctccagaaactgaagggaatgtatttttctctagtatgtggagatcacaccattstgacctcagcttacgcttccactcacacgtgtgtttccatcaaacgcaggggcatccaccgggctggaaagagcagctttggaggagcaataacagagcacaagcacgaggagtgagaagttcatggcttttaaggaatggttgtgatggctgtgagatgaggaaaacatccttcactcttttctcccctggtggcatccttacgtttttcaagcatctgctccaatgtcatccactctcctccctggagcaccactggctgctcgaccctgtcctgagcaccccaccccaggcaggtgg

SEQ ID NO: 42943 - DNA, 601 bp, Human
gttagccaggatggtctcgatctcctgacctcgtgatccgcccgcctcagcctcccaaagtgctgggattacaggtgtgagccaccgcacccagccaagattttcttaataacatgttcttttctctagcttactttactgtaataacacagtatataatgcatctaacgtacaaaatatgagttaatcgactgtttatgtgattggtaatgcttccggtcaacagtaagctatcagcagttaagtttcagggactcaaaagtcaaacacaggttttcggctgtgcagggagttaaaggtyaacacccttaagcattttcaaaagtcagctgtacatttacttctcttcctctccaccataaatgttgacttacttcaaactataactccttccctttctccagaaactgaagggaatgtatttttctctagtatgtggagatcacaccattctgacctcagcttacgcttccactcacacgtgtgtttccatcaaacgcaggggcatccaccgggctggaaagagcagctttggaggagcaataacagagcacaagcacgaggagtgagaagttcatggcttttaaggaatggttgtgat

SEQ ID NO: 42944 - DNA, 601 bp, Human
ctcactgcaagctctgcctcccaggttcacgccattctcctgcctcagcctcccaaatagctgggactataggcacctgccaccacgcccagctaattttttgtatttttagtagagacggggtttcacggtgttagccaggatggtctcgatctcctgacctcgtgatccgcccgcctcagcctcccaaagtgctgggattacaggtgtgagccaccgcacccagccaagattttcttaataacatgttcttttctctagcttactttactgtaataacacagtatataatgcatctaaygtacaaaatatgagttaatcgactgtttatgtgattggtaatgcttccggtcaacagtaagctatcagcagttaagtttcagggactcaaaagtcaaacacaggttttcggctgtgcagggagttaaaggttaacacccttaagcattttcaaaagtcagctgtacatttacttctcttcctctccaccataaatgttgacttacttcaaactataactccttccctttctccagaaactgaagggaatgtatttttctctagtatgtggagatcacaccattctgacctcagcttacgc

SEQ ID NO: 42945 - DNA, 601 bp, Human
ctccacctctctgccaccctgaggcagcaagatgccctccacttcctcctcagcacgctcaacatcaagatgacgagaatgaagatctgtatgatgatccacttccacttaatgcatagtaaatgtatttcctctgccttaagattttcttttcttttcttttctttttttttgagatggagtcttgctctgtcgcccaggctggagtgcagtggcacgatctctgctcactgcaagctctgcctcccaggttcacgccattctcctgcctcagcctcccaaatagctgggactataggcrcctgccaccacgcccagctaattttttgtatttttagtagagacggggtttcacggtgttagccaggatggtctcgatctcctgacctcgtgatccgcccgcctcagcctcccaaagtgctgggattacaggtgtgagccaccgcacccagccaagattttcttaataacatgttcttttctctagcttactttactgtaataacacagtatataatgcatctaacgtacaaaatatgagttaatcgactgtttatgtgattggtaatgcttccggtcaacagtaagctatcagcagtta

SEQ ID NO: 42946 - DNA, 601 bp, Human
ctccccttccacctcctccacctctctgccaccctgaggcagcaagatgccctccacttcctcctcagcacgctcaacatcaagatgacgagaatgaagatctgtatgatgatccacttccacttaatgcatagtaaatgtatttcctctgccttaagattttcttttcttttcttttctttttttttgagatggagtcttgctctgtcgcccaggctggagtgcagtggcacgatctctgctcactgcaagctctgcctcccaggttcacgccattctcctgcctcagcctcccaaatasctgggactataggcacctgccaccacgcccagctaattttttgtatttttagtagagacggggtttcacggtgttagccaggatggtctcgatctcctgacctcgtgatccgcccgcctcagcctcccaaagtgctgggattacaggtgtgagccaccgcacccagccaagattttcttaataacatgttcttttctctagcttactttactgtaataacacagtatataatgcatctaacgtacaaaatatgagttaatcgactgtttatgtgattggtaatgcttccggtcaacagta

SEQ ID NO: 42947 - DNA, 601 bp, Human
cctgcctccccttccacctcctccacctctctgccaccctgaggcagcaagatgccctccacttcctcctcagcacgctcaacatcaagatgacgagaatgaagatctgtatgatgatccacttccacttaatgcatagtaaatgtatttcctctgccttaagattttcttttcttttcttttctttttttttgagatggagtcttgctctgtcgcccaggctggagtgcagtggcacgatctctgctcactgcaagctctgcctcccaggttcacgccattctcctgcctcagcctcccraatagctgggactataggcacctgccaccacgcccagctaattttttgtatttttagtagagacggggtttcacggtgttagccaggatggtctcgatctcctgacctcgtgatccgcccgcctcagcctcccaaagtgctgggattacaggtgtgagccaccgcacccagccaagattttcttaataacatgttcttttctctagcttactttactgtaataacacagtatataatgcatctaacgtacaaaatatgagttaatcgactgtttatgtgattggtaatgcttccggtcaa

SEQ ID NO: 42948 - DNA, 601 bp, Human
tcactaacacttgttctacacacgtatacattccccaggatccaaggcctgtggtcatcctgcttgcacttccgggacagcccacagtgggcactccggcagggcctgtggaactgaacagtggattcagaaaatctgagaatgacacccagtctttaccatgatggacaactcgcaaacctccgtgggcctcggcttctctgagtgtaaccgggagccgctgctgccctcccaggcacagactcccatcacctctcctggcacgcacgtgctgctgctggtctgcctgtgtattgcttcrccccaagacacatgtgtgtgaggtattcacatgagtgtgtgtgtgtaattgtgcttagtgtgtgatgtgaggtgtttgtgatgtgaggctgtgtttgtcagtacgcagcatggtgtgtgtgtgcatctgtgtgtgtgtccatatgtgtggtgtgtctacgtgcatggtgtgtgtgtgtgtgtgtgtggtgcatgcctgtgagtgtgcggtgtgtgtgtgaggtgtaattgtgcttagtgtgtgatgtgaggtgtttgtgatgtgaggctgtatttgtatgtagcttggtatgtgtgtgta

SEQ ID NO: 42949 - DNA, 601 bp, Human
tgaatccgtatgaaccaggggcagcttcatccccagatgcagcctcaagtgggccagtcctgtcctactcccaagtatccatcactaacacttgttctacacacgtatacattccccaggatccaaggcctgtggtcatcctgcttgcacttccgggacagcccacagtgggcactccggcagggcctgtggaactgaacagtggattcagaaaatctgagaatgacacccagtctttaccatgatggacaactcgcaaacctccgtgggcctcggcttctctgagtgtaaccgggagccrctgctgccctcccaggcacagactcccatcacctctcctggcacgcacgtgctgctgctggtctgcctgtgtattgcttcaccccaagacacatgtgtgtgaggtattcacatgagtgtgtgtgtgtaattgtgcttagtgtgtgatgtgaggtgtttgtgatgtgaggctgtgtttgtcagtacgcagcatggtgtgtgtgtgcatctgtgtgtgtgtccatatgtgtggtgtgtctacgtgcatggtgtgtgtgtgtgtgtgtgtggtgcatgcctgtgagtgtgcggtgtgtgtgtg

SEQ ID NO: 42950 - DNA, 601 bp, Human
ccaagagctttgcaaagtgacagaactgaaatgaggagcccaagttgctctgtctgtgtgaatccgtatgaaccaggggcagcttcatccccagatgcagcctcaagtgggccagtcctgtcctactcccaagtatccatcactaacacttgttctacacacgtatacattccccaggatccaaggcctgtggtcatcctgcttgcacttccgggacagcccacagtgggcactccggcagggcctgtggaactgaacagtggattcagaaaatctgagaatgacacccagtctttaccaygatggacaactcgcaaacctccgtgggcctcggcttctctgagtgtaaccgggagccgctgctgccctcccaggcacagactcccatcacctctcctggcacgcacgtgctgctgctggtctgcctgtgtattgcttcaccccaagacacatgtgtgtgaggtattcacatgagtgtgtgtgtgtaattgtgcttagtgtgtgatgtgaggtgtttgtgatgtgaggctgtgtttgtcagtacgcagcatggtgtgtgtgtgcatctgtgtgtgtgtccatatgtgtggtgtgtctacgt

SEQ ID NO: 42951 - DNA, 601 bp, Human
taccaagagctttgcaaagtgacagaactgaaatgaggagcccaagttgctctgtctgtgtgaatccgtatgaaccaggggcagcttcatccccagatgcagcctcaagtgggccagtcctgtcctactcccaagtatccatcactaacacttgttctacacacgtatacattccccaggatccaaggcctgtggtcatcctgcttgcacttccgggacagcccacagtgggcactccggcagggcctgtggaactgaacagtggattcagaaaatctgagaatgacacccagtctttacyatgatggacaactcgcaaacctccgtgggcctcggcttctctgagtgtaaccgggagccgctgctgccctcccaggcacagactcccatcacctctcctggcacgcacgtgctgctgctggtctgcctgtgtattgcttcaccccaagacacatgtgtgtgaggtattcacatgagtgtgtgtgtgtaattgtgcttagtgtgtgatgtgaggtgtttgtgatgtgaggctgtgtttgtcagtacgcagcatggtgtgtgtgtgcatctgtgtgtgtgtccatatgtgtggtgtgtctac

SEQ ID NO: 42952 - DNA, 601 bp, Human
gtgctaaggatacagtggggcacagggtgggcactgcccatgtcacatgtcccctgggtgctgggacattttctctcctgcttctcaggtacaaggactgaatggctaggacaactcgccctctaccaagagctttgcaaagtgacagaactgaaatgaggagcccaagttgctctgtctgtgtgaatccgtatgaaccaggggcagcttcatccccagatgcagcctcaagtgggccagtcctgtcctactcccaagtatccatcactaacacttgttctacacacgtatacattccccrggatccaaggcctgtggtcatcctgcttgcacttccgggacagcccacagtgggcactccggcagggcctgtggaactgaacagtggattcagaaaatctgagaatgacacccagtctttaccatgatggacaactcgcaaacctccgtgggcctcggcttctctgagtgtaaccgggagccgctgctgccctcccaggcacagactcccatcacctctcctggcacgcacgtgctgctgctggtctgcctgtgtattgcttcaccccaagacacatgtgtgtgaggtattcacatgagt

SEQ ID NO: 42953 - DNA, 601 bp, Human
gcaatctcggcacctgcgaggagggagacgggtaataagcagacagctggcctgtgacactggtctgtgctggtgcctccttccctgtctcgggcacttccgccacaccgtcccctccaatacctgaatgatgcttcgcccactgggctcctccattcatgcattcatgcgttcattcaggaaacatctgttggttctgctgagcacacaccaggtgctaaggatacagtggggcacagggtgggcactgcccatgtcacatgtcccctgggtgctgggacattttctctcctgcttctcrggtacaaggactgaatggctaggacaactcgccctctaccaagagctttgcaaagtgacagaactgaaatgaggagcccaagttgctctgtctgtgtgaatccgtatgaaccaggggcagcttcatccccagatgcagcctcaagtgggccagtcctgtcctactcccaagtatccatcactaacacttgttctacacacgtatacattccccaggatccaaggcctgtggtcatcctgcttgcacttccgggacagcccacagtgggcactccggcagggcctgtggaactgaacagtg

SEQ ID NO: 42954 - DNA, 601 bp, Human
ctgggaatttacagcctctaaaggctggcactacaaactcaggggtgggcagcccggcccaagcaccctaaactcagagatgaaccaaaatggtgttcagcaaaattcctcactaagaataaaaacaaaacaaacagacaaaaaaacaaagttaaactaaataacattcattggcatgttccacaaagaaataaaattcaagacaggcatggaagtgcacgcctgtggtcccagctactcgggaggctgaggtggaggatcgcttgagcccaggaggtcgcggctgcagtgagctgtgatyacgtcactgcaccccagcctaagtgacagagcaggaccctgtctcaaaataaataaatagaagtaaaattcaacaaacccaaagtacatatagcttcagggcatcactgtgagggaatccagtccaaacacatcaatttataatgaagtatttatcaactggtacatttataaattaggtaaaagttctggaatacaatgtatctcttcctggccaacaacaacaacaaacccagaaaacccaacagagtggaaacaattcttcactaataggaattattgatggatacctccaactcct

SEQ ID NO: 42955 - DNA, 601 bp, Human
gggacatctacagggattaaactgaaagtgtgttacccagagagcacaataagaagttgtccaaggagagagttaaatgtaagacttctgtgttgttatagacttcattttaagcttcttaaaaatataacccttgcaaaattcgtcagggtcacaaatctggaatccggcctagttaactggaagagggagggaggccctgggttgcattcagccagctactcccatcactggagttaaggagctcctcagcttcactgacataggcagtctcagcaatgagagccctgccctggcaggkgagatggaccccaaagcaacaatatcaaaactccaaacaagtctcctggaggcgaatcaacactctggaggcacctggtgcagtgtgcgcttcatgctataaggtctgaattctacatacaggccgcaccttccccaagccagtgctgggaggcgtgggggaaaccagtgcctgtccagccctccccctgccccaggcagtctgaagtcccatagccaccaggagggctcaggcgggaatcctaaagcctcagcagacacccacgcaagtccatttgtcatagataagggggccgaagcc

SEQ ID NO: 42956 - DNA, 601 bp, Human
gagagagaccttcagctctgcctttaccctccacgtgccagcacagccatgctacccgatctcaccctgggctggctcctcgtctatgtcatatcctccagggacatctacagggattaaactgaaagtgtgttacccagagagcacaataagaagttgtccaaggagagagttaaatgtaagacttctgtgttgttatagacttcattttaagcttcttaaaaatataacccttgcaaaattcgtcagggtcacaaatctggaatccggcctagttaactggaagagggagggaggcccygggttgcattcagccagctactcccatcactggagttaaggagctcctcagcttcactgacataggcagtctcagcaatgagagccctgccctggcaggtgagatggaccccaaagcaacaatatcaaaactccaaacaagtctcctggaggcgaatcaacactctggaggcacctggtgcagtgtgcgcttcatgctataaggtctgaattctacatacaggccgcaccttccccaagccagtgctgggaggcgtgggggaaaccagtgcctgtccagccctccccctgccccaggcag

SEQ ID NO: 42957 - DNA, 601 bp, Human
ttctgtgctcccttgaactcaattcttcctgactttctgccacacttttccattttgtgctaggttttctcttagaaattacagactctctacatacggagacatgacacgctctgggctccaggtgccagtgctgcaggtctggagggggctcagtggatccttgggcccctcctggggggacagccatccaagaagggcagcccagctccacagcacgcagatccttctctgtcaccaaggtcagagctgggactcctctggctgccactcttttggggcaggcacatcaccaggagamtgccgccctggggggtgagggtggggagagagaccttcagctctgcctttaccctccacgtgccagcacagccatgctacccgatctcaccctgggctggctcctcgtctatgtcatatcctccagggacatctacagggattaaactgaaagtgtgttacccagagagcacaataagaagttgtccaaggagagagttaaatgtaagacttctgtgttgttatagacttcattttaagcttcttaaaaatataacccttgcaaaattcgtcagggtcacaaatctggaatccggcctag

SEQ ID NO: 42958 - DNA, 601 bp, Human
tgtgaataaggactcctcagtggcttgaggacaggctagccccctcagagagagtcccctgaggccagtgccatggtggctgccctggcccctggcccctgcccccaccccaccctttcagaggttctgtgctcccttgaactcaattcttcctgactttctgccacacttttccattttgtgctaggttttctcttagaaattacagactctctacatacggagacatgacacgctctgggctccaggtgccagtgctgcaggtctggagggggctcagtggatccttgggcccctcctsgggggacagccatccaagaagggcagcccagctccacagcacgcagatccttctctgtcaccaaggtcagagctgggactcctctggctgccactcttttggggcaggcacatcaccaggagactgccgccctggggggtgagggtggggagagagaccttcagctctgcctttaccctccacgtgccagcacagccatgctacccgatctcaccctgggctggctcctcgtctatgtcatatcctccagggacatctacagggattaaactgaaagtgtgttacccagagagcacaata

SEQ ID NO: 42959 - DNA, 601 bp, Human
cagacatcgtcagagccacatgtgtcctgggcaggtgctacctgcctggaacctgccggatatccctctgggatgggtcaactaggccacaggacaatgtgacacttgacagaaggtggtgacagccgtaatttgagctggccttgtagaggccttcctccttccgtagctttggagatgtttaaaaaatttaaattttaattgccaaataataattgtatatagtatgaggcacaatgtcatgttttgatacatgtatacactgtggtatggttaaatcaaaccattaacatctcacatrccgatctttttttctgatgagaacatttaaaatctacttgttagcaattttgaaatacacattgctattaactatggtcactgtgctgtacaacagatcctaaaacgactcctcctgtctaagggaaactttgtatcctttgaccaaaatccccccaagtcccttccaacctctggtaacccccattctactctgcttctatgaattcaacatttttaggttccacgcgtacgggagatcatgcagtgtttgtctctgtgtggctggcttatttcactgaacataatgttctccaggttc

SEQ ID NO: 42960 - DNA, 601 bp, Human
cacaggtgaggcagacatcgtcagagccacatgtgtcctgggcaggtgctacctgcctggaacctgccggatatccctctgggatgggtcaactaggccacaggacaatgtgacacttgacagaaggtggtgacagccgtaatttgagctggccttgtagaggccttcctccttccgtagctttggagatgtttaaaaaatttaaattttaattgccaaataataattgtatatagtatgaggcacaatgtcatgttttgatacatgtatacactgtggtatggttaaatcaaaccattawcatctcacataccgatctttttttctgatgagaacatttaaaatctacttgttagcaattttgaaatacacattgctattaactatggtcactgtgctgtacaacagatcctaaaacgactcctcctgtctaagggaaactttgtatcctttgaccaaaatccccccaagtcccttccaacctctggtaacccccattctactctgcttctatgaattcaacatttttaggttccacgcgtacgggagatcatgcagtgtttgtctctgtgtggctggcttatttcactgaacataatgt

SEQ ID NO: 42961 - DNA, 601 bp, Human
atgtgaaaatagtttgtttcagggctaggcgtggtggttcacatctgtaatcccagcactttgggaggccacggtgggaggagttcgagactagcctgagctctataaaaaacagaaacaaaattagccaggtgtggtggtgtacccctgtggtcccagctacttgggaggctgaggcaggaggattgcttcagcccaggaggttgaggctgcagtgagccacaatagcaccactacacttcagcctgaacaaaagagcgagaccctgtctcaaaaaaaagtagtttgtttcagagcttayaaatatgagtgtggcactggcctctttaatgcacactgccatggtctaattatggcctgtgtgcatgcatgcagcaatgcccgagcagctggagttggaaaagaagcctccgttcatgcacaaacgtggtactcatgagtcatcggggagctgctagcccacctcacaacgtggcttcttcccacccacactgggggaccttctcccatagtcatggaccctccacaggtgaggcagacatcgtcagagccacatgtgtcctgggcaggtgctacctgcctggaacctgccggatatccc

SEQ ID NO: 42962 - DNA, 601 bp, Human
aattttagagtatttgggagataggaagtgctgagaaacgggcattgctaaatcacagtggttctctcctatctttatttaggaaaaacaattgttttttctttgggaaaactgtgtaggttacaactggctatatcccaggtatcttatgtgaccgcgcaagcatacaacaatgagcagcgcccccttctgagggactgaatcagccagggcatccccaccttctcagccacacagcccacagccacacagcccagcccacaggacaccaccgtccacgtgactaagacacaggcccacrgagggagggcctgcgccaacttggcacctccagtccgatgtttaacatctaatgaatggcgaccttgggctttccctgccacctgctgagaagagagagtgacagcctcttccctacactctgcccaatgatttgagattgaatacctttcctattgtaaataggaacaagaactgttttaacatttttggatttctgatgaagggaataacaacctaatgccacagaatgagctctgattttggttttagtcatatgttatgacacttatgcttactagtaggggtacttgctttccca

SEQ ID NO: 42963 - DNA, 601 bp, Human
ccggcttggaagccgacgtcaattttcccagtcaagcatcaacagcagcagtgccctcgcgaaactgactttacccggtaatattccgagaatggataacaaggctgaaacgcagaactaactacaaactgagttttcctccttgggtaaaatacagtgagaagggccatgcagatggtcatcttctctggaggccacacacgtggattccacaaaggccattgcagggtcattgtcaccagtcagtcttggcagtgtccctggaaggtgtgccattcccattatcaggatgaagaggggrttgagtcaacgtccaaagactcacagctggaggtcggaacagcagctctaaggaaggcccaaaactcaactggctcatacctcccaattttagagtatttgggagataggaagtgctgagaaacgggcattgctaaatcacagtggttctctcctatctttatttaggaaaaacaattgttttttctttgggaaaactgtgtaggttacaactggctatatcccaggtatcttatgtgaccgcgcaagcatacaacaatgagcagcgcccccttctgagggactgaatcagccagggcat

SEQ ID NO: 42964 - DNA, 601 bp, Human
gggaatagaggggactttaacacatggatcaaaatataccatggagacatgatttccctgggcacagtgtgcagtgacctaagacacctttgtgaatcccggcttggaagccgacgtcaattttcccagtcaagcatcaacagcagcagtgccctcgcgaaactgactttacccggtaatattccgagaatggataacaaggctgaaacgcagaactaactacaaactgagttttcctccttgggtaaaatacagtgagaagggccatgcagatggtcatcttctctggaggccacacacrtggattccacaaaggccattgcagggtcattgtcaccagtcagtcttggcagtgtccctggaaggtgtgccattcccattatcaggatgaagagggggttgagtcaacgtccaaagactcacagctggaggtcggaacagcagctctaaggaaggcccaaaactcaactggctcatacctcccaattttagagtatttgggagataggaagtgctgagaaacgggcattgctaaatcacagtggttctctcctatctttatttaggaaaaacaattgttttttctttgggaaaactgtgt

SEQ ID NO: 42965 - DNA, 601 bp, Human
tatttttgtagaccaccttccccacttccccttctaagtgctcattgtgctccctgagtgattataagtagttctctgtaagtggccacaggtcttccccagcagctccacttcgctgggtgtgagttctgtttgtccaaaccctcttccgctccctggcagccaggaccctgcggatgagtggttactattttggttagcatagcatgcttgggtcagctttctaaagtgatggcagatccctttcttagaaaaggtgaagtggcctcccaagagttgtgggcacataacttcccccaawcctccctcagaagcaagggaaaatcagcctggggaaccagggcatccagtcgcctttgcatgcacagttgacctcttttccactggaggcccccagacctctgcaagcccaagtttcctccaagatgctctgctctgtgggactcaccccagggttctccgatgccccaccagtgctgtctagggacccagggaacccaagtcctgccccagatgcccagggatacagcagctacctcattcaggatgtgtatgggagggagagaagggttttgtccaggacaccatttccccagagtcc

SEQ ID NO: 42966 - DNA, 601 bp, Human
gaaaagggggccaaccccagacccacgtgggtgacagatgttgcatgtatttaaatgaccctgcaaatgctcccgggggttagatggcctactgcagcctctatgtggatgtccaaccccaaccccccaagcactggcctggtgagggtgaggcccgcgtttagaattcagatcttagagcacgaagcacgcactgcaccaggctcctccagagtgttaattcacctccaggagacttgtttggagtgtcaattttgttgctttgagttccatctcccctgctagggcagggctctcatcrctgagaccatctttacctgcacaacttcacctgcagccccagttccaatatctgttacaaaaagttgctccttttcaatcttttttttttttttgagatggagttttgctctcgttccccaggctggagtgcagtggtgcgatcctgactcaccgcaacctccacctcccaggttcaagcaattctcctgcctcagcctcccgagtagctgggactacaggcatgcgccaccatgcccagctaatttttgtatttttagtagagacagggtttctccatgttggtcaggctggtctcgaa

SEQ ID NO: 42967 - DNA, 601 bp, Human
tgcaggtcatttgtcatagaaaagggggccaaccccagacccacgtgggtgacagatgttgcatgtatttaaatgaccctgcaaatgctcccgggggttagatggcctactgcagcctctatgtggatgtccaaccccaaccccccaagcactggcctggtgagggtgaggcccgcgtttagaattcagatcttagagcacgaagcacgcactgcaccaggctcctccagagtgttaattcacctccaggagacttgtttggagtgtcaattttgttgctttgagttccatctcccctgcyagggcagggctctcatcactgagaccatctttacctgcacaacttcacctgcagccccagttccaatatctgttacaaaaagttgctccttttcaatcttttttttttttttgagatggagttttgctctcgttccccaggctggagtgcagtggtgcgatcctgactcaccgcaacctccacctcccaggttcaagcaattctcctgcctcagcctcccgagtagctgggactacaggcatgcgccaccatgcccagctaatttttgtatttttagtagagacagggtttctccatgtt

SEQ ID NO: 42968 - DNA, 601 bp, Human
cttaggcgggatgccccaaagcctcaacaaacacccatgcaggtcatttgtcatagaaaagggggccaaccccagacccacgtgggtgacagatgttgcatgtatttaaatgaccctgcaaatgctcccgggggttagatggcctactgcagcctctatgtggatgtccaaccccaaccccccaagcactggcctggtgagggtgaggcccgcgtttagaattcagatcttagagcacgaagcacgcactgcaccaggctcctccagagtgttaattcacctccaggagacttgtttggartgtcaattttgttgctttgagttccatctcccctgctagggcagggctctcatcactgagaccatctttacctgcacaacttcacctgcagccccagttccaatatctgttacaaaaagttgctccttttcaatcttttttttttttttgagatggagttttgctctcgttccccaggctggagtgcagtggtgcgatcctgactcaccgcaacctccacctcccaggttcaagcaattctcctgcctcagcctcccgagtagctgggactacaggcatgcgccaccatgcccagctaat

SEQ ID NO: 42969 - DNA, 601 bp, Human
cctgccccagccagtctgaggtcccatagccaccaggagggcttaggcgggatgccccaaagcctcaacaaacacccatgcaggtcatttgtcatagaaaagggggccaaccccagacccacgtgggtgacagatgttgcatgtatttaaatgaccctgcaaatgctcccgggggttagatggcctactgcagcctctatgtggatgtccaaccccaaccccccaagcactggcctggtgagggtgaggcccgcgtttagaattcagatcttagagcacgaagcacgcactgcaccaggcwcctccagagtgttaattcacctccaggagacttgtttggagtgtcaattttgttgctttgagttccatctcccctgctagggcagggctctcatcactgagaccatctttacctgcacaacttcacctgcagccccagttccaatatctgttacaaaaagttgctccttttcaatcttttttttttttttgagatggagttttgctctcgttccccaggctggagtgcagtggtgcgatcctgactcaccgcaacctccacctcccaggttcaagcaattctcctgcctcagcctcccga

SEQ ID NO: 42970 - DNA, 601 bp, Human
ttgtttgttttttgtgggaggagtgcagagtattttttttttaaaacaaacatttaaatggtcaaaccaactgatgttcattttcctctgttacgacctgagcatccaatgctgcttcttccagacagccaattgtgtcaatattgctaactagttcttttcccactgaacctacatacccactctgttacagataatatcatttgatttgggcttattaggttccattaatctacttgtcctttctcatgtcaaccccacatggcatggtagtacagtatgttggatcagtgccaccatyagcttcagcgctgagaggagtcttcatgcaaaggtacctgctcagggtggagcccagagacagggccctgggccagcacactggggaggtcctgctctgctctctgcaaagacagtggccaccagccctccccctgccccagccagtctgaggtcccatagccaccaggagggcttaggcgggatgccccaaagcctcaacaaacacccatgcaggtcatttgtcatagaaaagggggccaaccccagacccacgtgggtgacagatgttgcatgtatttaaatgaccctgcaaatgctc

SEQ ID NO: 42971 - DNA, 601 bp, Human
tgtctttttaaaacctccctgcaagtgttttttttttttttttttcaagacccttgctctgtcgcccaggctggagtgcagtggcacgatctcgactcactgcaacctccggcttctgggttcagcaattctcctgcctcagcctccccagtagctgggattacaggcgtgccccaccacacttggctagggcaggacatctacttttcttttaatgtgcatctccctgccacccagaccacttggcaggctcctctgtgaattaactctgcatgtttccccttcagtctttctttttttmttcttcttctgatttatttagttagagtcagggtttcactctgctgcccgtgctggagtgcagtggcacaatctagcttactgcagtggcacaatcacagctcactgcagcctcgacctcctgggctcaagcaatcttcccaccttggcctctggagtagctgggagtagctaacatgcaccacctgcccaacagttttttaacttggttgtagagacggagtcttgctatgttgcccagggtggtctcaaactcctgggctccagcaattctcccgcctcagtctcccaaagcactgtg

SEQ ID NO: 42972 - DNA, 601 bp, Human
accaaacaagactctaaaattatcgcagatttcatatacactcattatacatcaggcagagaagtagaaagcccagaatgccagcaacaatagctttcaaaggtttctccgccatcagcgctgttgagatttggggctggatatccttgatggtggacagctctgggctctgcactttgctgagcaccatccccagcctcctcctatagatgccagtagggctccctccctacaagttgttacaacctaaaacagctccaaacattgtcaaatgcctcctgggggtgcaaaatcgctcccrgttgagaaatgctgctttaaaacacccaggacaaagattctggaaaatggattattaagtaaatgtttacagaaccaatgtatttttaaaatcatgaaggtgagaactcagcactgaaacagcaatggcaaaatccgcagtgggaacgtgagccaagtatgttgcataacgcccagaatgtgtcttccttccaccataaactgaaacatctgctccttcagtgagacatgctaatggattctgaatctaatactaaaagtgagaggcagtgagaaatgatagttggagtgctttttctgg

SEQ ID NO: 42973 - DNA, 601 bp, Human
gtatgttcccacttacagacatggaaaccaaacgcgcagagactgacctcccaaaagtcacacaaacctgggtgactccagggtctgggaagccttagagagatttggttttgaaagcacatctgatctggtagcctaaaggaggaatatctcatgaagactataaagtgctaagcaaaaaagttcttccatttttccctttaaaattatgcagtgcagagactaatgtggtctgagataaaatatcactaagcttgagaaacggtggaggccaggcatggtgactcacatctgtaatccyagcactttgggaggctgaagtaggaggatcatttgaacccaggagttcaagaccagcctgggcaacatagtgagaccccatctctccaaaaaatacaagaatgagccaggtgtgctggcacaccttggtccgagctactcagaaagctgaggtgggagaatgacttgagcctgggaaagttgaggtggcagtaagccctgattgcgccactgcagtccagcctggatgacagggcaggactccttcttaaaaaaaaaaaaaaaaaaagaagaaagaaaaagaaaaagaaaagaaaaaggt

SEQ ID NO: 42974 - DNA, 601 bp, Human
attgtaataacaacattaaaaaatcagcaaagctgtgctggatatcctattatgacccaggcctgcacagaacatttcacagtctctctcagtgaaccctcccacgatcctgacagtatgttcccacttacagacatggaaaccaaacgcgcagagactgacctcccaaaagtcacacaaacctgggtgactccagggtctgggaagccttagagagatttggttttgaaagcacatctgatctggtagcctaaaggaggaatatctcatgaagactataaagtgctaagcaaaaaagttyttccatttttccctttaaaattatgcagtgcagagactaatgtggtctgagataaaatatcactaagcttgagaaacggtggaggccaggcatggtgactcacatctgtaatcccagcactttgggaggctgaagtaggaggatcatttgaacccaggagttcaagaccagcctgggcaacatagtgagaccccatctctccaaaaaatacaagaatgagccaggtgtgctggcacaccttggtccgagctactcagaaagctgaggtgggagaatgacttgagcctgggaaagttgagg

SEQ ID NO: 42975 - DNA, 601 bp, Human
gtgcccaggcggggaagctggcgttgtggctgggggcagagaggtgccacgccagcacacggcatcagggtgggccagggctgaccacacagggcccggaggacacagggttcctgggtgcctgccaccccagccagcagccacaggtctgcctccacacctcggccttcacctcccacggccgagtgaacacggctggaaggacatctcgaatgtgtgcccgtcaccaccgcagttttactccatttttggagacagtaacttccagtggcacatccatgaaggcagacagtcctcttgygcatcactcaagcacatttcatgcccagctgtagcaagaccatgtagtcttttgaacgacagaactgttcttcagaagtggacctcccctacaaaggccatggacgactaagagcttgggacaggtctttaggccacaccagcaggagctctagacgctaaattcctctcagcattgagacatcattatcatcttttttttttttttttttttttttttttgaggcggagtctcgctccatccctcaggctggagtgcagtggcgtgatctcggctcactgcaagctccgcctcctgggt

SEQ ID NO: 42976 - DNA, 601 bp, Human
ctccggaggtgtctccagctttgaagacaggcagatggagacagaaatatttgggggtcttaagcacagaggtgacagcagcccccactgtggatgtcatcactgagagcaccagggagaagtgtggggagaaggagagctgagggctgagcacaggccatgcaggcaaggtcgtgcccaggcggggaagctggcgttgtggctgggggcagagaggtgccacgccagcacacggcatcagggtgggccagggctgaccacacagggcccggaggacacagggttcctgggtgcctgccascccagccagcagccacaggtctgcctccacacctcggccttcacctcccacggccgagtgaacacggctggaaggacatctcgaatgtgtgcccgtcaccaccgcagttttactccatttttggagacagtaacttccagtggcacatccatgaaggcagacagtcctcttgcgcatcactcaagcacatttcatgcccagctgtagcaagaccatgtagtcttttgaacgacagaactgttcttcagaagtggacctcccctacaaaggccatggacgactaagagcttgggacaggtc

SEQ ID NO: 42977 - DNA, 601 bp, Human
ctccttactgcagcagaccaaaaaggcaagagatgcctcaggggtccaaatcctgcaaccactccagctggagcacccggcaaggagcctgggcccacatcaaccctgccatgtcaccactggctgcatttccctaacagcctttcctaatgtcccctgaactgtgtcccccgagagactatttggagagagaggctctaaagaggattaaagttagaatgaggccataaggctaggcccaaatgcaatgtggctggggtccttataagagaaaggcagcagaggcgtgcgcacacagctrtaaggacagggagaacatggcgaggggaggggcctcaggaggacccatcctgcccacacctcggtgtctgacttccaggctccagaactgcgaggtgatacattcctgctgttgaagtcaccccatctgtggtccactgccacggcagcctgagctgacgaatacacttaataacgtccattctcgtgactctggctggaaggagcagctcacaggctgtagtgacagaaactgaagggcaggcagaagcagtgagtggcaggagaggcatctcaccctgcaatttatccccatgcacag

SEQ ID NO: 42978 - DNA, 601 bp, Human
aaccatcttactaatcctcccatcctacaccccccataaaactctactctcacccgagttccaagagagcaaggagtttggtttgtatctggaggtggactgtgtgggccacatctatcagctccctgagcattggatgagaagtatggagagtttgcagagctaggaagccacacgccaattttctctcttctatttaattcccctgtgtggatttgagggacccccccctggcaaagttccagaggctcctaggaaaccatcggctgccctagatgctgaagagaggagtgtcccctgycattttaagcctctactttttttaaatcctctaattcaagatccaccaaaccagttatgtacaaagcatagctctggggcactacgttgggaacaaagatacattagatgatgcggttctgacctcgaaaacaaatgcaaggcaagctatcaccgctagagagcgccctttggggactgtggagtcaagcccctgaaagtgttcccaaagttgttcttcctgagcttacccaagcattcctcagagctgcttctcctgctgtgacaagctcggtcacctgcaggccatgtggtcccagca

SEQ ID NO: 42979 - DNA, 601 bp, Human
aaaaaatctgtcctctgggtgatactgtaaaagagtaaaaagcactaaaacacatttcatgtttaccataaccatcttactaatcctcccatcctacaccccccataaaactctactctcacccgagttccaagagagcaaggagtttggtttgtatctggaggtggactgtgtgggccacatctatcagctccctgagcattggatgagaagtatggagagtttgcagagctaggaagccacacgccaattttctctcttctatttaattcccctgtgtggatttgagggaccccccccyggcaaagttccagaggctcctaggaaaccatcggctgccctagatgctgaagagaggagtgtcccctgccattttaagcctctactttttttaaatcctctaattcaagatccaccaaaccagttatgtacaaagcatagctctggggcactacgttgggaacaaagatacattagatgatgcggttctgacctcgaaaacaaatgcaaggcaagctatcaccgctagagagcgccctttggggactgtggagtcaagcccctgaaagtgttcccaaagttgttcttcctgagcttaccc

SEQ ID NO: 42980 - DNA, 601 bp, Human
aaagaaacaaaaaatctgtcctctgggtgatactgtaaaagagtaaaaagcactaaaacacatttcatgtttaccataaccatcttactaatcctcccatcctacaccccccataaaactctactctcacccgagttccaagagagcaaggagtttggtttgtatctggaggtggactgtgtgggccacatctatcagctccctgagcattggatgagaagtatggagagtttgcagagctaggaagccacacgccaattttctctcttctatttaattcccctgtgtggatttgagggacccccccctggcaaagttccagaggctcctaggaaaccatcggctgccctagatgctgaagagaggagtgtcccctgccattttaagcctctactttttttaaatcctctaattcaagatccaccaaaccagttatgtacaaagcatagctctggggcactacgttgggaacaaagatacattagatgatgcggttctgacctcgaaaacaaatgcaaggcaagctatcaccgctagagagcgccctttggggactgtggagtcaagcccctgaaagtgttcccaaagttgttcttcctga

SEQ ID NO: 42981 - DNA, 601 bp, Human
ttcctggaataacaggctaactaatgtcacaaaggtcatttgtaagagttccttgaaggcggttttggccatttttaaataagtggaggaacataaatttatctgaacaaggtatgttacaccttggaaacataccttggagaggaaatctcattgagaaatcctctgggttgccgggtgccatggctcacacctgtaatcccagcactttgggaagctgaggcagcaggattgcttgaggctgggagtttcagaccagcctagacaacatagtgagacccccatctctaaaaaaaaattwaaaaaaaaattagttgggcatggtggcacgagcctgtagtcccagctacttgacaggctgaggcaagagcctcacttaagcccaggagatcaaggctgcagtgagccgtgatggcaccactgcactccagcctgggtgacagaggccctatctcaaaaacaaagaaacaaaaaatctgtcctctgggtgatactgtaaaagagtaaaaagcactaaaacacatttcatgtttaccataaccatcttactaatcctcccatcctacaccccccataaaactctactctcacccgagttcca

SEQ ID NO: 42982 - DNA, 601 bp, Human
ttaattctttttcctggaataacaggctaactaatgtcacaaaggtcatttgtaagagttccttgaaggcggttttggccatttttaaataagtggaggaacataaatttatctgaacaaggtatgttacaccttggaaacataccttggagaggaaatctcattgagaaatcctctgggttgccgggtgccatggctcacacctgtaatcccagcactttgggaagctgaggcagcaggattgcttgaggctgggagtttcagaccagcctagacaacatagtgagacccccatctctamaaaaaaattaaaaaaaaaattagttgggcatggtggcacgagcctgtagtcccagctacttgacaggctgaggcaagagcctcacttaagcccaggagatcaaggctgcagtgagccgtgatggcaccactgcactccagcctgggtgacagaggccctatctcaaaaacaaagaaacaaaaaatctgtcctctgggtgatactgtaaaagagtaaaaagcactaaaacacatttcatgtttaccataaccatcttactaatcctcccatcctacaccccccataaaactctactctcac

SEQ ID NO: 42983 - DNA, 601 bp, Human
cagaatgtccgcagggaagatttcgttgcagcgaagacgcacaaagtctcccacgtggatttctttccagaatcggttcacgtatttcttttcttccctagaaaacagattttgattaacaaaactcacgagacattggtcgtggctggatctgggtgatgggcacgtggggctcatatggcaattctttctacatttgcataggctgaaaattttgataataaacaggtgttttaaaaagaatatttggccgggtgtggtggctcacgcctgtaatcccagcactttgagagaccgaggygggcagattatgaggtcaggagtttgagaccagcctgaccaacacggtgaaactctgtctctactaaaaatacaaaaattagccgggtgcggtggtgcgtgcctgtagtcccagctacttgggaggctgaggcaggagaatcacttgaacctgggaggcagaggttgtagtgagctgaaatcacactactgcactccagcctgggctatagagtgatattccgtctcaaaaaaaaagaaggaaaaaaaaaagaatattcataccactgaagctcactcaaagtaaaagaagaaaagagta

SEQ ID NO: 42984 - DNA, 601 bp, Human
accagtgaaacagctaggtacgtgttgaccatcagctgctcataaatgttccttgtaactttacaggaacaaataacattctgcgaaacttagacatgcacaaaagaaatcagagtcagagaaactgaatcctgcttcccacagtcacaggcgggtcatgggctcaggtaggtcaggggtcctctcagaccctcagactcgtctactaggaaaaacagcctggtctgacagacaggaaaatgcaggtgctctgagccccagaaggctgtcatggggacactgtgtggctgtaatgcctgcraggccctggaaacgtgggtcacttacaagctccgagaagccgcggaccacctgccgccgcttcaggttggtctctccatccaggttggcggtctcgatgtggcatagcccgtcggggtcactggaggagagcagcagaatgtccgcagggaagatttcgttgcagcgaagacgcacaaagtctcccacgtggatttctttccagaatcggttcacgtatttcttttcttccctagaaaacagattttgattaacaaaactcacgagacattggtcgtggctggatctgggtgatgggcac

SEQ ID NO: 42985 - DNA, 601 bp, Human
cctgctgcaagtgtgtcaggcatctccccctgtgacggtgaccgggggcatctagagcggagacagggatgctagagccccccacaaccctgcccagccaatcgctcaccgccccactccctacagtgccctcgctgaggtccacagacagcagagcccactgccccagggaagcccgatgggctggtgccgaggccgatgggggagggcactgtctgatagaggaggaaaagcccagtggcatcctccctgtgaaccagaggccggcttccccacccttcagggcaggccgactcagacytgctgtctaggccagagcagggctgggagaaggaggcttgggaggagaaggctcgggccaggcccatttccttgtagggtcttcctgatctctgagggctcctgcccctgtcagttcacctggcattagcacctcacactcccggcacagacctggcgggtggggccctttctccctggagcagggacagatgttgggcagcccaatggagtcggtgtgtgcagctgtcacacgtgcttccctccagcctctcacccctcaccctgctgcacggtggccagggcacaccagaggcaggat

SEQ ID NO: 42986 - DNA, 601 bp, Human
gttcctgcattaatgacacagcccgctcttctccttaacctaagcgttgcaaatcacttctaatttaagtgatttgcaaaggggctcccacttccaactgatcattcattaaactggtaaaatattatattgtatttcacataagtcagtgtacagattattaccagttcttaacctgtctgagacaagctaactcagtattacaaaaaaactaattgaaacacagagtacttaaatgttcttggcatttgtggtttttcaattgctggggtttaaaagtcaagagacttgcttcctttaytttcagtggggtggttcatagatttcagaatataatgcataaatgggaatttggataccaaaaaaatgtctttggacctttagggaaagagaaaaaaaaaaacccagaaagtcgggggaaaaaggtaattgggaccagaatgtgcatgcaggtaaagaattttggtgctaataaaacaattttttaaaaaccctcagaattgtttaggctgttagtttggccattttgaccagatcatggctcaaagctacttcctcagcattcctggggccctgagaagggtgacgtagatgtgttggt

SEQ ID NO: 42987 - DNA, 601 bp, Human
ccccaaatttaaggctgtgccccctgccatggttcaggggttgggagggtactcttccctgagtgggagaactctgtctcagagccaggggcagtggctgtcccttcatcagctattcccatatatatatattggagacagagatagggtctctgtcccccaggctggagtgcagtggcatgatcacagctcaccacaacctcaaacttctggttcaaaccatccttcccattcaatcccttgagcagctaggaccacagctgcacaccacgatatctggcaattttttttctttctttctttttttttttttgagatggggtttctctgtgttgcccaggctggtctggaattcctggcctcaaacaatcctcctgtctcagcctcccaaagtgctgggattatgggcgtgagccactgttcctggctcctatattcttcagggtcctctttatttcttttttatttatttttttaaagataacagctttattgagatataattcacatatcattacttcttataacccaatccccaactaagaattcttcacatcagactttctctgattgaatcatgtgtggtttctgtctcctgact

SEQ ID NO: 42988 - DNA, 601 bp, Human
tttttgttgtagcccctcaacactgcgcactttttcaaatgctcttcattaaatacaaccctattccgcctctggggcaccatctgacggacgtcattccctgtagtgcctggcacctgagacctctccatcctggccttcagagtcagtttcaagctcctctttctggaacctcccttgacctctcatggccccaaacccctaacaaaagccccctggactcatctcactgctccatactgggcatcactggtgaataggcctgagtcctccacgtattggtcccatggctggtctttasgtggggtgtgtgtgtgtgtgcatgcgtgtgtgtgcatacgtgcgtgtgtgtgtgtgtgtgtgtgtgtgtacccgttccgcactgcccactccctccaggtttctccagggcttggcctgctccacactttccccatctctcagtccggggtaccctggacatattcctgcaggcaacatgggccctctcaagcccaggctgctgctccatgcaccctctcaaaggtggggctccacggcgctgctgtctagagagctgtcaccagtcttcatccactgcagcgagggcctggctccagca

SEQ ID NO: 42989 - DNA, 601 bp, Human
acttgaacccgggaggcagagaggttgcagtgagccgagatagtgccattgcactccagcctgggcaacaagagcaaaactccgtctcaaaaagaaaaaaaaaaaaaaaagatcagagtgctggtgctgcactctctgtacatggtgatttaatagactataaattaaaggcaaagaatccattatgaagtcaccagaatttaaaaaaaaaatcttcttcgggccaaacttatattgccatgaaataaacacagttaatatgaaaaaacatggtatgtctcaaataatcatattacctacmgaactgaatttctatgaatatccacacttgttagaattaaaaatttaatctaaataaagttattgtattgtcaaagtcatttatttctgtctttcctgttacagatttaatgtccttcaagaaaattatgagattgttaaatttaaaaacaaaaatgtctcagtataaattatgagcttgttgactatccttgaatgtataagagaaaaacatggaagcctctttgtaaaggcttaaaactgaccgatctaattaccatacccaggcagctgtctttattttccacttagatgatagatt

SEQ ID NO: 42990 - DNA, 601 bp, Human
cgtggccagcaatgacactcacatttcttgtccttttacagttttgggaggcggggaacataaggccttctgacagacacactactgaaaagggctttgtgaaaactgacaaattgaagaagtttgcaggcctgatctcagcttggttaaaagtctcactggggttcacgaagtcatttccttggcacacggattattcattagcaatggtgaaaaagccctgaattaatttcgacactaaacccaactgagatgtcaggaagcccagtttcatccacatcccagtaggcaatagtgtttyctgaagtcgagttcttgctttccttaaaggtcgattcctttataaggtctggtttatgtgactatatgaaactgcaaatgtgttcatggatctctgctgctgtagacgggcgaaactctaaggaagccctaataccacagtgagaaccaaaatacagccttccacttgaggagcactcgcaaaccgaaagcattgcataggttgaacgagggaagctggctcttaccaattcacaaaattaagataactccaatgtctgcggaggtgctctgacaggtcttgcattgtgctctgtggaca

SEQ ID NO: 42991 - DNA, 601 bp, Human
gacacatcctaaagctggcttaacaaacctcaattgattgatacttctgcctcagtcactcatttcagtcatcaagggttactagctttctgaacactgactcagagccaccccaattccaggttctgggctgtggctgaatctctggtccataggagatttgcagaaaaggtagggctctctcctccgaacgtcccccacccacccaccaggccctgacgtctctgatgcttgcggcagtctgatctcagcttcagaacccgactttgcacccaaaacctttccctgcccacttttagcyttaaaacaacactcaaaatccccgagaggggtttccgtggcccacgcaggctcactgggccgagatggagatgtcaacctcagagtctgtcctcgcagaatttcctgtctggtggtcaagaatccagaatgcttgataaaggccggatgagcaaaccagctatttgaagttttgtccaaaacaaacctacatccataatgctttgaagttggccttctttaccacacaaatgaaagggcttgtttctcgccaagggctggtgccagtgcggcaaaggtcagttgtgacaggtgagtggaa

SEQ ID NO: 42992 - DNA, 601 bp, Human
acctcttcagaaatcagtctgtgattcctattttaccgggacacatcctaaagctggcttaacaaacctcaattgattgatacttctgcctcagtcactcatttcagtcatcaagggttactagctttctgaacactgactcagagccaccccaattccaggttctgggctgtggctgaatctctggtccataggagatttgcagaaaaggtagggctctctcctccgaacgtcccccacccacccaccaggccctgacgtctctgatgcttgcggcagtctgatctcagcttcagaaccygactttgcacccaaaacctttccctgcccacttttagctttaaaacaacactcaaaatccccgagaggggtttccgtggcccacgcaggctcactgggccgagatggagatgtcaacctcagagtctgtcctcgcagaatttcctgtctggtggtcaagaatccagaatgcttgataaaggccggatgagcaaaccagctatttgaagttttgtccaaaacaaacctacatccataatgctttgaagttggccttctttaccacacaaatgaaagggcttgtttctcgccaagggctggt

SEQ ID NO: 42993 - DNA, 601 bp, Human
cccgggatcactcatgaggacattgtttgctggccacccataaacaaggacatgccaatcataacacaaagagcccggcacggcagctcacgcctataatctcagcactttgagaggctaatgtaggaggactgcttgagcccaggagttcaagagaaacctgagcaacatagtgagaccttcctatctctataaaaaataaaaagaaaaacattaggtctgcgatctaagtctagcttctaaaactaaagtctgttggattccacattaataatgtccactagaggcttatcttcccagstacagaacaaagacaagactcctccctccacccacccagagatgtctgcataattgactctgtgctttttctcttcacacattgactttgtctgatgtaaaaatgtggatttactggacaccaactgaagtctcacaggaaagtgaccattccctggctgcctacctgcccctcttcctgtgtgcctcctcctcctttaaggaaatgtatgaatactacacctcctgaaagccaccttttttttttttttgagacagagtcttactctgttacccaggctggagtgcagtggcatgatct

SEQ ID NO: 42994 - DNA, 601 bp, Human
tctttgtctatgataaacatctgagctcccacctgtcctgtggaactcgggtcgcacaggggattgaggccctgaattttgggttaaatgaaggcttccaggtagaggtcgttcaggggagggtgttaagtgaaaatgctgtagaaagtgcatgctgtttataagcggtagtggttttccttttcagcccgccaccaccagactctctcccctctgtgtaagcccctaatcaaaccccgtgttgcaagtgctggctctgggtctcttcttcggcctcttggacttgtgccttccccactgmggttaacaggggtgcagcacaacatgccccccgggatcactcatgaggacattgtttgctggccacccataaacaaggacatgccaatcataacacaaagagcccggcacggcagctcacgcctataatctcagcactttgagaggctaatgtaggaggactgcttgagcccaggagttcaagagaaacctgagcaacatagtgagaccttcctatctctataaaaaataaaaagaaaaacattaggtctgcgatctaagtctagcttctaaaactaaagtctgttggattccacattaa

SEQ ID NO: 42995 - DNA, 601 bp, Human
aacttaggcccagaggtggagccaggcaacaccctgttccagatgaaccgctctcactggcattactcatcatccaacgccccagggacaggcaagaggcctacagcatctctgcagggctgccctgcagggcaaatgcacctgacagcaatacctcaagcctgccctgaggatgactctgcatggcagatgtgcctgagtatgtgtgctgagctaggacatctgggcgtggccaacccagagatttgttctttgtctatgataaacatctgagctcccacctgtcctgtggaactcgggycgcacaggggattgaggccctgaattttgggttaaatgaaggcttccaggtagaggtcgttcaggggagggtgttaagtgaaaatgctgtagaaagtgcatgctgtttataagcggtagtggttttccttttcagcccgccaccaccagactctctcccctctgtgtaagcccctaatcaaaccccgtgttgcaagtgctggctctgggtctcttcttcggcctcttggacttgtgccttccccactgaggttaacaggggtgcagcacaacatgccccccgggatcactcatgaggaca

SEQ ID NO: 42996 - DNA, 601 bp, Human
taaatctcaggacccccaaacttaggcccagaggtggagccaggcaacaccctgttccagatgaaccgctctcactggcattactcatcatccaacgccccagggacaggcaagaggcctacagcatctctgcagggctgccctgcagggcaaatgcacctgacagcaatacctcaagcctgccctgaggatgactctgcatggcagatgtgcctgagtatgtgtgctgagctaggacatctgggcgtggccaacccagagatttgttctttgtctatgataaacatctgagctcccaccygtcctgtggaactcgggtcgcacaggggattgaggccctgaattttgggttaaatgaaggcttccaggtagaggtcgttcaggggagggtgttaagtgaaaatgctgtagaaagtgcatgctgtttataagcggtagtggttttccttttcagcccgccaccaccagactctctcccctctgtgtaagcccctaatcaaaccccgtgttgcaagtgctggctctgggtctcttcttcggcctcttggacttgtgccttccccactgaggttaacaggggtgcagcacaacatgccccccg

SEQ ID NO: 42997 - DNA, 601 bp, Human
agtcactctcaccagagggttgcaaaggaaaataataaatctcaggacccccaaacttaggcccagaggtggagccaggcaacaccctgttccagatgaaccgctctcactggcattactcatcatccaacgccccagggacaggcaagaggcctacagcatctctgcagggctgccctgcagggcaaatgcacctgacagcaatacctcaagcctgccctgaggatgactctgcatggcagatgtgcctgagtatgtgtgctgagctaggacatctgggcgtggccaacccagagatttsttctttgtctatgataaacatctgagctcccacctgtcctgtggaactcgggtcgcacaggggattgaggccctgaattttgggttaaatgaaggcttccaggtagaggtcgttcaggggagggtgttaagtgaaaatgctgtagaaagtgcatgctgtttataagcggtagtggttttccttttcagcccgccaccaccagactctctcccctctgtgtaagcccctaatcaaaccccgtgttgcaagtgctggctctgggtctcttcttcggcctcttggacttgtgccttccccact

SEQ ID NO: 42998 - DNA, 601 bp, Human
gagaagggagtagtgggggtagtcactctcaccagagggttgcaaaggaaaataataaatctcaggacccccaaacttaggcccagaggtggagccaggcaacaccctgttccagatgaaccgctctcactggcattactcatcatccaacgccccagggacaggcaagaggcctacagcatctctgcagggctgccctgcagggcaaatgcacctgacagcaatacctcaagcctgccctgaggatgactctgcatggcagatgtgcctgagtatgtgtgctgagctaggacatctgggcgtggccaacccagagatttgttctttgtctatgataaacatctgagctcccacctgtcctgtggaactcgggtcgcacaggggattgaggccctgaattttgggttaaatgaaggcttccaggtagaggtcgttcaggggagggtgttaagtgaaaatgctgtagaaagtgcatgctgtttataagcggtagtggttttccttttcagcccgccaccaccagactctctcccctctgtgtaagcccctaatcaaaccccgtgttgcaagtgctggctctgggtctcttcttcggcctctt

SEQ ID NO: 42999 - DNA, 601 bp, Human
agaaattatgtcttccttgaaggaaatgctaagaacttttaaaggagagtttagttaagggttgaaaggttttccctcactatttctaagggaaatgtttaatagaatttctgtcctgacattgcttattagtgccttgactctcacacacacatgcatgcacacgcgctccaatactgaaacacactctaatcagattttcgaagtctgccccatagtaaaatcctaattccttttgatccactgttatccacagagcttttacttttacatgcatataggctgggcatggtggcttacrcctgtaatcccagcactttgggaggctgaggcggatggatcatgaggtcaggagttcaagaccaccctggccaacatggtgaaaccctgtctctactaaaaatacaaaaaaattagccgggggtggtggcgggcgtctgtaatcccagctactcgggaggctgaggcagagaattgcttgaacctgggggggcggaggttacagtgagccgagatggcaccactgcactccagcctgggtgacagagggagactctgtctcaaaaaaaaaaaaaaaaaaaaaaaagacatgcatatacta

SEQ ID NO: 43000 - DNA, 601 bp, Human
ccaccttggcctcccaaagtgctgggattccaggtgtaaaccaccatgcctggtagagccctcttttcactactggtgtaaaacaagtctggattacttttataatgttaaacaagcagggaacaggaaaaacactacgtattgcttccgtagaaattatgtcttccttgaaggaaatgctaagaacttttaaaggagagtttagttaagggttgaaaggttttccctcactatttctaagggaaatgtttaatagaatttctgtcctgacattgcttattagtgccttgactctcacacrcacatgcatgcacacgcgctccaatactgaaacacactctaatcagattttcgaagtctgccccatagtaaaatcctaattccttttgatccactgttatccacagagcttttacttttacatgcatataggctgggcatggtggcttacacctgtaatcccagcactttgggaggctgaggcggatggatcatgaggtcaggagttcaagaccaccctggccaacatggtgaaaccctgtctctactaaaaatacaaaaaaattagccgggggtggtggcgggcgtctgtaatcccagc

SEQ ID NO: 43001 - DNA, 601 bp, Human
cccaccttggcctcccaaagtgctgggattccaggtgtaaaccaccatgcctggtagagccctcttttcactactggtgtaaaacaagtctggattacttttataatgttaaacaagcagggaacaggaaaaacactacgtattgcttccgtagaaattatgtcttccttgaaggaaatgctaagaacttttaaaggagagtttagttaagggttgaaaggttttccctcactatttctaagggaaatgtttaatagaatttctgtcctgacattgcttattagtgccttgactctcacayacacatgcatgcacacgcgctccaatactgaaacacactctaatcagattttcgaagtctgccccatagtaaaatcctaattccttttgatccactgttatccacagagcttttacttttacatgcatataggctgggcatggtggcttacacctgtaatcccagcactttgggaggctgaggcggatggatcatgaggtcaggagttcaagaccaccctggccaacatggtgaaaccctgtctctactaaaaatacaaaaaaattagccgggggtggtggcgggcgtctgtaatcccag

SEQ ID NO: 43002 - DNA, 601 bp, Human
ctacttgcaagtgtggactgagaggcaaagctcctggctgggcacctggactcccatcctgtccaccccaagtgcttcaaccccagacccaggtccaggtccaggtcccgccttgtgtttccaatttctaattgactctcagcagagctctctctctctttttttttttttttcttttgagacagggtatcactctgtcattcaggctggggtgcaatggcacaatctaggcttactgcaaccttaacttcccaggctcaagcaatcctcccacctcacctgcccaagtagctgggctaatttttttttttttttttttttttggtagcaatagggtctcaatttgttgctcaggttggtctcaaactcctgggtttatgtggccctcccaccttggcctcccaaagtgctgggattccaggtgtaaaccaccatgcctggtagagccctcttttcactactggtgtaaaacaagtctggattacttttataatgttaaacaagcagggaacaggaaaaacactacgtattgcttccgtagaaattatgtcttccttgaaggaaatgctaagaacttttaaaggagagtttagttaagggt

SEQ ID NO: 43003 - DNA, 601 bp, Human
ccagtcccaaaaaactcccgaaaaatactctaatcggggttttgtccatactttaaactagtggaactgtttctaaaaaaaaaaaaaaaaaaactttaatgggccccatataacttaatacatggacattcacaggcagacatatacacatacacacactttgccctgcctggtttcttggcatcagcaatttctttgaagagggctgctccgctacgtagcacattacagtcagatgtgtgggcagcaatcaaattcccttctgcctgttctggtctagagagccattccctaactttaycatggtattcacaggtgacactcaccgctgcaggcctttcagcctgagagtgccaaggttagaactgcaattttggtgcatcattctggcaggtgctgcagcagaacgtagggcttcctgcagagaggagatgggtggacacgctgtggcacccctgagacggtgaagggggtgccatgcaaggctgctgtcaccaggaagcagaggatggatggaggctgcgccacatcccggacagcgagtctgctgggagacctggatgaaccggggctcaggcagagaggcatggggttggggagt

SEQ ID NO: 43004 - DNA, 601 bp, Human
tgcaagcgctcctcgggcctcagcaaaacatcctagaacacagctaggtgccacggggactagagctgcagcttgagaaggcaccagtcccaaaaaactcccgaaaaatactctaatcggggttttgtccatactttaaactagtggaactgtttctaaaaaaaaaaaaaaaaaaactttaatgggccccatataacttaatacatggacattcacaggcagacatatacacatacacacactttgccctgcctggtttcttggcatcagcaatttctttgaagagggctgctccgctacrtagcacattacagtcagatgtgtgggcagcaatcaaattcccttctgcctgttctggtctagagagccattccctaactttaccatggtattcacaggtgacactcaccgctgcaggcctttcagcctgagagtgccaaggttagaactgcaattttggtgcatcattctggcaggtgctgcagcagaacgtagggcttcctgcagagaggagatgggtggacacgctgtggcacccctgagacggtgaagggggtgccatgcaaggctgctgtcaccaggaagcagaggatggatggag

SEQ ID NO: 43005 - DNA, 601 bp, Human
ctcggtgacaagaaagggccaggtggtgcttacatgcactgaggaaccacacgctcaaacactgcctccaggccccaacccagccgcttccatcccagcaccctgagctcagtgtctgtgccgcctgcaagcgctcctcgggcctcagcaaaacatcctagaacacagctaggtgccacggggactagagctgcagcttgagaaggcaccagtcccaaaaaactcccgaaaaatactctaatcggggttttgtccatactttaaactagtggaactgtttctaaaaaaaaaaaaaaaaaamctttaatgggccccatataacttaatacatggacattcacaggcagacatatacacatacacacactttgccctgcctggtttcttggcatcagcaatttctttgaagagggctgctccgctacgtagcacattacagtcagatgtgtgggcagcaatcaaattcccttctgcctgttctggtctagagagccattccctaactttaccatggtattcacaggtgacactcaccgctgcaggcctttcagcctgagagtgccaaggttagaactgcaattttggtgcatcattctggcag

SEQ ID NO: 43006 - DNA, 601 bp, Human
cctcaccgcggcactacagctgtcctgctcttatgtgcaggtaagcggtcactcctgaagtcctgggcaaggaaaagatcattgagacgcagcttcctccttcccagagctcgggctggaagctcccagccctggacagccaattctcatctaatacccaaactctccagcctcaccttaattcttccagctctgtggattagacagaggtattgtattcatgatcaagttcttctcacagagacgcaaacccttttctctataacttcactcctggtgccggtctcacctttcctccagyagcctgcctttcaatgacagcagcagcagggcagtgctgagggcagccacccttctgagcactcaccacctgccaggtgcagtgcaaaggacaggccagaaggacctctgacatcattcccattttgcagatgtatcagtccgttttcacattgctaataaagacatacccaaaactgggaacaaaaagagatttaattggacttacagttccacatagctggggaggcttcagagtcatggtgcaaggtgaaaggcacttcttacatggtggcggcaagacaaaaattaggaagaaaca

SEQ ID NO: 43007 - DNA, 601 bp, Human
gcctctaatgatatcacatccctcaccgcggcactacagctgtcctgctcttatgtgcaggtaagcggtcactcctgaagtcctgggcaaggaaaagatcattgagacgcagcttcctccttcccagagctcgggctggaagctcccagccctggacagccaattctcatctaatacccaaactctccagcctcaccttaattcttccagctctgtggattagacagaggtattgtattcatgatcaagttcttctcacagagacgcaaacccttttctctataacttcactcctggtgcyggtctcacctttcctccagcagcctgcctttcaatgacagcagcagcagggcagtgctgagggcagccacccttctgagcactcaccacctgccaggtgcagtgcaaaggacaggccagaaggacctctgacatcattcccattttgcagatgtatcagtccgttttcacattgctaataaagacatacccaaaactgggaacaaaaagagatttaattggacttacagttccacatagctggggaggcttcagagtcatggtgcaaggtgaaaggcacttcttacatggtggcggcaag

SEQ ID NO: 43008 - DNA, 601 bp, Human
gcaccaagaaagctcaggttaaagtcagagacttagcgttcccacccacattccagaattctgcccgtgtagagcctctaatgatatcacatccctcaccgcggcactacagctgtcctgctcttatgtgcaggtaagcggtcactcctgaagtcctgggcaaggaaaagatcattgagacgcagcttcctccttcccagagctcgggctggaagctcccagccctggacagccaattctcatctaatacccaaactctccagcctcaccttaattcttccagctctgtggattagacagmggtattgtattcatgatcaagttcttctcacagagacgcaaacccttttctctataacttcactcctggtgccggtctcacctttcctccagcagcctgcctttcaatgacagcagcagcagggcagtgctgagggcagccacccttctgagcactcaccacctgccaggtgcagtgcaaaggacaggccagaaggacctctgacatcattcccattttgcagatgtatcagtccgttttcacattgctaataaagacatacccaaaactgggaacaaaaagagatttaattggacttac

SEQ ID NO: 43009 - DNA, 601 bp, Human
tggcagagggtaattgtggcttccatgactgggttcaggaaatgagtgccactggggacctgagactgcagggaaaggtaaggaaatgcacttcattctattaaacctcccggctgaagcgtttgtctgtggaatgctagtgaggatgcaggacacacattaaacagcatcaagacttgcttctagacgattttctccttgaagcctagactttaaacagccctgatgtttcaggtgaaggatctctggggagcaccagcagccctgtggagccctcatgatgaagtcagcacaacacagkggggcggggcgggggtgttgtgtctgcctggcacagcctggtggcttcgtggagagacaatgtttaacagccagtagcatagtaatccaatattctccactcctctatagaatacctgccaataatgacaacatgtgaacaaagaattccccttcagcatcagaactttccattagaaacacgtctacctgctcctgcctttgatatctcagaagccctccagaacattcagcgtgtccaacttgctctggttttctggcaccaagaaagctcaggttaaagtcagagacttagcgttcc

SEQ ID NO: 43010 - DNA, 601 bp, Human
gggtttaggagtgccatgagctaaaagctccggcctgctaatggcagagggtaattgtggcttccatgactgggttcaggaaatgagtgccactggggacctgagactgcagggaaaggtaaggaaatgcacttcattctattaaacctcccggctgaagcgtttgtctgtggaatgctagtgaggatgcaggacacacattaaacagcatcaagacttgcttctagacgattttctccttgaagcctagactttaaacagccctgatgtttcaggtgaaggatctctggggagcaccagmagccctgtggagccctcatgatgaagtcagcacaacacaggggggcggggcgggggtgttgtgtctgcctggcacagcctggtggcttcgtggagagacaatgtttaacagccagtagcatagtaatccaatattctccactcctctatagaatacctgccaataatgacaacatgtgaacaaagaattccccttcagcatcagaactttccattagaaacacgtctacctgctcctgcctttgatatctcagaagccctccagaacattcagcgtgtccaacttgctctggttttctgg

SEQ ID NO: 43011 - DNA, 601 bp, Human
attagtgcccttctaagaagagacactcactcgaagttctgcctctctctctctctccaccatgtgaggacacagagtgaaggtggctgtctgcaggccgggaagagggcccttgccagacgccagatctactggcgcctcaatcttgtattcccagcttccagaactgtcagaaataaatgtctattatttatacgtgacccagtctgtggtcatttcattacagtattaggaacagaccaagatattccctttccaacaatctgagctatccttcacttcttcccatcacctgaaatayaaagggttatcactcagcctatgatgctagaaaccgcagacgctctaccttcgggtttaggagtgccatgagctaaaagctccggcctgctaatggcagagggtaattgtggcttccatgactgggttcaggaaatgagtgccactggggacctgagactgcagggaaaggtaaggaaatgcacttcattctattaaacctcccggctgaagcgtttgtctgtggaatgctagtgaggatgcaggacacacattaaacagcatcaagacttgcttctagacgattttctccttgaagcct

SEQ ID NO: 43012 - DNA, 601 bp, Human
tgaagtatgaaaatatcaactatgtcaggaaagcaagatcacagaagcggattatcccacttgcatgcaaaaccaaggacaacaattagagaagaatatgcctcattatgtccaggtgacacccatgcaatgcagggcttctcagtctccaatgggcacatgaatcccctaggatcttgtcaaaatgcagatccttgcctcagtggatctgggcagggcctgggactctgcatttcttcaaggcaccgagtgaggctgatgctgttattccactgacccgacaaagacttacgaaaatgargaatcctgggcaaagagctttccaacctaaggtgcaccgtgcagcgcgggcttccaggactcaggatgttccctgctacagatggcaggtttgagtcccccaaaatgtatatgttaaaacttagcccttagaatgtatgtgtttgagtcccccatgtatatgttaaaacctagtccttaatttgatggtatttgaaggtgggtccttgggaggtgattagggcatgagggtggagcctcacgagtgggattagtgcccttctaagaagagacactcactcgaagttctgcctctctctct

SEQ ID NO: 43013 - DNA, 601 bp, Human
aataaagcatccctaaaattatatctataggagaacaccgtttcattttattttatttagagcttttcaaaagtacatttttttgtaaaagataacctctctgtgtcttcttttaagtgcttgattagtgaagtatgaaaatatcaactatgtcaggaaagcaagatcacagaagcggattatcccacttgcatgcaaaaccaaggacaacaattagagaagaatatgcctcattatgtccaggtgacacccatgcaatgcagggcttctcagtctccaatgggcacatgaatcccctagsatcttgtcaaaatgcagatccttgcctcagtggatctgggcagggcctgggactctgcatttcttcaaggcaccgagtgaggctgatgctgttattccactgacccgacaaagacttacgaaaatgaagaatcctgggcaaagagctttccaacctaaggtgcaccgtgcagcgcgggcttccaggactcaggatgttccctgctacagatggcaggtttgagtcccccaaaatgtatatgttaaaacttagcccttagaatgtatgtgtttgagtcccccatgtatatgttaaaaccta

SEQ ID NO: 43014 - DNA, 601 bp, Human
ggaaataaagcatccctaaaattatatctataggagaacaccgtttcattttattttatttagagcttttcaaaagtacatttttttgtaaaagataacctctctgtgtcttcttttaagtgcttgattagtgaagtatgaaaatatcaactatgtcaggaaagcaagatcacagaagcggattatcccacttgcatgcaaaaccaaggacaacaattagagaagaatatgcctcattatgtccaggtgacacccatgcaatgcagggcttctcagtctccaatgggcacatgaatccccyaggatcttgtcaaaatgcagatccttgcctcagtggatctgggcagggcctgggactctgcatttcttcaaggcaccgagtgaggctgatgctgttattccactgacccgacaaagacttacgaaaatgaagaatcctgggcaaagagctttccaacctaaggtgcaccgtgcagcgcgggcttccaggactcaggatgttccctgctacagatggcaggtttgagtcccccaaaatgtatatgttaaaacttagcccttagaatgtatgtgtttgagtcccccatgtatatgttaaaac

SEQ ID NO: 43015 - DNA, 601 bp, Human
ttttttcaagtgacacacattttcccaaacttttggttttttgaaagactcttactgagcagctaaaaacaaccagttaatgaactgcctgtctttaagaaactactgtcatctgacttatccaaggctattttcaacttagggaaagggaagcttatttttgtaagaaaataattgctcctccacctgcactcaattcattctcgagcaaaattaacctgctgagaataagggtgttattttacgtgcctaaattgcttgcccatggaattcttgaaataaattattttcactgggactrggcatccttttaattctagatcactaatttaacatccgctcatctgttggtcttgaatatcagcaaccagtgagtccgactcatcccaaacgacagcagatggccaggctcctccccctgcatccagactcacttcctcctggtgaagttggctctccagcatcccttccagcactgggctcccagaaggatgcctctgagaggcttccacgcacatgagtgttaatttcatgtgtcaacttgagtgggccacagggtgcccggattaaagattgtttctgtgaatgtctgtcctctgtc

SEQ ID NO: 43016 - DNA, 601 bp, Human
tatgtgtggtttattttatgtcagtcagacctcaataaggctgtttaaaaaatgaaagggcagctaaagttttcaaccgataattaacaatgtttttttttcaagtgacacacattttcccaaacttttggttttttgaaagactcttactgagcagctaaaaacaaccagttaatgaactgcctgtctttaagaaactactgtcatctgacttatccaaggctattttcaacttagggaaagggaagcttatttttgtaagaaaataattgctcctccacctgcactcaattcattctcragcaaaattaacctgctgagaataagggtgttattttacgtgcctaaattgcttgcccatggaattcttgaaataaattattttcactgggactgggcatccttttaattctagatcactaatttaacatccgctcatctgttggtcttgaatatcagcaaccagtgagtccgactcatcccaaacgacagcagatggccaggctcctccccctgcatccagactcacttcctcctggtgaagttggctctccagcatcccttccagcactgggctcccagaaggatgcctctgagaggc

SEQ ID NO: 43017 - DNA, 601 bp, Human
gcacaatcatagctcactgcaaactagaactcttgggctccagggatcctccagcctcagcctcctaaccagctaggaattggcgtgtggcaccatgcccagctaagttgtaaattttctgtagagacaaggttttgctacgttgcccaggctggtctccaactcctggcctcaagtgatcctcccacctcggcctcccaaaactttgggattacaggcatgagcctggccaaattatacattttaaatatgtgtggtttattttatgtcagtcagacctcaataaggctgtttaaaaaaygaaagggcagctaaagttttcaaccgataattaacaatgtttttttttcaagtgacacacattttcccaaacttttggttttttgaaagactcttactgagcagctaaaaacaaccagttaatgaactgcctgtctttaagaaactactgtcatctgacttatccaaggctattttcaacttagggaaagggaagcttatttttgtaagaaaataattgctcctccacctgcactcaattcattctcgagcaaaattaacctgctgagaataagggtgttattttacgtgcctaaattgc

SEQ ID NO: 43018 - DNA, 601 bp, Human
actcaacgccagctgtgaaagcagccaggagtggggctgtacccagcaaagccacaagggtggagctatccaaggccatggcagcccacctctggcatcagtgtgacctagatgtgagacatggagtcaaaggagatcattttggagctttaagatttaatgactgccctatggattttggacttgcatggggcctgtagcccctttgttttagccaacctctcccatttggaatggctatatttacccagtgcctgttaccccattgtatctaggaggtaactaatttgcttttgatttyatagtctcataggcagaagggacttgctttgtctcaaatgagacttcggacttggacttttgggttaatgctggaatgaattaagactttgggggactgttggaaaggcatggctgtgttttgaaatgtgaggacgtgagatttgggtagggtggaatgatatggtttggctgtgtctctaccaaaatctcatcttgaattgtggctcccgtagtccccacatgttgtgggagggatccggtgggaggtaaatgactcaggggtcggttccccccatgctgttctcgtgacagtgagttc

SEQ ID NO: 43019 - DNA, 601 bp, Human
ccacggacagcttgcactaagtgcctggaaaagccacagacactcaacgccagctgtgaaagcagccaggagtggggctgtacccagcaaagccacaagggtggagctatccaaggccatggcagcccacctctggcatcagtgtgacctagatgtgagacatggagtcaaaggagatcattttggagctttaagatttaatgactgccctatggattttggacttgcatggggcctgtagcccctttgttttagccaacctctcccatttggaatggctatatttacccagtgcctgttmccccattgtatctaggaggtaactaatttgcttttgattttatagtctcataggcagaagggacttgctttgtctcaaatgagacttcggacttggacttttgggttaatgctggaatgaattaagactttgggggactgttggaaaggcatggctgtgttttgaaatgtgaggacgtgagatttgggtagggtggaatgatatggtttggctgtgtctctaccaaaatctcatcttgaattgtggctcccgtagtccccacatgttgtgggagggatccggtgggaggtaaatgactca

SEQ ID NO: 43020 - DNA, 601 bp, Human
ttaagccaacatgggcttatcgaatattttaaattatatgggaagcactgtcaaaacatggaatgatgtttagccttcgagtgacagttatatggatgtgttattaatagatgttccaaaattgtataaagttcctagaaacctatgtcttcatataaatgctatcagtcataattatggttcacgaataaccaaatttccttgtcaactgcattgccatagccattttaagccttggtgttcatagcaattgctttattccaatgcctttctgaaagttacttgcaagcacttacaatcktcaagtgttatgtcttcagggcagttcatggaaagaatggaaagaatgaaaaaaactctgacaagtatatagtttctaataattttgagttcatagcattggactgaatttccaaaactataatagcacaaaactgatgggcttgtgctaagcaagttcacagcaggaattaattacatggagctgggcacggtggctcatgaatgtaatgtcagcactttgggagactgaggcaggaggatggcttgaacacaggagcttgaggctgcagtgagctatgatcgtgccactgcactccgg

SEQ ID NO: 43021 - DNA, 601 bp, Human
atttacaataatggaatcaacccaagtgtccatcaacagatgaatgaagaaaatgtggtatagatacacaatgaaatactattcagctttaaaaagaaggaaattctgtcatttgcaacaacatggatggaactagacaacattttgctaagtaaaataagccaggcacagagacaaatatttcatatactcacttatatgtggaatctaaagcaaccaaactcagaagcagagagtggaattgtggttacagaggctgggagttgggagagatggggagatgatggtcaaagggtacaayatctcaggtagaccacactgttttgattcctgtagtcttgtagtacattttggagtcaagatatgtgaatcttccaacttcattcttctctttcaagattgttttggctatatggggagccttgtaactctacataaatttgaggattgccttttttatttctgcaaaaattcattagggttttgacagatagcgcattgtatcagtagactgctttgagtagtatggcatcctaacactatgaaatttgcctatccatgaacataggatgtcttttcatttatttaagtcctttaaaat

SEQ ID NO: 43022 - DNA, 601 bp, Human
acaaagcttcaaagtaaatgaagcaaaactgatagatctgcaaagagaaatacacatatctgcattatgttcagaggttcagtagccctttacaataattcctagaaaaaatggcataaaattagcaagaacacagaagacttgaataacatcatcaaccagtgttacctgtttgacatctataaaatactccacctaaaaacagcagaatgcacgttattctcaaaagcacatagagcatttagcaagatagaccatattttaggtcctaaaagaagtgtcaacaagtttaccataactyacattataaaaaatatttcccatttgtctgggtaataatttttttgatttgaccccgaaaggacaggcaacaaaaacaaaaatacacaagtttggtaatatcaaacttaaaagctcctgcacagcaaaagaacaattaacagtgtgcagagacaacctgcgaattgggagaaaatatctgcaagccatatatccattattgcaagctattattgattaataatggattaatatccaaagtatacaaggagctcaaaaacccaataacaagaaaacaaaaaatcaaattaaagaataggca

SEQ ID NO: 43023 - DNA, 601 bp, Human
aatggctatattgctatcagacaaagtaagtttcaaagcagagaatattgccagggatttataaaagggccaaaatgcccctgacaacaaagcttcaaagtaaatgaagcaaaactgatagatctgcaaagagaaatacacatatctgcattatgttcagaggttcagtagccctttacaataattcctagaaaaaatggcataaaattagcaagaacacagaagacttgaataacatcatcaaccagtgttacctgtttgacatctataaaatactccacctaaaaacagcagaatgcaygttattctcaaaagcacatagagcatttagcaagatagaccatattttaggtcctaaaagaagtgtcaacaagtttaccataactcacattataaaaaatatttcccatttgtctgggtaataatttttttgatttgaccccgaaaggacaggcaacaaaaacaaaaatacacaagtttggtaatatcaaacttaaaagctcctgcacagcaaaagaacaattaacagtgtgcagagacaacctgcgaattgggagaaaatatctgcaagccatatatccattattgcaagctattattg

SEQ ID NO: 43024 - DNA, 601 bp, Human
atgataggcttaaatctaaccatgtcattaatcacattaaatgcaaagctttacacatttcaattaaaaggcagactcgtttttaaaaaaattagcaaaagactcaatttcttgctgtctaaaaaaatgcactttaaatacaagatgcaaatatgttatataaggttatgctgtaactagtcaaaagaaagctaaaatggctatattgctatcagacaaagtaagtttcaaagcagagaatattgccagggatttataaaagggccaaaatgcccctgacaacaaagcttcaaagtaaatkaagcaaaactgatagatctgcaaagagaaatacacatatctgcattatgttcagaggttcagtagccctttacaataattcctagaaaaaatggcataaaattagcaagaacacagaagacttgaataacatcatcaaccagtgttacctgtttgacatctataaaatactccacctaaaaacagcagaatgcacgttattctcaaaagcacatagagcatttagcaagatagaccatattttaggtcctaaaagaagtgtcaacaagtttaccataactcacattataaaaaatatttc

SEQ ID NO: 43025 - DNA, 601 bp, Human
aataatatcactgaaaggatagatcaggatgaattaaagatgtatccaacaaaccttgaagtaacctctaatgaaaaggtatagctaatgggagaaaaaagaagcagaaaaagaagaaaagggtcacaaagagaagatgggaaaacaactagcaagatgataggcttaaatctaaccatgtcattaatcacattaaatgcaaagctttacacatttcaattaaaaggcagactcgtttttaaaaaaattagcaaaagactcaatttcttgctgtctaaaaaaatgcactttaaatacaagwtgcaaatatgttatataaggttatgctgtaactagtcaaaagaaagctaaaatggctatattgctatcagacaaagtaagtttcaaagcagagaatattgccagggatttataaaagggccaaaatgcccctgacaacaaagcttcaaagtaaatgaagcaaaactgatagatctgcaaagagaaatacacatatctgcattatgttcagaggttcagtagccctttacaataattcctagaaaaaatggcataaaattagcaagaacacagaagacttgaataacatcatcaaccagtg

SEQ ID NO: 43026 - DNA, 601 bp, Human
gagaaatggaaggataccattgcaaagttcctttactatatgtgaactgaaataatatcactgaaaggatagatcaggatgaattaaagatgtatccaacaaaccttgaagtaacctctaatgaaaaggtatagctaatgggagaaaaaagaagcagaaaaagaagaaaagggtcacaaagagaagatgggaaaacaactagcaagatgataggcttaaatctaaccatgtcattaatcacattaaatgcaaagctttacacatttcaattaaaaggcagactcgtttttaaaaaaattakcaaaagactcaatttcttgctgtctaaaaaaatgcactttaaatacaagatgcaaatatgttatataaggttatgctgtaactagtcaaaagaaagctaaaatggctatattgctatcagacaaagtaagtttcaaagcagagaatattgccagggatttataaaagggccaaaatgcccctgacaacaaagcttcaaagtaaatgaagcaaaactgatagatctgcaaagagaaatacacatatctgcattatgttcagaggttcagtagccctttacaataattcctagaaaaaatgg

SEQ ID NO: 43027 - DNA, 601 bp, Human
acaaagtctggaaggagagaaatggaaggataccattgcaaagttcctttactatatgtgaactgaaataatatcactgaaaggatagatcaggatgaattaaagatgtatccaacaaaccttgaagtaacctctaatgaaaaggtatagctaatgggagaaaaaagaagcagaaaaagaagaaaagggtcacaaagagaagatgggaaaacaactagcaagatgataggcttaaatctaaccatgtcattaatcacattaaatgcaaagctttacacatttcaattaaaaggcagactcrtttttaaaaaaattagcaaaagactcaatttcttgctgtctaaaaaaatgcactttaaatacaagatgcaaatatgttatataaggttatgctgtaactagtcaaaagaaagctaaaatggctatattgctatcagacaaagtaagtttcaaagcagagaatattgccagggatttataaaagggccaaaatgcccctgacaacaaagcttcaaagtaaatgaagcaaaactgatagatctgcaaagagaaatacacatatctgcattatgttcagaggttcagtagccctttacaataa

SEQ ID NO: 43028 - DNA, 601 bp, Human
acttacaaaagaaaaatatagtgaacttgaaaaatagtaaccaaaactatccaaacggaaatactaagagaaaaaagaatcaaaagagaggattggtaagttgtaaaacaatttcaagaagccaatattctattacttagaatccccaaagatggggaagggtatgaagaaatatttgattaaataataactgaaaagtttccaaacttaatgaaaactataaacctacagatccaagaatctcaaacccccaaattatgaagaaaattacaaagcatatcatgatcaatttgcttaaaastagtaattaaaaaaaaaacttgcaagcagctgtgttatgtacaaaggaacacaaataaggataagagcagatatttcattacaaacaatgcaagcaagacgacactggagcaacatctttaaagcaccaaagtgtaaaatactgtcaacctagaattctatacccagtaaagatatttttcaaaataaaaaaggagggtgtaaaataaagatgtttgcacatatacaaaagctgaaaaaaaattcctcacccacagatccataccagaaaaaaatgataaaggaagccattcaggcaaaa

SEQ ID NO: 43029 - DNA, 601 bp, Human
atgcaaagaagaaagaaaactaggcccataataaagagaataagtaagtcagcttaatctaacatagaagagacacagatgttagaatttgtagaaaatgacattaaagcagtaattatgctggctttccaatgatcaaaaacttaagtagggacatggaaggtaaaaaagagaccaaaattgaacttctagagatgaaagctacaatatctgagacaaaaaataaactgaatgagatcaacagctgcttagaacttacaaaagaaaaatatagtgaacttgaaaaatagtaaccaaaacyatccaaacggaaatactaagagaaaaaagaatcaaaagagaggattggtaagttgtaaaacaatttcaagaagccaatattctattacttagaatccccaaagatggggaagggtatgaagaaatatttgattaaataataactgaaaagtttccaaacttaatgaaaactataaacctacagatccaagaatctcaaacccccaaattatgaagaaaattacaaagcatatcatgatcaatttgcttaaaactagtaattaaaaaaaaaacttgcaagcagctgtgttatgtacaaagg

SEQ ID NO: 43030 - DNA, 601 bp, Human
tatcagggaaagaatgtatgatatcaccacttccatttagaactgtactggagtccttgccactgcaattaggtaagaaaaaaaaaagtataatgactaaaaaggtagaaataatgctatcataattcaaaaataaaatgactgtgtagaagatctaaaataatcttagaaacttattagaattaatacatgagtgaccaggcacagtggctcatgcctgtaatcccagcactttgggacgccaagataggcagattatctgaggtcaggagttcaagaacagcctggccaacatggtgasaccccatagctactaaaaatacaaaaaaaaaaaaattatccgggcgtggtggtgtgtgcctgtaatcccagctactcaggaggctgaggtgggagaattgcttgaaactgagaggcagaggttgcaatgagccaagatagcaccactgtacttcagcctgggcaacagagtgagactctgtcaaaaaaaaaaaaaaaaaaaaaaagaattaatacatgagtttagcaaagtttctggatacaagatcacctactatgtctctatagactgtatgaacatacatacatatgcatgtatact

SEQ ID NO: 43031 - DNA, 601 bp, Human
acaggtgtgagcggccaaaaattcttaataaaacattagtttactaatcccagaaatatataaaagataatacattaggaagatggatatagctcaagaattcaagattggtatggcattagaaaaatcaatgtcattagatacattaacacaaaaagagaaaaatcatatgatcaactcaactgaagcagaatatgcatttgattcaacatttattcataatactttctcttagcaggctacgaataaaagaatcattagtttgtaagggctattcaccaatatcctaataaaatatcayatataatggtacaatgttcaaatttttccctttacacattgtatcagggaaagaatgtatgatatcaccacttccatttagaactgtactggagtccttgccactgcaattaggtaagaaaaaaaaaagtataatgactaaaaaggtagaaataatgctatcataattcaaaaataaaatgactgtgtagaagatctaaaataatcttagaaacttattagaattaatacatgagtgaccaggcacagtggctcatgcctgtaatcccagcactttgggacgccaagataggcagattat

SEQ ID NO: 43032 - DNA, 601 bp, Human
tgccataagcaagtatcaatcaatttcaaaaaactaaattcatataggattaacttaaatcagaattcaccataaaaagaaaattactaaaagtcccatttgctttgaaattatgtaatacaattctaaatgaccaattagtcaaagaaaagaagtcacgagagaaattaagaaaaatatttttgtaaatgatattaaacatataggttgagtatccctactcggaaactccaaaatccaaaatgcttcaagatctaaaactttttgtgtgttggcatatgacacccaaaggaaatgctckctggagattttcggattaggaatgttcagctggtaagtgtaatgcaaataatatcccaaaaataaaaaaaaatcagaaatctgaaaaacttcttgtcttaagtatttcagataaagaatattcaacttggctggctcacgcctgtaatccctacactttgggaggccaaggcgggtggatcaagtgaggtcaggagttcgaggccagcctggccaatatgatgaaaccccatctctactataactacaaaacattagctgggcatggttgtgggctcctgtaatcccagctactcaagga

SEQ ID NO: 43033 - DNA, 601 bp, Human
gaccactattctgtctactataaaacctaccaagagaggggcctgataaacacctatgctttctaacgcaaccaggaagaacggcatcacagaggtgaactgcgggaaagagcttcaacatggaacttaatacaacacggtgccactgcatcaaacacatccagaacactgctgagctccttttgtgcagctgctacccagcttagagtcaactgagtggcccagaaaaatctcaatgtgaaaaatggagtataataattccaaattgctagaacccctagatactaaacaaaaccagcaraagtcttctttatatatgtgtgtctgtgtgtgcacatgtatgtgtgtgtgcatgtatgtgtgtgagtgtgtgtatatatatatgaaatacaaggcctcaaattatttgtaaaaaatcaatttccaggtacaatgtcagacacagactcagggataaccaggcataacaggatgtaaagcatcatggaagaaccaacaaaacaagaataggaacagatccacaggaagtttaaaatcatgcttgctgtgatcataaagctaaagatgcacctgaaattttacaacagctagaaattataaa

SEQ ID NO: 43034 - DNA, 601 bp, Human
aggtttaggtgagtaagatgtgggcatctttcgggggaccactattctgtctactataaaacctaccaagagaggggcctgataaacacctatgctttctaacgcaaccaggaagaacggcatcacagaggtgaactgcgggaaagagcttcaacatggaacttaatacaacacggtgccactgcatcaaacacatccagaacactgctgagctccttttgtgcagctgctacccagcttagagtcaactgagtggcccagaaaaatctcaatgtgaaaaatggagtataataattccaarttgctagaacccctagatactaaacaaaaccagcaaaagtcttctttatatatgtgtgtctgtgtgtgcacatgtatgtgtgtgtgcatgtatgtgtgtgagtgtgtgtatatatatatgaaatacaaggcctcaaattatttgtaaaaaatcaatttccaggtacaatgtcagacacagactcagggataaccaggcataacaggatgtaaagcatcatggaagaaccaacaaaacaagaataggaacagatccacaggaagtttaaaatcatgcttgctgtgatcataaagctaaaga

SEQ ID NO: 43035 - DNA, 601 bp, Human
cacattccctgacttatggcttccttccatttttaaagtcatcagtgtgcggggattgagtctgtctcacgctgtatcactttgatagtgaggtctgattaacagccttaattccacttacaacctccatttctgcttgctatgtagcataacatatccacaggtttaggtgagtaagatgtgggcatctttcgggggaccactattctgtctactataaaacctaccaagagaggggcctgataaacacctatgctttctaacgcaaccaggaagaacggcatcacagaggtgaactgcrggaaagagcttcaacatggaacttaatacaacacggtgccactgcatcaaacacatccagaacactgctgagctccttttgtgcagctgctacccagcttagagtcaactgagtggcccagaaaaatctcaatgtgaaaaatggagtataataattccaaattgctagaacccctagatactaaacaaaaccagcaaaagtcttctttatatatgtgtgtctgtgtgtgcacatgtatgtgtgtgtgcatgtatgtgtgtgagtgtgtgtatatatatatgaaatacaaggcctcaaatt

SEQ ID NO: 43036 - DNA, 601 bp, Human
attcaaacctagatgagggctgctcgttaaaattgccctcttgaacgtatttgtacttaatccaacagggtgtccctgcatgaaacccgcctgcagcccctctgctgagctattagcacagtgagatccacatcagtctgtctgcttccacagccacaggccacttagtgcctcttccatcactacaggtgggggtgatggtgtgagcagaggcacggcttttgggtgtgaacgtgtcatgctttagagctcactcagtagacagccttgctggagaaaaggtgctctctctgtgcacagygtaagaggggtctggagcctcagtgtatttgtaataaaagggaccctaaaggcagagttccatggaccacagggccattggtagccacatagaggaagaccatactactattttagaggccaactgggatggagaatacaaaaagaggtcagctaagaaaaaacctcttgcgctaatctggggaatgattccaagactgaaatggcaacagaaatgtgaaattctaaagcacaaccagatctgctcagtcatcagattcaaaagaaaagttatccagcaccagacgactgggcaatttgg

SEQ ID NO: 43037 - DNA, 601 bp, Human
actggctgtgcattcaggcagtaggtaacgagagttgtttcacagaacaccaaattcaaacctagatgagggctgctcgttaaaattgccctcttgaacgtatttgtacttaatccaacagggtgtccctgcatgaaacccgcctgcagcccctctgctgagctattagcacagtgagatccacatcagtctgtctgcttccacagccacaggccacttagtgcctcttccatcactacaggtgggggtgatggtgtgagcagaggcacggcttttgggtgtgaacgtgtcatgctttagmgctcactcagtagacagccttgctggagaaaaggtgctctctctgtgcacagtgtaagaggggtctggagcctcagtgtatttgtaataaaagggaccctaaaggcagagttccatggaccacagggccattggtagccacatagaggaagaccatactactattttagaggccaactgggatggagaatacaaaaagaggtcagctaagaaaaaacctcttgcgctaatctggggaatgattccaagactgaaatggcaacagaaatgtgaaattctaaagcacaaccagatctgctca

SEQ ID NO: 43038 - DNA, 601 bp, Human
ctgcgtccctgcctgacgtggttctcgtctccacggtgacaagctgacagggacaatgagaactggcatccaggcctccgcagtcctctttcagagtcagcttcacacaggtccacaggtggcttcttgggaggctcacgcctcagagaaactgatcaaggggtgtctgggttctgccttctttttctaactggagattttcttgccgcaagcaccagtgttagagatcaagtggtcctcccttagtttctgagcagaaaggcagcttttcccttgttaaattctagtttagaacgcaggygccagcctccccttgccttttctgcctttcatcttttgtccccttgcctcctgactgtcgcacagtcaaaaagcctcggtagatggtggcaaaattcaaaggctcacagtgcggggttagagtttgaagtctcaaaatcaaaaccctttctttccctcctggccccaaacgctccatgctgtttcagtgggctgtggctgtcagcaaagccttgctttctcctccgtcaaatgcacctaagagtccctaagaactggctgtgcattcaggcagtaggtaacgagagttgtttcacagaac

SEQ ID NO: 43039 - DNA, 601 bp, Human
ggagggcagatggcccgatcccaatactgaacgaatgagtgaatttactttttcactgccaagactgtattgtcaggtgaacattttcaatttgctaaactgaaacagcaaagtagtctgtttttgtccaccacgtgtctcctgacacatagtgggtactcaatcagttatttattgaaaaaataaataataaataaatacccaagtgaaagcgtctggtggcaagaaacaccgaacgtacaaggaaacttaactcaaagtgataatttctccaagttccacagattcagtgttactctakgggttaatgccccgtgacaaatactgaatagaaatgagcatgaaacccatttagacagcaatgtaatctataatagcggctgtgattgtattatttaaggtatcccaaatatggaagtgataagtaggttggcccagccgctcatggcgggacactccactgcacgtcacacagcatgtgacggactctgtgagtgctgcgtccctgcctgacgtggttctcgtctccacggtgacaagctgacagggacaatgagaactggcatccaggcctccgcagtcctctttcagagtcagcttc

SEQ ID NO: 43040 - DNA, 601 bp, Human
accatctcccaagagggcctgctgaggcgtctctgtggttccagaatgcatagttcctctttttaaagtgcgggctcttttcccctggcagcaatacaaaatgatttcttcatagcctctaatccggctccttagctccttacttattgatcatgggtaaagaatgccttcattaaattaagtcaagcattttaacccaaattaatggaataattaccccaactcttttgttttgtactttctttattattactattattattattttgtatttcaatctaatttgtatttaccacttgayggtcagtgctgtggaaattcaaaggagggcagatggcccgatcccaatactgaacgaatgagtgaatttactttttcactgccaagactgtattgtcaggtgaacattttcaatttgctaaactgaaacagcaaagtagtctgtttttgtccaccacgtgtctcctgacacatagtgggtactcaatcagttatttattgaaaaaataaataataaataaatacccaagtgaaagcgtctggtggcaagaaacaccgaacgtacaaggaaacttaactcaaagtgataatttctccaagt

SEQ ID NO: 43041 - DNA, 601 bp, Human
aagaagacgtggaaaacacacacactcccgtcttctgcatctggatcccgttctgaaaacgccctttgcatttcccttcatgatactcccaggtcacaaggagggtgaggtccccctggttcacttccagccttgacatcacgcctggacatggtcctcgaaggctctcagtgacaaacacaacacctctgtctacctggctttggtctcgccacctgctatgggcctgtttgtccctggactgaatgatccccgtctgatcacagaagttttccaccttaacaaagccttggagacagcygctgccctacagaatgcaatcctcatcccgtgcaacagcaaagctctgctcagggtcactgcgctgacctcctcggctaccatccctcccagcacccattcctgccacgcagggaaccctgaggaagcccaaacctttctgcatggcttcctctgtcttgccatcctacagcatcaggcgaagtgcccttcatttagcatttcaggatgttgtcttttctggagaagccttcctgacggccccctggtagggtaggcaggtgccacagctccgaacttgcttagtccccatgcagacatc

SEQ ID NO: 43042 - DNA, 601 bp, Human
gcccagtctgcggtgtttcatcaatgaggccccagtaaacgaatacagagaccatctttgagtttctcatttaaaaagcatttcatatccagagcacaccttctggatgaggaaaatcctgtttacattgcttatttctaacaacaggcaacacagcaacactccccatttaggaaatacattgatttatccctccatccactcatgtctacccctgactcattccaaaccagctttgaggtcatgcccaagttatccatcagtcagacttgtcaacctgccccctggagcatggacaaargtagaggcccccgatccacccttctgctctgggcacactaactccattcttcttaaaaagcagatatccagctagggaagaggaagcagttctacagatggatggtggtgatggttgcgcaacaatgcgaatgaacttaatgccactgaactgtacactcacaaatgattacaatagtaaactctgtgttatgcatattttgccatgataaaaaatttcatttacggccatgccaccctgaatgcatccaatcttgactgatcttggaagctaagcagggtcagtacttggatgggagac

SEQ ID NO: 43043 - DNA, 601 bp, Human
gcaaagacacacagaggggagatcatgcaaggacacagggagaagccaaaaaaagaggcctcaaaagaaaccatcctgctgaccccttactcccgaatgtccagcttccagacctgtgagaaaataaacttccgttgcttaagcagcccagtctgcggtgtttcatcaatgaggccccagtaaacgaatacagagaccatctttgagtttctcatttaaaaagcatttcatatccagagcacaccttctggatgaggaaaatcctgtttacattgcttatttctaacaacaggcaacacagcaacactccccatttaggaaatacattgatttatccctccatccactcatgtctacccctgactcattccaaaccagctttgaggtcatgcccaagttatccatcagtcagacttgtcaacctgccccctggagcatggacaaaggtagaggcccccgatccacccttctgctctgggcacactaactccattcttcttaaaaagcagatatccagctagggaagaggaagcagttctacagatggatggtggtgatggttgcgcaacaatgcgaatgaacttaatgccactgaactgta

SEQ ID NO: 43044 - DNA, 601 bp, Human
ttgtgtttatttaaagcctgtggattatcttgaaaccagtggatggctttttccagggcagacatttgcagatacaaagtacaggatggccatgaaggcagtgagttccagagaacaccaggattattcttggcagacgaggagggtaggacttaaaatattttgtctctgtttattattctttctctctaagaaaaatgtcatggacatggctcagaaacagtaggacattctgtctctgggacttcagagctgtgtttgtaatgttctaccaacaatcccatgccctggggagtgtgcrcaggggaggtcccaggcacgggacggctggcttcctctgcatccttctggaactggggaggatttggaggatttttagaactggagggatctctagagactggcatgggctgaactggagcccctcatccgccgctagaactcatatattgaagtcctaaccccacgtagctcagaacgtacccttatttagagaggaagtctttaaagaggtaactaaattaaactgaggtcatcagggtggaccctaatcccacatgactggcggccttatacaaagggaaaatcaggacgcaaagac

SEQ ID NO: 43045 - DNA, 601 bp, Human
ggcacatttcacgggggaagaactctgcctatgaatctctctggaaagccaaagcaccgccttctccactgtataataaataacagttaatcattttataacgagtgacaattgggggaccggtactggttactggttagtaagtgagcagaaatgactgcagctctattgcaaaatgagagaacaggcgataaagcaaaggaggccatcaatgaagcaaagggatgaatgagttttttaagacacacggcacttgcccatttctacagacttagggaagcaaattccacctggaaaacaggagcttataataaattctattttttcaacgtacactacatgatcttcatggatctttgatgaaaaagatttacatagccaatgagtgagccaacaacttctttagtattctgctcaattaaaaaaaaaccctgacaactcaccacaaaaatgtctttagaatttttccattgatagataaaacagagcctggctcataagaaaggcttaggagtggggggaaggaggaagaagggagagaaatggagggaataagccttcagtataaacgagcacaattagtggatttcttttttatcag

SEQ ID NO: 43046 - DNA, 601 bp, Human
tgtgtaaacacctgcctatgtagttatcaaacagaaggatgcgcgcaggcagacgcacgatactcacatgcagccgcgaaacctactcaggtcgttgtttggcttctcgcattcgatcacgctggtgaacgtcaaaggattgaattcggagacctaaaataacagcacgtagacattagagaaatccgggctcaggctgcgccgttctaaaaggcactcgcttttctgtcttgcatccgcggcaggcacatttcacgggggaagaactctgcctatgaatctctctggaaagccaaagcamcgccttctccactgtataataaataacagttaatcattttataacgagtgacaattgggggaccggtactggttactggttagtaagtgagcagaaatgactgcagctctattgcaaaatgagagaacaggcgataaagcaaaggaggccatcaatgaagcaaagggatgaatgagttttttaagacacacggcacttgcccatttctacagacttagggaagcaaattccacctggaaaacaggagcttataataaattctattttttcaacgtacactacatgatcttcatggatctt

SEQ ID NO: 43047 - DNA, 601 bp, Human
ctgggccacattcccaaacagctacaccatgtggcaaagagtattaaatgcatactttataactgagaatgtgtaaacacctgcctatgtagttatcaaacagaaggatgcgcgcaggcagacgcacgatactcacatgcagccgcgaaacctactcaggtcgttgtttggcttctcgcattcgatcacgctggtgaacgtcaaaggattgaattcggagacctaaaataacagcacgtagacattagagaaatccgggctcaggctgcgccgttctaaaaggcactcgcttttctgtctygcatccgcggcaggcacatttcacgggggaagaactctgcctatgaatctctctggaaagccaaagcaccgccttctccactgtataataaataacagttaatcattttataacgagtgacaattgggggaccggtactggttactggttagtaagtgagcagaaatgactgcagctctattgcaaaatgagagaacaggcgataaagcaaaggaggccatcaatgaagcaaagggatgaatgagttttttaagacacacggcacttgcccatttctacagacttagggaagcaaattcc

SEQ ID NO: 43048 - DNA, 601 bp, Human
gcaagtgccaacacagggccaggcctgtgccctgatccacctgtctttctgttttggagcaggaaggggctggcctactagacacactctaggttatgcttatttgttttaattgtctttctttcccccaaactagaatgaaataaacacaaaggcaggaacttctgtttattcagtttaccacattacatccagtgccttgaatgcacccagcatgtaacaggtatcaataaatacgtgttcagtgactgagtggaagcatatatccatgaaactccacccggcctactcctgcttccaygttaacggggccatgtgtggtcagctacacatctcttgtcacacccatcacctacccggggcctgctagcgggaggaaaagcggtacctcctcctcacagatggtagtggcaagcttctactgacaacaggctcttacccactactgacaacaggctcttacttccaaaagcagccaagaaggctcaggtgctgggccacattcccaaacagctacaccatgtggcaaagagtattaaatgcatactttataactgagaatgtgtaaacacctgcctatgtagttatcaaacagaaggat

SEQ ID NO: 43049 - DNA, 601 bp, Human
gcaacatgccggtgaggacaccacacgaggaacgcctgttggcggcacaggctggagaagccccggtgggcctggctggctggctgcaggcagatgacacccactcaagaggcatcttccccggcacccggggggagtgcagccaggcctgggggtacacagccaggcaagggcctcatgtgggaggcagtgaggtgctggggctgagcgcggggtggagacaccacccagactcctgtcctcaccacactgctagagacagtggctgagcaatacaatgctcctcccgtctcctgcaccrgaccccgcccctctcgtccaccccagcagagggccgtcacctttcctaggctctgtggatccagcaggctgcaggccttcgtatctgtccctgctgtgtctccactgccaggcaccgccctgtcacaccaaggacaatgagctaggagtgcagtcttcagaagaggaagtcggccccttatttatttatgttttttggtggagttggcactgtaaaattattccagggataccactgaacattctccagagattgccctcgccccacccttcacaatcattgtttcaggtcaagatgtct

SEQ ID NO: 43050 - DNA, 601 bp, Human
tacacgaggagacaacacgacatgactgagggcaaagcaggaaaggatttcatgctgggagagctgctcttctcatgtccctttctcgggcaacatgccggtgaggacaccacacgaggaacgcctgttggcggcacaggctggagaagccccggtgggcctggctggctggctgcaggcagatgacacccactcaagaggcatcttccccggcacccggggggagtgcagccaggcctgggggtacacagccaggcaagggcctcatgtgggaggcagtgaggtgctggggctgagcgcrgggtggagacaccacccagactcctgtcctcaccacactgctagagacagtggctgagcaatacaatgctcctcccgtctcctgcaccagaccccgcccctctcgtccaccccagcagagggccgtcacctttcctaggctctgtggatccagcaggctgcaggccttcgtatctgtccctgctgtgtctccactgccaggcaccgccctgtcacaccaaggacaatgagctaggagtgcagtcttcagaagaggaagtcggccccttatttatttatgttttttggtggagttggcact

SEQ ID NO: 43051 - DNA, 601 bp, Human
gaggcctgaattggctgggcgcacactggcccagatggtgcctgtgcccaggccacaagggggctaccagggttggacgatgggtggagtacacgaggagacaacacgacatgactgagggcaaagcaggaaaggatttcatgctgggagagctgctcttctcatgtccctttctcgggcaacatgccggtgaggacaccacacgaggaacgcctgttggcggcacaggctggagaagccccggtgggcctggctggctggctgcaggcagatgacacccactcaagaggcatcttccccrgcacccggggggagtgcagccaggcctgggggtacacagccaggcaagggcctcatgtgggaggcagtgaggtgctggggctgagcgcggggtggagacaccacccagactcctgtcctcaccacactgctagagacagtggctgagcaatacaatgctcctcccgtctcctgcaccagaccccgcccctctcgtccaccccagcagagggccgtcacctttcctaggctctgtggatccagcaggctgcaggccttcgtatctgtccctgctgtgtctccactgccaggcaccgccctg

SEQ ID NO: 43052 - DNA, 601 bp, Human
accccgggagtattcctcactgcgaggctgccccagtccccttcaggctgatggtccggggcagggctgctccccttggtcgtgccccacagtcacggggggaagtattaacacactgctgctccacccccagaagcccctcctgacctgtctggctgggagaggggccatccaggccctgacagccctgtggcaagcccagaacaccccggctggtggagatggcgaattatcgttaaagagcgtcaggtgtggagaggcctgaattggctgggcgcacactggcccagatggtgcctgygcccaggccacaagggggctaccagggttggacgatgggtggagtacacgaggagacaacacgacatgactgagggcaaagcaggaaaggatttcatgctgggagagctgctcttctcatgtccctttctcgggcaacatgccggtgaggacaccacacgaggaacgcctgttggcggcacaggctggagaagccccggtgggcctggctggctggctgcaggcagatgacacccactcaagaggcatcttccccggcacccggggggagtgcagccaggcctgggggtacacagccagg

SEQ ID NO: 43053 - DNA, 601 bp, Human
ttatagaaacaagaaaaatgttctacattaaatgttcttaattgtgacactgacttttgagcaactactgtgatttctgatgagtccaagccagacggcaacttggcaccttacacaggtgcatcgacctatacaggtccatgccagaaggaagagcgaatgcgaggggatgggaacgtactcctgcgtgaacagcccacaacacaaaggggaggctggagaacgacatcaccatcaggtgcctggtacctgggctagaggctgccttgggcttctgagagagagaggcccggccgagggygacacaggcccagaagcacacaggcacgaggctcaactccacaaagacacacacaagaacgtgagccgtcagctccgttgtcatgggctgaaccgtgtcccctcagaattcagctggtgaagccctaactcccaggactgcagaatatggctgtatttggagacagagtctttaaagagatccttaagttaaaatgaggtcctttggacaggcgtggtggctcacgcctgtaatcccagcactttgggaggccaaggcaggtggatcacttgaggtcaggagttcgagaccagcctgatc

SEQ ID NO: 43054 - DNA, 601 bp, Human
accccctatcacgtgtctcccgtggacttctccagcgaaagccagacaaagacaccattgcactgggacagtagaaaataacaaatagtctccaagttcaggttatgcttattaaggacaaacgataaactttatagaaacaagaaaaatgttctacattaaatgttcttaattgtgacactgacttttgagcaactactgtgatttctgatgagtccaagccagacggcaacttggcaccttacacaggtgcatcgacctatacaggtccatgccagaaggaagagcgaatgcgaggggwtgggaacgtactcctgcgtgaacagcccacaacacaaaggggaggctggagaacgacatcaccatcaggtgcctggtacctgggctagaggctgccttgggcttctgagagagagaggcccggccgagggtgacacaggcccagaagcacacaggcacgaggctcaactccacaaagacacacacaagaacgtgagccgtcagctccgttgtcatgggctgaaccgtgtcccctcagaattcagctggtgaagccctaactcccaggactgcagaatatggctgtatttggagacagagt

SEQ ID NO: 43055 - DNA, 601 bp, Human
gagtaaggttttcctttaaagagagattcgagacggcaaaccactttgccagccacagcatcaaaagcctggcaggtatgagatatccttaggtacaaaaccctgctctgcgcttgtggagtgaggacaccccctatcacgtgtctcccgtggacttctccagcgaaagccagacaaagacaccattgcactgggacagtagaaaataacaaatagtctccaagttcaggttatgcttattaaggacaaacgataaactttatagaaacaagaaaaatgttctacattaaatgttcttaaytgtgacactgacttttgagcaactactgtgatttctgatgagtccaagccagacggcaacttggcaccttacacaggtgcatcgacctatacaggtccatgccagaaggaagagcgaatgcgaggggatgggaacgtactcctgcgtgaacagcccacaacacaaaggggaggctggagaacgacatcaccatcaggtgcctggtacctgggctagaggctgccttgggcttctgagagagagaggcccggccgagggtgacacaggcccagaagcacacaggcacgaggctcaactcca

SEQ ID NO: 43056 - DNA, 601 bp, Human
cggagtaaggttttcctttaaagagagattcgagacggcaaaccactttgccagccacagcatcaaaagcctggcaggtatgagatatccttaggtacaaaaccctgctctgcgcttgtggagtgaggacaccccctatcacgtgtctcccgtggacttctccagcgaaagccagacaaagacaccattgcactgggacagtagaaaataacaaatagtctccaagttcaggttatgcttattaaggacaaacgataaactttatagaaacaagaaaaatgttctacattaaatgttcttmattgtgacactgacttttgagcaactactgtgatttctgatgagtccaagccagacggcaacttggcaccttacacaggtgcatcgacctatacaggtccatgccagaaggaagagcgaatgcgaggggatgggaacgtactcctgcgtgaacagcccacaacacaaaggggaggctggagaacgacatcaccatcaggtgcctggtacctgggctagaggctgccttgggcttctgagagagagaggcccggccgagggtgacacaggcccagaagcacacaggcacgaggctcaactc

SEQ ID NO: 43057 - DNA, 601 bp, Human
ttcttcgccagagcagacacagtggggccacacaagggccgttcagccaacgccgtgtctactgctcccttggcaatgccaagacggagtaaggttttcctttaaagagagattcgagacggcaaaccactttgccagccacagcatcaaaagcctggcaggtatgagatatccttaggtacaaaaccctgctctgcgcttgtggagtgaggacaccccctatcacgtgtctcccgtggacttctccagcgaaagccagacaaagacaccattgcactgggacagtagaaaataacaaatmgtctccaagttcaggttatgcttattaaggacaaacgataaactttatagaaacaagaaaaatgttctacattaaatgttcttaattgtgacactgacttttgagcaactactgtgatttctgatgagtccaagccagacggcaacttggcaccttacacaggtgcatcgacctatacaggtccatgccagaaggaagagcgaatgcgaggggatgggaacgtactcctgcgtgaacagcccacaacacaaaggggaggctggagaacgacatcaccatcaggtgcctggtacctgggct

SEQ ID NO: 43058 - DNA, 601 bp, Human
ctatgtcctagtgaagaagagaagctaaacagtaaaggcaaggctgaaatgcaagctgggaggatatattttccacaagtcagttatttaccaacagcaagggttcttcgccagagcagacacagtggggccacacaagggccgttcagccaacgccgtgtctactgctcccttggcaatgccaagacggagtaaggttttcctttaaagagagattcgagacggcaaaccactttgccagccacagcatcaaaagcctggcaggtatgagatatccttaggtacaaaaccctgctctgcrcttgtggagtgaggacaccccctatcacgtgtctcccgtggacttctccagcgaaagccagacaaagacaccattgcactgggacagtagaaaataacaaatagtctccaagttcaggttatgcttattaaggacaaacgataaactttatagaaacaagaaaaatgttctacattaaatgttcttaattgtgacactgacttttgagcaactactgtgatttctgatgagtccaagccagacggcaacttggcaccttacacaggtgcatcgacctatacaggtccatgccagaaggaa

SEQ ID NO: 43059 - DNA, 601 bp, Human
agtgccttccgagaggctaccttttcacacccacaccccctctccgcacgcattccccacactctcaagcccacatgcttcctgtatggctcttagcgtctcaccagggacccctgcaggggtttccctcctgccaactattagccttctgaccagggaaataaacctatgtcctagtgaagaagagaagctaaacagtaaaggcaaggctgaaatgcaagctgggaggatatattttccacaagtcagttatttaccaacagcaagggttcttcgccagagcagacacagtggggccacwcaagggccgttcagccaacgccgtgtctactgctcccttggcaatgccaagacggagtaaggttttcctttaaagagagattcgagacggcaaaccactttgccagccacagcatcaaaagcctggcaggtatgagatatccttaggtacaaaaccctgctctgcgcttgtggagtgaggacaccccctatcacgtgtctcccgtggacttctccagcgaaagccagacaaagacaccattgcactgggacagtagaaaataacaaatagtctccaagttcaggttatgcttattaagga

SEQ ID NO: 43060 - DNA, 601 bp, Human
gccaccaagggagtgccttccgagaggctaccttttcacacccacaccccctctccgcacgcattccccacactctcaagcccacatgcttcctgtatggctcttagcgtctcaccagggacccctgcaggggtttccctcctgccaactattagccttctgaccagggaaataaacctatgtcctagtgaagaagagaagctaaacagtaaaggcaaggctgaaatgcaagctgggaggatatattttccacaagtcagttatttaccaacagcaagggttcttcgccagagcagacacrgtggggccacacaagggccgttcagccaacgccgtgtctactgctcccttggcaatgccaagacggagtaaggttttcctttaaagagagattcgagacggcaaaccactttgccagccacagcatcaaaagcctggcaggtatgagatatccttaggtacaaaaccctgctctgcgcttgtggagtgaggacaccccctatcacgtgtctcccgtggacttctccagcgaaagccagacaaagacaccattgcactgggacagtagaaaataacaaatagtctccaagttcaggttatg

SEQ ID NO: 43061 - DNA, 601 bp, Human
ttaatatatgtggtctgaaatgtggtaaattccatgaaacaattctataaattctgttttactgctatttagatccagagggatagtctaagcttaagctactggttttcaaacttgtcctccgggcccactgatgacccaggctggctgggcagtcttgggctaggaccgccctgggacagatatggccccaggggccagagcacaggtcacagggggaggcctcataaccggaactgtaacccaggcctgctgtggttccaggtttccagaacaacagcaggggcccagcctaacccaygccaggcagggccaccaagggagtgccttccgagaggctaccttttcacacccacaccccctctccgcacgcattccccacactctcaagcccacatgcttcctgtatggctcttagcgtctcaccagggacccctgcaggggtttccctcctgccaactattagccttctgaccagggaaataaacctatgtcctagtgaagaagagaagctaaacagtaaaggcaaggctgaaatgcaagctgggaggatatattttccacaagtcagttatttaccaacagcaagggttcttcgcca

SEQ ID NO: 43062 - DNA, 601 bp, Human
attggtttcatttttaacatccttttctcttacaagaagttataaagttattagaagtattaatatatgtggtctgaaatgtggtaaattccatgaaacaattctataaattctgttttactgctatttagatccagagggatagtctaagcttaagctactggttttcaaacttgtcctccgggcccactgatgacccaggctggctgggcagtcttgggctaggaccgccctgggacagatatggccccaggggccagagcacaggtcacagggggaggcctcataaccggaactgtarcccaggcctgctgtggttccaggtttccagaacaacagcaggggcccagcctaacccatgccaggcagggccaccaagggagtgccttccgagaggctaccttttcacacccacaccccctctccgcacgcattccccacactctcaagcccacatgcttcctgtatggctcttagcgtctcaccagggacccctgcaggggtttccctcctgccaactattagccttctgaccagggaaataaacctatgtcctagtgaagaagagaagctaaacagtaaaggcaaggctgaaatgcaa

SEQ ID NO: 43063 - DNA, 601 bp, Human
tatagaggagggtataggtaggttatatgccaatactattccacttcatgtcagggacttgagcatctgaagattttgttatagagggggagtcctggaaccaaccccccatggataccgaaggacagctatactctgtcatgcccattcacccaggcgtttccatgtggcctgtgctgatgcaggctgcccttgagttcaagtcagtgaaaaactggggttttaatttttgagtgctaggtttgcatgtctgggggcagcccaccaagctcacctggagcccactcatttctttctttctttttttttttttggaaacagaatctcactctctcacccaggctggagtgcagtggtgcgatctcagctcgctgcaacctccccctcccgggttcaagccattctcctgcctcagtctcccgagtagctgggactacaggcacattttttttgtatttttagtagagatgggatttcaccatgttggccagctggtcaccaactcctgacctcaagtgatctgcccgcctcggcctcccaaagtgctaggattacgggcacgagccactgcgcctggcccccactcatttccgatccatct

SEQ ID NO: 43064 - DNA, 601 bp, Human
cctcctaggcaaaggctgagccaatgtcctctggtcactcagttcccaggaaggttggtagtgaccccactgccccctcgtcctctggactctgggaccctccccactctttcacagacctttctgggcatagatagccaggcattgactgggaggtgtcagggaagcatgcgaattaataataatagtaacaatagcaagtgcagataaatgcaatgtggataacctcaactaaatcctggagaagaaaaagcacatttatggaaggactagtgggatctgaaagaaggctatagttttrttcaaagcaaaggactagaccgggtgcagtggctcatgcctgtcatcctagcactttgggagaccgaggtgggtggatcacttgaggtcaggagttcaagaccagcctggccaacatggtgaaaccccatctctaccaaaaatacaaaaattagcaaggtgtgtggcatgcacctgtaatcccagctactcgggaggctgaggcaagataattgcttgaacccaggaagtggaggttgcagtgagccaagatcgtgtcactgcactccagcctggcgacaaaacaagactctgtctaaaa

SEQ ID NO: 43065 - DNA, 601 bp, Human
acgttaatcaaacaccagctacagtcctaactcgaggctagaacaaaatttgcatttatttagaaaactaatttagacagttaaataagactgtttcctgttgtatgaagcacatatatgagacagcaaaggttccctcctaggcaaaggctgagccaatgtcctctggtcactcagttcccaggaaggttggtagtgaccccactgccccctcgtcctctggactctgggaccctccccactctttcacagacctttctgggcatagatagccaggcattgactgggaggtgtcagggargcatgcgaattaataataatagtaacaatagcaagtgcagataaatgcaatgtggataacctcaactaaatcctggagaagaaaaagcacatttatggaaggactagtgggatctgaaagaaggctatagttttgttcaaagcaaaggactagaccgggtgcagtggctcatgcctgtcatcctagcactttgggagaccgaggtgggtggatcacttgaggtcaggagttcaagaccagcctggccaacatggtgaaaccccatctctaccaaaaatacaaaaattagcaaggtgtgtg

SEQ ID NO: 43066 - DNA, 601 bp, Human
aacatgaattagccagtgcccttctgaggattttatgactagaaaatggatggatgacaacagagacatctctctgtcccttgctgtggcagagcaaggggactggatgccttgggagtgagctccttgcgggtggcttgcctgattgcttaggcggatgcctggcaccccagacactgcaggaacagggcgggcggccgtgccagtgcctgttctataaatagcactgggcttcaggcacctgagctgctgtgacagccacgtctttatacttccttgaaaatcagtaatccctgaagcttgtgtgtgtgtgtgtgtgtgtgtgtgtgtgtgtgtgtctccaaacaattctggatagggcagctttctggttcagcctgggttgggagccccgcacccccagactcaccatttgcatcatgagaatattctacaccagacacagtgcatcttcggaaaaccatcttattctctgtcaaagtgccagttttatctgagaaaatgtactgtatctgtcctaagtcttccgtgatgttcagagctcggcactgcagctgcgagtctgtttcttcgtcatacaactgcatgtcctggttaatga

SEQ ID NO: 43067 - DNA, 601 bp, Human
agacaccaggttggaaggaggcagccacagataaggaagggagaggtgggagtggggaccgcttcaataattgggagtgaggcgattcatctttccagttcccaggaacactgttccagggaagagaacgaaacatgaattagccagtgcccttctgaggattttatgactagaaaatggatggatgacaacagagacatctctctgtcccttgctgtggcagagcaaggggactggatgccttgggagtgagctccttgcgggtggcttgcctgattgcttaggcggatgcctggcaccscagacactgcaggaacagggcgggcggccgtgccagtgcctgttctataaatagcactgggcttcaggcacctgagctgctgtgacagccacgtctttatacttccttgaaaatcagtaatccctgaagcgtgtgtgtgtgtgtgtgtgtgtgtgtgtgtgtgtgtgtctccaaacaattctggatagggcagctttctggttcagcctgggttgggagccccgcacccccagactcaccatttgcatcatgagaatattctacaccagacacagtgcatcttcggaaaaccatcttatt

SEQ ID NO: 43068 - DNA, 601 bp, Human
tgtttcacagagactgactttcatctcagagaacgtaaggagctttctaaggtcgcacaacttaggggaaggggaacgggttgacgtccagccggtctcttcaggtagagcctaggtgtacagggggtagggtggcaggtggccgggagagggaggcaggacagagggtggcaggccttccagtcatgctgggatgacggtgctcacctggtgctgagctccttgcccacatggacggtggccaccatctgctcctgtctggatgaaatgctatggcacaggggggctcacactcccagaytgcacagcttggacccctacagctagggtttggactcagctttgaaactccatccaagatgatcttgactgtgatgttgccctgctgagcaaattccccatgacctggtgaacgctgggcaaatcccctttagaggtgcctgcgctgtggcttcttgctaacccatggctctgaaccagttttctgggttttgcccagggaggacagcttgtttcaccgtggatgagcaaaatggagaccattcatgaggattacttatcagaacaaccgtttaatcagaacttcaagcacaggcatggt

SEQ ID NO: 43069 - DNA, 601 bp, Human
ctccgagtctgcctcttggtacctggccagacgctgcgctgcggggagagggcgcagggtgaggcatcatgggggaaggctgggcggagcggaaagaaaccattcagtgtgttttaggttccgtgaggcttccggcagggcagccccacaggattcaccacccttgctctctaatagcaaggcacggagaacatcctcagtcagctgcaacctggggaggttgatattctcaactctgtttcacagagactgactttcatctcagagaacgtaaggagctttctaaggtcgcacaacttakgggaaggggaacgggttgacgtccagccggtctcttcaggtagagcctaggtgtacagggggtagggtggcaggtggccgggagagggaggcaggacagagggtggcaggccttccagtcatgctgggatgacggtgctcacctggtgctgagctccttgcccacatggacggtggccaccatctgctcctgtctggatgaaatgctatggcacaggggggctcacactcccagactgcacagcttggacccctacagctagggtttggactcagctttgaaactccatccaagatgatc

SEQ ID NO: 43070 - DNA, 601 bp, Human
cgactgtgttgcagatggtgagtgcgatgaagaaatcaaagacgtcagacagctcgggcgagaggtgggccagcaggtgctcctgatgcctcgccacggctaggctcttgtcacactcactcaccttctccagcagctttgggtcgggcgtgatatccttctcctgggagaaagggaggctggcagtgagtcccacccagtagcctgccgaggatcttggggcgtgactatttaaggtactttgattttattataagctgtaaacagaacttcatctctcatatacatatatgtcattttrtaattgtaaattacttacaattttaattgcacaaaatatacagagcttctatccactttgtgaaaaccatgcttcagcattgccctctagtcttttcgctctacatttaaatttcacataatcaaaatattttatatacatattggtggtttccattttctccaaaacattattgtctgaacttttccaggcttttaagaattatttaaaaacacattttaacaacttgaaaatggatatgtcatcatttatttgaccatccctttatcactggatatttaaatttctttcagttttgct

SEQ ID NO: 43071 - DNA, 601 bp, Human
tgtttggtaaagcaaggtgcatagagccagattttgatacaggtgcttttcctttggtcttgttatgactttaaatacgctacatagccagctgggagacataggcacctgcacagcaatccctgctggctccaaatgtcctcgaaggtggcgctcaccaaccaatatgtgggaatagaaatgcacccagagacatcttcacctgcagcctgagtgtgggtgattgataggctgttccctaggtggaactcaagccgtgtaaccttcagcacaagcctcaatgacgctgccatctctcacycttcatttaacatctgtcagtcagggtctagcccagaaaaggggcacttcctgcagggatatacaccagaagggtttttaatgctgggggcagagcccagaggccagatgggagatgctgaggcagccaggagatgaactgcagcttcgggaagcagctccagcccagggctgccggcctaagcctcaagcctgctggtctctgagtggcaggcctgtccacttgggagtcactgggtccaggtactgccagacatgctgctgcagcagagaaaatacaggccaccttgttcaccccaca

SEQ ID NO: 43072 - DNA, 601 bp, Human
ccgaggcccagttgtccgcctggctgctgtagccgttgctggcgatggccgaggtgggctggcccagcctctcctccagcctgagaagcatgccgtcgctggacggggtggacgggaagctggagcccaacttgtggctggacttgttggcggccaggctcccgatgctgctgcagcctgaggtcaggcagctgggtgtgaacctccgcaggaagtcttctatcgtcttcaccggggacttcagctcaaacctcaccctcacctgcaagagaaatggtcagaaggcaggtgagggaactgmtatgtcccccagaggccccaccctggttcccacaggatgctccaggcacttggaggaacaatgacctcgcttccccactggggtctcagagcacagatttcccatttcccagatttcaggcatgcattgaaattgcaagcagaatagtgtcgcaataaacatgttgtgcacatgtatcataaaacttcttaaagtataataataataataaaaaaagaaattgcaagcagagacagtactccttccttgagatcgtccgctggcctcttccacttctcttaaacaaaggttatgcaagat

SEQ ID NO: 43073 - DNA, 601 bp, Human
ccagggccactccatgccttccccttagacatcacccgtcatgctgtgaaatctgaagcccaggaccccttatgttgtcttgaacccaaggctgtggaataagacagagagatttttttttgctgtagaatgaaatcactcagataattgccctatttatgtttttcttttgtgtggatgtaaacaagaatcgattttcagaagaagcttcctagaactcaaactgtgtccatgaattggattctttgctgactccaaggcagagccactgcagtgggagaaagggaagatctcgccccgyggtggtcatcatcatggaaggtcatccaaactcctctcagagacacatttgcagatttagctcagctgccttttggaggtcacagctctgtgatggggacatggatttcctgtatgaagctcttcctcccatccaattctccatcatgagtggtcctgggcttctgtgccaggggtcctctcctgaggcactgagatgctggcaagaaaggccagtgggaggtaaagtactccctagctccaactcggagctccagaagggagcaaccggcttatagcatttcccagcagctgctgccca

SEQ ID NO: 43074 - DNA, 601 bp, Human
tactcatgtaaaaaaatatgttgccagcaaagacaagcccggcaagtgctgcggccttccttgcacagctcacagggctccctgctctacaggactggacaggcctcgcctgccagcgctgggcagcccccacatgccagggccactccatgccttccccttagacatcacccgtcatgctgtgaaatctgaagcccaggaccccttatgttgtcttgaacccaaggctgtggaataagacagagagatttttttttgctgtagaatgaaatcactcagataattgccctatttatgtttktcttttgtgtggatgtaaacaagaatcgattttcagaagaagcttcctagaactcaaactgtgtccatgaattggattctttgctgactccaaggcagagccactgcagtgggagaaagggaagatctcgccccgcggtggtcatcatcatggaaggtcatccaaactcctctcagagacacatttgcagatttagctcagctgccttttggaggtcacagctctgtgatggggacatggatttcctgtatgaagctcttcctcccatccaattctccatcatgagtggtcctgggcttc

SEQ ID NO: 43075 - DNA, 601 bp, Human
tcccaacttgcagacaaacgaggaaatccctggctcactcaggggcctctggaggccaggccaccactgttccttttgccatggccctcggcacctgctagtgaacaggcaggggggccctgcctcttgataatgctctatccactctgggaaggtaccagaaaagcaggagtaggagagtgagcaggtcgtgacgctaaattcattcaattgaaaggcatccagttttctgggatatccttggtaattttttgggggggacggggtggagtgtgaaatgtggtccttcttttatgaaatratggctgatggtattagtgagacttagtgacagcagttctttttgtgtgtgttctgcttttgaggtttttactcatgtaaaaaaatatgttgccagcaaagacaagcccggcaagtgctgcggccttccttgcacagctcacagggctccctgctctacaggactggacaggcctcgcctgccagcgctgggcagcccccacatgccagggccactccatgccttccccttagacatcacccgtcatgctgtgaaatctgaagcccaggaccccttatgttgtcttgaacccaaggctgt

SEQ ID NO: 43076 - DNA, 601 bp, Human
ctcatgtggggacttcccgtgagaggcaggcactgtgatttcctttgtagatgggaaactgaggcacagaaagagtgagtgactcgtccagggtcatcccagccgtaagtgtagacctgggatttgaacagagatctgtgagaatgggttggggtggagtccctgcttgttgcctgacaccacacctgccagggcaggtgagccatggccccatcctgctgatatcatacagtcacatccactatctgctcagccaactcgggcctcttctggtgaaagtgtttcgagccctctgaagagrgcatcagattaagtctggagtgggacacctctgtgccctcctcagtttgtcacctacacacaggtagtaagttgatttacacaggcagagcgattcccaggcacagtgagccctctgcaatgagtctgcacctatccacacccctccaccgctccccaagtaaaaggcgaatgatctgtgcataagggcaggcggtcacaggtgggtaacttcgaggggactccagggccctcctgtagtcgttctcttgggaaactgctggggtctctgaacttcctgaaccttaacctgcccagtgtt

SEQ ID NO: 43077 - DNA, 601 bp, Human
gcaggaggctaaggggcacagctccaggtgcagtctgcgaagatgactccagtgcccactgaccccagacacagcagggccgagacagctgcacctgacagtgggctgcacctgatgttcccaccaggagacagctggcgagtggtgcttgcagacccacagagaggccctcagagggatgagggtagcctctcttcatgattttaccacgtgctttaaaattgctccaagtgatatttccatttcttctaagctttacaagcgatatttccccaataaggagttatcttattaaaatggyaaactaacgtgcagtccctgcttgtacatgcatgtactcatcatgcaaaaaacatatactgattactgcatggtatcaatgtgtgaggcccacgctaggcagtgggctacggccatctctctgtccttgctctgggagaaggcagagtggcctgaggtttacaccttaaagaccactccaagtagcaacgccaccaaagcataagcaagtggatcttaacaagaaggagccagagacttgggaaaggtaccgagtggacgctggacatcaatgtaacagcaggcactgagctaggggctc

SEQ ID NO: 43078 - DNA, 601 bp, Human
cgaaggagaatgtactggggaacagagtgtggatccctagaggcattcagtcagccctgctcttctccacttgctgaagtgatgctgggggtggctgatttcgagctgaaggcatggcaattttcacactgcattttaggcaacggtcatgcaatattagccccttctttctgatgttccacagccacccaagtcctgtgtgtcttgtctccctatggtgacaggaggaattctgtgcctggaactcagctcctcgggtgaggagtgacaccacctgagggagtgggaccagtgctgccckgcgccccctgctgggcagggacagtcgagagctctgtgctgcaggacgctgaggctgcatctgggtcggggcaggagcaggaggctaaggggcacagctccaggtgcagtctgcgaagatgactccagtgcccactgaccccagacacagcagggccgagacagctgcacctgacagtgggctgcacctgatgttcccaccaggagacagctggcgagtggtgcttgcagacccacagagaggccctcagagggatgagggtagcctctcttcatgattttaccacgtgctttaaaattg

SEQ ID NO: 43079 - DNA, 601 bp, Human
acgaactcctggactcaaatcatccacccgcctcggcctccgaaagtactgggattacagatgtgagccactgcgccctgctgatgtttggctgtttttaacatcctttgttgaaataagctcatgaaaataaaaactacatcaaaagtcatttggcatccttttgcccagcctattaaatggaggctcacgttcttcctgttaatgaaaattcttacttaatgggaagtgcactttctatcctcagaagagtaggatccttacaagtagcattgccagatacaacaaacgatgtctaaawatggcataggacatacttttacttaaaaaaggatttgtttgtctgaaattcaagtttaactggacattctatatatacagtttgtgaaatctggcaacactactgaccagtcatgaggcccgtggcccaggaaggattatctactaatctaagtccaccacctgaaagaggacccggtaagagacccttttacatgcctgaccgtgctgcattctccacaggggtgacagagccctcaagggagtgatcactggttcttggaggtggaaaaatcttactcttttctaaacaaagtctaag

SEQ ID NO: 43080 - DNA, 601 bp, Human
agcagtttctgggtcccaaaagtttccctgtttcccgaggggaaaatcctttcaactcccaactgtcagaaatctcactccttggctctatttttggtgggaaaccaggttaaggggaagcatggcagctgctgtcttggggtgcctggggggcagcacgtgcacctcacagaaatgagactaggagaagattcaggcaagcaccctcccgcctcggctgtgccagcgtcctgccaggtggctccctaaccaaggccagcctgcggagcagccgctgacaagagcactcacccctccaggrccgtccctgcaaactccacactgcccttaggcatgcgactctcaagttaattacctaacaagtgcaggttggtctccaggcgaatggcagactggaagaggagctcctcgctgttttccagggaggattcggcttctaggtggctttgcaaccagcaggcatactcttctttactcagaacctatgggagatacattgttgagtgctgcaccgggcgctgctcactgtggggcggccacctgcacgtgcaccctcgcggagacacccccactcactctcttggcgatgcacaaggtgcgc

SEQ ID NO: 43081 - DNA, 601 bp, Human
tttaagtattaaagtaagcattaacataataaataccttcatttatcactaatactagttagcatttattaagtaccaagatgaacacagctggaaatgtggacatatttcagtaaaaatgagcccattttcttttcattcacctcgaatctgtgaaacattcctaagatgcaaaatgcagcagtttctgggtcccaaaagtttccctgtttcccgaggggaaaatcctttcaactcccaactgtcagaaatctcactccttggctctatttttggtgggaaaccaggttaaggggaagcrtggcagctgctgtcttggggtgcctggggggcagcacgtgcacctcacagaaatgagactaggagaagattcaggcaagcaccctcccgcctcggctgtgccagcgtcctgccaggtggctccctaaccaaggccagcctgcggagcagccgctgacaagagcactcacccctccagggccgtccctgcaaactccacactgcccttaggcatgcgactctcaagttaattacctaacaagtgcaggttggtctccaggcgaatggcagactggaagaggagctcctcgctgttttccag

SEQ ID NO: 43082 - DNA, 601 bp, Human
gaaaagctgctccctggggaaggtgccccacagtgaagggttaaaaacaagcctggtcaatgaggctgggcgggcacgtctgggacaaccagcagatgcctcctaccccacaggcctgcacaatactgtcttccggggaagcccaatcagtccagacgacagcagccctgctttagtaagccaaaacttcagggcctaaaacaggcacagccatttctcaggtgttccatttaattcacatccagggctgccactcatggtgccactgggcccctggatcccggggctttccaagtaatgygtggcctcctataagattctgtgggcaaacaatatataaaatgtgtgcagatatatgttatgcctagtgtacattatgctattaaatgcaaaccttaactatgtattatactagaaatgtagatgtaaatatatagctatcccaactcctctgcccagaaaaagagggcaagtgaacaccgcctttttgtgttaagtgaagatgacctgcccagggctttgtgctcgagaagtaccacctgactcacagcacccgagatggaggtgggggtggaccatcctcaacaccagctcttcaagg

SEQ ID NO: 43083 - DNA, 601 bp, Human
gcagaacttggatgcaaaaaggattgagccacttgccccaggctgtccgatcagcctgcatgaccagcccgcatgaccagcttgcagtggcagagcagggctggacaactgagtcagggcttctgggctctgagagcagggaagatggagaaggggcagcctgggactcacagccatgtccccaaatagtcaaggtttcatcatgtggaaaagggaggagattctgtctgcattactccagggggcggaaccagcaagcactgtgaaatggcaccggagggccaatttcactccatttgasaagttagtgctgtccaggggaaaagctgctccctggggaaggtgccccacagtgaagggttaaaaacaagcctggtcaatgaggctgggcgggcacgtctgggacaaccagcagatgcctcctaccccacaggcctgcacaatactgtcttccggggaagcccaatcagtccagacgacagcagccctgctttagtaagccaaaacttcagggcctaaaacaggcacagccatttctcaggtgttccatttaattcacatccagggctgccactcatggtgccactgggcccctggatcc

SEQ ID NO: 43084 - DNA, 601 bp, Human
caccagagaaagcctgcagaggagaggccagctgggtggaaacggtgtggaagcaccaaccaggagactcaccacacaaccgctcagtgccaggccctgtgcctgcgccacgctcagtgccccccgtcatcccttcctttcaccctcacaagagcccgaaacactgggattaccacagagcagaacttggatgcaaaaaggattgagccacttgccccaggctgtccgatcagcctgcatgaccagcccgcatgaccagcttgcagtggcagagcagggctggacaactgagtcagggctyctgggctctgagagcagggaagatggagaaggggcagcctgggactcacagccatgtccccaaatagtcaaggtttcatcatgtggaaaagggaggagattctgtctgcattactccagggggcggaaccagcaagcactgtgaaatggcaccggagggccaatttcactccatttgagaagttagtgctgtccaggggaaaagctgctccctggggaaggtgccccacagtgaagggttaaaaacaagcctggtcaatgaggctgggcgggcacgtctgggacaaccagcagatgcctc

SEQ ID NO: 43085 - DNA, 601 bp, Human
agaagatgactggaactcaagttaaccatgagcctcgggtgccgcaggggccgttaacaacttaggatatgttaacagagctgcagcatccgggccaagagaggtgaccgatgcacgatcaccagagaaagcctgcagaggagaggccagctgggtggaaacggtgtggaagcaccaaccaggagactcaccacacaaccgctcagtgccaggccctgtgcctgcgccacgctcagtgccccccgtcatcccttcctttcaccctcacaagagcccgaaacactgggattaccacagagcrgaacttggatgcaaaaaggattgagccacttgccccaggctgtccgatcagcctgcatgaccagcccgcatgaccagcttgcagtggcagagcagggctggacaactgagtcagggcttctgggctctgagagcagggaagatggagaaggggcagcctgggactcacagccatgtccccaaatagtcaaggtttcatcatgtggaaaagggaggagattctgtctgcattactccagggggcggaaccagcaagcactgtgaaatggcaccggagggccaatttcactccatttgagaa

SEQ ID NO: 43086 - DNA, 601 bp, Human
aggaatccctgtgaaaaaggcctaagaagatgactggaactcaagttaaccatgagcctcgggtgccgcaggggccgttaacaacttaggatatgttaacagagctgcagcatccgggccaagagaggtgaccgatgcacgatcaccagagaaagcctgcagaggagaggccagctgggtggaaacggtgtggaagcaccaaccaggagactcaccacacaaccgctcagtgccaggccctgtgcctgcgccacgctcagtgccccccgtcatcccttcctttcaccctcacaagagcccraaacactgggattaccacagagcagaacttggatgcaaaaaggattgagccacttgccccaggctgtccgatcagcctgcatgaccagcccgcatgaccagcttgcagtggcagagcagggctggacaactgagtcagggcttctgggctctgagagcagggaagatggagaaggggcagcctgggactcacagccatgtccccaaatagtcaaggtttcatcatgtggaaaagggaggagattctgtctgcattactccagggggcggaaccagcaagcactgtgaaatggcaccggag

SEQ ID NO: 43087 - DNA, 601 bp, Human
cggtctgtgggaggaaggtcgatttactgcatttgctcatttctgtggtataaatactcccaccttggctgacttcaatctactaacatagcatcaaaaggcgacgtgagattcctgaacatttatgtgggctactgcaaaattcttcaaaatgtatccatgagctctgccaggaggcgtgagcaggctccagtgcacggctggcacccatgtgggcaacccaggagttccatcgctgacacatctcagagccatcctcacgtgcacctggagggaaggaatccacctgaggatgacagcrggatgtggtggaatcagtttggagaaacgctgatgaccgggatcccgactccaatcagaggaagtggaacaggggatcggtagacaactctgattttagatcttcacacagttgcccaagtaaaaattatagaatccaagcaaggaatccctgtgaaaaaggcctaagaagatgactggaactcaagttaaccatgagcctcgggtgccgcaggggccgttaacaacttaggatatgttaacagagctgcagcatccgggccaagagaggtgaccgatgcacgatcaccagagaaagcct

SEQ ID NO: 43088 - DNA, 601 bp, Human
agaaatttgagctcacaatgtgctgtgatcgcaccattgcactccagcccaggtgacagagtgagactctgtctcaaagacaaaaaaaaaaaacaaaaaaaaagcaccttcatgaaaagatttggctttggaatagtaaaaatataagtggctggcttcacttttcttaatgaagctgaggagctggaacacagtgcccgcgtttgagccatgtgaacgctaaggtggtgggtggctcccatactctccagctcaggcctcgtcatttgaaacataaacatatcaggtagcaggagatggyaagtggttaacaaccggtctgtgggaggaaggtcgatttactgcatttgctcatttctgtggtataaatactcccaccttggctgacttcaatctactaacatagcatcaaaaggcgacgtgagattcctgaacatttatgtgggctactgcaaaattcttcaaaatgtatccatgagctctgccaggaggcgtgagcaggctccagtgcacggctggcacccatgtgggcaacccaggagttccatcgctgacacatctcagagccatcctcacgtgcacctggagggaaggaatccac

SEQ ID NO: 43089 - DNA, 601 bp, Human
atttaagataagcacctgggcctggtgcaggggcacacgcctgtaatcccagcacttagacagactgaggcaggaggatcacgttaaaccaggagtttgagacaagcctgagtgagaccctgtctctaccaaaaaaaagtaaaaatttatctgggcctggtggcacacgcctgtggtcccagctactcaggaggctgaggcgggaggatcactagagcccagaaatttgagctcacaatgtgctgtgatcgcaccattgcactccagcccaggtgacagagtgagactctgtctcaaagaaaaaaaaaaaaaacaaaaaaaaagcaccttcatgaaaagatttggctttggaatagtaaaaatataagtggctggcttcacttttcttaatgaagctgaggagctggaacacagtgcccgcgtttgagccatgtgaacgctaaggtggtgggtggctcccatactctccagctcaggcctcgtcatttgaaacataaacatatcaggtagcaggagatggtaagtggttaacaaccggtctgtgggaggaaggtcgatttactgcatttgctcatttctgtggtataaatactcccacctt

SEQ ID NO: 43090 - DNA, 601 bp, Human
agaaactagcaaggacgccggggaaaatgagcaagagtatcctttgaatttaggttcctgcccagagcattaaggaaaagaaaatttcaagagcatggagagaacggagatcctttctgctgaagatagttatgtatggttctctgatgctatttaagataagcacctgggcctggtgcaggggcacacgcctgtaatcccagcacttagacagactgaggcaggaggatcacgttaaaccaggagtttgagacaagcctgagtgagaccctgtctctaccaaaaaaaagtaaaaatttawctgggcctggtggcacacgcctgtggtcccagctactcaggaggctgaggcgggaggatcactagagcccagaaatttgagctcacaatgtgctgtgatcgcaccattgcactccagcccaggtgacagagtgagactctgtctcaaagacaaaaaaaaaaaacaaaaaaaaagcaccttcatgaaaagatttggctttggaatagtaaaaatataagtggctggcttcacttttcttaatgaagctgaggagctggaacacagtgcccgcgtttgagccatgtgaacgctaaggtggtg

SEQ ID NO: 43091 - DNA, 601 bp, Human
cacagctttgaatgggaggggaaaggatttcaccaacgaggaagttttagacatttagagaaactagcaaggacgccggggaaaatgagcaagagtatcctttgaatttaggttcctgcccagagcattaaggaaaagaaaatttcaagagcatggagagaacggagatcctttctgctgaagatagttatgtatggttctctgatgctatttaagataagcacctgggcctggtgcaggggcacacgcctgtaatcccagcacttagacagactgaggcaggaggatcacgttaaaccargagtttgagacaagcctgagtgagaccctgtctctaccaaaaaaaagtaaaaatttatctgggcctggtggcacacgcctgtggtcccagctactcaggaggctgaggcgggaggatcactagagcccagaaatttgagctcacaatgtgctgtgatcgcaccattgcactccagcccaggtgacagagtgagactctgtctcaaagacaaaaaaaaaaaacaaaaaaaaagcaccttcatgaaaagatttggctttggaatagtaaaaatataagtggctggcttcacttttcttaatg

SEQ ID NO: 43092 - DNA, 601 bp, Human
atgaaattcagaatgtccagtctcaacaatgcttattactagtcactatagaaacagacttcacaggtaaggccattatttcttgaaaccaagattatcctaaatatgctttttccacaaacataaagaagttgagaggcaggttttgcctttttggtctcagtatgttgggaaaaatctactattgactgcggaaatgtgcttaggcctgcctcagatttttttttttttttttaagatctgtttacatcttggtgagatggtttctgtcttccccactctggaagtgagctgcagcccyggtccctaggttcgagccctgactgaggctcctttactgcgctacaccatgctgtgccctgtgctgggatgctgctatggactgagcgtttgtgtcccccagatccataggagggagcactaatccccagtgtggtagtattaggatgtggggcctgcaggaggtaattaagttcagatgaggtcatgaggatggggctcccgcgatgggatcagtgtccttataaaaagaggcactggggtcgggcgcggtggctcacgcctgtaatcccagcacttcgggaggccgtggcgggcgggt

SEQ ID NO: 43093 - DNA, 601 bp, Human
caggcactggtacagcccctgttgcctgggccttgccaggggctgggctgccagttgtctgccatgtagtgacaggaagtcccctgtggaaccatttcaggacagtggtggacgcttttgacagctctgtcgatgtgactcagtcgagtgcgtaggaataactgtgagtcactgagcataattatgtgtacttacaccaaagtacctcaacttctttctaacttgtaactttacagataacctgaaggcaaagcgtatgggaaggtgttgggaatgacgatattcggagggataaaaatayagtcttaaaaattgcccatcccatagaaagcttctggtgaatgaaattcagaatgtccagtctcaacaatgcttattactagtcactatagaaacagacttcacaggtaaggccattatttcttgaaaccaagattatcctaaatatgctttttccacaaacataaagaagttgagaggcaggttttgcctttttggtctcagtatgttgggaaaaatctactattgactgcggaaatgtgcttaggcctgcctcagatttttttttttttttttaagatctgtttacatcttggtgaga

SEQ ID NO: 43094 - DNA, 601 bp, Human
tgccaggaatgtgagtgtctgccaagggggccacgataaacatggaccaccccaggggaaggaagcggagccacttgaaacccacctacctgggaggtggcattcagggtgatgacctcctcgtcgtggtccagcagtttgcaggcatatgcaatgttgacagctgtttcttgtttgtcaccagtgagaacccaaatctgcaggcccgcttgacgcaatttagaaatagtttcagggactccgtcctgcaggcggtcttcaatcccagtggcacctggtcaaatgcacagcagtgtgagcsaacccgcttctcacgtgccccccaatccttctggggtgcaaatgtcatgcaccagatacaccgaaggcaggcactggtacagcccctgttgcctgggccttgccaggggctgggctgccagttgtctgccatgtagtgacaggaagtcccctgtggaaccatttcaggacagtggtggacgcttttgacagctctgtcgatgtgactcagtcgagtgcgtaggaataactgtgagtcactgagcataattatgtgtacttacaccaaagtacctcaacttctttctaacttgtaacttta

SEQ ID NO: 43095 - DNA, 601 bp, Human
gtgttatgctgagtgacagaagccaggctctgaaagttacacactggagtattctgtttacttgacatctggaaaagacaaaactgtagttctggagaacagattggtggcttccagaggttagaaaaggagggaagttacaattgcacgggggtagcatggcagactttctggggatgatggaactctcctggaccgtggatagggtggtgtatatacatatacagatctatgcacgtgttaaaattcatgtaagtgtataaccaaaaaaagagccaattttactatatgctaattatarataaataaataaaagcaatgaccaggtcatcaggtcaacctttagtataaattcgcaaactttcttggagaaagaggtcacttaaaaaaaaaaaaggccctggtgaaggcacaggctctgaagcagggtgaccttgcatagatgtgagaggaagggggtgccccggccagcgtggctgtgaagaaaggactgggaatggtgggaatctggatcatagaatccaatggaacaaggtgcgagggtcacaatggcgtctgtacaatgtggacaacggggcttgaaaggcagcctttcctacgc

SEQ ID NO: 43096 - DNA, 601 bp, Human
aagtgctgtttatgattgtcaacaaccagaaacaactaaaatgttcttcactgattgaatggatatgcaaaatctggtgttagtggatattactcagcatcaaggagaaatatactactggttcatgcaacagctcaggtgaatctcaaaagtgttatgctgagtgacagaagccaggctctgaaagttacacactggagtattctgtttacttgacatctggaaaagacaaaactgtagttctggagaacagattggtggcttccagaggttagaaaaggagggaagttacaattgcacrggggtagcatggcagactttctggggatgatggaactctcctggaccgtggatagggtggtgtatatacatatacagatctatgcacgtgttaaaattcatgtaagtgtataaccaaaaaaagagccaattttactatatgctaattatagataaataaataaaagcaatgaccaggtcatcaggtcaacctttagtataaattcgcaaactttcttggagaaagaggtcacttaaaaaaaaaaaaggccctggtgaaggcacaggctctgaagcagggtgaccttgcatagatgtgaga

SEQ ID NO: 43097 - DNA, 601 bp, Human
gacaatgcgaagtgctggaaaagacactgagcaaagtaatacagcactttgaaaagcaggctggtgtctggcagcttcttataaacttagacacattcacatctaacctaggtatttaaagaaatgaaaacatgttcacacaaaaacctgtatacacacatttatagaagtgctgtttatgattgtcaacaaccagaaacaactaaaatgttcttcactgattgaatggatatgcaaaatctggtgttagtggatattactcagcatcaaggagaaatatactactggttcatgcaacagytcaggtgaatctcaaaagtgttatgctgagtgacagaagccaggctctgaaagttacacactggagtattctgtttacttgacatctggaaaagacaaaactgtagttctggagaacagattggtggcttccagaggttagaaaaggagggaagttacaattgcacgggggtagcatggcagactttctggggatgatggaactctcctggaccgtggatagggtggtgtatatacatatacagatctatgcacgtgttaaaattcatgtaagtgtataaccaaaaaaagagccaatttt

SEQ ID NO: 43098 - DNA, 601 bp, Human
cctgacttacaatggttcaatttacaaattttcaacttttggatgggtcttttggggtattaaatacattttcaacttatgatttttttgacctatgataggtttattgggacataaccccatcataagttgaggagcatcagtgcttgggtatgtatctaacaaaacatgtatatgatgtgtatgctgaaaactataaaatgctgataaaagaaataaaagaagacctaaaaaatgtagagatataccatgtttacagagtggaagatcaacataataaaaatatcaatgcttcccaaaytgatttataaatttaacaaaattcaaataaaagctccagcaggaatttctgaacagaaaaattaatttaaaattcatatacgaaggcaacaaataagaagactagccaaaacaattttgaaatagaataaagttggaggaataacactaccaatttttaagacttataaaaaactacagtaatcaaactactacaatgaatcaatacacgtcgtattggtgaagggatagacaaacaaatgaatggaacagaacagaaagtctagaaacagacccacacaaatgtaactaactgattttt

SEQ ID NO: 43099 - DNA, 601 bp, Human
gcaggtgtgcgccaccacacacagctaattttttttattttttgtagagatggggactcactatgttgcccaggctggtctcaaactcccgggctcaagtgatcttcctgccttggcctcccaaactgttgagatgactggtgtgaaccacgtgcccagccatgtgctgatgttcttatgggtcattactttcccgttttcttttgagattccattctgtgtttccttttctttttaatctgccaaggatttccttccacttcttcaggaataccagacaccagtggctacgcggctgagscaggcactggccaggccagggaaacatcattcacgtcttactgtgtactgtggcctttcagggctgacgttgtcctcgtgctcccagggaggacactgacgctcagaggaggaggctgggacaggggtggtgcaggtcagcctgaagaccgtttccagctcctcagggaaacctgagggccaccccaggcacatgaaggcaaagatggcctcaggacaggccatggctgttaggttccccgggcctcctgaacacgtgccctgtgcccactctccttagcggttactggcctcagggtgt

SEQ ID NO: 43100 - DNA, 601 bp, Human
ggctcactgcagcctcaacctcctgggctcaagtgatcctcccacttcagcctcctgagtaggtaggactacaggtacatgccaccacacccagccaggttttgcatttttagtacagatggggtttcgcccaccatgttgccccagcagttttttttttctttttttgagacagggtctctcactctattgcctaggctggagtgtagtggtgtgatcacggttcactgcagccttgacctcctgggctcaggtgagcctcccacctcagcctctcaagtagctgagactgcaggtgtgygccaccacacacagctaattttttttattttttgtagagatggggactcactatgttgcccaggctggtctcaaactcccgggctcaagtgatcttcctgccttggcctcccaaactgttgagatgactggtgtgaaccacgtgcccagccatgtgctgatgttcttatgggtcattactttcccgttttcttttgagattccattctgtgtttccttttctttttaatctgccaaggatttccttccacttcttcaggaataccagacaccagtggctacgcggctgagccaggcactg

SEQ ID NO: 43101 - DNA, 601 bp, Human
gcactgcccccatcagattttcagtagaggaaacagtgaaaacagaagcaatgccaacaaagtcagaatgaatgaactatagttgacccttgaacaacactggagttaggggttcccccgaacagtcgaaaatccacatacaatttctgactccctcaaaacttaactactaatagcctacggttgatgggaagccttactgatcacataaacagttgataaacacgcacaatggaatctacatgtatttcacatattcatgacacacctacgttttccttaattttttttcctttttttaaaaaaaaaaaaaaaaaaagagagactgggtctcattgtattgcccaagcttgagtgcagtggtgcaatcatagttcacttcaggctcaacctcccaggctcaagtgatcttcctgcctcagccccctaagtagctgggactacaggcatgggccaccacgctggggtttttgcatttttagtagagatggggtttcaccacattgccccgctggtctcaaactcctggcctctggtgatcctcctgtcttgtccttccaaagtactgaaattacaggtgtgaaccaccatgcctggcccg

SEQ ID NO: 43102 - DNA, 601 bp, Human
gtcctaagaaccgaaccttccaatcccaaaactctagacaggtatccaatacctactgtgtttttgtagaagaagtacagcaccatgttggcaagtcgggagtagcaccaatgcccgtgaagaatcaagagcctctccaggtatcggaatttcggcactgcaaagtcgctggccatcactgccttcaaagggagagggattcctgttactggtgatgccgacctggcgtcagatttgtcttctcttctcaaaatgcaaggtacacaacagggaaggaaaatccccattctgaacacagtgygagcgtggccggccagggtctccatcgctgtcgtctccctcagcatctccttccgttacaaaagaggcaatctcacccaacacgctagttcagggatgtcaccttataagattcatttacgctttcaaatatgtgtcactaatggggtttaaaaggttttcttttttcctgctgttttctcaacaaatgaaaacacacagagatacatggtgtttatctgcctttctttgccccggatgtcattttcctctaaatcggtccatggtcacaacccaaggatgacccaaagctgctcctgcc

SEQ ID NO: 43103 - DNA, 601 bp, Human
atgcctataataccacactttgggaggcagagatgggacgatagcttgaggccaggagtttgacaccagcctgggcaacatagcgacaccctgtctctacaaaatagaaaaaattagctgggcatggtggcctgtagtcccagctactcaggaggctgaggtagggggattgcttgagcctaggagtttgaggatacagtaagctagagtggcgccactgcactccaacctgggcaacagaatcagaccctgtctttaaaaaaaaaaaaaaaaaaatccaaagcaggaattaacttgctcragaacccacagctaacaagtgatagaaagggggcttggattcttccctgcccacccccattcatccctccactccttcgggagctgagaacctttaggcttacaactgtgcacttgaggcctcaaagttctggggatttaatgccagggctgggagaaaggaggtatgagccggcaagcccaggagtggtgtgacacagccttcctcagatagtcccaggcacagcctaatctgaattaatgtctgggaccaaacctatcaagttaaacatgccctgactggatctgagcagctgtatgc

SEQ ID NO: 43104 - DNA, 601 bp, Human
tttgtttttttaagatttaaaagaagactggacatggtggttcatgcctataataccacactttgggaggcagagatgggacgatagcttgaggccaggagtttgacaccagcctgggcaacatagcgacaccctgtctctacaaaatagaaaaaattagctgggcatggtggcctgtagtcccagctactcaggaggctgaggtagggggattgcttgagcctaggagtttgaggatacagtaagctagagtggcgccactgcactccaacctgggcaacagaatcagaccctgtctttaaaaaaaaaaaaaaaaaaatccaaagcaggaattaacttgctcaagaacccacagctaacaagtgatagaaagggggcttggattcttccctgcccacccccattcatccctccactccttcgggagctgagaacctttaggcttacaactgtgcacttgaggcctcaaagttctggggatttaatgccagggctgggagaaaggaggtatgagccggcaagcccaggagtggtgtgacacagccttcctcagatagtcccaggcacagcctaatctgaattaatgtctgggaccaaacct

SEQ ID NO: 43105 - DNA, 601 bp, Human
gacattttaactgggaattagggatcagctggctcaactcacaggctttgctttgtttttttaagatttaaaagaagactggacatggtggttcatgcctataataccacactttgggaggcagagatgggacgatagcttgaggccaggagtttgacaccagcctgggcaacatagcgacaccctgtctctacaaaatagaaaaaattagctgggcatggtggcctgtagtcccagctactcaggaggctgaggtagggggattgcttgagcctaggagtttgaggatacagtaagctakagtggcgccactgcactccaacctgggcaacagaatcagaccctgtctttaaaaaaaaaaaaaaaaaaatccaaagcaggaattaacttgctcaagaacccacagctaacaagtgatagaaagggggcttggattcttccctgcccacccccattcatccctccactccttcgggagctgagaacctttaggcttacaactgtgcacttgaggcctcaaagttctggggatttaatgccagggctgggagaaaggaggtatgagccggcaagcccaggagtggtgtgacacagccttcct

SEQ ID NO: 43106 - DNA, 601 bp, Human
aaggcctggcatttttatggaataaaaacaggcgtcctcttctcctttctgcacccttcaatggggagggactcatcgcagcaggcaggaggctgtgcccgttccaggtgaccactagggcctttgtttgcatctgaagtgtttaatgatttggcctacatcattcttgccctcccttcgatctgagacattttaactgggaattagggatcagctggctcaactcacaggctttgctttgtttttttaagatttaaaagaagactggacatggtggttcatgcctataataccacacttkgggaggcagagatgggacgatagcttgaggccaggagtttgacaccagcctgggcaacatagcgacaccctgtctctacaaaatagaaaaaattagctgggcatggtggcctgtagtcccagctactcaggaggctgaggtagggggattgcttgagcctaggagtttgaggatacagtaagctagagtggcgccactgcactccaacctgggcaacagaatcagaccctgtctttaaaaaaaaaaaaaaaaaaatccaaagcaggaattaacttgctcaagaacccacagctaacaagt

SEQ ID NO: 43107 - DNA, 601 bp, Human
ttttgtgcttgacaagctctggatcattaacataaaacaaaatcaaggtttcacaggggtgtagggctgctcacatttcaagagggccagttgagtatgagctgtggcatcttccctagtggccctcctctgtctgtgaccccagacaaagcctacctgtggctatatctctgctcctgtctcttctttagtgacctgcatactctctgaggaggtgcagtggacagtgactgactcccactgaggggaggacacacaaaagcacaatagcaaagccaatgacctcatcaacatcgctgcrgtgacctgattgtccacggggacctctgctggggggagagggagaggcatcatctctgatcctcatagctacagctacccagctcagcagaacaggaaagtgagattcagggaggtggaacagccacctctggcccctgctcactggggtgggagcaaggtcagatctcttctcactattgctagattcctgaatatcagcagcctgagtgcatttatacggtggacatgacagtttagtgattgcaaagcattctaacactcatgagctatgtagctgggcacagagcatgaactcctc

SEQ ID NO: 43108 - DNA, 601 bp, Human
tggagggcagagctcaggaggtggaaggcggagactcgggggagctttacctccatgttctggccactcttgtagagctgcgggttggtcagcagcacattggctggcacatccctgtccagcaccccagtcacgagcgggggaagtgacgagaagagcagattaaagaagattagataccactggtcaatcatggtagatgcagagaagccacagaaaaactggaaccaaaacaggaggcccacgaacatctgaaatcaagaaaggaagaacaggaacaggcgagtcttcagccattgcygaggattctcatccgagggagctgacaggcctgcagagtttcacagtcaagattaaatgtattggcagcgatttctgccaaagacagccatgaccttgagccctgctgctggcctctgcctctccctcttcctctttcccttcgccctcctcactcccttaagaaagaagaactggcagtgggaattgggaattcccaggagcagcacttgcggggatgagatttttgtgcttgacaagctctggatcattaacataaaacaaaatcaaggtttcacaggggtgtagggctgctcacatt

SEQ ID NO: 43109 - DNA, 601 bp, Human
ttgtcttaaaaaaaaaaaaaaaaaaaagatgaaactgctttctgcatcttcccagggaacatgtctctcaagtaggaagtaggaatagcacctgaaattccgggcattctcccccagtttgagcccttctattccttccactttgaccaggttttgcctctcttggtggtgggtcccttagaatgtttcttaagagtgagtcttcacttttaaaattacacgatggatgtgtcccaatgttaaaagcaaacagctatatacccatgggcagaaatgaaaataaccttgatatagatgaatggtctctattacccgggtgaccaaatgtgtatttgaccctgccaagtaccagagcagctggcacgggacctgcaggaaacacacactggggaaggagctctggctgagcacttagggaaagtgctggctaggctcttcctgtgggccacttaattccacaggacaggacacactcccagcgtctttgtcccacaggtggccgaggaggctgaggcctggccaaggatgggaactcccctgaagcaacagataacaagcagaggccctgctcccctccctggcccttcgcctcctggcaccc

SEQ ID NO: 43110 - DNA, 601 bp, Human
actcaggaggctgaggcaggagaatggcgtgaacccgggaggcggagcttgcagtgagccgagatcacaccactgccctccagcctgggtgacagagcgagaccttgtcttaaaaaaaaaaaaaaaaaaaagatgaaactgctttctgcatcttcccagggaacatgtctctcaagtaggaagtaggaatagcacctgaaattccgggcattctcccccagtttgagcccttctattccttccactttgaccaggttttgcctctcttggtggtgggtcccttagaatgtttcttaagagygagtcttcacttttaaaattacacgatggatgtgtcccaatgttaaaagcaaacagctatatacccatgggcagaaatgaaaataaccttgatatagatgaatagtctctattacccgggtgaccaaatgtgtatttgaccctgccaagtaccagagcagctggcacgggacctgcaggaaacacacactggggaaggagctctggctgagcacttagggaaagtgctggctaggctcttcctgtgggccacttaattccacaggacaggacacactcccagcgtctttgtcccacaggt

SEQ ID NO: 43111 - DNA, 601 bp, Human
tagaaaaattagccaggcatggtggtgggcgcctgtagtcccagctactcaggaggctgaggcaggagaatggcgtgaacccgggaggcggagcttgcagtgagccgagatcacaccactgccctccagcctgggtgacagagcgagaccttgtcttaaaaaaaaaaaaaaaaaaaagatgaaactgctttctgcatcttcccagggaacatgtctctcaagtaggaagtaggaatagcacctgaaattccgggcattctcccccagtttgagcccttctattccttccactttgaccagkttttgcctctcttggtggtgggtcccttagaatgtttcttaagagtgagtcttcacttttaaaattacacgatggatgtgtcccaatgttaaaagcaaacagctatatacccatgggcagaaatgaaaataaccttgatatagatgaatagtctctattacccgggtgaccaaatgtgtatttgaccctgccaagtaccagagcagctggcacgggacctgcaggaaacacacactggggaaggagctctggctgagcacttagggaaagtgctggctaggctcttcctgtgggccactt

SEQ ID NO: 43112 - DNA, 601 bp, Human
ctgggtgcggtggctcacgcctgtaatcccagcactttgggatgcccaggtgggcggatcatgaggtcaggagatcgagaccatcctggttaacatggtgaaaccccgtctctactaaacatatagaaaaattagccaggcatggtggtgggcgcctgtagtcccagctactcaggaggctgaggcaggagaatggcgtgaacccgggaggcggagcttgcagtgagccgagatcacaccactgccctccagcctgggtgacagagcgagaccttgtcttaaaaaaaaaaaaaaaaaaaaaatgaaactgctttctgcatcttcccagggaacatgtctctcaagtaggaagtaggaatagcacctgaaattccgggcattctcccccagtttgagcccttctattccttccactttgaccaggttttgcctctcttggtggtgggtcccttagaatgtttcttaagagtgagtcttcacttttaaaattacacgatggatgtgtcccaatgttaaaagcaaacagctatatacccatgggcagaaatgaaaataaccttgatatagatgaatagtctctattacccgggtgaccaaatgt

SEQ ID NO: 43113 - DNA, 601 bp, Human
gctatttaggttgacacctcgaatgacatttcctaggatgctacacgtaagttaatgcacaaggcaagcacccaaggaaaactcactctctcaggacttttggagacgcgaggccccagaggcccgatgaaaagcactaccaaacacctacaaaactatctgcagctgcgtcactcactgggaacacctgcaccaaaaagacgagcttcagtagctccaggttcacagtaaaaagatgaaactggctgggtgcggtggctcacgcctgtaatcccagcactttgggatgcccaggtgggcrgatcatgaggtcaggagatcgagaccatcctggttaacatggtgaaaccccgtctctactaaacatatagaaaaattagccaggcatggtggtgggcgcctgtagtcccagctactcaggaggctgaggcaggagaatggcgtgaacccgggaggcggagcttgcagtgagccgagatcacaccactgccctccagcctgggtgacagagcgagaccttgtcttaaaaaaaaaaaaaaaaaaaagatgaaactgctttctgcatcttcccagggaacatgtctctcaagtaggaagtagg

SEQ ID NO: 43114 - DNA, 601 bp, Human
ccaggtaaacaggtccacgttcgagtcatagtaggcctgaaagacagtggggtcctggatctgtaggtccccggatccagctggtaagaaaaactgcacccaggggccaacttaccaggtaaggaatggaaaagcaaaccaggctctggaaggcggcgtcggccatgttaaaccagaacgttcgtggccggtattcctgggacacaaaaacaatcagtgatgttacagtgaagcattggcatcctctgtgaaagcagttagaataaaaatggagtcacttgtgttaaaaacaacaacaatcacaacaaaaacccaccctgaggagtagagctgggaaaggccatgaagggagggttctcatgcataaatacctgataacaaaaatgatcatatccacagaaaaatatatctataaggacatgtgcccagcaactgtctgtccaacctcaaacaggcaccatctttgtcgtttatccttgtagtcaaggaaagagcatctcaaaacgatcatgaaattttttcctttaaatacatttgtcttcctttacctcgctaaatatgcacatagcttactacagcacacacattcccattgcagtgc

SEQ ID NO: 43115 - DNA, 601 bp, Human
aatctgcagggaagtgtggggtccacggcatcagtgctcttctgagacgtggccatgcaggcggctcttacccaggttttggtttcaatgcccaggtggagcaggaaagtgagcagcgcgattgtcacaataggggtcccccaggtaaacaggtccacgttcgagtcatagtaggcctgaaagacagtggggtcctggatctgtaggtccccggatccagctggtaagaaaaactgcacccaggggccaacttaccaggtaaggaatggaaaagcaaaccaggctctggaaggcggcgtcrgccatgttaaaccagaacgttcgtggccggtattcctgggacacaaaaacaatcagtgatgttacagtgaagcattggcatcctctgtgaaagcagttagaataaaaatggagtcacttgtgttaaaaacaacaacaataacaacaaaaacccaccctgaggagtagagctgggaaaggccatgaagggagggttctcatgcataaatacctgataacaaaaatgatcatatccacagaaaaatatatctataaggacatgtgcccagcaactgtctgtccaacctcaaacaggcaccat

SEQ ID NO: 43116 - DNA, 601 bp, Human
cctcatgaatctgcagggaagtgtggggtccacggcatcagtgctcttctgagacgtggccatgcaggcggctcttacccaggttttggtttcaatgcccaggtggagcaggaaagtgagcagcgcgattgtcacaataggggtcccccaggtaaacaggtccacgttcgagtcatagtaggcctgaaagacagtggggtcctggatctgtaggtccccggatccagctggtaagaaaaactgcacccaggggccaacttaccaggtaaggaatggaaaagcaaaccaggctctggaaggyggcgtcggccatgttaaaccagaacgttcgtggccggtattcctgggacacaaaaacaatcagtgatgttacagtgaagcattggcatcctctgtgaaagcagttagaataaaaatggagtcacttgtgttaaaaacaacaacaataacaacaaaaacccaccctgaggagtagagctgggaaaggccatgaagggagggttctcatgcataaatacctgataacaaaaatgatcatatccacagaaaaatatatctataaggacatgtgcccagcaactgtctgtccaacctcaaacag

SEQ ID NO: 43117 - DNA, 601 bp, Human
ggcacaagacgcattgtaaatcaaagccacggtgaaaaacaaaaggacactgaagccacacgttatccagttgagccaggtctgagggggaatgagaaagaaagggcttttatttccacctaaaagtgacaacaatgacaataacaaaaacgtgccagtcatcaatgagcaggtgtgaggttctgaggccttcagacacactgcggtctatgacgcgggtaaccggtggggctcaatgaggcctccagaacccatggaccgccctgggagatgcacatgaggtgagatggagtcaggggcragagggcaagacaggagggaaaggagagaatgtggtggtggaagcgggaaagaggcgggagggagatgagcatggccggggaagtgcgagcatcaggctgcagcggctccccacaccacagggctcgggaatgtgtcattgtccttctcatcacactgaggtcagctttgcagtctcctgtctactcaaaacgacctcccagacctcatgaatctgcagggaagtgtggggtccacggcatcagtgctcttctgagacgtggccatgcaggcggctcttacccaggttttggtttcaatg

SEQ ID NO: 43118 - DNA, 601 bp, Human
tggcgcagaggacatgggggccggtgcgctcagcccctccagcagggtgtgctccctcactggcatgctcatgtccactgtgctgggctccccgctggcctccagggagcagaccggctgctgtgtgtgccaagaaggctgggacaggggcacagaggtcttgactgtcctccctgatgagtgctcggttcccgagtccttcgggaggcgtccctgagcaaaggtctctttgggagcactgcatctcctgggggacttcctggtcaactgacgtgccagctgaagttgtgtggggaaaacsctcccctggagggatctgaaaaacaatctagaaaaagtacattaaaacaaaaagttagatattcctgtcggtggtgtctttgagcttccagagacccacacagagcagaagcaatgccaatgtcgtctgggctcactcggggctcagaggcactatcccgctccgacacccacctgggcagcagtgcagcgacaggcgtcatcaggcaagtcaagtaaaacactgggtcacccagtaaggcttgcatagtccagtaagggttggacggaggatagcacgtggcacaagacgcattgtaaa

SEQ ID NO: 43119 - DNA, 601 bp, Human
atctaaacacacttttcaagtgttactcttctttaaacttttatatatgttaaggctcttctttttcttttcaatatactctacttagaattttaaaaaataaactttcttttttggtacctcttgtttcctgtattagcctgggaaacatttagaaatacatctccctagaactcttctgtgcaaataataaacataaataatattaacatttatttatatatattaaaaaaggccatttcaaggttttcactgtgaccgccttgaagatgctcctataagtagtctgtggtctggcccytgaagtcctgatcggcctgagtggggctggacaggaagtccacgtcccgcttgtccatctgcaagctgctccgtccgggagaactgtaagacactccccagcctgctgaccagcgaccaggaggaaatccagttgagtaagctgaaggtaggcaggctgaagagggaagacaggggggtcaccctgccggtgctggcagctctcaccttggactcctcaggacaccctcctggactcctcaggacagcctcccctggcgcagaggacatgggggccggtgcgctcagcccctccagcagg

SEQ ID NO: 43120 - DNA, 601 bp, Human
caatttataaaagaactaagatttaaggaacatgccaaaacctttcaaatttaagccatatttatttgcatttttaagactacagagatatactttaaatcaaatacaatgttagtgctggtagcaggtttgttttataccaaagaatgaaaagatattttaagcaattgggtttatatcaaatctgttatttgccttttgatctctaaaacagaaataatttatatcacagttttcaaagacagatgccgcctaagcaaacatgaatttatatatggcctaaaacagacctttgactttyaacagaaaaagatattgagtaattttataaattactaaaaagatactgagtaatttcataaatacataaagcattttaaactctagttaaaagtctagtaaagttttgggagcaatgcaatgaagatgaaaagatacccattttcacctagtttcctaaaactgcacaatcctcaaccctgtgggtaagtctttcctttggtgtacttttccccttctttttagttttcatttttgaattatttccttaaataggcaaaaaatgaagctttagtgaagggggcattgcaataaaatacat

SEQ ID NO: 43121 - DNA, 601 bp, Human
tctgctcttggaattacacgcttgtgcctaacgtggaagacccacctgtttggattcaagacctgtggaaaggagacaattccctcccaccccccacccaaaaaaatcaaacctctgaataagagggggtaggaaaaaagaatcccactttcctcccaaatctcttctccttagggtttctccactagttcttcaatgggtgagggacatggtagacaaatccccagggccaggaccaaccgggctgcggtgcaaggctgggtaactgacgagggggccggggatggcctcatggaaaacrcttccataaatgggcatgtttgcctcaatctctgccctcccacggaaaagtaatgataacaaatccataacagataccttgtacggaataacacatctatttcggacatgataataaaaaaacatggtgtttacaaggcaagcctggcggcttctcggaaaagacccagctagttcacgttctggactctcggcatggcagcccacctagggtcactggtttcagctaggtcaccccctcaatcaggggacaaacagtgccttttattttaaatgtgcaaaaagtcagtttatgttttct

SEQ ID NO: 43122 - DNA, 601 bp, Human
ttagccccatttcccggatgagaaagtgaggtttggggaggtgcgggagatgatttttaaatttgcttatggccttctatgattctactggattgaatattgaacttggttttcaagaaaaatctactatatatctgctcttggaattacacgcttgtgcctaacgtggaagacccacctgtttggattcaagacctgtggaaaggagacaattccctcccaccccccacccaaaaaaatcaaacctctgaataagagggggtaggaaaaaagaatcccactttcctcccaaatctcttckccttagggtttctccactagttcttcaatgggtgagggacatggtagacaaatccccagggccaggaccaaccgggctgcggtgcaaggctgggtaactgacgagggggccggggatggcctcatggaaaacgcttccataaatgggcatgtttgcctcaatctctgccctcccacggaaaagtaatgataacaaatccataacagataccttgtacggaataacacatctatttcggacatgataataaaaaaacatggtgtttacaaggcaagcctggcggcttctcggaaaagaccc

SEQ ID NO: 43123 - DNA, 601 bp, Human
tgtccacaaagcgtttagcatctcgccaggcaaaagtgcccaaaaaacatgagttattctcattagccccatttcccggatgagaaagtgaggtttggggaggtgcgggagatgatttttaaatttgcttatggccttctatgattctactggattgaatattgaacttggttttcaagaaaaatctactatatatctgctcttggaattacacgcttgtgcctaacgtggaagacccacctgtttggattcaagacctgtggaaaggagacaattccctcccaccccccacccaaaaaaatcaaacctctgaataagagggggtaggaaaaaagaatcccactttcctcccaaatctcttctccttagggtttctccactagttcttcaatgggtgagggacatggtagacaaatccccagggccaggaccaaccgggctgcggtgcaaggctgggtaactgacgagggggccggggatggcctcatggaaaacgcttccataaatgggcatgtttgcctcaatctctgccctcccacggaaaagtaatgataacaaatccataacagataccttgtacggaataacacatctatttcgg

SEQ ID NO: 43124 - DNA, 601 bp, Human
tccatatgtgtaaaataaagccagttagaataacagtatctactctaaagggttgttatgaagacgtaagataatgtccacaaagcgtttagcatctcgccaggcaaaagtgcccaaaaaacatgagttattctcattagccccatttcccggatgagaaagtgaggtttggggaggtgcgggagatgatttttaaatttgcttatggccttctatgattctactggattgaatattgaacttggttttcaagaaaaatctactatatatctgctcttggaattacacgcttgtgcctaaygtggaagacccacctgtttggattcaagacctgtggaaaggagacaattccctcccaccccccacccaaaaaaatcaaacctctgaataagagggggtaggaaaaaagaatcccactttcctcccaaatctcttctccttagggtttctccactagttcttcaatgggtgagggacatggtagacaaatccccagggccaggaccaaccgggctgcggtgcaaggctgggtaactgacgagggggccggggatggcctcatggaaaacgcttccataaatgggcatgtttgcctcaatct

SEQ ID NO: 43125 - DNA, 601 bp, Human
acctagatttgtagaatcttcttttccttactggttagctgagctatcttaagcaagttattcagactccatatgtgtaaaataaagccagttagaataacagtatctactctaaagggttgttatgaagacgtaagataatgtccacaaagcgtttagcatctcgccaggcaaaagtgcccaaaaaacatgagttattctcattagccccatttcccggatgagaaagtgaggtttggggaggtgcgggagatgatttttaaatttgcttatggccttctatgattctactggattgaawattgaacttggttttcaagaaaaatctactatatatctgctcttggaattacacgcttgtgcctaacgtggaagacccacctgtttggattcaagacctgtggaaaggagacaattccctcccaccccccacccaaaaaaatcaaacctctgaataagagggggtaggaaaaaagaatcccactttcctcccaaatctcttctccttagggtttctccactagttcttcaatgggtgagggacatggtagacaaatccccagggccaggaccaaccgggctgcggtgcaaggctgggtaa

SEQ ID NO: 43126 - DNA, 601 bp, Human
atctgtgaaactctggagttagaaagacctagatttgtagaatcttcttttccttactggttagctgagctatcttaagcaagttattcagactccatatgtgtaaaataaagccagttagaataacagtatctactctaaagggttgttatgaagacgtaagataatgtccacaaagcgtttagcatctcgccaggcaaaagtgcccaaaaaacatgagttattctcattagccccatttcccggatgagaaagtgaggtttggggaggtgcgggagatgatttttaaatttgcttatgrccttctatgattctactggattgaatattgaacttggttttcaagaaaaatctactatatatctgctcttggaattacacgcttgtgcctaacgtggaagacccacctgtttggattcaagacctgtggaaaggagacaattccctcccaccccccacccaaaaaaatcaaacctctgaataagagggggtaggaaaaaagaatcccactttcctcccaaatctcttctccttagggtttctccactagttcttcaatgggtgagggacatggtagacaaatccccagggccaggaccaa

SEQ ID NO: 43127 - DNA, 601 bp, Human
gtaatctgagcactttgggagaccaagccaggcgaatcacttgaggtcagcggttcgagaccagcctggccaatatggtgaaaccccatctctactaaaaatacaaaaaattagccaggcatggtggtgggcgcctataaacccagctactctctactcaggaggctgaggctggagaagtgcctgaacctaggaggcggaggttgcagtgagccaagatcgcaccactgcactccagcctgggcgacagagcaagactctgtctcaaaaacaaacaaacaaaaccctaaacaaatgtaaytggaatttgtaacattcccaatccaggtaaggaatggtagcttaatatattaaagattctaatcaccactttcagcccaaatagaaacgaggtttatgagatcaaagggaagaaaattaagagaagcttctcctttaacggccacatagtttaggcttcccggttctgccaaagatgagccatgccatactgagcaaacatcttgaactctctggttgtgtttgctataaataaccatcactgaagcttaccaggggccaggcactgtgctaaacccttcatacacattagctcatcaaa

SEQ ID NO: 43128 - DNA, 601 bp, Human
aagacctagagagcaaaaaggccatcccttaaagtatgccatcaagaccctaaataagccaggcgcggtggctcacgcctgtaatctgagcactttgggagaccaagccaggcgaatcacttgaggtcagcggttcgagaccagcctggccaatatggtgaaaccccatctctactaaaaatacaaaaaattagccaggcatggtggtgggcgcctataaacccagctactctctactcaggaggctgaggctggagaagtgcctgaacctaggaggcggaggttgcagtgagccaagatygcaccactgcactccagcctgggcgacagagcaagactctgtctcaaaaacaaacaaacaaaaccctaaacaaatgtaattggaatttgtaacattcccaatccaggtaaggaatggtagcttaatatattaaagattctaatcaccactttcagcccaaatagaaacgaggtttatgagatcaaagggaagaaaattaagagaagcttctcctttaacggccacatagtttaggcttcccggttctgccaaagatgagccatgccatactgagcaaacatcttgaactctctggttgtg

SEQ ID NO: 43129 - DNA, 601 bp, Human
aagtcacagatgtccgacctcccctttcagccactgtgagcagcttcttcctctgtccttggatcacatacaaggtttctttcaaattcttgcctgcctttctctaaattcagtctttcctccattgtgtggccagggttaaaagttgaaaggtcaggagtggaaggagaagacctagagagcaaaaaggccatcccttaaagtatgccatcaagaccctaaataagccaggcgcggtggctcacgcctgtaatctgagcactttgggagaccaagccaggcgaatcacttgaggtcagcrgttcgagaccagcctggccaatatggtgaaaccccatctctactaaaaatacaaaaaattagccaggcatggtggtgggcgcctataaacccagctactctctactcaggaggctgaggctggagaagtgcctgaacctaggaggcggaggttgcagtgagccaagatcgcaccactgcactccagcctgggcgacagagcaagactctgtctcaaaaacaaacaaacaaaaccctaaacaaatgtaattggaatttgtaacattcccaatccaggtaaggaatggtagcttaatatatt

SEQ ID NO: 43130 - DNA, 601 bp, Human
gagccactgcacctggtctgcaatgtctttagccagtcatttgcaatatctattaattttagatacgcatgccctttaactcagcaagcgcatttctgggaatttatcctacagataaattcatataattagacaaaaagtccaaggatgaaagagtggcattatctattattcccattttcctgctaagcctatcggggtcttgaaaggtaaatgcaaggccctcccttgcaaaagttggggaaccaggattagaatcccgatctgtttgaagcctaatttactcagagatggcattagygatgtttgacacatctgaatatgtcagccctattcacagtcctgtcctaacaactcactgcttcatcccttgagcacaaacaagctattcattagcctgtggaagatccttaggtcttcgagttacaagtctcagctctgcccaaaactcgctgggtgatgctaggcaagtcacttgccctctctgggccttgtatttttcagcctggtacagtaaagttctatgcccctcaccttttttttgagacagagtctcactctgttgcccaggctagagaacagtgatgcaatcagggcccac

SEQ ID NO: 43131 - DNA, 601 bp, Human
ctgacctcaggtgacccacctgctgcggcctcccaaagtgctgggattacaggcgtgagccactgcacctggtctgcaatgtctttagccagtcatttgcaatatctattaattttagatacgcatgccctttaactcagcaagcgcatttctgggaatttatcctacagataaattcatataattagacaaaaagtccaaggatgaaagagtggcattatctattattcccattttcctgctaagcctatcggggtcttgaaaggtaaatgcaaggccctcccttgcaaaagttggggarccaggattagaatcccgatctgtttgaagcctaatttactcagagatggcattagcgatgtttgacacatctgaatatgtcagccctattcacagtcctgtcctaacaactcactgcttcatcccttgagcacaaacaagctattcattagcctgtggaagatccttaggtcttcgagttacaagtctcagctctgcccaaaactcgctgggtgatgctaggcaagtcacttgccctctctgggccttgtatttttcagcctggtacagtaaagttctatgcccctcaccttttttttga

SEQ ID NO: 43132 - DNA, 601 bp, Human
atcactgcctaagctccgcctcctgtcagataagcagcattagattttcacagaagcacaaaccctattgccaactccacctgcaagggatctaggttgtacgttccttatgagaatctaaccaatgcctgatgatgaggtgggacagtttcatcccaaaaccatcctccccactccaccctggaaaatattgtcttccacgaaaccagtctctggtgccaagaggatggggactgctgtcatatgtgactgcaacaagttgcaatttgcaatgccttttttttttttttttttgagaccragtctcactctttgcccaggctggagtgcagtggtgtgatctcggctcaatgcaacctctgcctctgaggctcaagcgattctcgtgcctcagcctcccgagtagctgggattacaggtgcccacgaccatgcccagataatttttgtatttttagtagagatagggtttagcagagaccatgttggccaggctggtcttgaactcctgacctcaggtgacccacctgctgcggcctcccaaagtgctgggattacaggcgtgagccactgcacctggtctgcaatgtctttagccagtc

SEQ ID NO: 43133 - DNA, 601 bp, Human
agtgaccatcactgcctaagctccgcctcctgtcagataagcagcattagattttcacagaagcacaaaccctattgccaactccacctgcaagggatctaggttgtacgttccttatgagaatctaaccaatgcctgatgatgaggtgggacagtttcatcccaaaaccatcctccccactccaccctggaaaatattgtcttccacgaaaccagtctctggtgccaagaggatggggactgctgtcatatgtgactgcaacaagttgcaatttgcaatgccttttttttttttttttttgagaccgagtctcactctttgcccaggctggagtgcagtggtgtgatctcggctcaatgcaacctctgcctctgaggctcaagcgattctcgtgcctcagcctcccgagtagctgggattacaggtgcccacgaccatgcccagataatttttgtatttttagtagagatagggtttagcagagaccatgttggccaggctggtcttgaactcctgacctcaggtgacccacctgctgcggcctcccaaagtgctgggattacaggcgtgagccactgcacctggtctgcaatgtcttta

SEQ ID NO: 43134 - DNA, 601 bp, Human
gtgacagagtgagactccatctcaaaaagaaaaaaaagaaaaaagaaaaattgctcatattctaaatgtcataaagggctggatacagtggttcacacctgtaatccaagaactatgggaggccaagccaagaggattgcttgaattaggagctctagactagcctgggcagcacagtgagatcccatctctatttcaaataaacgaatgaatgaatgccacacaggcaaaacagaagttctctgaacctgatctgcaacacaattcgccagctggaaggacctctgcagtggaaatcctygctcaaggcctggtccaggtgtagggaggcatcaaatgtgtcgcagggagaggcactgggcactctaaatgcacctgcttggcaggtccccagtagtaccaaaaaggcagtttagatctattattcataacagccactgtatttattgggccccttgtattcatcaggtatcaggccagacagcttcctatatagaccatctcactgtctcctaagcgctctgtaaggtggcatcacctgctattgctattttcctgctaagatgaccgaggtcctggaaggtaaatgcaagacccccac

SEQ ID NO: 43135 - DNA, 601 bp, Human
gtagttcaagaccagcctggccaacatggtgaaaccccgtctctactaaaaatacaaaaaatagccaggtgtggtggtgggcgcctgtaataccagctactcaggaggctgaggaaggagaatcgcttgaacccaggaggtggagggtgcagtgagctgagatcccatcactgcactccagcctgggcgacaagagcaaaactctgtcttgaaaataaataaataaatagtaaattaaatatcccagagcccagagagtataggatttgcacatcacctcacctggtcaacagcttccctyaggattttactgccaagccattggctaaagattttggaccagagacaaaaacccaaatgtttttggagatcaggtaagtaatacagagtgacccagaccagatgttagagtattgcttatattctaaataccatgcagggttcagcactgtggctcacgtctgtaatcccaacactgggaggccaaggcaggcagttcgcttgagcttaggagtttgacaccagcctgcgcaacatggtgaaaccccatctctacagaaaatacaaaaattagccaggcatggcagcacatgccggtagt

SEQ ID NO: 43136 - DNA, 601 bp, Human
tattcccctttccctcattgagacacaaaacacacaacaggacacttgagtctctggcagatccggaaacctgaaagctgttttgctcctacgagccttgggtccccaaaacaacatttagccacagatttgccaaatgttttgagaatgttttcctaaaaatttgccaaatttttgagaaaattcagtgagcctgacaaattaataatactaatactagtaataatagttgctaagtctttttttttttttttttttgacacagagtctcgctctgttacccaggctggagtgcagtgaygcaatctcagctcactgcaacctccacgtttctgggttcaagtgattctcgtgcctcagcctcccaagtagctgggactacaggcatgcgctaccatgcctggctaatttttgtatttttagtagagatgaggtttcaccatattggccaggctggtcttgaactccaggcctcaagcaatcctcccaccttggccccccaaagtgctgggattacaggcgtgagccaccgcagctggccacaaactctgcactgtgactcttgggctgcgtcattctgtgtcgtgaggggagctcttcc

SEQ ID NO: 43137 - DNA, 601 bp, Human
ttctttgtagagacggggtttcaccatgttgtccaggctgaggtcttgaactcctgacctcaagtgatctgcctgcctcggtctcccaaagtgctgggattacaggcatgagccgctgcgcccagccctaagtgggctcttcctaattgccatgtggatgagttgccttaaaagtcagaaaaaatagcaaaagctacaacagaaaaataaaaggacacgcacgcctccattgcctgggaccctgtctaacctcagacttaaaaacacaaacaagatcaagtgcaaagattcagtctctgtmcaaaaaaggagagcttggagcaggctggattccctctggctttgatgtctctgacagttacgacgtgcaaaatctgctttggtcaaaagacagcaagatgggggatgagaagcttcgactcatgctagaatggtgttttccatagcatgccccttggaaccctaattccctgaaatatctgggctggggtggagctgcggaggttgagaagctcttcaaacagtggcgcagtcaaggtcaaatccatctggaaggtgctacatattcccctttccctcattgagacacaaaacacacaac

SEQ ID NO: 43138 - DNA, 601 bp, Human
tcttttttttttttttttttttctgagacagggtcttgctctgtcgcccaggctggagtgcagtggcatgacctcagctcacggcaacctccgcctcccaggctcaagtgatcctcccaccccagcctcccaaatagttgggaccacaggcacctgccaccatgcccagctattttcctgtattctttgtagagacggggtttcaccatgttgtccaggctgaggtcttgaactcctgacctcaagtgatctgcctgcctcggtctcccaaagtgctgggattacaggcatgagccgctgygcccagccctaagtgggctcttcctaattgccatgtggatgagttgccttaaaagtcagaaaaaatagcaaaagctacaacagaaaaataaaaggacacgcacgcctccattgcctgggaccctgtctaacctcagacttaaaaacacaaacaagatcaagtgcaaagattcagtctctgtccaaaaaaggagagcttggagcaggctggattccctctggctttgatgtctctgacagttacgacgtgcaaaatctgctttggtcaaaagacagcaagatgggggatgagaagcttcga

SEQ ID NO: 43139 - DNA, 601 bp, Human
gtttgtgcagatggtagccaattacatcccaagagggctaggagagtgtttcatttgttctaagcactatgacaagtaaagtggacttcttttttttttttttttttttctgagacagggtcttgctctgtcgcccaggctggagtgcagtggcatgacctcagctcacggcaacctccgcctcccaggctcaagtgatcctcccaccccagcctcccaaatagttgggaccacaggcacctgccaccatgcccagctattttcctgtattctttgtagagacggggtttcaccatgttgyccaggctgaggtcttgaactcctgacctcaagtgatctgcctgcctcggtctcccaaagtgctgggattacaggcatgagccgctgcgcccagccctaagtgggctcttcctaattgccatgtggatgagttgccttaaaagtcagaaaaaatagcaaaagctacaacagaaaaataaaaggacacgcacgcctccattgcctgggaccctgtctaacctcagacttaaaaacacaaacaagatcaagtgcaaagattcagtctctgtccaaaaaaggagagcttggagcaggctggatt

SEQ ID NO: 43140 - DNA, 601 bp, Human
cttgtgcaataatgaagagtttgtgcagatggtagccaattacatcccaagagggctaggagagtgtttcatttgttctaagcactatgacaagtaaagtggacttcttttttttttttttttttttctgagacagggtcttgctctgtcgcccaggctggagtgcagtggcatgacctcagctcacggcaacctccgcctcccaggctcaagtgatcctcccaccccagcctcccaaatagttgggaccacaggcacctgccaccatgcccagctattttcctgtattctttgtagagayggggtttcaccatgttgtccaggctgaggtcttgaactcctgacctcaagtgatctgcctgcctcggtctcccaaagtgctgggattacaggcatgagccgctgcgcccagccctaagtgggctcttcctaattgccatgtggatgagttgccttaaaagtcagaaaaaatagcaaaagctacaacagaaaaataaaaggacacgcacgcctccattgcctgggaccctgtctaacctcagacttaaaaacacaaacaagatcaagtgcaaagattcagtctctgtccaaaaaaggagag

SEQ ID NO: 43141 - DNA, 601 bp, Human
ttgatattcttgtgcaataatgaagagtttgtgcagatggtagccaattacatcccaagagggctaggagagtgtttcatttgttctaagcactatgacaagtaaagtggacttcttttttttttttttttttttctgagacagggtcttgctctgtcgcccaggctggagtgcagtggcatgacctcagctcacggcaacctccgcctcccaggctcaagtgatcctcccaccccagcctcccaaatagttgggaccacaggcacctgccaccatgcccagctattttcctgtattcttkgtagagacggggtttcaccatgttgtccaggctgaggtcttgaactcctgacctcaagtgatctgcctgcctcggtctcccaaagtgctgggattacaggcatgagccgctgcgcccagccctaagtgggctcttcctaattgccatgtggatgagttgccttaaaagtcagaaaaaatagcaaaagctacaacagaaaaataaaaggacacgcacgcctccattgcctgggaccctgtctaacctcagacttaaaaacacaaacaagatcaagtgcaaagattcagtctctgtccaaaa

SEQ ID NO: 43142 - DNA, 601 bp, Human
caggtgacatggctcacgcctgtaatcccagcactttgagaagccaagatgggaggaccacttgagcccaggagtttgagaccagcctggccaacacagcaagacccatctctaagaaaaaatgttttttaattacctgtgtggaagactgaggtaggaggataacctgagcccaggaggctgagaccggcctggtcaacatggtgaaaccttgtctctagcaaacatacaaaaattaaccggttgtgatagtgtgcacctgcagtcccagctactcaggaggctgaggtgggaggatcayttaagctcaggaggtcggggatgcagtgagccatgatcatgccactgcactgcagcctgggtgacagagtgagacccccatctataaaaaatatatcctcttgaaaattcatcaagctgcacacttttttgcacatcaagcgtacttttttggttgtaaagtacacttcattttccttccctcttatctttaattgtggtaaaatacagctaacattcaccacctcggccacttaaacacagttcagtagcattaagtatattgatattcttgtgcaataatgaagagtttgtgcagatg

SEQ ID NO: 43143 - DNA, 601 bp, Human
gtgtgaagatgaagtaagattgatcacaagtaggccgagtgtgatggctcatgcctataatcccagaactttgggaggctgaggtgggaggataacttgaggtcaggagtttgagaccagcttggccaacattgtgaaaccctgtctctactaaaaatacaaaaattaaaaattagccaggattggtggtacgtgcctgtagccccagctacttgggaggctgagtcaggagaatcacttgaacccgggaggtggaggttgccgtaagccgacatcataccactacactccagccttggcracagagtcagcctccatctcaaaaaaaaagaagtgtcagagctgggacccaaacctgggtctcattctggagtctatttggttctgcctttcacataaggtgggtgggcttgtcagatgcccataaaggaatcaatcctgtaaggcacctggcacagtacctgacacattacaaacacccaaaataggactcgaatcaggtgaagtaaactacagctccacaccacaaaaaaggacatctcacaacacatccttgagcaaaagaaggtggtcacaaaaagcacaggttctgtgactattg

SEQ ID NO: 43144 - DNA, 601 bp, Human
caccaagtaccttctgtttctataccctttctcacttccggtgactctaagccacttcgctcattcctaaccaatagcatttactactgttggatgttttaattatgtttatttctggacagccatagtcacagaagtggcttgatacgacgcgtcttcttttaatagtataaccaaggttagtttaaacaggcagcaaaataggaaatgcggcaaaatattcaatcattccctgataatctcttgtttcttaaggtgtcgcagcagatcgtgtgtgtgtgtgtgagagagagagagagagaaagaaggagagagagagagagaaactggaggatgcgtaagagaaatgggagggtgtgaagatgaagtaagattgatcacaagtaggccgagtgtgatggctcatgcctataatcccagaactttgggaggctgaggtgggaggataacttgaggtcaggagtttgagaccagcttggccaacattgtgaaaccctgtctctactaaaaatacaaaaattaaaaattagccaggattggtggtacgtgcctgtagccccagctacttgggaggctgagtcaggagaatcacttgaacccg

SEQ ID NO: 43145 - DNA, 601 bp, Human
acaccaagtaccttctgtttctataccctttctcacttccggtgactctaagccacttcgctcattcctaaccaatagcatttactactgttggatgttttaattatgtttatttctggacagccatagtcacagaagtggcttgatacgacgcgtcttcttttaatagtataaccaaggttagtttaaacaggcagcaaaataggaaatgcggcaaaatattcaatcattccctgataatctcttgtttcttaaggtgtcgcagcagatcgtgtgtgtgtgtgtgagagagagagagaggaaaagaaggagagagagagagagaaactggaggatgcgtaagagaaatgggagggtgtgaagatgaagtaagattgatcacaagtaggccgagtgtgatggctcatgcctataatcccagaactttgggaggctgaggtgggaggataacttgaggtcaggagtttgagaccagcttggccaacattgtgaaaccctgtctctactaaaaatacaaaaattaaaaattagccaggattggtggtacgtgcctgtagccccagctacttgggaggctgagtcaggagaatcacttgaaccc

SEQ ID NO: 43146 - DNA, 601 bp, Human
acacccagactttgcaatcagatgctaattcaaacgtgactctgccactgcagaatgcgtgcttctgggtgacttacgtagatctgagactcagatttactgtatattaatactggggacctaacgggtgccctgcagagctgccatgaagtttagatgaaactctctacaccaagcttgtctaacctgcagcccacaggctgcatggggcccaggacggctttgaatgtggcccgatacaaattcataaactttcttaaaacagtatgatattttttcgcgattttttttttttttttttagctcatcagctatcattagtgctagtgtattttacgtgtggcccaagacaattcttctttttctggggtggcccagggaagccaaaagataggacacccctgatctacaccaagtaccttctgtttctataccctttctcacttccggtgactctaagccacttcgctcattcctaaccaatagcatttactactgttggatgttttaattatgtttatttctggacagccatagtcacagaagtggcttgatacgacgcgtcttcttttaatagtataaccaaggttagtttaaacag

SEQ ID NO: 43147 - DNA, 601 bp, Human
cgggcacagtggctcacacctgtaatcccagcactttgggaggctgaggcgggcagatcacgaagtcaagagatcgagaccatcctggctaacacggcaaaaccctgtctctactaaaaaaaaaaaaaaaaattagccgggcgtggtggcggccgcgtgtagtcccagctactctggaggctgaggcaggagaatggtgtgaacctgggaggcggagcttgcagtgagtgggtgagtggagatgcgccgctgcactccagcctggacgacagagtgagactccgtctcaaaaaaaaaaaaagaaagaaaggaagaaagaaagggtcttggcaagttggcaagttctaccagtaattgctaaaaccattaggccaatggggctcacatttcctggtgcattagcttctgagtcagtaggactgggatggggcccaagaatatgcattcctaaccagcttccgggtgatgatgatgatgctggtctagggtccccaccacaagactgactatatcagatgaagagctcttgtggaatttttaagggatgggtccgcctgccatcacctaaatctactaattaaccctaacatcacaaaaagag

SEQ ID NO: 43148 - DNA, 601 bp, Human
aaggaaggaaagaaagaagaaaggaaggaagaggccgggcacagtggctcacacctgtaatcccagcactttgggaggctgaggcgggcagatcacgaagtcaagagatcgagaccatcctggctaacacggcaaaaccctgtctctactaaaaaaaaaaaaaaaaattagccgggcgtggtggcggccgcgtgtagtcccagctactctggaggctgaggcaggagaatggtgtgaacctgggaggcggagcttgcagtgagtgggtgagtggagatgcgccgctgcactccagcctggrcgacagagtgagactccgtctcaaaaaaaaaaaaagaaagaaaggaagaaagaaagggtcttggcaagttggcaagttctaccagtaattgctaaaaccattaggccaatggggctcacatttcctggtgcattagcttctgagtcagtaggactgggatggggcccaagaatatgcattcctaaccagcttccgggtgatgatgatgatgctggtctagggtccccaccacaagactgactatatcagatgaagagctcttgtggaatttttaagggatgggtccgcctgccatcacct

SEQ ID NO: 43149 - DNA, 601 bp, Human
taaatgggtacagaaagtggggtggaaatgtgaaaatcttgattctgcgttttctatacaaattgttccttagggtaactaaattaagaaggggaagtctctcttgatggaagattaggtcattaaatgtcctgtctacatgggaagcccatggatggtagattcacgttatctgtcgttatccagatgtgtttatgaggagagggacagagacaacacactctataggcctgtccggccccccgttcctgactctctgaccatagctgcaggggctgtcctggaaacactggcttacagycccttctacctcttgctgctgggctccaaagaactgagttgctggctaagtgaggacatatggccaccaggatctatgcgtggttgacatccctccttcagcagggaattcacaactcctttgaattcactgataatccccacgcttgggccccaaatcccacagcgacagaataaagacccatgtcccactcctggatccctagagctgagcagccaactcctgaaacccaaccttttgggtgatgcagattttgcaagacagaatgggagtggcagatattccaatacctattttttt

SEQ ID NO: 43150 - DNA, 601 bp, Human
tagaaaactgcataccaaaatattatactagggttctatctggtcaaatacgagacagtgtgaatatcaataagaaaaataattatatgtccatcaccctaacaccccaaaaagggtggaaagacaaatatatttaaatgcatttgttcaaaatgatttttgttgttgttgtttgagatggagtcttgctctgttgtctatgctggagtgcagtggtgcaatcttggctcactgcaacctctgcctctgggttcaagcgattctcctgccttagcttcccgagtaactaggattacaggcrtgcaccatcacacccagctaatttttgtatttttagtagagacggggcttcgccaagttggccaggctggtctcaaactcctgacctcaagtgatccaccagcctcgggctctcaaagtgaagggattacaggcatgagccactgtgcccagccccaaatgcattattttttaaatgggtacagaaagtggggtggaaatgtgaaaatcttgattctgcgttttctatacaaattgttccttagggtaactaaattaagaaggggaagtctctcttgatggaagattaggtcattaaatg

SEQ ID NO: 43151 - DNA, 601 bp, Human
cattgcactccagcctgagtgacagagtgagacgctgtctcaaaaaaattaaaaaaaagagttgccagtggcaaggaaaggaatggattagtaagaggcacagaagaggtacataagaggtaagaggcaccacctttcggggtgataaaagtattccctgtggtcatggtggtgcttacaagactgtatacatttgtcaaaactcattaagaatgttctatccactataggatgagtaaagtgaacaataaaatattacatcgtttccaagagctagaagaaggacattgaatgttcccarcacaaagagatgataaatgtcattatataggaagtagcaaaataaaagtaatggcaaatgcttgagatgatggatatgctaattatcctgatcttatctccccacacattatatgtattaatatcaaaacattactaagagctggactcagtggctcacacctgtaatcccagcactgtgggaagctgagacaggaggatcccttgaggccaggagttcaagaccaacctgggcaacataagaagcccctgtctctgtaaaaaaattaaaaattagcctggcacggtggtgcatgcctac

SEQ ID NO: 43152 - DNA, 601 bp, Human
gagatagaaggtaatggcggccgggcgcggtggctcacgcctgtaatctcagcaccttgggaggctgaggtgagtggatcacctgaggtcaggagttcaagaccagcctgggcaacatggtgagacccctgtctctactaaaaatacaaatattaatggagtgtggtggcacacacctgtagtcccagctactcaggaggctgaggcaagaggattgcttgaacccaggaggcggaggttgcagtgagctgagatcgcgccactgcactccagcctcggcgacagagcgagactctgtctmgaaaaaaaaaaaaagtaatggcaaaatagaaaaggcatatctatggtgacaggcaatcaagagttgccagaggaggccatgcacggtggctcacacctgtaatcccagcactttgggaggccaaggcaggggggatcacttgaggtcaggagtttgaaaccagcctgcccaatgtggtaaaaccccatctctactaaaaatacaaaaattagccgggcatggtggtgcacacctgtaatcccagttactcaaaaagctgaggcaggagaatcacttgaacctgggaggcagaggctgcag

SEQ ID NO: 43153 - DNA, 601 bp, Human
gagaatcacctgagcctgggaggtcaagattgcagtgagccaagatcaagccactgcactccagcctgggtgacagagtgagactctgccttaaaaacaaacaaacaacccaaggtatataactggaaactcagtaaaaggaaagaaattatgcaataaaataaatgagtctcaaaagcatcatgctcagtgaaacaaaccagaaaggccacacgctctattactccttcaatacgaaaaactattaggctggtgcaaacgtaagtgtggttattgagatagaaggtaatggcggccgggygcggtggctcacgcctgtaatctcagcaccttgggaggctgaggtgagtggatcacctgaggtcaggagttcaagaccagcctgggcaacatggtgagacccctgtctctactaaaaatacaaatattaatggagtgtggtggcacacacctgtagtcccagctactcaggaggctgaggcaagaggattgcttgaacccaggaggcggaggttgcagtgagctgagatcgcgccactgcactccagcctcggcgacagagcgagactctgtctcgaaaaaaaaaaaaagtaatggcaaa

SEQ ID NO: 43154 - DNA, 601 bp, Human
taagcaacatggcaaaaccttgtctctacaaaaaatacaaaaaattagccaggcatggtagcgcacacctgtagtctcagctacttgggaggctgaggtgggagaatcacctgagcctgggaggtcaagattgcagtgagccaagatcaagccactgcactccagcctgggtgacagagtgagactctgccttaaaaacaaacaaacaacccaaggtatataactggaaactcagtaaaaggaaagaaattatgcaataaaataaatgagtctcaaaagcatcatgctcagtgaaacaaaycagaaaggccacacgctctattactccttcaatacgaaaaactattaggctggtgcaaacgtaagtgtggttattgagatagaaggtaatggcggccgggcgcggtggctcacgcctgtaatctcagcaccttgggaggctgaggtgagtggatcacctgaggtcaggagttcaagaccagcctgggcaacatggtgagacccctgtctctactaaaaatacaaatattaatggagtgtggtggcacacacctgtagtcccagctactcaggaggctgaggcaagaggattgcttgaacc

SEQ ID NO: 43155 - DNA, 601 bp, Human
accacccaaaggcccttcagaaagggatgtgtgtcatcgcctaaaataccaaaagtcagacaacccaaatgtccaccaacatacagctggatacataagccatgctatttccacactgtgaaatactacccagtgctcaggaggcaggaagtagggctggacaaggtggctcacacctgtaaacccaacactgtgggaggccgaggtgggcaaatcacttgaggccaggagttcaagaccagcctggccaacatggtgaaaccccgtctctactgaaaatacaaaaattagccaggtgtgrtggtgtgcacctgtaatcccagccacttgggaggctcaggcagaattgctcaaacccaggaggcagaggttgcagtgagccaagatagtgccactgcactccagcctgggtgacagagccagactccatctcaaaaaaaaaaaaaaaaaagaagaagaagccggaagtaagtgtacacgtgctaatatgggaagatggtcaagtctaactgtgcgctgcaaaataagagtcctcatacgattaaacatagaattacccagattccttgagcccaggagttggagaccagcctaagcaaca

SEQ ID NO: 43156 - DNA, 601 bp, Human
agggctgagatgtgaacccaccttggaatgattccacctcatcttgcaatctccctcgatcaaaccttcagcctcccatttcctttttttttttttttttgagacagagtcttattctgtcacccaggctggagtgcagtggtacagtcttggctcactgcacctccacctcctggattcaagcaattcctctgccccagcctccccagtagctgggattacagatgcgcaccaccacccttggctactttttgtatttttagtagagacggcatttcatcatgttggccagcgtggtctygaacttctgacctcaggtgatctgcccacctcggcctcccaaagtgctgggagtacaggcatgagccactgtgcccagccctcccaacacatttctaatgcctactttccttatgaggccaggagtaggtacctggctgcctgcaatactcacatatattagccctgagaagtaccgctccctcaggttgtgtagcacggaggcttcgttgaggcacgtcagctccgccatgtcctccaccttggagaacttgggtgggttcatcttctggatgtcatctttcccaaccgtgaccttctt

SEQ ID NO: 43157 - DNA, 601 bp, Human
tacccacctggctgccaagacaaaccagcctttccaaagtggttatgagctcttctttactttcaagaggaaggaaggacagagaacgatgccaatgaaatctgttgagagtttatcatacgtcttggcacttggcacatgtgatgacatgggattgtcacacctcctgtctgtaatgagggtgattattcccattttacggataggaaaaccaaggcttcgagagaggaaataacctcttcaagggctgagatgtgaacccaccttggaatgattccacctcatcttgcaatctccctckatcaaaccttcagcctcccatttcctttttttttttttttttgagacagagtcttattctgtcacccaggctggagtgcagtggtacagtcttggctcactgcacctccacctcctggattcaagcaattcctctgccccagcctccccagtagctgggattacagatgcgcaccaccacccttggctactttttgtatttttagtagagacggcatttcatcatgttggccagcgtggtctcgaacttctgacctcaggtgatctgcccacctcggcctcccaaagtgctgggagtaca

SEQ ID NO: 43158 - DNA, 601 bp, Human
tctgcacttatgctacccagtacaccagccactagccacaggtggctattgactacttgacctagggccaacacaacaaaagaaataaatttgttattttttattgtcttttacttatgtatttatttagagatgaagttttgctcttattgcccaagctggagtacaataacgcgattttggctcactgcaacctccatctcccaggttcaagcgattctcctgcctcggcctcccaagtagctgggattacaggcgcacaccatcatgcccagctaatttttgtatttttagtagagayggggttttaccatgttggccaggcttgtctagaactcctgacctcaggtgatccacccaccttggcctcccaaagtgctgggattacaggtgtgagcccacgcacccagctaataaattttttaatgtttcttttttttttttttttttttttgagatggagtttcgctcttattgcccaggctggagtgcaacggcaccatctcggctcactgcaacctctgcctcccgggttcaagcaattctcctgcctcagcctctcaagtagctgggattacagatgtgcactaccatgcctggc

SEQ ID NO: 43159 - DNA, 601 bp, Human
caaacatttttaactcaggggatgctgtgttaaataaaatacaatgtgtcaatgtacagcacttggattggaggacatatttaatagttacggccaggcacagtggctcacacccgtaatcccagcgccgtgaaaagtcaaggcaggagatggcttgaggccaggagtttgagaccagcctgggcaatatagtgagatcccagtctctacagaagtttttttttttttttttaattagccaggtgtggtggtgcacacctgtggtccacagctactcaggaggctgaggtgagaggatcgyttgaatccaggacttggaagctgtactgagctacgatagaaccactgcactccagcctcaaagacagagtaagcccccatctcaaaaaaaaaaaaaaaagttatgagttgctaagttgctcactcttaccatttggctctttaaaaagccactctaactccttctgaaatatctataagaacagtggaaaaatggcctatccccatgacagattctatactaccccttacaaggggtatctttggggcttcctgagatatattacacaagtcaacactgagcatttccaaatggaaaaaa

SEQ ID NO: 43160 - DNA, 601 bp, Human
cttcccctacttaagaaagtaaagatacattttgcaacactgcacctcagcttccttccctaaaaggggcaaacatttttaactcaggggatgctgtgttaaataaaatacaatgtgtcaatgtacagcacttggattggaggacatatttaatagttacggccaggcacagtggctcacacccgtaatcccagcgccgtgaaaagtcaaggcaggagatggcttgaggccaggagtttgagaccagcctgggcaatatagtgagatcccagtctctacagaagtttttttttttttttttaattagccaggtgtggtggtgcacacctgtggtccacagctactcaggaggctgaggtgagaggatcgtttgaatccaggacttggaagctgtactgagctacgatagaaccactgcactccagcctcaaagacagagtaagcccccatctcaaaaaaaaaaaaaaaagttatgagttgctaagttgctcactcttaccatttggctctttaaaaagccactctaactccttctgaaatatctataagaacagtggaaaaatggcctatccccatgacagattctatactaccccttaca

SEQ ID NO: 43161 - DNA, 601 bp, Human
cttcactccagcctgagcaacaaaagtgaaattccatctcaaaaaaaaaaaaaagaagaaagaaagaaaaagaaaatgtccaccatacaaacagccccagatcaataatttttccatacaaacagtgccacagacaagagacttcccctacttaagaaagtaaagatacattttgcaacactgcacctcagcttccttccctaaaaggggcaaacatttttaactcaggggatgctgtgttaaataaaatacaatgtgtcaatgtacagcacttggattggaggacatatttaatagttayggccaggcacagtggctcacacccgtaatcccagcgccgtgaaaagtcaaggcaggagatggcttgaggccaggagtttgagaccagcctgggcaatatagtgagatcccagtctctacagaagtttttttttttttttttaattagccaggtgtggtggtgcacacctgtggtccacagctactcaggaggctgaggtgagaggatcgtttgaatccaggacttggaagctgtactgagctacgatagaaccactgcactccagcctcaaagacagagtaagcccccatctcaaaaaaa

SEQ ID NO: 43162 - DNA, 601 bp, Human
atgatacgtcttagatggaagacctgggccccaaagagtccaattttccctctagctccctacagacgggcctctttagaaatatccaacatactggctgggcgtggtggttcaggcctgtgatcccagcactttgggaggccgaggcaagtggatcacctgaggtcaggagttggagaccagcctagccaacatggtgaaacccgtctctactaaaaatacaaaaatcagccaggcatggtggcacatccctgcaatcccagctactcgggaggctgaagcaggagaatcacttcaaccygggaggtggaggttgcaatgagccaagatcgctccacttcactccagcctgagcaacaaaagtgaaattccatctcaaaaaaaaaaaaaagaagaaagaaagaaaaagaaaatgtccaccatacaaacagccccagatcaataatttttccatacaaacagtgccacagacaagagacttcccctacttaagaaagtaaagatacattttgcaacactgcacctcagcttccttccctaaaaggggcaaacatttttaactcaggggatgctgtgttaaataaaatacaatgtgtcaatg

SEQ ID NO: 43163 - DNA, 601 bp, Human
ctgtccagagaagcatagcaggaatttgaagctttgattcatttatttttaatctgctgtcagaagatattttgggtctcaggaccttcatatgccctttttttttctgatttctatttgaggacagcaggtgagatgaatacacaggcctgtcctgaaactccctagatggtgatgatacgtcttagatggaagacctgggccccaaagagtccaattttccctctagctccctacagacgggcctctttagaaatatccaacatactggctgggcgtggtggttcaggcctgtgatccyagcactttgggaggccgaggcaagtggatcacctgaggtcaggagttggagaccagcctagccaacatggtgaaacccgtctctactaaaaatacaaaaatcagccaggcatggtggcacatccctgcaatcccagctactcgggaggctgaagcaggagaatcacttcaacccgggaggtggaggttgcaatgagccaagatcgctccacttcactccagcctgagcaacaaaagtgaaattccatctcaaaaaaaaaaaaaagaagaaagaaagaaaaagaaaatgtccaccatacaa

SEQ ID NO: 43164 - DNA, 601 bp, Human
tatcttctccgtcatggacgacggtttctattaagcaattaaactgaccagaaaggaacaagagaagagcgggaccatcatcacaaggctgaaaggattttaatctaatctgtccagagaagcatagcaggaatttgaagctttgattcatttatttttaatctgctgtcagaagatattttgggtctcaggaccttcatatgccctttttttttctgatttctatttgaggacagcaggtgagatgaatacacaggcctgtcctgaaactccctagatggtgatgatacgtcttagatgraagacctgggccccaaagagtccaattttccctctagctccctacagacgggcctctttagaaatatccaacatactggctgggcgtggtggttcaggcctgtgatcccagcactttgggaggccgaggcaagtggatcacctgaggtcaggagttggagaccagcctagccaacatggtgaaacccgtctctactaaaaatacaaaaatcagccaggcatggtggcacatccctgcaatcccagctactcgggaggctgaagcaggagaatcacttcaacccgggaggtggaggttgca

SEQ ID NO: 43165 - DNA, 601 bp, Human
tccttctttatcttctccgtcatggacgacggtttctattaagcaattaaactgaccagaaaggaacaagagaagagcgggaccatcatcacaaggctgaaaggattttaatctaatctgtccagagaagcatagcaggaatttgaagctttgattcatttatttttaatctgctgtcagaagatattttgggtctcaggaccttcatatgccctttttttttctgatttctatttgaggacagcaggtgagatgaatacacaggcctgtcctgaaactccctagatggtgatgatacgtcttagatggaagacctgggccccaaagagtccaattttccctctagctccctacagacgggcctctttagaaatatccaacatactggctgggcgtggtggttcaggcctgtgatcccagcactttgggaggccgaggcaagtggatcacctgaggtcaggagttggagaccagcctagccaacatggtgaaacccgtctctactaaaaatacaaaaatcagccaggcatggtggcacatccctgcaatcccagctactcgggaggctgaagcaggagaatcacttcaacccgggaggtgg

SEQ ID NO: 43166 - DNA, 601 bp, Human
gagtaagttactgtgctcccccaccccaacccctttccttctttatcttctccgtcatggacgacggtttctattaagcaattaaactgaccagaaaggaacaagagaagagcgggaccatcatcacaaggctgaaaggattttaatctaatctgtccagagaagcatagcaggaatttgaagctttgattcatttatttttaatctgctgtcagaagatattttgggtctcaggaccttcatatgccctttttttttctgatttctatttgaggacagcaggtgagatgaatacacaggmctgtcctgaaactccctagatggtgatgatacgtcttagatggaagacctgggccccaaagagtccaattttccctctagctccctacagacgggcctctttagaaatatccaacatactggctgggcgtggtggttcaggcctgtgatcccagcactttgggaggccgaggcaagtggatcacctgaggtcaggagttggagaccagcctagccaacatggtgaaacccgtctctactaaaaatacaaaaatcagccaggcatggtggcacatccctgcaatcccagctactcgggagg

SEQ ID NO: 43167 - DNA, 601 bp, Human
caccctggccctggactcacacagaccttgtctgaatcccagctctgcccaccttccagtggtgggactaagcacatctgagcttcagcaacctcatcttttttttttttttttttttttttttttgagatgtagtctcactctgtcacccaggctggagtgcagtggcacaatatcatgcctgtaatcctaacactttgggaggccgaagtggtgaagattgcttgagctcaggagttcgagatctgtttgggcaatacggtgtgaccccacctctaccaaaaacacaaaaaaattagcygggcatcgtgctacatgcctgtagtcccagctactaaggagactgagataggatcccttgagttccaggaggcagaggttgcagtgagctgagatcatgccactgtactccagcctgggcaacagagtaagaccccatctcaaaagaaagaaaaagaaaaaagaagaaagaaaaaagaagacagaaagacagagaaagaaaggaagaaagagagagggagggagggagggaggaaggaaggaaggaaggaaggaagggaggaacgaactaactaactcgaggcagacgaactcagccaaa

SEQ ID NO: 43168 - DNA, 601 bp, Human
ggctacatatgtaaccagcaaccacagtgtctctaagaaggggaactggaagggcgagaaataggaacgaagggggaagttctatattcccttatacactattttatttcatatttgcatgtcttacctattcaaaaacatattttaagtctgactagatagttatgaacagacagaaaaaactataaggtagggttaagtggaaaaaaaatcatactgcaaaacatacaaggagtgactttttcttatgtttggggtgtgtgtgtgtgtgtgtgtgtgtgtgtgtgtgtgtgtacatacrtgaacctgtgaatcatgtttgcctccagggaagagggctgctttttgtgatacatacttatttttaaatattctcctgaggtctttgcatagattatccttgtattactggaggaggttctttgaagcaataatgacttgaaagatcagaaggctgggtgcagtggctcatgcctgtaatcccagcacgttgggaggcggaggtgggaggatcatctgagttcaggagttcaagaccaacctggccaacatggtgaaaccacttctctactaaaaatacaaaaattagctgggcgtggtg

SEQ ID NO: 43169 - DNA, 601 bp, Human
agagtgagactccatctcgaaaaataatataaataaataaataacatgactggagggctacatatgtaaccagcaaccacagtgtctctaagaaggggaactggaagggcgagaaataggaacgaagggggaagttctatattcccttatacactattttatttcatatttgcatgtcttacctattcaaaaacatattttaagtctgactagatagttatgaacagacagaaaaaactataaggtagggttaagtggaaaaaaaatcatactgcaaaacatacaaggagtgactttttcktatgtttggggtgtgtgtgtgtgtgtgtgtgtgtgtgtgtgtgtgtgtacatacatgaacctgtgaatcatgtttgcctccagggaagagggctgctttttgtgatacatacttatttttaaatattctcctgaggtctttgcatagattatccttgtattactggaggaggttctttgaagcaataatgacttgaaagatcagaaggctgggtgcagtggctcatgcctgtaatcccagcacgttgggaggcggaggtgggaggatcatctgagttcaggagttcaagaccaacctggc

SEQ ID NO: 43170 - DNA, 601 bp, Human
ctcagctacttgggaggctgagggaggagaattgcttgaacctgggagggggctgttgcagtgagccaagatcatgccacttcactccagtctgggtgagagagtgagactccatctcgaaaaataatataaataaataaataacatgactggagggctacatatgtaaccagcaaccacagtgtctctaagaaggggaactggaagggcgagaaataggaacgaagggggaagttctatattcccttatacactattttatttcatatttgcatgtcttacctattcaaaaacatatttkaagtctgactagatagttatgaacagacagaaaaaactataaggtagggttaagtggaaaaaaaatcatactgcaaaacatacaaggagtgactttttcttatgtttggggtgtgtgtgtgtgtgtgtgtgtgtgtgtgtgtgtgtgtacatacatgaacctgtgaatcatgtttgcctccagggaagagggctgctttttgtgatacatacttatttttaaatattctcctgaggtctttgcatagattatccttgtattactggaggaggttctttgaagcaataatgacttgaaaga

SEQ ID NO: 43171 - DNA, 601 bp, Human
acagggatggccgggcgcagtggctcacacctgtaatcccggcactttgggaggccaaggtgggtggatcacctgaggtcaagagttcgagaccagcccggccaacacagtgaaacctcatctctactaaaaatacaaaaattagcaaggtgtggtggcgcgtgcctgtaatcccagctactcgggaagctgaggcaggagaactgcttgaactcaggtggcagaggttgcagtgagctgagattgtgccactccactccagcctgggtgatacagcgagacttggtctcaaaaaaaaaaagacacacaggcctgggcagagtgttggctttgccttatcacctgcctgacttgtgcatacagacctacccctgagcttcctcagtaaagtgatggataatcacggcttctttatgaagctgcagtgcaatatcacggctttctaaatacccaacctagagacagacgtggtccaccaagcacgtgcttttgctgcagccttgcttttaagagcaaaaagactagaaacaacctaaatacctgtcaatagcagacaggcttaatcattatggttcatccctatagcagaagactgtgcagt

SEQ ID NO: 43172 - DNA, 601 bp, Human
agcagctccagtttttctctgacgctttatatggtcagccacagagccctgagcagggggtgctcccggggcctgcagcagaaatgaggaacagggagggaagggagggaagtggaaggaacactggctttcagacacacagggatggccgggcgcagtggctcacacctgtaatcccggcactttgggaggccaaggtgggtggatcacctgaggtcaagagttcgagaccagcccggccaacacagtgaaacctcatctctactaaaaatacaaaaattagcaaggtgtggtggcgcgygcctgtaatcccagctactcgggaagctgaggcaggagaactgcttgaactcaggtggcagaggttgcagtgagctgagattgtgccactccactccagcctgggtgatacagcgagacttggtctcaaaaaaaaaaagacacacaggcctgggcagagtgttggctttgccttatcacctgcctgacttgtgcatacagacctacccctgagcttcctcagtaaagtgatggataatcacggcttctttatgaagctgcagtgcaatatcacggctttctaaatacccaacctagagac

SEQ ID NO: 43173 - DNA, 601 bp, Human
tggccccacgagcccctctccagctggttaaattcagaggtttcaacatcccagcctcctgtgtcccagccggcatctcatgggccctgtgccaccagcaagtcccagctgcaggcccaggatttccctcttgtgaccgtattaggaagcagctccagtttttctctgacgctttatatggtcagccacagagccctgagcagggggtgctcccggggcctgcagcagaaatgaggaacagggagggaagggagggaagtggaaggaacactggctttcagacacacagggatggccgggygcagtggctcacacctgtaatcccggcactttgggaggccaaggtgggtggatcacctgaggtcaagagttcgagaccagcccggccaacacagtgaaacctcatctctactaaaaatacaaaaattagcaaggtgtggtggcgcgtgcctgtaatcccagctactcgggaagctgaggcaggagaactgcttgaactcaggtggcagaggttgcagtgagctgagattgtgccactccactccagcctgggtgatacagcgagacttggtctcaaaaaaaaaaagacacacaggcctgg

SEQ ID NO: 43174 - DNA, 601 bp, Human
caacccgtctcacaggaactgctttccccaaacgataaacatcagtactgcccaagactctgatggccataaagcgtatcctcttccctgcaagtgacttagggagaaccacagatccatctctcagttacagctagggtgaaccaagcaacagagggttaagtgacttgaccgaggtcaccaaagaagatcctggcagcaccaagcccagcctggcccgcccccaggtatgagcatggtccattatgctatccagcctaggcccatccaacagaaacagaaactactgatcgttcgttcrttcattcattcattcattcattcattcattcattctgtacgtcccagatgccatgcaaaaggtgctgggactacattagaacattaaaaaaacacaggatcccagccctcaagggccttttagtcaagggctggagccaattagagagtgggaaagtctggctgggtgtggtggctcacaactgtaatcccagcactttgggaggtcaaggcaggaagattgcttgagcccagaagtctgagaccagcttgggcagcacagtgagacccccatctctataagaaatttaaaaattagctg

SEQ ID NO: 43175 - DNA, 601 bp, Human
ccctctctacaaaaaaaaaaaaaaaaaaaaaatagctggccatggtggtgatcacctgtagtcccagctacttgggaggctgagtcaggaggattgcttgatcccaggagctcaaggttatagtgagctatgattgtaccattgcactctagcccctgggtgacagagcaagaccctgtcttgaaattgatagctgtacaacattgtgaatgcacttaatggcactgttttctttaaaatgtttaaaatggtaaattttatgtcatatgcactttaccatttaaaaaatagcagtcctctyctactgggtgaataggagcatctgaaaataatcagatcagggacggaggagtcaaggcacaaggcgagtcccgccatgctgtacgtggtaaggcactattgtcatgatttttccttactggatactagattttcccatggttgaggtcacagttcaggagacaggctccaacccgtctcacaggaactgctttccccaaacgataaacatcagtactgcccaagactctgatggccataaagcgtatcctcttccctgcaagtgacttagggagaaccacagatccatctctcagttaca

SEQ ID NO: 43176 - DNA, 601 bp, Human
agtgctgggattacaggtgggaaccaccgcactcagccagagagggaatgtcgttaactgaacattggaggcatagaaagccacacacccctaaaaaggggctgtccagagggatccgcagtcatacagaaacacagctgccaaaactgtggtccaggagggagggaggaaaaggtaataatcctccaagctctctctcctcccaccaccctctgatctctttctgggacctcccaatgtccatatctaagaagaaaccccagtgactcagtctctagaagatggcagaggcatctccgcrtggcatcttcacaactactcagtaacagtgatttccccaccgcctgtttgacaggagggcaaagtgaggcatggtgaggttgtcaccaggttacacagctggagggaagttgggaactagaactcctgtttaccccacagcgcctgctcctgatcattaataccttccccatctgcaaaacagagaccaacactgacatgagctctccaatgtggatgaagcttgaaaatatgcctagtgaaagaagccaggcacgaaaagtcacgtactctatcatctcatttatgtgaagtgtctaga

SEQ ID NO: 43177 - DNA, 601 bp, Human
aaagtgctgggattacaggtgggaaccaccgcactcagccagagagggaatgtcgttaactgaacattggaggcatagaaagccacacacccctaaaaaggggctgtccagagggatccgcagtcatacagaaacacagctgccaaaactgtggtccaggagggagggaggaaaaggtaataatcctccaagctctctctcctcccaccaccctctgatctctttctgggacctcccaatgtccatatctaagaagaaaccccagtgactcagtctctagaagatggcagaggcatctcckcatggcatcttcacaactactcagtaacagtgatttccccaccgcctgtttgacaggagggcaaagtgaggcatggtgaggttgtcaccaggttacacagctggagggaagttgggaactagaactcctgtttaccccacagcgcctgctcctgatcattaataccttccccatctgcaaaacagagaccaacactgacatgagctctccaatgtggatgaagcttgaaaatatgcctagtgaaagaagccaggcacgaaaagtcacgtactctatcatctcatttatgtgaagtgtcta

SEQ ID NO: 43178 - DNA, 601 bp, Human
ataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggagcagttaagtctgaagagcaagaacagaagagaatgttgtttacttttttttttttttgagacagggtcttgctctgtcrcccaggctgcagtgtagtggggtgatcttggctcactacaaccttgagtttctgggcttaagtgatcctctcgcctcagcctcccaagtaggtggtaccacaggtgtgcacaaccatgcccaggtaatttttattttgttttttgtagagacagggtttcaccatattgcccaggctggtctcgaactcctgagctgaggtgatgcgccagtctcagcctcccaaagtgctgggattacaggtgggaaccaccgcactcagccagagagggaatgtcgttaactgaacattggaggcata

SEQ ID NO: 43179 - DNA, 601 bp, Human
tttgaagagctctgggttcaaatctcagctccactcctccgagctgccactttacctccccggacctcactggcttaaataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggagyagttaagtctgaagagcaagaacagaagagaatgttgtttacttttttttttttttgagacagggtcttgctctgtcgcccaggctgcagtgtagtggggtgatcttggctcactacaaccttgagtttctgggcttaagtgatcctctcgcctcagcctcccaagtaggtggtaccacaggtgtgcacaaccatgcccaggtaatttttattttgttttttgtagagacagggtttcaccatattgcccaggctggtctcgaactcctgagctgaggtgatgcgccagtctcagcctcc

SEQ ID NO: 43180 - DNA, 601 bp, Human
gttttgaagagctctgggttcaaatctcagctccactcctccgagctgccactttacctccccggacctcactggcttaaataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggrgcagttaagtctgaagagcaagaacagaagagaatgttgtttacttttttttttttttgagacagggtcttgctctgtcgcccaggctgcagtgtagtggggtgatcttggctcactacaaccttgagtttctgggcttaagtgatcctctcgcctcagcctcccaagtaggtggtaccacaggtgtgcacaaccatgcccaggtaatttttattttgttttttgtagagacagggtttcaccatattgcccaggctggtctcgaactcctgagctgaggtgatgcgccagtctcagcct

SEQ ID NO: 43181 - DNA, 601 bp, Human
ctgtgttgctcaggctggtctcaaattcctgggctcaagcaattctctcatttcagcctcccaaagcactgggattatagttgtgagccattgcacctggccaaactgtggagttttgaagagctctgggttcaaatctcagctccactcctccgagctgccactttacctccccggacctcactggcttaaataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggagcagttaagtctgaagagcaagaacagaagagaatgttgtttacttttttttttttttgagacagggtcttgctctgtcgcccaggctgcagtgtagtggggtgatcttggctcactacaaccttgagtttctgggcttaagtgatcctctcgcctcagcctcccaagtaggtggtaccacaggtgtg

SEQ ID NO: 43182 - DNA, 601 bp, Human
tcactgtgttgctcaggctggtctcaaattcctgggctcaagcaattctctcatttcagcctcccaaagcactgggattatagttgtgagccattgcacctggccaaactgtggagttttgaagagctctgggttcaaatctcagctccactcctccgagctgccactttacctccccggacctcactggcttaaataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggagcagttaagtctgaagagcaagaacagaagagaatgttgtttacttttttttttttttgagacagggtcttgctctgtcgcccaggctgcagtgtagtggggtgatcttggctcactacaaccttgagtttctgggcttaagtgatcctctcgcctcagcctcccaagtaggtggtaccacaggt

SEQ ID NO: 43183 - DNA, 601 bp, Human
gtggtgtgaacgtgactcactgaaaccttgacctttctggactcaggtgatcctcctacctcagcctcctgagtagccaggactacaggcgggcgccaccaggcctggctgatgtttatattttctgtagagacatgggtttcactgtgttgctcaggctggtctcaaattcctgggctcaagcaattctctcatttcagcctcccaaagcactgggattatagttgtgagccattgcacctggccaaactgtggagttttgaagagctctgggttcaaatctcagctccactcctccgasctgccactttacctccccggacctcactggcttaaataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggagcagttaagtctgaagagcaagaacagaagagaatgttgtttac

SEQ ID NO: 43184 - DNA, 601 bp, Human
cagaagaggccagagtacgtctgcagacagagaacccagcttacttccagacctcctccagggtagacagattgcacagaagcactcaatattctcatgttagagatggggaaactggagcttggagtcttagtggaaaccctgggcctcactgatattccaggtacgtgggaagaggagaaagggcgagagtgggtttccaagctgcctatgttttattttgcaactgtggggggttttgtgtttgttttgagatggggtctcactctgtcacctaggctggagtgcggtggtgtgaacrtgactcactgaaaccttgacctttctggactcaggtgatcctcctacctcagcctcctgagtagccaggactacaggcgggcgccaccaggcctggctgatgtttatattttctgtagagacatgggtttcactgtgttgctcaggctggtctcaaattcctgggctcaagcaattctctcatttcagcctcccaaagcactgggattatagttgtgagccattgcacctggccaaactgtggagttttgaagagctctgggttcaaatctcagctccactcctccgagctgccacttta

SEQ ID NO: 43185 - DNA, 601 bp, Human
gccaaactccacattcctggcaagaactgcagacaagcaggacaggaggggctccctggagctggccccgtgcagccctgagttcactcaccttgaagcatgctccggtaggccgtgtctgcgatggcgtagatgtgaggcggcatctcgtgcctcttcttgcccttgtacatgtcgacgatcttctccgagtagatgggcaggtgtttataggggttgaccaccacgcagaagaggccagagtacgtctgcagacagagaacccagcttacttccagacctcctccagggtagacagatygcacagaagcactcaatattctcatgttagagatggggaaactggagcttggagtcttagtggaaaccctgggcctcactgatattccaggtacgtgggaagaggagaaagggcgagagtgggtttccaagctgcctatgttttattttgcaactgtggggggttttgtgtttgttttgagatggggtctcactctgtcacctaggctggagtgcggtggtgtgaacgtgactcactgaaaccttgacctttctggactcaggtgatcctcctacctcagcctcctgagtagccaggact

SEQ ID NO: 43186 - DNA, 601 bp, Human
gggcccatgcccgtatttgcccaagctcttggctctccctcaccctcccaggctgcaaacacagatgttccttttgctttttccctttttcagccacagtaactcctggtccctcgcagtgcctgccaaactccacattcctggcaagaactgcagacaagcaggacaggaggggctccctggagctggccccgtgcagccctgagttcactcaccttgaagcatgctccggtaggccgtgtctgcgatggcgtagatgtgaggcggcatctcgtgcctcttcttgcccttgtacatgtcracgatcttctccgagtagatgggcaggtgtttataggggttgaccaccacgcagaagaggccagagtacgtctgcagacagagaacccagcttacttccagacctcctccagggtagacagattgcacagaagcactcaatattctcatgttagagatggggaaactggagcttggagtcttagtggaaaccctgggcctcactgatattccaggtacgtgggaagaggagaaagggcgagagtgggtttccaagctgcctatgttttattttgcaactgtggggggttttgtgtttgtt

SEQ ID NO: 43187 - DNA, 601 bp, Human
ggaaactgaggctgaagaggaaaagatatttacccacagtcccacaggggttgagggacaggtaggtgtcaacacagaccacaatggctcagccccagggctgttccccaccctctttccatcctttgcagacagctggcccgacggggcccttgggcagcgagccccggagctggagctggagcgggcccatgcccgtatttgcccaagctcttggctctccctcaccctcccaggctgcaaacacagatgttccttttgctttttccctttttcagccacagtaactcctggtccctcrcagtgcctgccaaactccacattcctggcaagaactgcagacaagcaggacaggaggggctccctggagctggccccgtgcagccctgagttcactcaccttgaagcatgctccggtaggccgtgtctgcgatggcgtagatgtgaggcggcatctcgtgcctcttcttgcccttgtacatgtcgacgatcttctccgagtagatgggcaggtgtttataggggttgaccaccacgcagaagaggccagagtacgtctgcagacagagaacccagcttacttccagacctcctccagggt

SEQ ID NO: 43188 - DNA, 601 bp, Human
gaccctgtctcaaaaataataaaacaatagtaaaaataataacgtataaacatgaaagtaataggcacaagtcttaagtttggaaaaaccagcattaacaatcttcacaagaagctacaagatagagactatcaccccttttgacaaatgaggaaactgaggctgaagaggaaaagatatttacccacagtcccacaggggttgagggacaggtaggtgtcaacacagaccacaatggctcagccccagggctgttccccaccctctttccatcctttgcagacagctggcccgacggggmccttgggcagcgagccccggagctggagctggagcgggcccatgcccgtatttgcccaagctcttggctctccctcaccctcccaggctgcaaacacagatgttccttttgctttttccctttttcagccacagtaactcctggtccctcgcagtgcctgccaaactccacattcctggcaagaactgcagacaagcaggacaggaggggctccctggagctggccccgtgcagccctgagttcactcaccttgaagcatgctccggtaggccgtgtctgcgatggcgtagatgtgaggc

SEQ ID NO: 43189 - DNA, 601 bp, Human
gcctgatgatctgtcactgtctcccatcacccccagatgggaccgtctagttgcaggaaaacaagctcagggctcccactgattctacatgatggtgagttgtataatgatttcattatatatgacaatgtaatcatagaaataaagtgcacaataaatgtaatgcgctcgaatcatcccgaaccatctctcccctgcggtccatggaaaaactgacttctatgaaactggtccctggtgtcaaaaaggttggggactgctggtctaggaaagcaaaagtccccacaacacaaaagtattyttcaatgactacaagagcgatcaaactccaccgaaacctccttctccgacgattcagtggcttcaccttgccaattattgggtatcaatagccaccatcatgatatgaacacaaaacaaagtggcagttctggaaaacaaggtgcagtgactggcaaagtcagtggccttggaaaggccaaaaaaaagattcaggggccaagtgtggtggtgcacacctgtaatcccaccactttgggaggccgaggtgggaggatcacctgaggccaggagttcaagaccagtctgaccaacatggtaa

SEQ ID NO: 43190 - DNA, 601 bp, Human
tttttgtagagacaagagctcactatgttggccaggctggtctctaactcctggcctcaagtgatcctcctgccttggcctcccaaagtgctaggactgaagacatgctgctgtgctcaatcatgatagtcatttcctattggagcttactatgtgtcaagtgagcatttctaagtagtttcaagagagctgactatgcaattttgtgttaaaacctagagaccatgaggaatcaaatatatgaacacagggtgtccttgtcaattacaacattgcctcacagttaagaggtggtctagcrcaggcatctcaaaccaccgactggtactgcacagcaggaggtgagtagtgggcttcatctgtatttacagccactccctatcactccaattactgcctgagctctgcttcctctcagatcagaggcggcattagactcttatagaaccaccaaccctactgtgaactgcacataagagggatccaggctgtgtgctccttatgagaatctaatgcctgatgatctgtcactgtctcccatcacccccagatgggaccgtctagttgcaggaaaacaagctcagggctcccactgattcta

SEQ ID NO: 43191 - DNA, 601 bp, Human
atttaaattaagtaaagagtttatcttttatggatgtgcatattcacggttttcattttctttctttctttcgtgacagggtcttactctgttgccaaggctggagtaccatagcacgatcatagcacactgcattcttgaagtcctgggctcaagccatcctcctgcctcagcctccagagtagctaggactacagactcacgcactgtggccagctaattatttttttgtagagacaagagctcactatgttggccaggctggtctctaactcctggcctcaagtgatcctcctgcctyggcctcccaaagtgctaggactgaagacatgctgctgtgctcaatcatgatagtcatttcctattggagcttactatgtgtcaagtgagcatttctaagtagtttcaagagagctgactatgcaattttgtgttaaaacctagagaccatgaggaatcaaatatatgaacacagggtgtccttgtcaattacaacattgcctcacagttaagaggtggtctagcgcaggcatctcaaaccaccgactggtactgcacagcaggaggtgagtagtgggcttcatctgtatttacagccact

SEQ ID NO: 43192 - DNA, 601 bp, Human
cccgattctttttatttttggagtccgccatcaatgatttgccagaaagcaccaggtcatgccaaaatagacgagggcatagcaggtgttggttaacatttaaattaagtaaagagtttatcttttatggatgtgcatattcacggttttcattttctttctttctttcgtgacagggtcttactctgttgccaaggctggagtaccatagcacgatcatagcacactgcattcttgaagtcctgggctcaagccatcctcctgcctcagcctccagagtagctaggactacagactcacrcactgtggccagctaattatttttttgtagagacaagagctcactatgttggccaggctggtctctaactcctggcctcaagtgatcctcctgccttggcctcccaaagtgctaggactgaagacatgctgctgtgctcaatcatgatagtcatttcctattggagcttactatgtgtcaagtgagcatttctaagtagtttcaagagagctgactatgcaattttgtgttaaaacctagagaccatgaggaatcaaatatatgaacacagggtgtccttgtcaattacaacattgcctc

SEQ ID NO: 43193 - DNA, 601 bp, Human
cgatctcctgatctcatgatccccccaccttggcctcccaaagtgctgggattacaggcgttagccaccgtgcccgattctttttatttttggagtccgccatcaatgatttgccagaaagcaccaggtcatgccaaaatagacgagggcatagcaggtgttggttaacatttaaattaagtaaagagtttatcttttatggatgtgcatattcacggttttcattttctttctttctttcgtgacagggtcttactctgttgccaaggctggagtaccatagcacgatcatagcacactrcattcttgaagtcctgggctcaagccatcctcctgcctcagcctccagagtagctaggactacagactcacgcactgtggccagctaattatttttttgtagagacaagagctcactatgttggccaggctggtctctaactcctggcctcaagtgatcctcctgccttggcctcccaaagtgctaggactgaagacatgctgctgtgctcaatcatgatagtcatttcctattggagcttactatgtgtcaagtgagcatttctaagtagtttcaagagagctgactatgcaattttgt

SEQ ID NO: 43194 - DNA, 601 bp, Human
ttgtcaaaactaagataaaattatactgggactctgatatgaggcatgtgtgttggaacgaggaaataggggcaaatccagagggtgaatgagctaaatttcatctttcatggaggaaagtcaatagatgatacctaaaattgaaaacaaaattaagatagcagcacaatgatcaagtgttgttttcagagatatggtggtaaataccaaaaaaaaaaaaaatcaattaaaggagttgagaagtagcagaggatggctatttttcttaataagccttcaaaaattacttgactctaagccrtctgcatgaatacttttaacaaaaataaaaaccaattttttaaaaaagggaacaaggaattcctacatgcactgatatgtaacatcctctggcaaaatataggactgtatatatatggaatgctagtatttgtagggaaatcttagggaagaaaatagatacctatttgcttatacttgcaaaaatatctctaggagaaaacctcatacactagaaaccataattgtctcttgggagggaagctaagggtctaatgcacaagggttgaagggagaagttcaccttttgaatttgtatgta

SEQ ID NO: 43195 - DNA, 601 bp, Human
taacatctacataatcataataatgtaaactctagatagcattacatagtcataataatggaaactctgaacactgagtttgtcaaaactaagataaaattatactgggactctgatatgaggcatgtgtgttggaacgaggaaataggggcaaatccagagggtgaatgagctaaatttcatctttcatggaggaaagtcaatagatgatacctaaaattgaaaacaaaattaagatagcagcacaatgatcaagtgttgttttcagagatatggtggtaaataccaaaaaaaaaaaaaatcaattaaaggagttgagaagtagcagaggatggctatttttcttaataagccttcaaaaattacttgactctaagccgtctgcatgaatacttttaacaaaaataaaaaccaattttttaaaaaagggaacaaggaattcctacatgcactgatatgtaacatcctctggcaaaatataggactgtatatatatggaatgctagtatttgtagggaaatcttagggaagaaaatagatacctatttgcttatacttgcaaaaatatctctaggagaaaacctcatacactagaaaccat

SEQ ID NO: 43196 - DNA, 601 bp, Human
tttagaaagagattttggggcagaattggtggttaaatacatggaaaacaagattggggaaaaaaaaggcaattgctaactccaggaaaaagaaaagtcatacagaaagaagaaaaatagtcacaaagcagtgcaaagctcagctttgaataacatctacataatcataataatgtaaactctagatagcattacatagtcataataatggaaactctgaacactgagtttgtcaaaactaagataaaattatactgggactctgatatgaggcatgtgtgttggaacgaggaaatagggkcaaatccagagggtgaatgagctaaatttcatctttcatggaggaaagtcaatagatgatacctaaaattgaaaacaaaattaagatagcagcacaatgatcaagtgttgttttcagagatatggtggtaaataccaaaaaaaaaaaaaatcaattaaaggagttgagaagtagcagaggatggctatttttcttaataagccttcaaaaattacttgactctaagccgtctgcatgaatacttttaacaaaaataaaaaccaattttttaaaaaagggaacaaggaattcctacatgca

SEQ ID NO: 43197 - DNA, 601 bp, Human
tccaatacatgtctggacatattaaaaggagattaacacatttagaaagagattttggggcagaattggtggttaaatacatggaaaacaagattggggaaaaaaaaggcaattgctaactccaggaaaaagaaaagtcatacagaaagaagaaaaatagtcacaaagcagtgcaaagctcagctttgaataacatctacataatcataataatgtaaactctagatagcattacatagtcataataatggaaactctgaacactgagtttgtcaaaactaagataaaattatactgggaytctgatatgaggcatgtgtgttggaacgaggaaataggggcaaatccagagggtgaatgagctaaatttcatctttcatggaggaaagtcaatagatgatacctaaaattgaaaacaaaattaagatagcagcacaatgatcaagtgttgttttcagagatatggtggtaaataccaaaaaaaaaaaaaatcaattaaaggagttgagaagtagcagaggatggctatttttcttaataagccttcaaaaattacttgactctaagccgtctgcatgaatacttttaacaaaaataaaaa

SEQ ID NO: 43198 - DNA, 601 bp, Human
gtcatatgaaagaaacatttaaaaataaaatagaatttttggaatttaataaaatatataccagaaatttaaaacgcaatggaagggttagggaaaaaagttgaggtaagtgcccagaaaataccattaaaaacattaaagtgatgaaaatgacaaaagaaagagatttaaattataggattggtctaggaattccattatggaaataaaaagacttctaagaaaaagaaacagagaacacagggagaaagacagcatcaatgaaataatttgcaacatttcccagaatttgtggacacamgtttatagattaattgggccactaagtgtccaggataacaaataaaaatggactcatagcaagtcccatcatcctgaataggggtacaaagacagtctaaaagcttctagagaaggaggaaaaacaaaaactggtcatgtacaaaggatcaagaatattcccagccaggaaggtgaatataatcacacacacacacactcacaaacatacacacatacgaatcagattgggtttcatcttctcaaaactgaaactagaaggcaacaacacaaatgccttaaaaagctcaggcaaaaaaag

SEQ ID NO: 43199 - DNA, 601 bp, Human
gggggaaaaggcaaaaaaaaaaaagtgtaaaaaggccgggcgtggtggttcacgcctgtaatcccagcactttgggaggctgaggtgagtggatcacctgaggtcaggagctcgagacgagcctggccaacccgtctctactaaaaatacagaaattagctgggcatggtggcatgcacctgtaatcccagctactcaggaggctgaggctgcagaatcgcttgatcctgggaggtggaggctgcagtgagcagagatcgtgcactccagcttgcgcgacaagagggaaactccatcccccaaaaaaaaacaaacaaaccaaaaagtgtaaaaatacatgaggcagtttaaaaagaactagagaggggagaacagcaaagccatcttggaagacagaaaatgggataagcgttgaaaagtaccaagaaaaagtccagacaccgtggctcacgcctgtaatcccagcactttgggaggccgagttgggtggatcacctaaggtcgggagttcaagaccagcctgaccaacatggttgaaccccatctctatttaaaatacaaaaattagccgggtgtggtggcggatgcctgtaatcccagc

SEQ ID NO: 43200 - DNA, 601 bp, Human
cctggaaaatataacaagaccccattctccacacaaaagaggggggaaaaggcaaaaaaaaaaaagtgtaaaaaggccgggcgtggtggttcacgcctgtaatcccagcactttgggaggctgaggtgagtggatcacctgaggtcaggagctcgagacgagcctggccaacccgtctctactaaaaatacagaaattagctgggcatggtggcatgcacctgtaatcccagctactcaggaggctgaggctgcagaatcgcttgatcctgggaggtggaggctgcagtgagcagagatcrtgcactccagcttgcgcgacaagagggaaactccatcccccaaaaaaaaacaaacaaaccaaaaagtgtaaaaatacatgaggcagtttaaaaagaactagagaggggagaacagcaaagccatcttggaagacagaaaatgggataagcgttgaaaagtaccaagaaaaagtccagacaccgtggctcacgcctgtaatcccagcactttgggaggccgagttgggtggatcacctaaggtcgggagttcaagaccagcctgaccaacatggttgaaccccatctctatttaaaataca

SEQ ID NO: 43201 - DNA, 601 bp, Human
gattattattatcacttctttgtaaaagaaggcatgagagaattcccatgagaagatggtaggctgagtgcatgcatttagctctcttccttcctaaaccttactaaaataactgtaaaagactttccaaaaatacatgaaccagtttagccgggcatggtggctcatgcctggaatcccagctcttaggaaggcacaggcatgaggaaagctggagcccaggagttcaagacctgcctggaaaatataacaagaccccattctccacacaaaagaggggggaaaaggcaaaaaaaaaaaagtgtaaaaaggccgggcgtggtggttcacgcctgtaatcccagcactttgggaggctgaggtgagtggatcacctgaggtcaggagctcgagacgagcctggccaacccgtctctactaaaaatacagaaattagctgggcatggtggcatgcacctgtaatcccagctactcaggaggctgaggctgcagaatcgcttgatcctgggaggtggaggctgcagtgagcagagatcgtgcactccagcttgcgcgacaagagggaaactccatcccccaaaaaaaaacaaacaaaccaaaa

SEQ ID NO: 43202 - DNA, 601 bp, Human
aagcatataataaaaatccatgattattattatcacttctttgtaaaagaaggcatgagagaattcccatgagaagatggtaggctgagtgcatgcatttagctctcttccttcctaaaccttactaaaataactgtaaaagactttccaaaaatacatgaaccagtttagccgggcatggtggctcatgcctggaatcccagctcttaggaaggcacaggcatgaggaaagctggagcccaggagttcaagacctgcctggaaaatataacaagaccccattctccacacaaaagagggrggaaaaggcaaaaaaaaaaaagtgtaaaaaggccgggcgtggtggttcacgcctgtaatcccagcactttgggaggctgaggtgagtggatcacctgaggtcaggagctcgagacgagcctggccaacccgtctctactaaaaatacagaaattagctgggcatggtggcatgcacctgtaatcccagctactcaggaggctgaggctgcagaatcgcttgatcctgggaggtggaggctgcagtgagcagagatcgtgcactccagcttgcgcgacaagagggaaactccatcccccaa

SEQ ID NO: 43203 - DNA, 601 bp, Human
aggaagcatataataaaaatccatgattattattatcacttctttgtaaaagaaggcatgagagaattcccatgagaagatggtaggctgagtgcatgcatttagctctcttccttcctaaaccttactaaaataactgtaaaagactttccaaaaatacatgaaccagtttagccgggcatggtggctcatgcctggaatcccagctcttaggaaggcacaggcatgaggaaagctggagcccaggagttcaagacctgcctggaaaatataacaagaccccattctccacacaaaagargggggaaaaggcaaaaaaaaaaaagtgtaaaaaggccgggcgtggtggttcacgcctgtaatcccagcactttgggaggctgaggtgagtggatcacctgaggtcaggagctcgagacgagcctggccaacccgtctctactaaaaatacagaaattagctgggcatggtggcatgcacctgtaatcccagctactcaggaggctgaggctgcagaatcgcttgatcctgggaggtggaggctgcagtgagcagagatcgtgcactccagcttgcgcgacaagagggaaactccatcccc

SEQ ID NO: 43204 - DNA, 601 bp, Human
agcactttggaaggccaaggtgggtggatcacctgaggtcaggagttcaagaccagtctggtcaacacggtgaaacaccatctctactaaaagtacaaaaattagctgggcatggtggcatgtgcctgtaatcccagctactcaggaggctgaggcaggagaatcacttgaacccaggaggtggaggttgcagtgagctgagatcgtgccattgcactccagcctgggtgacaggggtgaaactctgtctcaaaacaaacaaacaaaaaacagttgtttttttttaattagctgagcatgktggtacatctctgtagtctcagctacttgggaagctgaggcaggattgctgaacccaggagtttgaggctgcagtgagttacaatcgcaccattacactccagcctgggcaacagagcaagaccctgtctctaaaaaaagcaaaaacaaaaacaattttgtcagccttctttactttataatttaatttttttttatgacatatgcctgcaccttaatagtttcagggcttaattttaaaattcctaatctggtcctgtccaccttgtaggtttgtggtaaagattaactgagaatattt

SEQ ID NO: 43205 - DNA, 601 bp, Human
gtgtttgtgccactgcactctagcctgggtgacaaagtgagaacctgtctcaaaaataaaaaagactgggcacggtggctcatgcctgtaatcccagcactttggaaggccaaggtgggtggatcacctgaggtcaggagttcaagaccagtctggtcaacacggtgaaacaccatctctactaaaagtacaaaaattagctgggcatggtggcatgtgcctgtaatcccagctactcaggaggctgaggcaggagaatcacttgaacccaggaggtggaggttgcagtgagctgagatcrtgccattgcactccagcctgggtgacaggggtgaaactctgtctcaaaacaaacaaacaaaaaacagttgtttttttttaattagctgagcatggtggtacatctctgtagtctcagctacttgggaagctgaggcaggattgctgaacccaggagtttgaggctgcagtgagttacaatcgcaccattacactccagcctgggcaacagagcaagaccctgtctctaaaaaaagcaaaaacaaaaacaattttgtcagccttctttactttataatttaatttttttttatgacatatg

SEQ ID NO: 43206 - DNA, 601 bp, Human
ctccaaagtggttcttgtctggagggctttaatggcgcttttctcctattcatcacgttcatttattgaacttagctccagcctcctaagctttgagctgtcaacactctgagatgaagacagtagacagccttccgtgggattgagggggatccctgtggttgcccggtgtcaccgactgaccagcagggctccggctttggagtcaggataatccaagtgtatatttggctctgacacttaacaaatctgcagcaagttctccactcctctgagtctgttttcccagctgtaaaagggrgctaataatagctcttgcggctagcgttggatcacccaataaaccttgtaagcatatgctgagggcacacccacacaggcatgcacgagaaggaagaatgccatagttgccatttcataagcaccacgaagataaacatcatgggaaaaatagcaactttaggctgggcacggtggctcatacccataatcccagcactttgggaggtcaaggcaggaggatcacttgaggccaggaatgagagaccagcctgggcaacacagtaagatcttatctctaaaaaaaaaaaaaaaaaaaaaa

SEQ ID NO: 43207 - DNA, 601 bp, Human
aagcttgatcttggacttcccagcctccagaaccacgagaaacaaatatctgtttaaaagccacccagtctatggtattttgatatagcagccttaacaggctaagacacaaggcctatgctagtcccttagccttctgggggcctcagtttcctcttccgttatatggggacaagaatactacactatctataccacgctacccaggagggaagagtaacattctgagggcagcgaagctgggtccccaggtttgactctcagttctggggccaagtaggtgtgctgagttttccccatygatcaaatggggaggctgccacccaccctgtgtggtgctagtgagggccgagcaatgtgggattgatggagcagtgaacccaggtcctgacctattgcaggggccctgaggacatcagtgcccttcctctctctgcctctactggggagcagcctcaggggagttgggtgagcaggaaccatccccagggggctgccaatctcaagcagaaggatacagccgagtgtgggaacttgcaaagtggagaaagtcgtttggatcactccacccgcagagttgtcttaagcttaaagaggaatt

SEQ ID NO: 43208 - DNA, 601 bp, Human
atctctacaaaaaatcaaaaaattagccaggcgtgatgatctgcgcctgtggtcccagctacttgggaggctgagaggggaggatcacttgagcccaggagttggaggctggagtgagctatgagtgtgccactccactccagcctgggcaacagggcaaggccttgtctcacaaaaaaatgctgttggataaagaaaggaatggggagccagactgcccagaggctgggaggacaccgagggaggtggctgacacatgcaatttaacaaggaaggtgctggccaggcactgtgggtcacrcctataatcccagcactttgggaggccgaggtaggtggattgcttgggctcaggagttcaaggccagcctgaacaacatagcaaaacctcatctctacaaaaaatacaaaaattagccagttgtactggtgcatgcctgtatgcagctactctggaggctgaggtgggaggatcacctgagcctggagaggctgaggctcaggtgagccgagatcacaccactacactccagcctgggcaacagagtgagactctgtctcaaaaaagcccaaaacaaacaaggaaggtgttgccaagtgt

SEQ ID NO: 43209 - DNA, 601 bp, Human
cctcccaaggtccccagggctacacttccccactctctggacctcctctacttagcagctacttgtgggatgattcaattcgtatttacacatacgcacagtaggctgtgtctagggcaacatctaataatcaatattgttagaatgaccgggcgtggtggatcacatctgtaattccagcactttgggagaccgaggcgggaggattgcttgaggccaggagttcgagaccagcctgggcaacataatgagacctcatctctacaaaaaatcaaaaaattagccaggcgtgatgatctgygcctgtggtcccagctacttgggaggctgagaggggaggatcacttgagcccaggagttggaggctggagtgagctatgagtgtgccactccactccagcctgggcaacagggcaaggccttgtctcacaaaaaaatgctgttggataaagaaaggaatggggagccagactgcccagaggctgggaggacaccgagggaggtggctgacacatgcaatttaacaaggaaggtgctggccaggcactgtgggtcacacctataatcccagcactttgggaggccgaggtaggtggattgc

SEQ ID NO: 43210 - DNA, 601 bp, Human
acccaacaggtgttttccaaacctacaggaagccctggtattgtaaaagcagaactgggctgggcataggagctcatgcctgtaatcccagtgctttgggaggctgaggcagaaggattgcttgaggcgaggagtttgagactcaaagcgagacccctatctctatgaaaaaaaaattttttttaattagctgtggacagaggtgtgtgcctgtagccccagctatttggaaggctgaggcaggaaaattgcttgagcctaggagttcgaggttacagggagctattattgtgccactgcrctctagcttgggtgaaagagtgaaactctgtctcaaaaaatatataataaataaaaacatgaaagcagaactggccagtgaaggggtgtaggagacaggaaaaccaacgctctccctcttgggcctccactcctacctcctacattctcccccttctctctgctccagccccagcagcctcatagaacctatatcaagttccctagccaagcctacacttcaccttccaaggaagcctcccctgtcctcccaaggtccccagggctacacttccccactctctggacctcctctacttag

SEQ ID NO: 43211 - DNA, 601 bp, Human
aagccattctgtaagtgagggcccttctctttctccagccttcatctccccactctactctcccggcagagttggttaggatgacatgctgagtaagaagagatactttgagagcctttgctgcaacccaacaggtgttttccaaacctacaggaagccctggtattgtaaaagcagaactgggctgggcataggagctcatgcctgtaatcccagtgctttgggaggctgaggcagaaggattgcttgaggcgaggagtttgagactcaaagcgagacccctatctctatgaaaaaaaawttttttttaattagctgtggacagaggtgtgtgcctgtagccccagctatttggaaggctgaggcaggaaaattgcttgagcctaggagttcgaggttacagggagctattattgtgccactgcgctctagcttgggtgaaagagtgaaactctgtctcaaaaaatatataataaataaaaacatgaaagcagaactggccagtgaaggggtgtaggagacaggaaaaccaacgctctccctcttgggcctccactcctacctcctacattctcccccttctctctgctccagccccagc

SEQ ID NO: 43212 - DNA, 601 bp, Human
ataaagggcttcagcggttcctcccccgctgtgggcctgaggactcccaggaggtacccagctccccacagaccagctatttcggcccaagcccaaacacaagctggtggattctgtctgggaagccagagcactgtaggctgaccataaaaggagaaaacccagcggggactgagcacagacccaggctccctgcgtctgcccttctttctggtaacaggctgctgggggatccagtgagaggtaatcaaaacccgtctctgcagggccatcaatacccctgggctagtaaagaagaaargtctcagcctccattgcctgcagaaaagtggctctctacctaatgccccgcacggaggcagatgccagaggttctggatcttctgtggtgtgactgtgaaggtggccactgcatggcccttgacggtgggtcctcggcagctgactgctaatgcctgttgaacttgtcctgtccatgcaccgtgtccctacacactgaccgaatcacccttgtaacaactggagtaagcacagtcatcatcctcacgggacaagtgaggaaactgaggcacaaagtaatagccggggcagagctgggagg

SEQ ID NO: 43213 - DNA, 601 bp, Human
ggccggccatcatcaggacccgcctggggctgagcttcccagcccagatccctggggctcatgtcacctcacaccccatccttaaacatgcctctctcccttcctcctccccagactccccacccagcctcggatgtgtaaggccccaggcacgtttcctgagaagataaagggcttcagcggttcctcccccgctgtgggcctgaggactcccaggaggtacccagctccccacagaccagctatttcggcccaagcccaaacacaagctggtggattctgtctgggaagccagagcackgtaggctgaccataaaaggagaaaacccagcggggactgagcacagacccaggctccctgcgtctgcccttctttctggtaacaggctgctgggggatccagtgagaggtaatcaaaacccgtctctgcagggccatcaatacccctgggctagtaaagaagaaaggtctcagcctccattgcctgcagaaaagtggctctctacctaatgccccgcacggaggcagatgccagaggttctggatcttctgtggtgtgactgtgaaggtggccactgcatggcccttgacggtgggtcct

SEQ ID NO: 43214 - DNA, 601 bp, Human
aaggctggagctgggggcggccggccatcatcaggacccgcctggggctgagcttcccagcccagatccctggggctcatgtcacctcacaccccatccttaaacatgcctctctcccttcctcctccccagactccccacccagcctcggatgtgtaaggccccaggcacgtttcctgagaagataaagggcttcagcggttcctcccccgctgtgggcctgaggactcccaggaggtacccagctccccacagaccagctatttcggcccaagcccaaacacaagctggtggattctgkctgggaagccagagcactgtaggctgaccataaaaggagaaaacccagcggggactgagcacagacccaggctccctgcgtctgcccttctttctggtaacaggctgctgggggatccagtgagaggtaatcaaaacccgtctctgcagggccatcaatacccctgggctagtaaagaagaaaggtctcagcctccattgcctgcagaaaagtggctctctacctaatgccccgcacggaggcagatgccagaggttctggatcttctgtggtgtgactgtgaaggtggccactgcatgg

SEQ ID NO: 43215 - DNA, 601 bp, Human
tgtttgtttgttttttcacactgacctgagcaagacaggaagccttcacggcagaggtgaccactgaacagcattaagaaaaatgtgaaagaatctcctggggagaggtcgaggcagagcatcccaagcagagggcctgggacagaagctccaaagtgggcggggacacagtaccgagcctccgtggagtctgggaaggctggagctgggggcggccggccatcatcaggacccgcctggggctgagcttcccagcccagatccctggggctcatgtcacctcacaccccatccttaaacrtgcctctctcccttcctcctccccagactccccacccagcctcggatgtgtaaggccccaggcacgtttcctgagaagataaagggcttcagcggttcctcccccgctgtgggcctgaggactcccaggaggtacccagctccccacagaccagctatttcggcccaagcccaaacacaagctggtggattctgtctgggaagccagagcactgtaggctgaccataaaaggagaaaacccagcggggactgagcacagacccaggctccctgcgtctgcccttctttctggtaacaggc

SEQ ID NO: 43216 - DNA, 601 bp, Human
ttattttgaattgctctctggctcagagaggcaaccaaggtagaagcaatggaaaatgcatattcacgtgttcacatattcattcaacaaacgagtcctgagccaggtaccgaaagcacaaaagtcaataagatctgctttttttttttcttttcttttttaagagatgaggtgtcactctgatgcccaggctgaagtgcagtagcacgatcatagctaactgcagtctggaactcctgggctaacagatccttccatctcagcctcctgagcagctgggactacaggtgcatgccactaygcctggctaatggtttttttgttttttgttttcattttttttgtagagacagggcctagtaaggtaacttagtaatattacccaggctggtcccaaactcctggcctcaagtgatcctcccgccttggcctcccaagtaactgaaatcacaggctcaagccaatgcaccgagcttcatgacttgcttatccttgcttttgagaagttcatgacccagggtgggagtcagatgggcaaagaaatgaccgtaagagatgagcagtgctacgatggatgtgaacccaagtgctatagacgtca

SEQ ID NO: 43217 - DNA, 601 bp, Human
atgcagctctattaggtttccaacaattacaaaattgttcattttcaatgcttttcccctgaaccaatgagctcctgaaggtcaagggctgtgcctgatcccgggtacaaggaacaatgcctgacacacagtaggtgctcaggaaatgcttgttattttgaattgctctctggctcagagaggcaaccaaggtagaagcaatggaaaatgcatattcacgtgttcacatattcattcaacaaacgagtcctgagccaggtaccgaaagcacaaaagtcaataagatctgctttttttttttcttttcttttttaagagatgaggtgtcactctgatgcccaggctgaagtgcagtagcacgatcatagctaactgcagtctggaactcctgggctaacagatccttccatctcagcctcctgagcagctgggactacaggtgcatgccactacgcctggctaatggtttttttgttttttgttttcattttttttgtagagacagggcctagtaaggtaacttagtaatattacccaggctggtcccaaactcctggcctcaagtgatcctcccgccttggcctcccaagtaactgaaatc

SEQ ID NO: 43218 - DNA, 601 bp, Human
aggaatatggagtgacaaaaaaatgtgcacaagatttctttgggggatgatagaaatataaaattatattgcagcaatggctgcataaccatgtaaattatgagtgaatttagacagttatgcagacatagctgcaattttaggtgtgaactgtatccttaaaatgaatttatttaaattataccgcataaaccttttttaaaaatgatgttcattttataccacctctgaatgattataaatctgacttcttccacttcatgcagctctattaggtttccaacaattacaaaattgttcrttttcaatgcttttcccctgaaccaatgagctcctgaaggtcaagggctgtgcctgatcccgggtacaaggaacaatgcctgacacacagtaggtgctcaggaaatgcttgttattttgaattgctctctggctcagagaggcaaccaaggtagaagcaatggaaaatgcatattcacgtgttcacatattcattcaacaaacgagtcctgagccaggtaccgaaagcacaaaagtcaataagatctgctttttttttttcttttcttttttaagagatgaggtgtcactctgatgccca

SEQ ID NO: 43219 - DNA, 601 bp, Human
attcagagtttttcttgtttttcttttccatattggtaaaaattatggactttattcataatatccaaaaaatagaaacaaccaaatgttcatcaatgggtagatggataaacaaaatgtggtctacccagacagtgggatagtattcagccatgaaaagaaaggatgttatggccggcggccatggctcatgcctgaaattccagcactttgggaagctgaggcaggtggattgcttgagcccgggagtccgaaaccagcctgggcaacatggtgaaaccctatctctacaaaaaaaaaygcaaacattagctgggcatagtggcacaatccctgtggtctcagctactcaagaggctgaggtgggacaatggcttgagcccaggaggtggaggttgtagtaagccacgactgcaccacggtactccagctggggtgacagagacagaccctgtcttaaaaaatatataaatagtatgaatccatgatacaacgtggatgaaccttgacaacattatactaagtgaaagaagctagccggctgggcacggtggctcacacctgtaatcccagcactttgggaggctgaggtgggcagatc

SEQ ID NO: 43220 - DNA, 601 bp, Human
gcctatttgtggctgagtcatatcacattgtacggatggatcatattttgtttatccattcaacagttgacggacatttgggttatttccaccttttggctattctgcatagtgctgctatgaacattcctgtacaagttttagtttgagtaccttttcaattcttcgggtacataccctaatctgtatctgaaacatcgtcttgggagtcaactcttctatgataccttctctaactctgcacttttctagagctgagttggagacctttccacttgacctcctacctgcaggatggccrtggaccgtggtgcatgttgtacactgcataactctatggagaaactatttgcattggtcatttattgtattgcattgtgtatttattgtaataatctttcagcagatggaggaaaagtgctttgagaaaacggtgcctttctctaatataaacatgagtgtcacatggcctagtggttcccatggtccacaggttctctccattttagtaattatcatcattgtgatccttacttaataaatgtctcaaaacattctggcggaaaaaggtacagatgatatggaatgataataggccatc

SEQ ID NO: 43221 - DNA, 601 bp, Human
aatttacactacataaaaagaaccattttaaagtgaataattcaagccaggtgcggtggcttatgcctgtaatcccagcactttgggaggccgacacagctggatctcctaaagtcgggagtttgagaccaacacggcaaaaccccgtctctaccaaaaatacaaaaattagctgggcgcggtggtgcacacctgtaatcccagctactcaggaggctgaggcaggagaatcgcgtgaaccagggaggtggagtttgcagtgagctgagatcgcgccactgcactccagcctgggtgacasagggagactccatctcaaaaaatagtaataaagataaaaaaataactaaagtgcataattcaggagcatttagtacattcacaatgttacgtaactaccacctttatctagttctaaaatattctgtcacccccaaatgaaaccctctacccgttaagcagccactcccccataagcccttgcaaccgccaatttgctttctgtctctatggtcttacctattctagatatttttgcataaatggaattataacatgtgcggcctttcatgtctgacttctttcactcagcatgtggctg

SEQ ID NO: 43222 - DNA, 601 bp, Human
ggcaggccgggcgcagtggctcatgcctgtaatctcaccactttgggaggccaaggagggtggatcacttgagttcaggagttccagaccagcctggctaacatggtgaaaccccatctccactaaaaatacaaaaattagttgggtgtcatggcacacgcttgtaatcccagctactcagaaggctgaggcaggaaaattgcttgaactcaggaggcggacgttgcagtgagccgagatcgtgccactgcatgccaggctgggcaacagagcaagactctgtttcaaaaacaaataagawataaatacataaataaaataggcagccattgaaaagaaccaggcagagctttgtggatggacacagaaaaatatccaaaatatattaagctaaaaataaaagatgaggtagcatagtgttataccttttgtgttttaaaaagacagatatataggtaggatgcagtggttcatgcctgtaatctcaacactttgggaggctgagatgggaggatcacttgaggccaggagttccagaccagcctggacaacatagcaagacccagtctctacaaaaaaaaatttttttttaattagctat

SEQ ID NO: 43223 - DNA, 601 bp, Human
aatgccacagtggcaagcatttcttaaatccactccctggcttcagtcctactagttcagtgctcagctctcacaagcttcatttcatcaaaaatctcctaggcttggttttacattgtatctctagtactggcacatagatggtaggtgctgaattatgcttgttagatggatggattgagggatggatgagtagatggatgggaagatgagtggacggaaggaaggaagaaaggaaggaagggtagatgggtgaatggaagggtgggtagatgggtaggtagatggatgggtgggtggrtggatgaatagacagatggacgggagggtggataagcagatgagtaggtgagtaggtgggtgggtggatgggcagatgggtgggaaaatggatggatagatgagtagatggatgggaggatggaagaagaggtggatgggcaagtgagtggaaggaaggaagaaaggaaagaaggaaggaagaaaggatgggtggatggaagaatggatggataggtaaatggacgggaggataaatggatgggaggctgggtgaataggcagacagatggctggatggaaggatggatagatggacagg

SEQ ID NO: 43224 - DNA, 601 bp, Human
gctgcattggtcagactctctggcctaaaactccaagctcagtcaaggacagggaagcacagcaggtggacagagccctgaggcagacttcctttctgcccctgggcccaagcagcccagtttctgtcatttacctagcctgattcctagtgttcccactgcaactgtgagctcctccatactcccctacaaatccctttcctctactagatgacagagtcagtctctcttgtttaccaccagagaaacccaaaagatacagaggtcatcaaagaactagatgtgattaagcagacattayccatcaccttctactcttaaagaggcctctgaggtggagccaggctctgaagacccatttccttcccaaagagagatctgagaacagttaccaatacgttcaatggtcacctaacaatgtagaaatcccagcatcatatctgctggtagacaatgccacagtggcaagcatttcttaaatccactccctggcttcagtcctactagttcagtgctcagctctcacaagcttcatttcatcaaaaatctcctaggcttggttttacattgtatctctagtactggcacatagatggtaggt

SEQ ID NO: 43225 - DNA, 601 bp, Human
ttagataagattctgcatataaaatctttagttcaagtcctggcacagagtacatgttcaataaatgctagttttttagaaggaggagaggtatggaaccaaatgatagcaggtgtcattaagagtttaagtttgcctgcctccgcagaagaccatatatcacaaatgtttagtgagcatctacatggtgccaggtataaagagaggcacttggaaccatgaacaaatcaaagatctctgcactcatggatcttttctttcataggttggatctcgactacagattaaaaaaaaaaaaaamcaaaaaaaaaacagaagaaaaagcagttccacttacgtgcatagaatggactggtcctcccgatctgcaaacagaaagaagaaaaaagagccatgaattaaaatgagctctgagctaagggtctggacttggctcctcccagggccctcccattctaaagcttctccatgctggcctcattggaagtgacaacaggtcagctgggctcattgcccaggctacaggggccacgaccaaagccaaaagggcagccccaaagtcccagaggcagccccagaaagatgctggagcctgactgat

SEQ ID NO: 43226 - DNA, 601 bp, Human
gaaattctaattactagtttttaattgtccttccagataatttcatgcaaataggaaacatatgcacgtccatgcaatcctgctctttttaaagacacacacggttacattatgcatatgctggtttgcccctgtgttttccactcaacggtattatctataaagagcgttctctctcagcataaatagatcagcctcactctttgtagtggctacctggaaatgctatattttatttaaataacctctgttgattatagctttagttgcttccagaccttcaaatatatatatatataaatataaatatattaaatataatacatattatatattatgtaaatatatatatgcacagtctatcctcattatttatatattctatattttcaaattcaccgacctgctgaaagttatttgtaaccccaaaatcaatattcatggcacttttgtagtcatttgtgaacatgtgcagagtaaggaaaattcgattcccccaatgcacacgttcccagctcaggttgaacaggggaatgctctaccttctagtttcaactctcatactgtaaacaagtgtcctttctgtagtgtatttagtgcc

SEQ ID NO: 43227 - DNA, 601 bp, Human
tctgaaattctaattactagtttttaattgtccttccagataatttcatgcaaataggaaacatatgcacgtccatgcaatcctgctctttttaaagacacacacggttacattatgcatatgctggtttgcccctgtgttttccactcaacggtattatctataaagagcgttctctctcagcataaatagatcagcctcactctttgtagtggctacctggaaatgctatattttatttaaataacctctgttgattatagctttagttgcttccagaccttcaaatatatatatatataaatataaatatattaaatataatacatattatatattatgtaaatatatatatgcacagtctatcctcattatttatatattctatattttcaaattcaccgacctgctgaaagttatttgtaaccccaaaatcaatattcatggcacttttgtagtcatttgtgaacatgtgcagagtaaggaaaattcgattcccccaatgcacacgttcccagctcaggttgaacaggggaatgctctaccttctagtttcaactctcatactgtaaacaagtgtcctttctgtagtgtatttagt

SEQ ID NO: 43228 - DNA, 601 bp, Human
ataagagagaggtagggggaccagagaaagagatttgaagataccatgctgcaggatttaaagatggaggaagagaccatgagccaaggaatgcaggtgacccctagaagccagaaaactaggaaaccaagtcggcaggttgttttagcatttatatcctcatagctaggtagcattatatctctagatccagactattcattgtcaaacatcaaatgtgtacatcctaccatggaatatgagaattcagttcccatctaatcctcttccctttccccacagagccaagtccatcacaggkagttattctggttagataaatactccaaacttgcacagctgggctccttagtccaatgtgattacttctccttccatcccaacttttgttttttcctggagtttataattgcctttgttttattgtttccaggttttctatctatatcaaccccaaacttattaattgtttcaatcttctctcaatacagttcattgccatcctaccatccatcaccatctgaaattctaattactagtttttaattgtccttccagataatttcatgcaaataggaaacatatgcacgtccatgcaatc

SEQ ID NO: 43229 - DNA, 601 bp, Human
gcagtcttggctcagtgccaactttctgcctcccaggctcagtgaaccgagatcctcctgcctcatcctcctaagtagctgggactacaggcacatgccatcacgctcagctaatttttgtttttgtagagagggggtttggccatgttggccaggctggtcttgaactcctgagctcaagcgatcagcctgccttggcctcccgaagtgctaggattacaggcatgagccaccatgcccagcctgtcatccattttagacgaaagtttaaactcctccccagggcctggaagcacccccytacctctctctaattttatgtgaaaccaccctcctcctcttactttagccccctgatcacacagctctatctccagccaggcccatggcctctaattaaactgattatactggatggattacatgctagacaaaatacaactcaggcctaaaaattacatttattcagctttcagtttccttcctttcttgtcttccttcccttcctttccttccttcctgtctctgggtcttgctctgttgcccaggctgaggtgcagtggtgccatcatagctcacttagcctctaactcccaagctc

SEQ ID NO: 43230 - DNA, 601 bp, Human
gttttgcttcttgctcaggccggagtgcagtggcacaatcttgactcactgcaatctcgaactcctgggttcaagtgaccctcccacctcagcctcctgagtagctgggatgacaggcatgtgccactacacctagctaattttttgattttgtggggtctcgctaagttgcccaggatagtcttgaactccaggcctcaggcaatcctcctgcctcggccccctaaagtgttgggattacaggtgtgagccactgtgcccacctattattacttttataaccactgcttccacagaagtyatatattgtttgtataatgattttcagcattcatcctatcattacaatataaataatattcacattttcccactgtttaagctaggagttagcaaactctttttgtaaaaggtcagacagtaaatattttagactttgagggtcacgcattctttgtcacatctgctcagctctccactgcagcacaaaagcaaatacgtaaacaagtgggtgcggctgtgtttcaataaaactttatctggaacagacagacaagggcctgatttgacccactggttaaactttgtccttccttggctt

SEQ ID NO: 43231 - DNA, 601 bp, Human
gggactacaggtgcacaccaccacagctggctgatttttaaattttctgtagagacaggggtctcgctatgttgctcaagctggtctcgaactcctggtctcaagtgatctctagcctcagcctcccaaagtgctgggactacaggcatgagccaccatgcctgaccttttatatgattcttatgaggattaaatgagtgaacatttatataaaatgcttagaacaatgcctggtatgccaaaatgttagttattattacttttgttttttgagacagagttttgcttcttgctcaggccrgagtgcagtggcacaatcttgactcactgcaatctcgaactcctgggttcaagtgaccctcccacctcagcctcctgagtagctgggatgacaggcatgtgccactacacctagctaattttttgattttgtggggtctcgctaagttgcccaggatagtcttgaactccaggcctcaggcaatcctcctgcctcggccccctaaagtgttgggattacaggtgtgagccactgtgcccacctattattacttttataaccactgcttccacagaagttatatattgtttgtataatgat

SEQ ID NO: 43232 - DNA, 601 bp, Human
cccgcctcagcctcccaaagtgctgggattccaggtgtgagtcactgcactcagccagcattttcattttgcaaaattctacaaattctgcagctggtcctggctcccagggtcgaatattgccaagtccattgcagcctgtggtttgccactggtaggaaagccaaattgtctctgatgaacctcacagctattcagtccctggtctttatgtgactggcaaagcaccctggcattttgtactgtacaactcctacacgtcctgcaaaaccccaggcagaagcaacgcctctctcccctrtagcatcaattggcagaatagcataatgggctccaggaccaggttgctcaagttcaaatccctcctctgccagttacctgggtgaccttaggcaagtcatttagcctctccatacctcagtttctttaccccattataaaatgggtataataaaaacacttaccttgtatgatttttttttttttttttttgagacaagatctcactctgtggcccaggctggagtgcagtgatgcaatcatagctcactgcagctgagaattcctaggctcaagtgatactcctgccccaatctcccag

SEQ ID NO: 43233 - DNA, 601 bp, Human
acagcaaagaagggatacagtcagaatggaaagtcaggtctctgattctaatgcagtcagaattccttttactacatttcaccaagttgttccatgacacaggcccaaccctctagggacttgctttctaaggccagaagaagggcaggggaaggggaattgatatttgttgaaggcctgcacagtactaggctttgggctcacagatcttttcatttactctacccagcaatctaatgagagagttattaattatccccatcacccatccggggaaactgaggcaaagagaggtttgaaktaaattgctccagcccacaattgctcctgctttcacacagataggaaatggaggagaagcaggatttgaacgtaggtccacttgacaccagggcccatgttctgcctcctacccttttattttaacaaatcagcaaagagaaaagacagagtgaagtcccagccccactccactggaattctgccatatattccaggaggctttacttgccccaatcaatgaaccaagccactcagtcattcacacctaagtatgaattacttcaatcaggctaacgtcagaaccttgcttgacttcatt

SEQ ID NO: 43234 - DNA, 601 bp, Human
catgttattatagaaggaagagtcttgcccagagtgggtaagcaattttccctaggtcacacagcaaagaagggatacagtcagaatggaaagtcaggtctctgattctaatgcagtcagaattccttttactacatttcaccaagttgttccatgacacaggcccaaccctctagggacttgctttctaaggccagaagaagggcaggggaaggggaattgatatttgttgaaggcctgcacagtactaggctttgggctcacagatcttttcatttactctacccagcaatctaatgasagagttattaattatccccatcacccatccggggaaactgaggcaaagagaggtttgaagtaaattgctccagcccacaattgctcctgctttcacacagataggaaatggaggagaagcaggatttgaacgtaggtccacttgacaccagggcccatgttctgcctcctacccttttattttaacaaatcagcaaagagaaaagacagagtgaagtcccagccccactccactggaattctgccatatattccaggaggctttacttgccccaatcaatgaaccaagccactcagtcat

SEQ ID NO: 43235 - DNA, 601 bp, Human
atgaattatttcctttatcctcttcctgcttccatgttattatagaaggaagagtcttgcccagagtgggtaagcaattttccctaggtcacacagcaaagaagggatacagtcagaatggaaagtcaggtctctgattctaatgcagtcagaattccttttactacatttcaccaagttgttccatgacacaggcccaaccctctagggacttgctttctaaggccagaagaagggcaggggaaggggaattgatatttgttgaaggcctgcacagtactaggctttgggctcacagatmttttcatttactctacccagcaatctaatgagagagttattaattatccccatcacccatccggggaaactgaggcaaagagaggtttgaagtaaattgctccagcccacaattgctcctgctttcacacagataggaaatggaggagaagcaggatttgaacgtaggtccacttgacaccagggcccatgttctgcctcctacccttttattttaacaaatcagcaaagagaaaagacagagtgaagtcccagccccactccactggaattctgccatatattccaggaggctttactt

SEQ ID NO: 43236 - DNA, 601 bp, Human
ataacttggctcatggcttaaaaaagaaatagaagaaaagaaaaaagaaagagaaagaaaaaaaaagtgccccaaattgctgtgcctaatcctacaggtcccactgtccagaaatcaagtgtctgatggccaagaatgatgaaacatcttgcggtgactttgtgtggtcccttcccttcctagaggccttccttcccaatggccacattatttcacatggcctcagaggcagtttatgaaatggggaccatgaaggcattaccccatttccccagaaggggaaactaagaccagaatatatgtgtgtgtgtgtgtgtgtgtgtgtgtgtgtgtgtgtgtgtgtaaaagaggagaactggccaggtgcagcagagaactggccacgtttataatagcagctactcaggaggctgagttgggaggatgccttgaggccaggagtttgagagaagcctgggcaacatagcaagatcccatctcttaagacagagaagaattggcgtttgtcattggggggatatagggggaagggtccctttgctaaatgctctacatgaattatttcctttatcctcttcctgcttccatgttattatagaag

SEQ ID NO: 43237 - DNA, 601 bp, Human
aataacttggctcatggcttaaaaaagaaatagaagaaaagaaaaaagaaagagaaagaaaaaaaaagtgccccaaattgctgtgcctaatcctacaggtcccactgtccagaaatcaagtgtctgatggccaagaatgatgaaacatcttgcggtgactttgtgtggtcccttcccttcctagaggccttccttcccaatggccacattatttcacatggcctcagaggcagtttatgaaatggggaccatgaaggcattaccccatttccccagaaggggaaactaagaccagaatatrtgtgtgtgtgtgtgtgtgtgtgtgtgtgtgtgtgtgtgtgtgtaaaagaggagaactggccaggtgcagcagagaactggccacgtttataatagcagctactcaggaggctgagttgggaggatgccttgaggccaggagtttgagagaagcctgggcaacatagcaagatcccatctcttaagacagagaagaattggcgtttgtcattggggggatatagggggaagggtccctttgctaaatgctctacatgaattatttcctttatcctcttcctgcttccatgttattatagaa

SEQ ID NO: 43238 - DNA, 601 bp, Human
cggctaattttttgtatttttagtagagacggggtttcaccatgttagccaggatggtctcgatctcctgacctcgtgatccgcctgcagacatcattagcattgctagaaatggaaagaccaggcacaaggcagccttcaagaaaggatgtaagtgcctctggagtaccaggacctaaagtttaagaagctcccttatggaaagaaaaatttaccaaaaaaccggttatcccattggtcactgggcagatgcaagcccctttatcctctgaggaatcccaccccatgtatcaggaagctrgctgatgatctcagccaagtatctaagaataaacccagttgaagtaattcacactaaagtgtaaatgactgatatgtttagatcagcacgacatggtttgtcgtatcaaaaaagtatgtcctcctggaatatgaaggtagatcttttttttttttttttttaccaagatggctttcgtgcactagctgcctgttttggccaccagaaatcatcacaatggaaccgctccatccagatactgcctctatgttccaccactcctagtgaaagataaggacagtgccttgaccaaaacttcac

SEQ ID NO: 43239 - DNA, 601 bp, Human
gctatttgggaagttgaggcaggaggatcactcgagtccaggagttcaagaccagcctgagcaacacagcacaaccctgactctataaaaaataagaaaaattaaccaggcttggtggtgcatgcctgtagtcccagctactcaggaggctgaggtgggaggatggcttgagcccaggagtttgaggccacagtgagccatgatcacaccactgcactccagcctgggtgacagagcaagacctcatctctaaaaaaatagagtgaacaagaaaaccttagttttcttacataggtccaaacaggtttatttggaattatctactttttttttttttttttttttgagatggagtctcactctgtccccaggctggagtacagtggcacaatttcagctcactgcaagctccacctccctggttctcctgcctcagcctcccaagtagctgggactacaggcacccaccagcacactcggctaattttttgtatttttagtagagacggggtttcaccatgttagccaggatggtctcgatctcctgacctcgtgatccgcctgcagacatcattagcattgctagaaatggaaagaccag

SEQ ID NO: 43240 - DNA, 601 bp, Human
ttgcccaaggccacatctctggtagtgagcggaactgggtccccagcctaggtccaatgcccaatctattccttccaagaggacatagaaaagaattcagatacaaagagtgaaaaggtgggccggatgtggtggctcatgcctgtgatcccagcacttggggaggctgaggtgggaggatcatttgagcccaggagtgtgagaccagctcagcaacacagagagacactgcctctagaaaaagatttaaaaattagccaggcatggtggcacatgcctgtagtcccagctatttgggaasttgaggcaggaggatcactcgagtccaggagttcaagaccagcctgagcaacacagcacaaccctgactctataaaaaataagaaaaattaaccaggcttggtggtgcatgcctgtagtcccagctactcaggaggctgaggtgggaggatggcttgagcccaggagtttgaggccacagtgagccatgatcacaccactgcactccagcctgggtgacagagcaagacctcatctctaaaaaaatagagtgaacaagaaaaccttagttttcttacataggtccaaacaggtttatttg

SEQ ID NO: 43241 - DNA, 601 bp, Human
gtgtctttcttgcccttgtgggaggaggccaccacggccaggtactgaatgaccttcttggtgttttcggttttcccggctccagactcgcctctgaaagacacgggaacatcatctatgcacacgttccatggtgacctttccgcagttccatgagccaggcaggacaataatgatcatcaccaccatttcccagagggtgaaacagaggctcccagaggggaagtaacttgcccaaggccacatctctggtagtgagcggaactgggtccccagcctaggtccaatgcccaatctattmcttccaagaggacatagaaaagaattcagatacaaagagtgaaaaggtgggccggatgtggtggctcatgcctgtgatcccagcacttggggaggctgaggtgggaggatcatttgagcccaggagtgtgagaccagctcagcaacacagagagacactgcctctagaaaaagatttaaaaattagccaggcatggtggcacatgcctgtagtcccagctatttgggaagttgaggcaggaggatcactcgagtccaggagttcaagaccagcctgagcaacacagcacaaccctgactc

SEQ ID NO: 43242 - DNA, 601 bp, Human
atctgtttatttgagggattctttgacaactacatgctcttccacaggtctggaagctcagagaagagaataacagcatctctcagacttatccccaggtccccaccccaagtggttcctggcatacagtaggtgctcaatccacagttactgaatggcattgcactgaagcccacgggccgagtgataccagcatctccatcccagggacagggggacacgtggaggaatccgggaacccaaaaggtaccttaacccctgggacgttacagagattcatgaaaggagtgcttctcaatcragggcaactgtcccaccccagggaacatctgacaatgtctagagatatttttggttgtcacaactggagggaagggggctgtcggcatctggcgggtcgaggccagggatgttgtgaaacattctacgagccacagggaagcccctccaaggaagagttatctggtccaaaatgacatcagtgccaccactgagaagccccgacgtggaggaagatctcgctatggaaggaaagggcttattctcatttcacaaaacgggcccccttctggagggatgcttctagctgagccaagaaatc

SEQ ID NO: 43243 - DNA, 601 bp, Human
atcctaccatcttcccacccacaaacctgcagacggaggcaccggccagtcctagcggccctaccacgtgccccctcctgtgggatagatggggcagggctgacacacgaggaggaagagaaggatgggccctagaggtgatgactctagaaacctgctcttcttttcctcccaagctcttagtcataccgtgtcatcatctgtttatttgagggattctttgacaactacatgctcttccacaggtctggaagctcagagaagagaataacagcatctctcagacttatccccaggtccycaccccaagtggttcctggcatacagtaggtgctcaatccacagttactgaatggcattgcactgaagcccacgggccgagtgataccagcatctccatcccagggacagggggacacgtggaggaatccgggaacccaaaaggtaccttaacccctgggacgttacagagattcatgaaaggagtgcttctcaatcaagggcaactgtcccaccccagggaacatctgacaatgtctagagatatttttggttgtcacaactggagggaagggggctgtcggcatctggcgggtcgagg

SEQ ID NO: 43244 - DNA, 601 bp, Human
gacatctggaatggcgaacactggagacaccccatgccgtggtcagatctccatcctaccatcttcccacccacaaacctgcagacggaggcaccggccagtcctagcggccctaccacgtgccccctcctgtgggatagatggggcagggctgacacacgaggaggaagagaaggatgggccctagaggtgatgactctagaaacctgctcttcttttcctcccaagctcttagtcataccgtgtcatcatctgtttatttgagggattctttgacaactacatgctcttccacaggtcyggaagctcagagaagagaataacagcatctctcagacttatccccaggtccccaccccaagtggttcctggcatacagtaggtgctcaatccacagttactgaatggcattgcactgaagcccacgggccgagtgataccagcatctccatcccagggacagggggacacgtggaggaatccgggaacccaaaaggtaccttaacccctgggacgttacagagattcatgaaaggagtgcttctcaatcaagggcaactgtcccaccccagggaacatctgacaatgtctagagatattt

SEQ ID NO: 43245 - DNA, 601 bp, Human
accaaagctagtgcatcgcgacctccaagactgtttctggaggcttgagtcaagcaaccagcatgcaagagacagacacgcactgcacacgcatgcacagggacacactggtgcaccagggacagggctgagggaagacacttagggatgatggcagggagagaagagggaggcatgccacagctgtgccatcgactgtccatcgagccagggaagctttggggcctgacagtcctaaaacactcagccagatgggacagacatctctgtctaggttgttccagtcaagggtaccaggagyggatgctttgaagggtgcaggggttcattctgaaccggagaaatccatttcaggctggagcgcaaccctggggactccaataggcgtcccgtgggtggtaaatgcacccccacacccttccctggcatcagacacccacaggatggtattttggtgcatttactgatttaagttgtgaaactctagggcctaccccatttctaccaccagctacgggactcggtgggtgcaagaggatcatgcagatctaagttcactccgtgcctcccctacacaccaggaaaacactctcagttactc

SEQ ID NO: 43246 - DNA, 601 bp, Human
gggcatttctttgttggtgggaagacgactaaaggaatcacttttgttcacataaacttggggtctccatgctctctgaaaaaggctccctttctagaatggggattctggcaggtaaggttgaaaagtcttggcaagagagctttaaatcgggggacctggttcaaaccctcaattttatagatgatgaaaccatagccccgaggagttaactgactcggccaaggtcacacaaaagcagatcccaaataagaactgtaattctccttctgatctgcaacacagtcacccagggtctaamtaagatggattgaatgatcttttcgggagccaaggaagacacctgtgggtttcttctaggctgggacccacacatcagccccccaagctctgtgttagagatgagtttacatatgcacaggtccaagcaggaccaggttatgcgttgcgtagctggggccttaccgcgccaccaaagctagtgcatcgcgacctccaagactgtttctggaggcttgagtcaagcaaccagcatgcaagagacagacacgcactgcacacgcatgcacagggacacactggtgcaccagggacagggctg

SEQ ID NO: 43247 - DNA, 601 bp, Human
acactctgcagccccaggcaggagatgacaccaaagcttttctggaaaatccatgtggctttgctacttacgaatcgtgaggagttgtcgttcttcactgttttggcgttgccgaaagcctccagaatcgggtttgcttgtagaagctgcttttccagctctccctaaaattcattcacatctagttattggagaaagcaacctaggtcctgacagttctaccttggatggatgttgtcacaaaactctgcccttaacccacaggttctctcctatctcctacctcctcttagaccctgaygctaatgttcagatttacaggaggatttcagaagagaagcaactgtctgagctctctaatagctaggacatctgctccctaggaaggtcacttttttcaagaccagggcctgctcatctgtgcaacatcactgccactcaaagccactgccttgcacaatgtcggtgatgtcatttacatcatgatgaatggtgccccccggagttgtgcagtgcaccacctgtcccactgtacatggcagtcgtgctgctgttcatgtttaacaagcagccttcttcaagttaaaccactacaagcctc

SEQ ID NO: 43248 - DNA, 601 bp, Human
tacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtgagactcgctgagtgcctggtatacagtaggcacttaataaaaacagcaaatgagaaaaaaacaaagagaatggtggtacatgtaaaagtgcctaccagagtaattrtacacagtaggtacttactaagtatttcttggaggaggtgtgtgcctggtacacagttggcactcaattcatgttttgttacataaaatggtatcggatataagggtctagcccataccaggtgctcaatacctaattttttaaattttattttaataatagagatgggatctcgctttgttgcccaggctggtctagaacccctgggctcaagtgatcctcccacctcagcctcccaaagtgctgggattacaggtgtgagccaccgcaccaggccaatcaatatttgttgagtgaata

SEQ ID NO: 43249 - DNA, 601 bp, Human
taaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtgagactcgctgagtgcctggtatacagtaggcacttaataaaaacagcaaatgagaaaaaaacaaagagaatggtggtacatgtaaaagtrcctaccagagtaattgtacacagtaggtacttactaagtatttcttggaggaggtgtgtgcctggtacacagttggcactcaattcatgttttgttacataaaatggtatcggatataagggtctagcccataccaggtgctcaatacctaattttttaaattttattttaataatagagatgggatctcgctttgttgcccaggctggtctagaacccctgggctcaagtgatcctcccacctcagcctcccaaagtgctgggattacaggtgtgagccaccgcaccaggccaatcaat

SEQ ID NO: 43250 - DNA, 601 bp, Human
ctacggagacaaccgcttcttttgcacaataaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtgagactcgctgagtgcctggtatacagtaggcacttaataaaaacagcaaatgagaaaaaaacaaagagaatggtggtacatgtaaaagtgcctaccagagtaattgtacacagtaggtacttactaagtatttcttggaggaggtgtgtgcctggtacacagttggcactcaattcatgttttgttacataaaatggtatcggatataagggtctagcccataccaggtgctcaatacctaattttttaaattttattttaataatagagatgggatctcgctttgttgcccaggctggtctagaacccctgggctcaagtgatcctcccacctcagcctcccaaagtgctgggattacag

SEQ ID NO: 43251 - DNA, 601 bp, Human
tgcaaagagtctttcacagggccccatctcagcgagcaacagttcagagacccccttctcctggaatgcagaggcaatttttccttcatcttttctcactaaaatatctttctgaccctcctacggagacaaccgcttcttttgcacaataaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagtkggaagaaccagcttcatgaaggctggaaccatatctgaactattcatcgcaatcctgtgagactcgctgagtgcctggtatacagtaggcacttaataaaaacagcaaatgagaaaaaaacaaagagaatggtggtacatgtaaaagtgcctaccagagtaattgtacacagtaggtacttactaagtatttcttggaggaggtgtgtgcctggtacacagttggcactcaattcatgttttgttacataaaatggtatcggatataagggtctagcccataccaggtgctcaataccta

SEQ ID NO: 43252 - DNA, 601 bp, Human
gttagggcattatgctgatgtgtattcatctaatacgtgtaggaggtgatactatctatgattctaatttcgggcgaggaaaggagacattatgtaattgtttgttactaaaatgggccttggggatcacagggtcagggaccaccatgtgcatttgctcagcagagcagagctttctgcaaagagtctttcacagggccccatctcagcgagcaacagttcagagacccccttctcctggaatgcagaggcaatttttccttcatcttttctcactaaaatatctttctgaccctcctayggagacaaccgcttcttttgcacaataaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtgagactcgctgagtgcctggtatacagtaggcacttaataaaaacagcaaatgagaaaaaaacaa

SEQ ID NO: 43253 - DNA, 601 bp, Human
cctggcctgaaatgcacactttcattatgaattgtcttatgttatttcttcttcatattccagttagggcattatgctgatgtgtattcatctaatacgtgtaggaggtgatactatctatgattctaatttcgggcgaggaaaggagacattatgtaattgtttgttactaaaatgggccttggggatcacagggtcagggaccaccatgtgcatttgctcagcagagcagagctttctgcaaagagtctttcacagggccccatctcagcgagcaacagttcagagacccccttctccwggaatgcagaggcaatttttccttcatcttttctcactaaaatatctttctgaccctcctacggagacaaccgcttcttttgcacaataaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtgag

SEQ ID NO: 43254 - DNA, 601 bp, Human
gcctggcctgaaatgcacactttcattatgaattgtcttatgttatttcttcttcatattccagttagggcattatgctgatgtgtattcatctaatacgtgtaggaggtgatactatctatgattctaatttcgggcgaggaaaggagacattatgtaattgtttgttactaaaatgggccttggggatcacagggtcagggaccaccatgtgcatttgctcagcagagcagagctttctgcaaagagtctttcacagggccccatctcagcgagcaacagttcagagacccccttctcmtggaatgcagaggcaatttttccttcatcttttctcactaaaatatctttctgaccctcctacggagacaaccgcttcttttgcacaataaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtga

SEQ ID NO: 43255 - DNA, 601 bp, Human
ggttcagcgcttcactgagagtcagttgccattctggaaaatcccatgccaacatcatcagtgcctgaacttgacccttttccttgtatttgtagctgtcgccgtggatagacctaagtgtctgtctcttactgtgtcttctgttggtgtggcctggcccgagcattgatatgctgaaatgcactttatttatttatttttgtagagatggggtttccccatgttgcccaggctggtctcaaactcttgagctcaagtgatctgcccgcctcagtctcccaaagtactgggactacgggcrtgagccacctcgcctggcctgaaatgcacactttcattatgaattgtcttatgttatttcttcttcatattccagttagggcattatgctgatgtgtattcatctaatacgtgtaggaggtgatactatctatgattctaatttcgggcgaggaaaggagacattatgtaattgtttgttactaaaatgggccttggggatcacagggtcagggaccaccatgtgcatttgctcagcagagcagagctttctgcaaagagtctttcacagggccccatctcagcgagcaacagttcagag

SEQ ID NO: 43256 - DNA, 601 bp, Human
gttgttagtgaacagtggggccaaggatattttgggagtcctgcaatgacctggagagtctctgatgccaatccttgtctatatcccttatgactcttccaatgtctcacctgccactcatggaggtaaaaatctgtttgtaattagccaggcttagaacctaacctttatgactttagatttttacgctttttttttttttttttttttttttgagacaagagcctcactctgtcgcccaggttggagtgcagtggtgtgactttggctcactgcaacctccatctccccgggttcaagraattctcccacctcagcctcccgagtagctgggaatacaggcatgtgtcactgcgcccagctaatttttgtatttttagtagagacagggtttcaccatgttagccaggctggtctcaaactcctgacctcaggtgatcttcccaactcagcctcccaaggtgctgggtttacaggtgtgagccactctgtgcctggtctagatttttatgcttttaaatgaaagcattaacaagtgtttaaaatgttgttctaatacaagaatatcccatctgtgtgactctagagaagattgttcttt

SEQ ID NO: 43257 - DNA, 601 bp, Human
ggaacatgcaaacgcagtgcttctcagtggaggcggcacatctgctatggagattttggaaatcggtggaagccattatttggcttgtcacatgttgggggggggccgctgttgttagtgaacagtggggccaaggatattttgggagtcctgcaatgacctggagagtctctgatgccaatccttgtctatatcccttatgactcttccaatgtctcacctgccactcatggaggtaaaaatctgtttgtaattagccaggcttagaacctaacctttatgactttagatttttacgctytttttttttttttttttttttttgagacaagagcctcactctgtcgcccaggttggagtgcagtggtgtgactttggctcactgcaacctccatctccccgggttcaaggaattctcccacctcagcctcccgagtagctgggaatacaggcatgtgtcactgcgcccagctaatttttgtatttttagtagagacagggtttcaccatgttagccaggctggtctcaaactcctgacctcaggtgatcttcccaactcagcctcccaaggtgctgggtttacaggtgtgagccactctg

SEQ ID NO: 43258 - DNA, 601 bp, Human
attggaacatgcaaacgcagtgcttctcagtggaggcggcacatctgctatggagattttggaaatcggtggaagccattatttggcttgtcacatgttgggggggggccgctgttgttagtgaacagtggggccaaggatattttgggagtcctgcaatgacctggagagtctctgatgccaatccttgtctatatcccttatgactcttccaatgtctcacctgccactcatggaggtaaaaatctgtttgtaattagccaggcttagaacctaacctttatgactttagatttttacsctttttttttttttttttttttttttgagacaagagcctcactctgtcgcccaggttggagtgcagtggtgtgactttggctcactgcaacctccatctccccgggttcaaggaattctcccacctcagcctcccgagtagctgggaatacaggcatgtgtcactgcgcccagctaatttttgtatttttagtagagacagggtttcaccatgttagccaggctggtctcaaactcctgacctcaggtgatcttcccaactcagcctcccaaggtgctgggtttacaggtgtgagccact

SEQ ID NO: 43259 - DNA, 601 bp, Human
attgggaaacatgcagtagagtgatttgggatgaccatatcccagatggagccagggagagccggctggtcacaggcaaggcccaggcaccttcttcactctccttcccaagatggcagggacgccagtgagtggaggatgtttttagggatttgtcttgcacgtgcttccatttatgacaggctagaaacattgcacagaattggaacatgcaaacgcagtgcttctcagtggaggcggcacatctgctatggagattttggaaatcggtggaagccattatttggcttgtcacatgttcggggggggccgctgttgttagtgaacagtggggccaaggatattttgggagtcctgcaatgacctggagagtctctgatgccaatccttgtctatatcccttatgactcttccaatgtctcacctgccactcatggaggtaaaaatctgtttgtaattagccaggcttagaacctaacctttatgactttagatttttacgctttttttttttttttttttttttttgagacaagagcctcactctgtcgcccaggttggagtgcagtggtgtgactttggctcactgcaacctccatct

SEQ ID NO: 43260 - DNA, 601 bp, Human
aaccaccccaggcctgacagcaacagaacgtgtaaaacatgttcacagatcaatttcattcggcttttgcaatgaccgtagtccatcatggctatccctatttaaaaaaacttatttatttattagagacaaggttttgctctgtcagcgagggctggagtgcagtggtgcaatcacagctcactgtaaccttgaactcctgggctcaagcaatccccttttccccatgacctcaccctcccaagcagctaggactacaggcatgcaccaccatatctggctaatttttaaatttttttttgtagagataggatctcactgtgttgtccaggttggcctcagactgctgcactcaagcaatcctcccacctcagcctcccaaagtgctgggattacaggagtaaactaccacacccagcccactatccccattttaaagctgggaaaactaaggctaaaagagatcaagtgacttgtccaacgtgacgttgctcctgagaggtagggccctaagcagaaagaaggtttttccatattcaggggctagagggctccctccccagaccccaccctgctccaaaacatccacatcatccaacta

SEQ ID NO: 43261 - DNA, 601 bp, Human
ggagatttgttctggaagaaacctaagaggctggaaagatagaggtggctcttggactctcccagcctctgggcaggagattggtagggggcaggggtacccatttggcccaggctcagggaaaggatacaggtctcaatgttggctcccacgatgtaacccgtgacgtcgaagttgatgcggatgaatttgccctgccaacaggaaaacacagttcaggctttgctgcccaacttcagccgttaaccccatgctgtgggcaagcaggaggcagatggtacagaggatgggaggtggggcrgggagattcttgcgaacactcagaaccccacaggtcaagttgtcaggcggaaccaacatctgctgagctgaaaccaccccaggcctgacagcaacagaacgtgtaaaacatgttcacagatcaatttcattcggcttttgcaatgaccgtagtccatcatggctatccctatttaaaaaaacttatttatttattagagacaaggttttgctctgtcagcgagggctggagtgcagtggtgcaatcacagctcactgtaaccttgaactcctgggctcaagcaatccccttttccccatg

SEQ ID NO: 43262 - DNA, 601 bp, Human
aaaccaggggtccggtccacacatgtataaccactgcaccacaatgcctgctgttaaggggagatttgttctggaagaaacctaagaggctggaaagatagaggtggctcttggactctcccagcctctgggcaggagattggtagggggcaggggtacccatttggcccaggctcagggaaaggatacaggtctcaatgttggctcccacgatgtaacccgtgacgtcgaagttgatgcggatgaatttgccctgccaacaggaaaacacagttcaggctttgctgcccaacttcagcckttaaccccatgctgtgggcaagcaggaggcagatggtacagaggatgggaggtggggcggggagattcttgcgaacactcagaaccccacaggtcaagttgtcaggcggaaccaacatctgctgagctgaaaccaccccaggcctgacagcaacagaacgtgtaaaacatgttcacagatcaatttcattcggcttttgcaatgaccgtagtccatcatggctatccctatttaaaaaaacttatttatttattagagacaaggttttgctctgtcagcgagggctggagtgcagtggtg

SEQ ID NO: 43263 - DNA, 601 bp, Human
tatgaggcagataccattcattatcatccccattttgctgatgaggcacagagaggtggagtaaccagcccaaggtcactcagctaagggacagatcatttgagcatcacatgcagcctaggctgcttgtttagggttcaaaccaggggtccggtccacacatgtataaccactgcaccacaatgcctgctgttaaggggagatttgttctggaagaaacctaagaggctggaaagatagaggtggctcttggactctcccagcctctgggcaggagattggtagggggcaggggtacccrtttggcccaggctcagggaaaggatacaggtctcaatgttggctcccacgatgtaacccgtgacgtcgaagttgatgcggatgaatttgccctgccaacaggaaaacacagttcaggctttgctgcccaacttcagccgttaaccccatgctgtgggcaagcaggaggcagatggtacagaggatgggaggtggggcggggagattcttgcgaacactcagaaccccacaggtcaagttgtcaggcggaaccaacatctgctgagctgaaaccaccccaggcctgacagcaacagaacgt

SEQ ID NO: 43264 - DNA, 601 bp, Human
gaagtgaagatcatacgatagacactacgtagccagcccttactctgcacctcgcatggtgcctagagctttatatgagttcattcactctattctcacatttctatgaggcagataccattcattatcatccccattttgctgatgaggcacagagaggtggagtaaccagcccaaggtcactcagctaagggacagatcatttgagcatcacatgcagcctaggctgcttgtttagggttcaaaccaggggtccggtccacacatgtataaccactgcaccacaatgcctgctgttaasgggagatttgttctggaagaaacctaagaggctggaaagatagaggtggctcttggactctcccagcctctgggcaggagattggtagggggcaggggtacccatttggcccaggctcagggaaaggatacaggtctcaatgttggctcccacgatgtaacccgtgacgtcgaagttgatgcggatgaatttgccctgccaacaggaaaacacagttcaggctttgctgcccaacttcagccgttaaccccatgctgtgggcaagcaggaggcagatggtacagaggatgggaggtgggg

SEQ ID NO: 43265 - DNA, 601 bp, Human
tggctccacttcaccgctcaggttcatgaaagagatgctctacttgttccttgcgataccagcattcttctgggtaaactctgttttcatcaatttcctacctaagaagtggagccgatcacagaccaactctctaagaggacgacaggtccagaatttggcctcggacaatggctgaataaggatgaagtgaagatcatacgatagacactacgtagccagcccttactctgcacctcgcatggtgcctagagctttatatgagttcattcactctattctcacatttctatgaggcagrtaccattcattatcatccccattttgctgatgaggcacagagaggtggagtaaccagcccaaggtcactcagctaagggacagatcatttgagcatcacatgcagcctaggctgcttgtttagggttcaaaccaggggtccggtccacacatgtataaccactgcaccacaatgcctgctgttaaggggagatttgttctggaagaaacctaagaggctggaaagatagaggtggctcttggactctcccagcctctgggcaggagattggtagggggcaggggtacccatttggcccag

SEQ ID NO: 43266 - DNA, 601 bp, Human
agaggaagctactccacaacccaccctcttatccagggcacataacgtggaaaaatgggaccactaggtgctgctagaggacctcaggtgcagaaagaagctaagtcaggcccccaggtcctattcattgccaagcacgtgttccacaggaagcctgagccctagggccgcctgcaaagctcctgaggctgatcagtcactgaactctagacctggttgttcccccacgtccagaaatttctaacttggctccacttcaccgctcaggttcatgaaagagatgctctacttgttccttgcrataccagcattcttctgggtaaactctgttttcatcaatttcctacctaagaagtggagccgatcacagaccaactctctaagaggacgacaggtccagaatttggcctcggacaatggctgaataaggatgaagtgaagatcatacgatagacactacgtagccagcccttactctgcacctcgcatggtgcctagagctttatatgagttcattcactctattctcacatttctatgaggcagataccattcattatcatccccattttgctgatgaggcacagagaggtggagtaac

SEQ ID NO: 43267 - DNA, 601 bp, Human
tttgggcccagtaccgtaccaagggctgtgcatattattatgcatattatttcatttaacccctgcaccagctccagaaactaggtgcaatcacccccattttaccgaggcaaaactgaggcccagagagcttcagtgattttcccaaatccccacagcttagacaagtacagtggagaggaagctactccacaacccaccctcttatccagggcacataacgtggaaaaatgggaccactaggtgctgctagaggacctcaggtgcagaaagaagctaagtcaggcccccaggtcctatwcattgccaagcacgtgttccacaggaagcctgagccctagggccgcctgcaaagctcctgaggctgatcagtcactgaactctagacctggttgttcccccacgtccagaaatttctaacttggctccacttcaccgctcaggttcatgaaagagatgctctacttgttccttgcgataccagcattcttctgggtaaactctgttttcatcaatttcctacctaagaagtggagccgatcacagaccaactctctaagaggacgacaggtccagaatttggcctcggacaatggctgaa

SEQ ID NO: 43268 - DNA, 601 bp, Human
gccctctgttccaagagtggggtctgacgggatggaggcgagagagaccgtaaacacgccacactaattaatttcaggagagcttctccgcgatgcggggtggcaggagggagagcagaggggagggcaggtgagggtggcatggagatcacagggtccggggtgatgggaaagggcagctaggaggctgggctactgtactgggtggatttccacagcactaagcatgatggtgcgggatgatggggctagatcagcagaccttgtcttcttcaagtcctaaagccagctagcagtgccygggctaccacagcccatgtccaatctggaaagcagtgattctcagactttctcatggtgtacatgggtatacacacgcacacatacacacacacacacacacacacacgcacgtatgtttgagccagagtctcgctctgtcacccaggctggagggcagtgtgtgatcttggctcactgcaacctctgcctcccggatccaagcaattctcctgcctcagcctcctgagtagctgggactacaggtgcatgccaccacgcctggataatttttgtatttttagtagagacagggtttcac

SEQ ID NO: 43269 - DNA, 601 bp, Human
tatgctaggaaataagtgcaactattatcagtgttttcaataaggggaaactgaggctcagagaagagaagtcctttctcaagatgatacagctaacaagtggcaaagctgtcttccatgccctctgttccaagagtggggtctgacgggatggaggcgagagagaccgtaaacacgccacactaattaatttcaggagagcttctccgcgatgcggggtggcaggagggagagcagaggggagggcaggtgagggtggcatggagatcacagggtccggggtgatgggaaagggcagctrggaggctgggctactgtactgggtggatttccacagcactaagcatgatggtgcgggatgatggggctagatcagcagaccttgtcttcttcaagtcctaaagccagctagcagtgcccgggctaccacagcccatgtccaatctggaaagcagtgattctcagactttctcatggtgtacatgggtatacacacgcacacatacacacacacacacacacacacacgcacgtatgtttgagccagagtctcgctctgtcacccaggctggagggcagtgtgtgatcttggctcactgca

SEQ ID NO: 43270 - DNA, 601 bp, Human
cctcacaaagtatgctaggaaataagtgcaactattatcagtgttttcaataaggggaaactgaggctcagagaagagaagtcctttctcaagatgatacagctaacaagtggcaaagctgtcttccatgccctctgttccaagagtggggtctgacgggatggaggcgagagagaccgtaaacacgccacactaattaatttcaggagagcttctccgcgatgcggggtggcaggagggagagcagaggggagggcaggtgagggtggcatggagatcacagggtccggggtgatgggaragggcagctaggaggctgggctactgtactgggtggatttccacagcactaagcatgatggtgcgggatgatggggctagatcagcagaccttgtcttcttcaagtcctaaagccagctagcagtgcccgggctaccacagcccatgtccaatctggaaagcagtgattctcagactttctcatggtgtacatgggtatacacacgcacacatacacacacacacacacacacacacgcacgtatgtttgagccagagtctcgctctgtcacccaggctggagggcagtgtgtgatcttg

SEQ ID NO: 43271 - DNA, 601 bp, Human
tgtctcactgaagcctcacaaagtatgctaggaaataagtgcaactattatcagtgttttcaataaggggaaactgaggctcagagaagagaagtcctttctcaagatgatacagctaacaagtggcaaagctgtcttccatgccctctgttccaagagtggggtctgacgggatggaggcgagagagaccgtaaacacgccacactaattaatttcaggagagcttctccgcgatgcggggtggcaggagggagagcagaggggagggcaggtgagggtggcatggagatcacagggtcyggggtgatgggaaagggcagctaggaggctgggctactgtactgggtggatttccacagcactaagcatgatggtgcgggatgatggggctagatcagcagaccttgtcttcttcaagtcctaaagccagctagcagtgcccgggctaccacagcccatgtccaatctggaaagcagtgattctcagactttctcatggtgtacatgggtatacacacgcacacatacacacacacacacacacacacacgcacgtatgtttgagccagagtctcgctctgtcacccaggctggagggca

SEQ ID NO: 43272 - DNA, 601 bp, Human
aaatggaaccgctgggtgctgccagcagacttcagatgcaaaaaaaagggaggggaatagagtgaaaagaaaaagcataaaaaggctccaggaagaaggtaatggtaacgagatgttcccctaacagccatcaccagcaaatcttctttaaaatgagctgtcttcagacatgacagaatacaaataatgacaccatctatgatcctatgatttatgattcattcctgtgtgaaatgattgatataaattgtctcactgaagcctcacaaagtatgctaggaaataagtgcaactattatcrgtgttttcaataaggggaaactgaggctcagagaagagaagtcctttctcaagatgatacagctaacaagtggcaaagctgtcttccatgccctctgttccaagagtggggtctgacgggatggaggcgagagagaccgtaaacacgccacactaattaatttcaggagagcttctccgcgatgcggggtggcaggagggagagcagaggggagggcaggtgagggtggcatggagatcacagggtccggggtgatgggaaagggcagctaggaggctgggctactgtactgggtggatt

SEQ ID NO: 43273 - DNA, 601 bp, Human
ttatgtgttgcctatgttcattggtttatgtgctgcctgtgctcattggtttatgtactgcctgtgctcattggtttatgtgttgcctgagctcactggtttatgtgttgcctgcactcattggtttatatattgcctgtggctgctcttgtattacaatggcagagttgaatagctgtgccagaagccacctggcctgcaaagcctgaagatttactatctggccttttacagaaaaagtcttgacccctgttctacaaagtcactggcaaaacatgtataatgaaaaatgcttagtccygctgcccctgcaaattccttataaaaccagaatgcatcttttatatttgcaagttttataaattggcaagtaaggcaaatgtctttctccctttccttgaaggcgtagattgtgtctagttggacttgatgctctctggtctaatgagacatgaatcattaatgatctaatgtctaattggagttgatggctactatgtcacatagtaggtgctcagtaaatgagaatgactgaacacaagccacactcactcattgggaggagatgaagaactgttcatatgtcactcacagacatggt

SEQ ID NO: 43274 - DNA, 601 bp, Human
tgcctgtttttgtaaataaagttttattgtaacacagtgatgcatctgcactcactgatttatgtgttgcctatgttcattggtttatgtgctgcctgtgctcattggtttatgtactgcctgtgctcattggtttatgtgttgcctgagctcactggtttatgtgttgcctgcactcattggtttatatattgcctgtggctgctcttgtattacaatggcagagttgaatagctgtgccagaagccacctggcctgcaaagcctgaagatttactatctggccttttacagaaaaagtyttgacccctgttctacaaagtcactggcaaaacatgtataatgaaaaatgcttagtcctgctgcccctgcaaattccttataaaaccagaatgcatcttttatatttgcaagttttataaattggcaagtaaggcaaatgtctttctccctttccttgaaggcgtagattgtgtctagttggacttgatgctctctggtctaatgagacatgaatcattaatgatctaatgtctaattggagttgatggctactatgtcacatagtaggtgctcagtaaatgagaatgactgaacacaag

SEQ ID NO: 43275 - DNA, 601 bp, Human
tttaccaaaaattgctccacctcatagcctatgttcctgaaagccagccattaaggaaacttatttttattgtttgagacagagtctcactctatcgcctaggctggagtgcagtggtgcaatcttagctcactgcaaactccaccttctaggttcaagtgattctcctgcctcagcctcccaagtagctgggatgacaggcgccagccaccacacctggctaatttttgtatttttggggagacagggtttcactatcttggccgagctggtctcaaactcctgacctcaggtaatccgyccgcctctgcctccgaaagtgtgggattacaggcatgagccactttgccccaccctggaaatttaaataatggataatgccaccccctagtagctgaggtctacaatacactccgacacagcgaagttctgagctcacacagatccttttggtaactgtcttaaccaaaataactaaccttgggccacaaaagagatgggaagcaaagtctgtattgttcccatagaatttcagactcaaaacttattactaacatgtagactctactatgtacagatagtcactgatccattccttttt

SEQ ID NO: 43276 - DNA, 601 bp, Human
tgctggtacataaaaaatccattcagcattccccctttaccaaaaattgctccacctcatagcctatgttcctgaaagccagccattaaggaaacttatttttattgtttgagacagagtctcactctatcgcctaggctggagtgcagtggtgcaatcttagctcactgcaaactccaccttctaggttcaagtgattctcctgcctcagcctcccaagtagctgggatgacaggcgccagccaccacacctggctaatttttgtatttttggggagacagggtttcactatcttggccragctggtctcaaactcctgacctcaggtaatccgcccgcctctgcctccgaaagtgtgggattacaggcatgagccactttgccccaccctggaaatttaaataatggataatgccaccccctagtagctgaggtctacaatacactccgacacagcgaagttctgagctcacacagatccttttggtaactgtcttaaccaaaataactaaccttgggccacaaaagagatgggaagcaaagtctgtattgttcccatagaatttcagactcaaaacttattactaacatgtagactct

SEQ ID NO: 43277 - DNA, 601 bp, Human
acaaacggcccctgggaatttagttctgagccctatacttgcccatttctggaagaccagaggcaaagcacaaaactggaacccaaggtaccaaacaaccaaactgttttcttgggtgccaaataaaaggaaaaggaatgtcaacatttttccctggcccattccacagggtcctgcactgtaactgctaatataccatgtttgctggtacataaaaaatccattcagcattccccctttaccaaaaattgctccacctcatagcctatgttcctgaaagccagccattaaggaaacttawttttattgtttgagacagagtctcactctatcgcctaggctggagtgcagtggtgcaatcttagctcactgcaaactccaccttctaggttcaagtgattctcctgcctcagcctcccaagtagctgggatgacaggcgccagccaccacacctggctaatttttgtatttttggggagacagggtttcactatcttggccgagctggtctcaaactcctgacctcaggtaatccgcccgcctctgcctccgaaagtgtgggattacaggcatgagccactttgccccaccctggaaatt

SEQ ID NO: 43278 - DNA, 601 bp, Human
tacctttcctttcctccagctattttttttttttttttttgagagggagtttcacctttgtccaggttggagtgcagtggtgcgatattggctgctcactgcaacctctgcctcccggattcaagcaattctcctgcctctcgagtagctgggattacaggcacccaccaccatgcccaggtaatttgttgtatttttagtagagacggggtttcatcatgttggctagtctagtcttgaacccctgacatcaggtgatccacccgcctcagcctcccaaagtgctgggattacaggtgtsagccaccgtgcccagccacccccagctatttttagttgaatcaatatataaggcttatatcacaggttggcaaatctggtcccctgttgtttttgtaaataaagttttattgaaacacagctgctctgatgtccttgtttatttctcatggctgctttctcactaggcaacagagttgagtagttgcaacagaggccatctggtccttaaagtctaaaacgtttactactgaccctttagcaaaaacagtttgccaactccctttttatgacattaattagatattctgtgtcaaactgt

SEQ ID NO: 43279 - DNA, 601 bp, Human
ctacattatggtgactagtataattatttcattgtatattacaatgtaataataaagtgcacagtaaatgtaatacacgtgaatcatccccacaccatccccccaaccctgcccgcccagtctgtggaaaacttttcttccaggaaaccagtcctcagtgccaaaagtaacaggtgcttttggcctattggaagaccagaggcaaagcacaatcgctgtaataggcgatttctggatatgtcaagtttagatagtatctagtgacttcctgctatggtaggcaaaaatgcagctttcttayactacctttcctttcctccagctattttttttttttttttttgagagggagtttcacctttgtccaggttggagtgcagtggtgcgatattggctgctcactgcaacctctgcctcccggattcaagcaattctcctgcctctcgagtagctgggattacaggcacccaccaccatgcccaggtaatttgttgtatttttagtagagacggggtttcatcatgttggctagtctagtcttgaacccctgacatcaggtgatccacccgcctcagcctcccaaagtgctgggattacaggt

SEQ ID NO: 43280 - DNA, 601 bp, Human
tgagctccgcttcccataagatcagcagcagcattagattctcataggagcgcaaaccctatcgtgagctgcacatgtgccctccttataacactctaatgcctgataatctgtcactgtcccccatcaccccccgatgggactgcaggaaaacaagctcccaatgattctacattatggtgactagtataattatttcattgtatattacaatgtaataataaagtgcacagtaaatgtaatacacgtgaatcatccccacaccatccccccaaccctgcccgcccagtctgtggaaaamttttcttccaggaaaccagtcctcagtgccaaaagtaacaggtgcttttggcctattggaagaccagaggcaaagcacaatcgctgtaataggcgatttctggatatgtcaagtttagatagtatctagtgacttcctgctatggtaggcaaaaatgcagctttcttatactacctttcctttcctccagctattttttttttttttttttgagagggagtttcacctttgtccaggttggagtgcagtggtgcgatattggctgctcactgcaacctctgcctcccggattcaagcaat

SEQ ID NO: 43281 - DNA, 601 bp, Human
accctgcccacatgttcctgatgaggccaacatctctaccttcagctccaagaatccattcttagggaccataatgaaaccaccctgcgctttccacaaccctgcctatgctgcatagctcaggaatgtgcatatcaacctaagccaaccaatcagagtcaatgacactccattcaggaacttaagccgggaatctactctgttctttggacataaacccaaagaatataagggctggaacccagctatgttgctgtcaacaaactgcatcctatagagaaacaatgtagtcgagagagayagaagacaagaaattaggttctagaaaaatcttttgaacacctagatctcactgtacctgaagcttgaattcctgaactttttttttttttgagatggagtctagctccatctcccaagctggagtggagtggtgtaatcttggctcactgcaacctctgccttccgggttcaagcaatcctcccacctcagcctcctgagtagctaggactacaagtgtgcaccaccagccctggctaattttttttttgtatttttagtagagacagggtttcaccaaattgaccaggttggtctcga

SEQ ID NO: 43282 - DNA, 601 bp, Human
tccagaccccaagttatcttcggaggagctgcccctccccttatgcagcatttcagcaacctcagtgctattctggggctccaaacgggcgtaggcgtgggaaggaagggaaactttccacagttctgtcctggtgttcctgaaagagattaaccttcaacactgaggcacatctaacgcagaaggaaaatcgtttctggaaacacagtgtcccgaccaagaatttctttctgagctgtcctgttctcaagacccagtgtgtttcttggccattggttggatgattttgatcaatatcaaytgatcaccagagcaacccctccaggaaaagcctgagtaaatccactgcctcgatcactccccctcccctaaaccctgcccacatgttcctgatgaggccaacatctctaccttcagctccaagaatccattcttagggaccataatgaaaccaccctgcgctttccacaaccctgcctatgctgcatagctcaggaatgtgcatatcaacctaagccaaccaatcagagtcaatgacactccattcaggaacttaagccgggaatctactctgttctttggacataaacccaaagaatat

SEQ ID NO: 43283 - DNA, 601 bp, Human
atcaacctattttagtttgttccagtttttttctatttattttttttgtagagacagagtctcactgtgttatccaggctggtctcgaactcctgggctcaagcaatcctcttgcctcagtgtctccaaatgctgggattacaggcatgagccactgtgcccagcctgttccagttttttattatttaaataaaactatactgaacagtgtagtacatcaagaaaaaaggatttggtaaattcctggcacacagcaaatacttaaccattgttcattgttatttaaaagcaagattagaagcaaaactgacccctgtcccaaatgaaatgaatcattcttggagggcctatgtcattcagacaaggaggctatcagcactagattctgatgtgggaccctggccaagacccacatacaccatccatttgtcaactgacccatacagcctaattttccagaccccaagttatcttcggaggagctgcccctccccttatgcagcatttcagcaacctcagtgctattctggggctccaaacgggcgtaggcgtgggaaggaagggaaactttccacagttctgtcctggtgttcctgaaaga

SEQ ID NO: 43284 - DNA, 601 bp, Human
gggctgattgtttgagcccaggagttcaagaccagagaatactggataacatggtgaagccttgtctctacccacccctccaaaaatcaaaccaaaacaaaacaaaaaaccccaggccaggcacggtggctcatgcctgcaatcccagcactttgggaggccaagatgggtggatcatctgaggtcaggagtttaagaccagcctggccaacatggcgagacccagtatctactaaaaatacaaaaaaaattagtggggcatggtggtgggcgcctataatcccagctacccaggaggctsagccaagagaattgcttgaacccaggaggcagaggttgcagtgagccgaggtcgtgccactgcactccagcctgggtgacaatagcaagcctccatctcaaacaaaacaaaacaaaaaccctaaaatcaaaaattagccaggcgtggtagcacatgtctgtagtctcaacgacttgagaggctgagctgggaggactgcttgagcctgcaaggcagagattgcagtgagctgagactgcgccaccgtactccagcctaggtgacagagtggtgtgatctcggctcactgcagcttcgacc

SEQ ID NO: 43285 - DNA, 601 bp, Human
gccaaggtgggctgattgtttgagcccaggagttcaagaccagagaatactggataacatggtgaagccttgtctctacccacccctccaaaaatcaaaccaaaacaaaacaaaaaaccccaggccaggcacggtggctcatgcctgcaatcccagcactttgggaggccaagatgggtggatcatctgaggtcaggagtttaagaccagcctggccaacatggcgagacccagtatctactaaaaatacaaaaaaaattagtggggcatggtggtgggcgcctataatcccagctacccrggaggctcagccaagagaattgcttgaacccaggaggcagaggttgcagtgagccgaggtcgtgccactgcactccagcctgggtgacaatagcaagcctccatctcaaacaaaacaaaacaaaaaccctaaaatcaaaaattagccaggcgtggtagcacatgtctgtagtctcaacgacttgagaggctgagctgggaggactgcttgagcctgcaaggcagagattgcagtgagctgagactgcgccaccgtactccagcctaggtgacagagtggtgtgatctcggctcactgcag

SEQ ID NO: 43286 - DNA, 601 bp, Human
acacccggctaatttttctatttttagtagagacggagtttcaccatgttggccaggctggtctcaaactcctgacttcaagtgatccatgtgccttggcctcccatagggttgggattataggccacagtgcccggcctacccatatttaaactttaggaaccaatttctaaaaattttgaaggttgtagtggccgatctctcctgtgggctcaggaaccattggtttgcactttctggtatagttaaatgtaattccagaaatgacaaaagaatgccaccactcccaggccataagagrtgaaccttggggcagaattagcagacagcaaagaagtaaaccagtgaggagacacaacacagcaagggtggtgacggctggcagcatcctggtgtgctggtgcaaagcacgcgctctgcagttagagagtcctgagttcaaatcccagctttgcttcttataaatctcattatctctgaatttccaaatcctagttccgggtccagatacacatggggagggagggagatggatggatggcagatggagggtgaatggatggatgaatgtataaatgtatagaggatgggttcatggatg

SEQ ID NO: 43287 - DNA, 601 bp, Human
acagaggattgatggatagacgatggatagatggatggagaattgatggaggaatggatacagcattgatggatggatgatggatggatgaatggatggatggacagatgatggatggatggtagatggatgaatggatggatgatgattaatgcaaattcttggcttagcttaactcaggtacaaatcacccagagttctggcttcaaatcagtcactatgttccaggaacaaagcctagagatcccagacttctctggttcctcaggccaaaccagacattacaaggcccttcacaacrgctattctcacgccatggggtccctggcccagctcagcaaaaggacccagctgctgaccacccatccatttgctcccacttactatggtagaaagccttctccccaaaatgaatgaagctgctgttgacagggcttggaaacacacttccttttaaccataacatctatgaaagagtctttgtaaactatgaagagttgcactcacagttttaaaagtgtcaatttaaactaaagattcctgaaatgcctgcacagcccaggcgagccggccaactcagggtttctcaatcttgtcactg

SEQ ID NO: 43288 - DNA, 601 bp, Human
gacagaggattgatggatagacgatggatagatggatggagaattgatggaggaatggatacagcattgatggatggatgatggatggatgaatggatggatggacagatgatggatggatggtagatggatgaatggatggatgatgattaatgcaaattcttggcttagcttaactcaggtacaaatcacccagagttctggcttcaaatcagtcactatgttccaggaacaaagcctagagatcccagacttctctggttcctcaggccaaaccagacattacaaggcccttcacaacagctattctcacgccatggggtccctggcccagctcagcaaaaggacccagctgctgaccacccatccatttgctcccacttactatggtagaaagccttctccccaaaatgaatgaagctgctgttgacagggcttggaaacacacttccttttaaccataacatctatgaaagagtctttgtaaactatgaagagttgcactcacagttttaaaagtgtcaatttaaactaaagattcctgaaatgcctgcacagcccaggcgagccggccaactcagggtttctcaatcttgtcact

SEQ ID NO: 43289 - DNA, 601 bp, Human
gaccatgtcataaaaaaaaaaaaaaaaaaaaaaaaagcaatggcagagaaggaaagggaagggaaagagggtagggaagaaaaaaaggaagaaaaaagaggatggaaggaaggcagaaattaaagaaaatacctttgatatgaaaatgtgggttaatggaaattgtaagagttcacaaggattcagcttacagcctttcaggactgggtgatggattgggtgggggaatgctatgtgcatggggagagtgtggggtccacgtcggctccacagaggccacacacgtgtacaaggtgtgacrgagccccgcacgcccacgtgcccctcaccggtcgctcgatgagctcgatgcagggctgtaggtccagcccaaagtcgatgaagttccactcgatgccctcgcgctggtactcctcctgctccaggatgaacatggtgtggttgaagagctgctgcagcttctcgttggtgtagttgatgcacagctgctcgaaggagttcacctgagcacatggcgtgggggcggggcgtgagcatcttggtatgaagtcagaagacaaggagccccacagaagctccacccgacagcgcccccatggcc

SEQ ID NO: 43290 - DNA, 601 bp, Human
gggcaacacgcaggcaacatcatgaagagttcataactcttttttttttttttttttttttgagacagagttttgccttgtcgcccaggcagacggtgcagtggcgcgatctcgactcactgcaagctccgcttcctgggttcacgccattctcctgcctcagcctcccgagtagctgggactacaggcgcctgccacggcgcccggctgattttttctatttttagtagaggcggggtttcaccgtgttagccaggatggtctccatctcctgacctcgtgatccgcccgcctcggcctyccaaagtgctgggattacaggcatgagccaccgcgcccggccgagttcataattcttgcaaatgaatttgttgcttgacttgaattcacctagggttcctgttagaaaagttttttttggagacagggtctcactctgttatccaggctggaatgcagtggcgcaatctcggcttacagcaacctctgcctccagggctcaagcaatcctcccacctcagcctcccaaatagctgggaccacaggcgtgcaccaccaggcccggctaattagtagaaaccctgtctctactgaaaataca

SEQ ID NO: 43291 - DNA, 601 bp, Human
ggatggaaggcagaacataatgtttgctgccgccccctagtgggcaacacgcaggcaacatcatgaagagttcataactcttttttttttttttttttttttgagacagagttttgccttgtcgcccaggcagacggtgcagtggcgcgatctcgactcactgcaagctccgcttcctgggttcacgccattctcctgcctcagcctcccgagtagctgggactacaggcgcctgccacggcgcccggctgattttttctatttttagtagaggcggggtttcaccgtgttagccaggatrgtctccatctcctgacctcgtgatccgcccgcctcggcctcccaaagtgctgggattacaggcatgagccaccgcgcccggccgagttcataattcttgcaaatgaatttgttgcttgacttgaattcacctagggttcctgttagaaaagttttttttggagacagggtctcactctgttatccaggctggaatgcagtggcgcaatctcggcttacagcaacctctgcctccagggctcaagcaatcctcccacctcagcctcccaaatagctgggaccacaggcgtgcaccaccagg

SEQ ID NO: 43292 - DNA, 601 bp, Human
atccgccgagatctgatactgtatttgcccacatataaagatgagtttatgacccccatgcttccaaatctaccttcaaattaccctgtgcccaatggaccagtaacagggatggaaggcagaacataatgtttgctgccgccccctagtgggcaacacgcaggcaacatcatgaagagttcataactcttttttttttttttttttttttgagacagagttttgccttgtcgcccaggcagacggtgcagtggcgcgatctcgactcactgcaagctccgcttcctgggttcacgccatyctcctgcctcagcctcccgagtagctgggactacaggcgcctgccacggcgcccggctgattttttctatttttagtagaggcggggtttcaccgtgttagccaggatggtctccatctcctgacctcgtgatccgcccgcctcggcctcccaaagtgctgggattacaggcatgagccaccgcgcccggccgagttcataattcttgcaaatgaatttgttgcttgacttgaattcacctagggttcctgttagaaaagttttttttggagacagggtctcactctgttatccaggctg

SEQ ID NO: 43293 - DNA, 601 bp, Human
atgatcgcaccactgcactccagcctgggcgacaaagcgagaccctgtctccaacaaaaacagaaagaaataactgtctggacgtcacggttggaaaacatgagagtggctacagctgatgccttacagatgcgtagacaaattacgaataggacttggttgggattcgcttagcagcagatggctttgcagtttccaggcagcccaaggttctgccactctcagactgtctctgcgctgagcagccactgggggtcccctgagacagagtcccctgggccctgtggctggtaccttcccrgcataatggatgatggagaactcagtcttgtccttgagctgcttgggcttctggaacttggggtggctgccctgctccgtgcacagcttctccacgaaagacttgtccgtggctttggggaaccagcattcctcgtccagcagggccagcacacctggagggttgttctgtgggagacaagtagggcttgaatcagagagaacacccaacctcaggcattccatgaagagctggccaactatacacaacgcatgggcatccgccgagatctgatactgtatttgcccacatataaagatg

SEQ ID NO: 43294 - DNA, 601 bp, Human
gaggccaggtacagtggctcgtgctcataatcccagcacttcaggaagccgaggcagggagatctcttgagcccaggaattcaagaccagcctgggcaacacagcaagaccccatatctatacataatttaaaaatttagctgggcggccaggcacggtggctcatgcctgtaatcctagcaccttgggaggccgaggcgggtggatcacctgaggtcaggagtttgagaccagcctggccaacatggcgaaacccttctctactaaaaatacaaaaattagctgggtgtggtggcaggtrcctgtaatcccagctatttgggaggctgaggcaggagaatctcttgaacccggagggagaggttgcagttagcagagatcacgccattgcactccagcctggatgacaagagcaaaattccatctcaaaaaggaaaaaagattttagctgggcatggtggtgtacacctgtagtcccagctacttgggaagctgaggcaggaggatcgtgtgagcccaggaggttgaggctgtagtgagctatgatcgcaccactgcactccagcctgggcgacaaagcgagaccctgtctccaacaaaa

SEQ ID NO: 43295 - DNA, 601 bp, Human
gggcctatacaataacagccaaggcatgttgatgatgatgatgatgatgatgaatacaactatcatagatttccctggccagagcaggctggcaatagcaaactcaagaccgtgacatgggagatttttgttgaagccaggtgtggatgtattagtcaccccattccagttggccccgcctgttgggtataacttgtagcaggaaggatttagagtctatacaagaaaagcaggctgaggccaggtacagtggctcgtgctcataatcccagcacttcaggaagccgaggcagggagatckcttgagcccaggaattcaagaccagcctgggcaacacagcaagaccccatatctatacataatttaaaaatttagctgggcggccaggcacggtggctcatgcctgtaatcctagcaccttgggaggccgaggcgggtggatcacctgaggtcaggagtttgagaccagcctggccaacatggcgaaacccttctctactaaaaatacaaaaattagctgggtgtggtggcaggtgcctgtaatcccagctatttgggaggctgaggcaggagaatctcttgaacccggagggagaggtt

SEQ ID NO: 43296 - DNA, 601 bp, Human
gttgggaaacttttggtgaaggcccagatagtagatatttttggcttggcaagtcatacaatgttttgtttgtttgtttgttttggtttttgagacagagtggttctctgttgcccagtctggagtgcagtggtgcagtctcagctcactgcaacctccaacttcctgggtcaagcagttctcttgcctcagcctcctgagtagctgaggttacagttgtgtgcctgtaatctcacagctggctaatttttaaattttttttattttttatttttagcagagacgggctttcgccatgttrgccaggctggtctcaaactgctgacctcaagtaatccacctgccttggtgctggggttacaggcgtgagccaccacacccagccaagtcatacagtctttgtcgcagctactcaactctagcactgtagtatacaaaagcagccagccatagacattatgcatacaaatgggcatggctgtgttccaataaaactttatttacaataacaagctgtgggccagatcggactctgttgccaggccctggtagagagcattgtttgtgcccatgatgcagtggaggtactgaggagtcaata

SEQ ID NO: 43297 - DNA, 601 bp, Human
ttgttggccaggctggagtgcaatggcgtgatctcggctcaccacaacctccgcctcccgggttccagcaattctcccgcctcagcctcccagtagctgggattacaggcatgcgccaccacgcccggctcattttttttatatttttagtagagacagagtttctccatgttggtcaggctggtctcgaactcctgacctcaggtgattcccctgccttggcctcccaatgtgctgggattacaggcgtgagctaccgcgcccggccatcatcatcatcatcatcatcatcatcatcataacctccaaggttctttttctaccagcccagcaggtcctgcacatgccaagcccaacccacaggccatggatggcaccatttcttcaccttctactcagattctgtgtaacaatcttttttttttttttttttttttgagacaagctctcactctgtcgcccagctggagagcagtggcacgatcttggctcactgcaaccttcaccacccaggttcaggtgattctcctgccttagcctcctgagtagctgggattacaggcacccaccagcacacccggctaattttgtttttattttt

SEQ ID NO: 43298 - DNA, 601 bp, Human
cacactccgagatagcctggcacatcagtaagtgctcaacaaaaagtaggtattattattattattattattattattattattattattatcattattttattttattgagacggagtttcactcttgttggccaggctggagtgcaatggcgtgatctcggctcaccacaacctccgcctcccgggttccagcaattctcccgcctcagcctcccagtagctgggattacaggcatgcgccaccacgcccggctcattttttttatatttttagtagagacagagtttctccatgttgrtcaggctggtctcgaactcctgacctcaggtgattcccctgccttggcctcccaatgtgctgggattacaggcgtgagctaccgcgcccggccatcatcatcatcatcatcatcatcatcatcatcacctccaaggttctttttctaccagcccagcaggtcctgcacatgccaagcccaacccacaggccatggatggcaccatttcttcaccttctactcagattctgtgtaacaatcttttttttttttttttttttttgagacaagctctcactctgtcgcccagctggagagcag

SEQ ID NO: 43299 - DNA, 601 bp, Human
gtgctctcttagacaaggaggtggtgggctctgctaagttgatatttgagcagaaaccagcaagaaatgagtgggtaaccatgtaggtatccacggaagaaatattctgaggcagaagatacagcacacactccgagatagcctggcacatcagtaagtgctcaacaaaaagtaggtattattattattattattattattattattattattattatcattattttattttattgagacggagtttcactcttgttggccaggctggagtgcaatggcgtgatctcggctcaccacaacstccgcctcccgggttccagcaattctcccgcctcagcctcccagtagctgggattacaggcatgcgccaccacgcccggctcattttttttatatttttagtagagacagagtttctccatgttggtcaggctggtctcgaactcctgacctcaggtgattcccctgccttggcctcccaatgtgctgggattacaggcgtgagctaccgcgcccggccatcatcatcatcatcatcatcatcatcatcatcacctccaaggttctttttctaccagcccagcaggtcctgcacatgcca

SEQ ID NO: 43300 - DNA, 601 bp, Human
ttggggaagccctgccggcagatgcgaatgccttccagcaccccattgcaccgcagctgctccagcaccaggaacgcatccagcttgccggactgcaaaggtcaaagagggcagtggatccctggggccagaaaccatggcgcagcaaagccccaaacctcctacctggatgacccacctggccaggccatgagggtaccaacagaagcacccaaggagggcttagctgagggccgaggggcaaagcagtgcccccctctgggttttcatctctttgcttcggcaatggctgcctcatgawctctctggttcttggtgacactagcatcgcctggctggaacctggggcttcctcctcatcacctcgtctccctcacttcctgtccatcagcagtttgattgcttctagctcccaaatatctcccaacccccccacttctcttcaccaccattgtctccactatcttctcctgcctggacaaccacagaaaccacccacctggtctctctctctggtcttgcctctcccctcaatccctttgtcctttttattttttgagatagggtcccattctgtcagccaggctggagtccagtggtg

SEQ ID NO: 43301 - DNA, 601 bp, Human
tgctctgccctatcctgtataagttggggtcaagttccagggctttgatctgcaaaaggaaggaaaggaagagctcctgatttccactgtgccatttggccagtgatgacatgggtaagaacggtcccaccaagagcagcaggtggcttgcggccagaggttgggaggtctctggtggacttctgggctcaccatgagaatgcaggcctgcttcccgtccatgaagcctttggggatggcattcgccgccaggatctcgtagcttgaaacacagagcagaagtcaccccgggtacctccarcatccattcctccacccagtcccgctcaccccctgccctacctgggccagaccttgggacttaccgttggcggaactcctggaagacgatccggttggggaagccctgccggcagatgcgaatgccttccagcaccccattgcaccgcagctgctccagcaccaggaacgcatccagcttgccggactgcaaaggtcaaagagggcagtggatccctggggccagaaaccatggcgcagcaaagccccaaacctcctacctggatgacccacctggccaggccatgagggtaccaacaga

SEQ ID NO: 43302 - DNA, 601 bp, Human
catcggtgatcttcaaatctcgctcctcctctaggtgggccaggacgccagttcggaagaagattttgctctgccctatcctgtataagttggggtcaagttccagggctttgatctgcaaaaggaaggaaaggaagagctcctgatttccactgtgccatttggccagtgatgacatgggtaagaacggtcccaccaagagcagcaggtggcttgcggccagaggttgggaggtctctggtggacttctgggctcaccatgagaatgcaggcctgcttcccgtccatgaagcctttgggratggcattcgccgccaggatctcgtagcttgaaacacagagcagaagtcaccccgggtacctccagcatccattcctccacccagtcccgctcaccccctgccctacctgggccagaccttgggacttaccgttggcggaactcctggaagacgatccggttggggaagccctgccggcagatgcgaatgccttccagcaccccattgcaccgcagctgctccagcaccaggaacgcatccagcttgccggactgcaaaggtcaaagagggcagtggatccctggggccagaaaccatgg

SEQ ID NO: 43303 - DNA, 601 bp, Human
ctccagcctgggcgacagagagagagagagagactctgtctcaaaaaggaagaagaaaggaaggaaggaagggagggagggaaggaaggagtgagggagggaggtaaaaacaacaacaatcatttctgacctgagaaccacgcactgttctaagctctcgtcatgcgttatcttagtgacacctcatgaacagctctctgaggtcaaaatgattatgctcagtttccagctaaaaaactggaagctcagagaggtagagtaacttgcccaaggttcatcagcaaaaactggggcatccacratgagaacccaggtctaaaactcgttcccttcctgcactcgtaacttggtacatttatttaaagtagaagcatttcttccccttcaagaaaaggctgtcattcagtcaatgatgcatcttaaacaggtggcctcttagaatcagggaatcagaacagaaaggcccctgtttgtgattcgcgtttgaggtattaggatgcaggaaagcatctttactttctggccaagtagccacgacacatcgcctggaaggccatgatgacatcggtgatcttcaaatctcgctcctcctctaggtggg

SEQ ID NO: 43304 - DNA, 601 bp, Human
gggacatcacaccctccaaaaccctgccttataaatcccactgggacacggggatctagacaccgtcaagtcctctttcctcaatggtttatccaattctaacatgtctaggctgggcgcagtgggtcatgcctataatcccagcactttgggaggccaaggcaggtggatcacttgagaccaggaatttgagaccagcctggccaacatggtgaaactttgtctctactaaaaatacaaaaattaggccagtgtggtggtgggcgcctctaattccagccactcgggaggctcagacacragaattgcttgagtccaagaggcagaggttgcagtgagttgagactgcgccactgcactccagcctgggcgacagagagagagagagagactctgtctcaaaaaggaagaagaaaggaaggaaggaagggagggagggaaggaaggagtgagggagggaggtaaaaacaacaacaatcatttctgacctgagaaccacgcactgttctaagctctcgtcatgcgttatcttagtgacacctcatgaacagctctctgaggtcaaaatgattatgctcagtttccagctaaaaaactggaa

SEQ ID NO: 43305 - DNA, 601 bp, Human
gttgcccaggctggagtgcggtggcacgatctcagctcactgcaaactccacctccggggttcaagtgattctcctgcttcagcctcctgagtagcttggattacaggtgcccacaaccatgcctggctaatttttgtatttttagtagagatggggtttcccatgttggccaggtgggtctcaaactcctgacctcaggtgatccacccaccttggcctcccaaagtgctgggattacaggtaggagccaccatgcccagcctacaccagctgtttctgactaacttatttatttatttrtttattttcagagacagggtctggctctgcggcccaggctggagtgcagtggtgtgatgatggctcactgcagcctcaaattcctgggcttaaatgatcctcctgcctcagcctcccaagtagttgggactacgggcacatgctaccatgcccagctaatttttaaagtttttttttttttggtagagataggggtctcgccatgttgcccaggctggtctcaaactcctgggctcaagcaatcctcctgcctcggcctcccaaagtgcctgggattacaggtgtcagctaccacaccca

SEQ ID NO: 43306 - DNA, 601 bp, Human
tgcgggggtcatgaagccacaccctgctgtcaacagagccctgccctgcagcatcctgaacctgcacagggacatgccccaatctccccaactcaggttcttccagaaaccctgtgtgacacatgtgttgtctggctgcaaacaacttaaatcatctacaggacagagcctttttcagtggacaaggaagacccagggctcacaacatgccctggacttagctgagatccaaacaccactcagaaaacacaactatgtgcatcattcctaagggggctcccgtactccccagctgcactarctgtttcttttttctttctttcttttttttttttttttttttttgagatagagtttcgctcttgttgcccaggctggagtgcggtggcacgatctcagctcactgcaaactccacctccggggttcaagtgattctcctgcttcagcctcctgagtagcttggattacaggtgcccacaaccatgcctggctaatttttgtatttttagtagagatggggtttcccatgttggccaggtgggtctcaaactcctgacctcaggtgatccacccaccttggcctcccaaagtgctgggatt

SEQ ID NO: 43307 - DNA, 601 bp, Human
gtgagccgccgcccccggcagcattcttgaaccatcaaaattacagaactggagaacagagtggtttccatggctacggaggaagtgggtgtggctataaatgggccacacgagggattccagtgcggatggaaatattaatactttgtgttaaggtcctggctatagcctatgtgccaaaggacagggcctcctcgggccagagaaccgccaatgctcaaggtctgagttcgagccctccattccacacccacttgcgaccacctcctgtcccaaatgtgaaggctccagagtgaagaascagggctgggggcccctgggaagggggctggggcagagcactcactttggtgaaaagcctccaccactgccagttccgcagcttgaggtaggcggcgcagttcctctgaatcaccttcatggcggtcagctgctgctgcctcttggcaaaagccctagggaggggggaagagaaggtgcgggggtcatgaagccacaccctgctgtcaacagagccctgccctgcagcatcctgaacctgcacagggacatgccccaatctccccaactcaggttcttccagaaaccctgtgtgacacat

SEQ ID NO: 43308 - DNA, 601 bp, Human
ctaattccatgtatagaatatttgttttatttttttttgagacggagtctcgctctgtcaccaggctggagtgcagtacagtggcgcgatctcagctctctgcaacctctgcctcccaggttcaagtgattctcttgcctcagcctcctgagtagctgtgactacaggcgtttgccaccacgcccagctaatttttgtacatttagtagagacagggtttcaccatcttggccaggatggtcttgatttcttgactttgtgatccacccgcctcggcctcccaaagtgctgggattacagscgtgagccaccgtgcctggccttttttttaaataaaaaaaaaaagaaagaagagacagagtctcaatctttcacccaggctggagtgcaggcatgatcttggctcactgcaacctctgtctcctgagttcaagagattctcctgccttagcctcctgagtatctgggattacaggtgcctgccaccatacccagctaatttttgtattttaagtagagacagggttttgccatgttggccaggctggttttgaactcctgaccgcaagtgatccgcctgcctcggcctcccaaagtgctg

SEQ ID NO: 43309 - DNA, 601 bp, Human
gaccagcctgggtaacagagtgagactccatttcaaaaaatgcaaaaagtaaaaaaaaaaaaacctgcagtattgatacatgcaacagtctggatgctctctaattccatgtatagaatatttgttttatttttttttgagacggagtctcgctctgtcaccaggctggagtgcagtacagtggcgcgatctcagctctctgcaacctctgcctcccaggttcaagtgattctcttgcctcagcctcctgagtagctgtgactacaggcgtttgccaccacgcccagctaatttttgtacrtttagtagagacagggtttcaccatcttggccaggatggtcttgatttcttgactttgtgatccacccgcctcggcctcccaaagtgctgggattacagccgtgagccaccgtgcctggccttttttttaaataaaaaaaaaaagaaagaagagacagagtctcaatctttcacccaggctggagtgcaggcatgatcttggctcactgcaacctctgtctcctgagttcaagagattctcctgccttagcctcctgagtatctgggattacaggtgcctgccaccatacccagctaatt

SEQ ID NO: 43310 - DNA, 601 bp, Human
ctcctcggtcagctgcacgcaggtggtggggaggaggcgggtgagccccacggggccaagtcctgttccccagcaaccccagccatgcatccatacaggtacctgcgagtgcttctgttccagctccttaagctcattctctgccttctgctgccgctccttggtcttctgcagttcatcctccttggcctgcatctcctcctcctgccgtgtcacctgcagcagtggcttcacctgcacacacacggttagcccatcatttgtttttgtggcaaagggatatgttgtcataataaattcsatcagtggttccgagccagggacaatgttgcccccaccgatccccactaggggatattgtctggagacactgctgattgtcacagctggggtggggggtgcctctggcatccagtgggtagaggccagggatactgctaaacaccctacagtgcacaggacagcccccacaacagaattagtcaccccaaaatatcaacagtggcaagactgaggagctctaaatcagagcaccagaaaaggtacaaagtgaaaggaaaaagtctcatcttccccactttagaaccatcccaacagagaa

SEQ ID NO: 43311 - DNA, 601 bp, Human
agaagtgggtcctccagccccagatgagccttcagatgactgcagcctcagccaacaccttgactgcaacctcaggccggaccctcagccagaaccactcacctaagccactctcaaattcctgactatgcaatactttttatttttagctgctgagtttggcatgttttgttatgtagcaatagctaacaaatacaattatcctccattcaggcttgctgttaggagaaaaggggttagcacatgcaaggcagggcaatagaacagagtgggctcactgtgttccagtcccaatcccagytgtgtggccttgatcagatgaccaaccctctccaagcccccgtctcatcatctgtcccagcagggacacatatccctggatgcacctccacaggcctgtggtgagggtcaagtgatttgctacccaccacgggctgcccctgtgacaccttaccagcatctgctgggccatcttcttcctttcagcctgtagctgctggcccctgtcttcctcctcctccaggcgggcctccatctcatgcagtatctcctccagctcctgcttcttggccgccagccgcacccgcatctcctcagcctc

SEQ ID NO: 43312 - DNA, 601 bp, Human
cgtctctactaaaaatacaaaaaaaattagccaggcatggtggtgggctcctgtaatcccagctactcgggaggctgaggcaggagaatcgcttgaacccgagaggcagaggttgcagtgagctgagatcgcaccatcgcaccccagcctaggcaagagagtgagactctgtctcaaaaaaaaaaaaaaaataaagacctgggtaagctgctctgcttcatggaacctcaacctcctcatctataaaatgagcacagtaggtaccatggtggttttaaaatctatccacaagttctttgckactccaaaaaggtggagcctaattctcctccccttgagtgggggttagatttgcttctaacaacaacaacaaaaatcaggaagaagtgatggaatgtaacttcagagattaggctataaaaggcattgcggcttcctttctcctctctcagatcactccttctgggggaactctgctgccatattggaaggacactcaagcagccctgaggggagaggccttcatgataaggaactgaggcctcctccaacagctgtgtgaataagccaagtagaagtgggtcctccagccccagatgag

SEQ ID NO: 43313 - DNA, 601 bp, Human
ttcaggaaggggaggccccagagagatgcccggaaatgagccttcctgcccaggcattttacccggaggagatgaacacatcccccaatcagtaaccatcatagtcacggtctggaccattatctcccgatgaacagcaccttatattgtcataatattattattagttgagatggagttttgctcttgttgcccaggctggagtgcagtggcgcaatctcagctcactgcaacctccgcctcccgggttcaagcaattctcctgcctcagcctcccgagtagctgggattacaggcgccygccaccacgcctggctaatttttgtattttgagacagggtttcaccatgttggccaggctggtctccaactcttgacctcgtgatccgcccacctcggcctcccaaagtgctgggattacaggcgagagccaccgcacccagcccttttatcatattattagtgcatgtgatgactaagggtgatttcgagaggtggcatagagttagttgtcactcatgggatgatctgccatcctcaaatttcctttctgattttcctgcttttaaaaatacccattcaagcccaggaatagtggctc

SEQ ID NO: 43314 - DNA, 601 bp, Human
gagggaggggctggggaaaggaaggtcattcccgccttagacaggggtgtttgagatgacggtggaaattgactcattgggcaatcggaaattcagaagggggtctagatgagaaaagcctggatgtcgaagaggcagcagcaacaccatgggagtaggtgagatcaactgcaaagacatgatgtgtttgcagggaagagaagaaagtcgaaggtgaggatctgggggagtgaacagggtcgagaaggcttgtgggaggcctggcctgggaaacgaagttcatgccaagggcctggggccrccttgaccaagacagccactgcgaatgagcgaatgagcaggggcccaggggatacatggacacacagcaaatgccccttgccagccccgctacctggccagggccgcctgcagctcctcctccttcttggccagctgcatcttgagctctgcgatctgcgcctggaggtcagcgatctgctcgtggaagtcgctggcatcaccctccagcttccgtttcagcttctccagctcctgtcggctcttctcttccttctttagccgcactgcaaaaaccaaggtgctcttcaggaaggggagg

SEQ ID NO: 43315 - DNA, 601 bp, Human
aggtaaataatcattcatagtggctgctgcagtattagcattagtgtaaatccagctaagagccaggaagagggaaaaaccagaggaaatgggtgggggacatttagaaggactggcagaatctgaaggttgctgcttgctgtgggtcggcagaaacaaaggaggagattggtgttcacaaaaaagagggcccttagagggaggggctggggaaaggaaggtcattcccgccttagacaggggtgtttgagatgacggtggaaattgactcattgggcaatcggaaattcagaagggggtmtagatgagaaaagcctggatgtcgaagaggcagcagcaacaccatgggagtaggtgagatcaactgcaaagacatgatgtgtttgcagggaagagaagaaagtcgaaggtgaggatctgggggagtgaacagggtcgagaaggcttgtgggaggcctggcctgggaaacgaagttcatgccaagggcctggggccgccttgaccaagacagccactgcgaatgagcgaatgagcaggggcccaggggatacatggacacacagcaaatgccccttgccagccccgctacctggccagggc

SEQ ID NO: 43316 - DNA, 601 bp, Human
cagcaaagttttgtgagcaggttcctgccccagagagatgctttcccttcatcaccgtagcactgtcaacatagcacaaattggccgacaaaagagccaggccaggggatcaatcagaaagctttgaggcttaaatcccagctctgcctcttagaagcaatgacattgctcctgttgcgttacccctaggaggctcagcttcctcctcaaagacaccggcagtacacctggccaggtgtctgcaaaggtattgcttgaaaagaacttagcaccgagtgagcaggtaaataatcattcatastggctgctgcagtattagcattagtgtaaatccagctaagagccaggaagagggaaaaaccagaggaaatgggtgggggacatttagaaggactggcagaatctgaaggttgctgcttgctgtgggtcggcagaaacaaaggaggagattggtgttcacaaaaaagagggcccttagagggaggggctggggaaaggaaggtcattcccgccttagacaggggtgtttgagatgacggtggaaattgactcattgggcaatcggaaattcagaagggggtctagatgagaaaagcctgga

SEQ ID NO: 43317 - DNA, 601 bp, Human
gatgagggtcgggtgcagtggctcacacatgtaataccagcagtttgggaggcggaagtgggtggatcacttgaggccaggagttcaagtccagcctgggcaacatggcaaaactccatctctactaaaaacaaaaaattagccgggtgtggtggcacatacctgtaatcccagctactcaggaggctgaggcatgagaatcgcttaaatctcagaggtggaggttgcagtgagccaagatggcacaactgcactccagcctaggcaacaaagccagactgcctcaaaaaaaaaaaaaaaagaaagaaaaaaaagaaacagccaaccatgcttctataagttaaagcaaaccgcggccaggaaggtaaatgcacaggggctgatgcacgatttgctttgggtttgtcccctcttctgcccccatcccattggtgcagtgggatagcaggatggtgggattgatgggcccctcacctgagctcctgctgagtggctgtgctgtccagtgtgtcttccagctctgtctttagggcctccagctcctcgccgaggtctcgcttctgcttttcagccttgttcctggcggcccgctctgagtcca

SEQ ID NO: 43318 - DNA, 601 bp, Human
gaaactaaggctaagagagggtaagcagttttacccatggtgtcacagccattgtgtgatggagccagaattagaagctaaaccttgaccttgagtccatggttttgtttgtttgtttttgagatggagtttcactcctgttgcccaggctggagtgcgacagcgcaatcttggccccctgcaacctccacctcccgggttcaagcgattctcctgcctcggcctcctaagtagctgggattacaggtgcccaccaccacgcccggctaattttatatttttagtagagatggggtttcamcatgttggtcaggctggtttcgaactcctgacctcaggtgatccacccgcctcagcctcccaaagtgctgggattacaggtgtgagccaccgcactcagcctggttttttgttttgtttgtttgtttttcttatcgagtcttgctccgtcgtccagactggagtacagtggaatgatgtcagctcactgcaacctctgcctcccaggttcaagggattctcctgcctcagtctcccaagtagctgggattaccgacgcccaccaccacgcccggctaatttttgtctttttagtagagac

SEQ ID NO: 43319 - DNA, 601 bp, Human
ttgcttaaatattaatgttggctcttatttaatgagcagttactatatgccaggccctgagctaagttttttatatacatcatctaatcctcagagcaacccaaagaggcaggtgtgttattatttccattttacaaatgaggaaactaaggctaagagagggtaagcagttttacccatggtgtcacagccattgtgtgatggagccagaattagaagctaaaccttgaccttgagtccatggttttgtttgtttgtttttgagatggagtttcactcctgttgcccaggctggagtgcracagcgcaatcttggccccctgcaacctccacctcccgggttcaagcgattctcctgcctcggcctcctaagtagctgggattacaggtgcccaccaccacgcccggctaattttatatttttagtagagatggggtttcaacatgttggtcaggctggtttcgaactcctgacctcaggtgatccacccgcctcagcctcccaaagtgctgggattacaggtgtgagccaccgcactcagcctggttttttgttttgtttgtttgtttttcttatcgagtcttgctccgtcgtccagac

SEQ ID NO: 43320 - DNA, 601 bp, Human
cccccacaagcagatggaaccaggtctctacatcagaattcaagttgttagaggcaaaggcctctgtttccctgcacctgagatgggcagaggtttgcacctctacctgctttgtgcgggtcagtaatggacatgccgtctgctggtggtcttaataactgcgtcttcccaaagaggcctggctgggaatgggcttggcttctagctcctgttcacgtctaatgaaccccaagcatggggagggtcagtgattctgtctggggcctcactcttccaaccataattttttttttttttttttgaaactgagtctcactctgttgcccaggctggggtgcagtggcacaatcttggctcactgcaacctttacctcctgggttcaagtgattttcatgtctcagcctcccaagtagctgggattacaggcgaccgccaccacgtccagctaatttttgtatttttagtagagacggggttttgccatgttggccagactggtctcaaactcctgacctcaggtgatctgcctgcctcgggctcccaaagtgctgggattacaggcgtgagccactgcacccagcctaattttatgtattttta

SEQ ID NO: 43321 - DNA, 601 bp, Human
acacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaaggaagggttttttttctttttttttttttttcctgagacagagttttgcccttttagcccaggctggagtacaatggtgcggtctcygcacactgcaacctctgcctcctgggttcaagctattctcctgcctcagcctcccgagtagatgggactacaggtgcccacgaccacgcctggctaatttttgtatttttagtagagacttttcaccatgttggccagactggtctcaaacccctgacctcaggtgatccacccacctctgtctcccaaagtgctgggattacaggcatgagccaccgtgcctggccagaaggtttttttaatatttaattgaacagggagatcatcgcctctcctccaggaacgcaactagaggaaagg

SEQ ID NO: 43322 - DNA, 601 bp, Human
caccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaataccggtgaggtatgggactctgataaaaaaaaaaaaacacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctca

SEQ ID NO: 43323 - DNA, 601 bp, Human
caaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaataccsgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacg

SEQ ID NO: 43324 - DNA, 601 bp, Human
ccctctacctgatcaaatttcctctgcttcttttccaggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgartggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagct

SEQ ID NO: 43325 - DNA, 601 bp, Human
acctggtagcgttaatgctccatggtcgcccaagacaagataagacagcctcccatggctccccacagagtggagaggggatgcaggcacaggccagagccacgcgtcatactctgcagagctgattccccaacccagcgtccatggccagagtgggggacaccccacgccctctacctgatcaaatttcctctgcttcttttccaggttggacacgagttgccgctggttgtccaaatcaacaaccaggtcgtccagctcctgctgaagcctgttcttggtcttttccagtttatcatamgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgaatggcccctgtccctggccccacagactctgagaagcgaagaccatgtctcctcgttggagaaacccaatagcaggggaagctggggggtcaagcaccatcgcaccaacactccaccgcgatctgcctgcgg

SEQ ID NO: 43326 - DNA, 601 bp, Human
gcctcactgtacaatcctcattttatttatttttgagacagggttttcactccatcactcaggctggggtgtagtggcgcaatcttggctcactgcaacctccaccccaccctgggttcaagcgattctcctgcctcagcttccagagtagcagggattacaggcgtgcgccaccacgcccggctaattttggtatttttagtagagacaaagttgcacgatgttggccaggctggtctcaaacccctgacctcaagtgatccacctgcctcagcctcccaaagtgctaggattacaggcrtgagccaccgtgcctggcctctcaaactgatttttagaataaccctgagtcacttgtaaactaaatcatatttactaaataataatgtatcttaaaagttggtatttaggggtttgggtcatacaggggtctccatttatcgtacaattaagatttgtgaatctcatcacatgtaagttttaccccaaaagaagcaaaattgtgtttaaaaataaactctaattaatatgcaatgttgaggtgtggaaggggaaatgtactgacatctgtaatttgctctgaaatgtacccaagagataa

SEQ ID NO: 43327 - DNA, 601 bp, Human
taaatggcacagtcaacacaaaaatcccacactatgtgtgccactgcactacactctatgtgacaggaaaataaaagcaacctcaggccttcaaccagataacgaagcattgaagatgagctgacagcccagaggagaggtagctgatgggaagaggagaaactgggatgttatctagaatcctgacactaggaggtcagtcagggaggggtagggaacctgcaggcatctggcatttagcctcactgtacaatcctcattttatttatttttgagacagggttttcactccatcactcargctggggtgtagtggcgcaatcttggctcactgcaacctccaccccaccctgggttcaagcgattctcctgcctcagcttccagagtagcagggattacaggcgtgcgccaccacgcccggctaattttggtatttttagtagagacaaagttgcacgatgttggccaggctggtctcaaacccctgacctcaagtgatccacctgcctcagcctcccaaagtgctaggattacaggcgtgagccaccgtgcctggcctctcaaactgatttttagaataaccctgagtcacttgtaaac

SEQ ID NO: 43328 - DNA, 601 bp, Human
ttgggattacaggtgcccaccaccacacctggctaatttttgtattttaagtagagatgtggttttgccatgttgaccaggctggtctcgaactcctgaccctcaagtgagcctcctgcctcggcctcccaaagcacggagattacaggtgtgagccaccacacctggccaaatccttgtgcttcgaaaccactagacctgcccacgttgcttagagcacactgaggtcaaagtgagatttaaagctgccagaagctagttattagtttgtttcatggccacaagtagctattaatatctyacaaaagtatcctaagagcctcagtagggaaatggtaagcatgggtggccctgcacacatatctctctgcttggagaagcaactcagagaacattccatgctcacgttaatctcatcttcagagagaacagagcagattataaattgtaacatccaaaagccaaacttccagtattcagcaaagacagggacctctaaatggcacagtcaacacaaaaatcccacactatgtgtgccactgcactacactctatgtgacaggaaaataaaagcaacctcaggccttcaaccagataacga

SEQ ID NO: 43329 - DNA, 601 bp, Human
ccaacatggtgaaaccttgtctccactgaaaaaaaaaaaaaaattagctaggtatggtggcatgcgcctgtaatccaagctactcgggaggctgaggcaggaggtggaggttgcagtgagctgagattacgccactgcactccagcctgggcgacagagcgagactctgtttcaaaaaaaaataaagaaaacgaagtttccacaccaaccatgagagtggtgataggaatgaaaaaggccacccgacctccctctgctggcctccccggcagcacgcacctgtctctgcagttgcctcctyttctcctcattctgctcgtcccgggcttggagatccctttcgaactggcccttgagcgcctgcatgttgacttccagccgcagtttggcgtcctccgtggcttgcagctcgtcctccagctcttccagctgcgtcttcatctcctccatctgggtctccagggcccgcttggacttctccagctcatggacctgccggcagagcgggcagccccattctatgaggctcaacttcatgaagacgattgagaaacccaccgtgagcggcacctcaggagatcagggaggtggctttggcctc

SEQ ID NO: 43330 - DNA, 601 bp, Human
acacccaccccttggattttctgcagttgaccacaaagaagttcccattgcacgagcatggctctcagttccaggtggctggtggtgcgctgggagcaccattctgggtgggctccacagacctgcctgagaagctgagcccctgatgtgatctgagggcagtggccaaatacctaataatgctgccctacccagggcaggagacagccaccaaatcctgaatggttccagaaaaaccccagctgaacccacaccaatggcaggtgcaggcttgcttcctggagcccgctctgctgacttyggtggcctgaggggaactgtgccctccctccacccatgccccaagctcctagtgtcacccacctgcagtttgcgtagctgcttgatggcttcctccctccccttgatggcagagtcggcctgaagctccaggtctttcaggtccccttccagcttcttctttgctgcagctgccagggcacgttgctttcgctcgtcttccagttccgtctcatactcgtgaagctgggcgaggaatagagatgtgtgctgccccacttgcccctgggaggtcctttggctcacctaggcagcacatcac

SEQ ID NO: 43331 - DNA, 601 bp, Human
gcttccaagctcttggctttcttctcattctctttggctgtggcaaagatctcatctctggaggcacgggcatcttccagctctctttgaaagtccttcatctgagcctgcatgagtcaacagggaggacaagctcagatgtccttactcccccaagttctgctgcccagttcagctttgcacacccaccccttggattttctgcagttgaccacaaagaagttcccattgcacgagcatggctctcagttccaggtggctggtggtgcgctgggagcaccattctgggtgggctccacatacctgcctgagaagctgagcccctgatgtgatctgagggcagtggccaaatacctaataatgctgccctacccagggcaggagacagccaccaaatcctgaatggttccagaaaaaccccagctgaacccacaccaatggcaggtgcaggcttgcttcctggagcccgctctgctgacttcggtggcctgaggggaactgtgccctccctccacccatgccccaagctcctagtgtcacccacctgcagtttgcgtagctgcttgatggcttcctccctccccttgatggcagagtcggc

SEQ ID NO: 43332 - DNA, 601 bp, Human
gaccccagaggaggacgaaatgaaatctgggaatgcacagactggagctgccaaggggtgctaccgtgacacccgcatctgaggctctcctagcaaggcgaggctttacctcttgtagctgcatgaggtctgcttccaagctcttggctttcttctcattctctttggctgtggcaaagatctcatctctggaggcacgggcatcttccagctctctttgaaagtccttcatctgagcctgcatgagtcaacagggaggacaagctcagatgtccttactcccccaagttctgctgcccarttcagctttgcacacccaccccttggattttctgcagttgaccacaaagaagttcccattgcacgagcatggctctcagttccaggtggctggtggtgcgctgggagcaccattctgggtgggctccacagacctgcctgagaagctgagcccctgatgtgatctgagggcagtggccaaatacctaataatgctgccctacccagggcaggagacagccaccaaatcctgaatggttccagaaaaaccccagctgaacccacaccaatggcaggtgcaggcttgcttcctggagcccgc

SEQ ID NO: 43333 - DNA, 601 bp, Human
ggaggtggaggttgcagtgagccaagattgtgccactgccctccagcctgggtgacagaatgaaactctgtctcgaaaaaatttaaaaaataaaatgggggtcgaggatgctgcctgtccccccatcctctgcttcagagccctcttcctccattcagtttcctaccttcccgacaggctactggccagctcctctgccagttcctccttctcgaggtccgcttgtttgcgagccctctcagcggcggcgaggtcctaggtgggagggaggaaggctgttgtctgccagggaaaggccaakccccaccaagagtccaccctgacaactcagccacccttgaaagtacatgttcttcctctgagctcaggggaggccccgtgaatacatagaggagggaagcgtgtgtctttctagacaggtggaccccagaggaggacgaaatgaaatctgggaatgcacagactggagctgccaaggggtgctaccgtgacacccgcatctgaggctctcctagcaaggcgaggctttacctcttgtagctgcatgaggtctgcttccaagctcttggctttcttctcattctctttggctgtggcaaag

SEQ ID NO: 43334 - DNA, 601 bp, Human
tggtgtaagggccctggatctctactctcaggccccaccaccctcttgtccctcaatccagggcctgcacacaggaagccgccacgcgtgtgttgactggtgcaggatcctgctgcaggagagacagtaggcagcgtgactgtggtgtccaggcggccctcacctgctgtgtggctttgcggacccggtcgctcatggcctccatgttgccctgctcctcctccagctcctcctccagctgggcgatccgggcctccaggcggcgcttctcgtcctggagtgcgttcctgggggaagggcrgccatggtgggggcctctaccctcccccgccttaaaagatgccccctccttggagtcatgcctcaggggtattgccctcatcatctaatgggtgaaactgaggcttggagaagattagaagactcatctgtagttacacagccaggaagtggacagccgggactcaggccgggtccgtgtcagcaaagctgggattgggatggggaccagcacactcctccctgactcttcctggcctccccttctccccacacagctacttattgggaatgaatgaaagcagccacacccccaaacagg

SEQ ID NO: 43335 - DNA, 601 bp, Human
ctagtgcccaccatggaactagtgctcagtgacatcaccaagggctcactggataaggtcagagcttcagctaggggaaaacgcaatgaaagagcatcccaaggcccggactccagggatggccgtgaggtacggggagccagccacgccgtggctggaaaatgagacactgcagcgtggagaggagtattctgaagacagcagcctgggcactggtgtaagggccctggatctctactctcaggccccaccaccctcttgtccctcaatccagggcctgcacacaggaagccgccacgcrtgtgttgactggtgcaggatcctgctgcaggagagacagtaggcagcgtgactgtggtgtccaggcggccctcacctgctgtgtggctttgcggacccggtcgctcatggcctccatgttgccctgctcctcctccagctcctcctccagctgggcgatccgggcctccaggcggcgcttctcgtcctggagtgcgttcctgggggaagggcggccatggtgggggcctctaccctcccccgccttaaaagatgccccctccttggagtcatgcctcaggggtattgccctcatcatcta

SEQ ID NO: 43336 - DNA, 601 bp, Human
ctcgagctgctgccgggcactctcattcttctgggccgtgctgcgctctgtggccagctcgttgctgagctgctcggcctggggaggagagtgaaggccatgaggcggactcagggaagcccaagagagcgcactgagaccatgcctcttcctgccttgtttggcctctgcacgagtcccttgatcccgggcaccctgtcctctccttcatcctgtaaaactccactcaagagcttcttccaggccgggcgtggtggcgcacgcctgtaatcccagcacttttggaagcagaggcaggtaratcacttgagctcaggagttcgagacctgcctggccaacatggtgaaaccccgtctctattaaaaatacaaaaattagccgggcagtggtggcacgtgcctgtagtcccagctacttgggaggttgaagcaggagaatcccttgaacttgggaggcagaggttgcagtgagccaagattgcgccactgcactccagcctgggccacagagagaccctgtctccaaaaaaaagaggtgcttccacaagtgtcagtgccacccaggctgagcgagtgacttgtcccttgctttctctgtcct

SEQ ID NO: 43337 - DNA, 601 bp, Human
accatggagatgctaagagcagctcacactttaggtgcttgccctaggccaggaaccagcagggcactttgctgtgtttacgttcagttctcacaacatacctgcactgtaggcatcacagagcttgcttcttacaagccagaactgatgctggaagaggttccctgacttcactatgactcctgctgtccatcacccccctgcaaactgggttcggaactccacacccgcatacctggcctcctgctcgacctgctcctccagctgtgcaatcttggcctccagcgccgcgatggtggayttgaacttggacttgacggccccctccatctcgtggagcttgctccggagctccttgttctgccgctcgagctgctgccgggcactctcattcttctgggccgtgctgcgctctgtggccagctcgttgctgagctgctcggcctggggaggagagtgaaggccatgaggcggactcagggaagcccaagagagcgcactgagaccatgcctcttcctgccttgtttggcctctgcacgagtcccttgatcccgggcaccctgtcctctccttcatcctgtaaaactccactcaagagct

SEQ ID NO: 43338 - DNA, 601 bp, Human
tcatatgtactgctgggaaggcaggttaatgtcaggaggaccatggagatgctaagagcagctcacactttaggtgcttgccctaggccaggaaccagcagggcactttgctgtgtttacgttcagttctcacaacatacctgcactgtaggcatcacagagcttgcttcttacaagccagaactgatgctggaagaggttccctgacttcactatgactcctgctgtccatcacccccctgcaaactgggttcggaactccacacccgcatacctggcctcctgctcgacctgctcctcyagctgtgcaatcttggcctccagcgccgcgatggtggacttgaacttggacttgacggccccctccatctcgtggagcttgctccggagctccttgttctgccgctcgagctgctgccgggcactctcattcttctgggccgtgctgcgctctgtggccagctcgttgctgagctgctcggcctggggaggagagtgaaggccatgaggcggactcagggaagcccaagagagcgcactgagaccatgcctcttcctgccttgtttggcctctgcacgagtcccttgatcccgggcaccc

SEQ ID NO: 43339 - DNA, 601 bp, Human
gggtctcactctgtccatccagggtaagtgcattggctagatcatggctcactgcagccttgacctctggggctccactgatcgtcccacctcagcctcctgagtagctgggattttaggtttgcgccatcccacctggctgatttttgtttgtttgttgtagagatggggtcttgctgctcttgaactcctgagctcaaagcgattcacctgccttggcctcccaaagtgctgggattataggtgtgagtcccgtgcccagccaagcttgagtttcatttgggttgtgctttcaccaaaygattgcagcaatgcaagagggggaaccggatgttgaggatgcgcgacgggggttactagacagctggtttggagctgggtcagaggctgatggcattaatggagtgaagaccccgttggggacagagccaaagaaaggtggcaccaggcagacaatgggatgcctgagggtcaaattgtgagggctcctaggagtactggttggcccggtagaagcagcaggatcacccagagggtcaaggaaccgagaggctgcgtcgcccacctggatgttgaaatcatggagaactgtgaggagtgg

SEQ ID NO: 43340 - DNA, 601 bp, Human
ctataggcatgcaccaccacacctggctaatttttatattttttggtagagacagggtttcggcattcacatccagttttgtagtaagggtagcaaggtagacatggggctaagaggttattccatttgctgatggagcaaatgaaagagaaaaccttgcaaaataaggatttttggagctatgtgcttgagtgaacaagagggtcgggtccaatggaggtgttggcctcggttggtgccagagggttcagcatagaaatggaaaaaaaatagaagtgtacagaggtgcacggaggtaggrtgatgaggcagtgggagcttgtgcacgtttcatgatcatttctgcttttgagttaagtaggaagtaaggtccccagctgagagagaatggggaggagcgatcataagttcaaagaaaaagtgaaaagcagcagagagtgagaagatgagggaggggtgtgggaggacccctgagcaaggcctgctctgtgggaaaaggtggagagtgggttttgggttttttgagacagggtctcactctgtccatccagggtaagtgcattggctagatcatggctcactgcagccttgacctctgggg

SEQ ID NO: 43341 - DNA, 601 bp, Human
gacagcagtggggtagggagtcagagtggctgtatccccatcgctcagcccagccactcaggagaggcagggggactggttgccagcagagcacatctgagggtttttgttttttgttttttttttggagacagagtcttgctctgaaggctggagtatagaggcttgatcttggctcactgcaggctcctcctcctgggttgcaaaggagtgtcctgtctcagcctcacgagtagctgggattacaggcatctgccaccacgcctagctgatttttgtgtttttagtagagatgaagttycaccatgttggccaggctggtctcgaactcctgacctcaggtgatcagcccacctcagcctcccaaagtgctgggattacaggcgtgagccaccgcgctttgccccaggagtcttcacagtgagaacagctctcctccactgacccctcaaccctgggagatgcttccaggcccctgctgtactttgggagcctaggcctggtttctctcctatccatgggggaccaacaagcgctcaccatgcagcgagtggggcttttccctgaaggcttggtgccctgcgccagctgctctcttccc

SEQ ID NO: 43342 - DNA, 601 bp, Human
ctggtagatgaaaggataagcagttttttgatactctgtcacccaggatggagtgcactggcatgatctatctctgctcactgcaacctccacctcccgggttcaagcgattctcctgcctcagcctcccgagtagctgggattacaggcatgcaccaccgtggctggctaattttcatatttttagtagagacggagtttcaccatgttggccatgctggtctcgaactcctgacctcaagtgatccacccacctcggcctcccaaagagctgggattacaggtgtgagccactgcaccyggctcagttttttaaatggaaaggaaaatgtctgtcctttagagctacttttaagaacctcctataaatcccatgattgcatactggttcagggaagtaaaagcatttgagcaagctagtttgagaaatcagtgttggaacagaagccaagaagtcccaggcaaggaacctgcagccgcctgtcccttggtttatgattacttgctcttcattagctttcgggcctctagcaagagaggagaggtggaggccttgtacagctcttgccggaggtaactggcagtgtagccagtggtaggt

SEQ ID NO: 43343 - DNA, 601 bp, Human
gggggccctctgaaacagagagagaatccccggaggttaccatcagcaaacaagaaggagcccggttaagtatattcttaattgttaaagacatttgcttcgatttaataattaaaggcactcttttttattttgagatagtctctgtcacccaggctggagtgcaggggtgcgatcttggctcactgcaacctctacgtcctggattcaagtgatccccttgtctcagcctcccgagtagctgggattacaggcaggccccacgtgcttggctaatttttgtatttttagtacagatggkgttgcactatgttggtcaggcttgtctccaactcctgatgtcaatgatcttcctgccttggcctcccaaggtgctgggatttgggattacaggcatgaaccaccgcacctggcattaaaagcacccttaagtcaacgttgcagtgaatcacctgacgccaagagcatttggtgaggctggtagatgaaaggataagcagttttttgatactctgtcacccaggatggagtgcactggcatgatctatctctgctcactgcaacctccacctcccgggttcaagcgattctcctgcctcag

SEQ ID NO: 43344 - DNA, 601 bp, Human
tgaaggcatgatacctggtgcatcactgcgaagtttcctgtggggggggccctctgaaacagagagagaatccccggaggttaccatcagcaaacaagaaggagcccggttaagtatattcttaattgttaaagacatttgcttcgatttaataattaaaggcactcttttttattttgagatagtctctgtcacccaggctggagtgcaggggtgcgatcttggctcactgcaacctctacgtcctggattcaagtgatccccttgtctcagcctcccgagtagctgggattacaggcakgccccacgtgcttggctaatttttgtatttttagtacagatggtgttgcactatgttggtcaggcttgtctccaactcctgatgtcaatgatcttcctgccttggcctcccaaggtgctgggatttgggattacaggcatgaaccaccgcacctggcattaaaagcacccttaagtcaacgttgcagtgaatcacctgacgccaagagcatttggtgaggctggtagatgaaaggataagcagttttttgatactctgtcacccaggatggagtgcactggcatgatctatctctgctca

SEQ ID NO: 43345 - DNA, 601 bp, Human
accaattctttagtcaaaaggaacaactcggctgggcatggtggctcacacctgtaatctcagcactttgggaggctgaggcgggcggatcatgaggtcaggagatcgagaccatcctggctaacatggtgaaaccgtgtctctactaaaaatacaaaaaattagccgggcgtgctggcgggtgcctgtagtcccagctactcgggagggaggctgaggcaggagaatgacatgaacccaggaggcggagcttgcagtgagccgagatgtggccactgcactccagcctaggcgacagggygagactccgtctcaaaaaaaaaaaaaaaaaaaaatcaaggcccagagattcatgatcactgagaagaggaattcgcaaatgacccttttgttgacagaggatgggagagaccccggctgggaaagcccacctggctataaaggatgggacttcccgcagtgcagcgatcaggaataaatacttaaagctgcagccacttcaaagtaaacactcctagcccagcttcacagagaagcttctggacttgcagccctactagagaactctccatccttctctctctagatgtgacccttaagt

SEQ ID NO: 43346 - DNA, 601 bp, Human
ccagccttcaccgttcagaagaaacacttaactcttttcagcaaccgcaacaaataattatgttgggctctggccatctggccctgtttgacctgaatcggaagacaggtcttattttaggacatcaaagaagagagcagacttttgctccccacgcaagggttggataagaagccataaggatgaacacaactcagtgaccaattctttagtcaaaaggaacaactcggctgggcatggtggctcacacctgtaatctcagcactttgggaggctgaggcgggcggatcatgaggtcagsagatcgagaccatcctggctaacatggtgaaaccgtgtctctactaaaaatacaaaaaattagccgggcgtgctggcgggtgcctgtagtcccagctactcgggagggaggctgaggcaggagaatgacatgaacccaggaggcggagcttgcagtgagccgagatgtggccactgcactccagcctaggcgacagggtgagactccgtctcaaaaaaaaaaaaaaaaaaaaatcaaggcccagagattcatgatcactgagaagaggaattcgcaaatgacccttttgttgacagagga

SEQ ID NO: 43347 - DNA, 601 bp, Human
gctaatttttgtatttttagcagagatgggattttgccatgtgacccaggctggtcttgaactcctggcctcaaacgatccacctgtcttagcctctcaaagtgttgggattacaggtgtgtgccagtgcacctggcctctgaggtggattttagctccagccagtaggacacccctgtctctccttaatgctgccatctcctctctgcgctggttctctcttgagtttatcacctcgacttcacaggaagggctggtcacgtgaggggagactttgggtaggaggaagagagtgggcagragaaggaaaaatcagatctgcctgctgccagccttcaccgttcagaagaaacacttaactcttttcagcaaccgcaacaaataattatgttgggctctggccatctggccctgtttgacctgaatcggaagacaggtcttattttaggacatcaaagaagagagcagacttttgctccccacgcaagggttggataagaagccataaggatgaacacaactcagtgaccaattctttagtcaaaaggaacaactcggctgggcatggtggctcacacctgtaatctcagcactttgggag

SEQ ID NO: 43348 - DNA, 601 bp, Human
ggagaaggtttttcaaagcaagacgatctgcttttcaatatgtcaggcttggtcatttgagaagccacaggattctggtctgctgtggtctttgatttagaataggaaaaaaacgccaaaaaccaagcaggggattttgtcttctgactttattcatagcccatggggcagagttgaagagagaacatactgtttttcttctgtatctcctcacccccattcgccttagaggtgagttttcaagatttgaattggaagaaggtgaaatggacaagggcagccttgagaaggacacagaggrgctccctggttaaaaggcgagacagcaccccctgctggtgtgaatgttcatggactgagttttccccactgcagggactgctgcatctgttttgctgatcgtggaacataccgcacatggcgtaaaacaggtgcccagtgaatattagaaaaggaaattatacgtgttaatccaaggtggattattttattaaattgagatgaggtcttgatattgttgcccaggctggtctggaactcctgagctcaagcagttctcctaccttggcctcccaaagcgctggcattacaggcgtgggcc

SEQ ID NO: 43349 - DNA, 601 bp, Human
ctgtgcgtgtctgaggtgtggaaaccaggagagggggaaagaattctcaaaggcctgacgtgagaagttggaaaggtttgcaggttagggaatgaattgggagtgggggccggcggcacccatttcggtgactttctccccatttcatgtaaacagaattgccagggaccggttaccgtggatatgtttttctaaaaactcagtgtctgcacaatccattgatagaactggaggatgtgtctgtgtttcctgttgggtttttctcatctcttacatcatacaaacttcaatttttaccttsaatacaggggtagtaggggtggtggtggtggtggtggttgagacagggtctctgttgcccaggctggagtgcaatgatgcaattatagctcattgcagcctcgaagtcctgggctggagcgttcttcctggctcagcctccctagtagctgggaccacaggtgtgtaccaccacgcccagcttatttttaaattcttgtatagatgaggttttactacgttgcccaggctggagggtggtggtttttatattccttgtgtgaggggtgtctgtgatatttggaatttgagaatggattta

SEQ ID NO: 43350 - DNA, 601 bp, Human; identical to SEQ ID NO: 43121

SEQ ID NO: 43351 - DNA, 601 bp, Human; identical to SEQ ID NO: 43122

SEQ ID NO: 43352 - DNA, 601 bp, Human; identical to SEQ ID NO: 43123

SEQ ID NO: 43353 - DNA, 601 bp, Human; identical to SEQ ID NO: 43124

SEQ ID NO: 43354 - DNA, 601 bp, Human; identical to SEQ ID NO: 43125

SEQ ID NO: 43355 - DNA, 601 bp, Human; identical to SEQ ID NO: 43126

SEQ ID NO: 43356 - DNA, 601 bp, Human; identical to SEQ ID NO: 43127

SEQ ID NO: 43357 - DNA, 601 bp, Human; identical to SEQ ID NO: 43128

SEQ ID NO: 43358 - DNA, 601 bp, Human; identical to SEQ ID NO: 43129

SEQ ID NO: 43359 - DNA, 601 bp, Human; identical to SEQ ID NO: 43130

SEQ ID NO: 43360 - DNA, 601 bp, Human; identical to SEQ ID NO: 43131

SEQ ID NO: 43361 - DNA, 601 bp, Human; identical to SEQ ID NO: 43132

SEQ ID NO: 43362 - DNA, 601 bp, Human; identical to SEQ ID NO: 43133

SEQ ID NO: 43363 - DNA, 601 bp, Human; identical to SEQ ID NO: 43134

SEQ ID NO: 43364 - DNA, 601 bp, Human; identical to SEQ ID NO: 43135

SEQ ID NO: 43365 - DNA, 601 bp, Human; identical to SEQ ID NO: 43136

SEQ ID NO: 43366 - DNA, 601 bp, Human; identical to SEQ ID NO: 43137

SEQ ID NO: 43367 - DNA, 601 bp, Human; identical to SEQ ID NO: 43138

SEQ ID NO: 43368 - DNA, 601 bp, Human; identical to SEQ ID NO: 43139

SEQ ID NO: 43369 - DNA, 601 bp, Human; identical to SEQ ID NO: 43140

SEQ ID NO: 43370 - DNA, 601 bp, Human; identical to SEQ ID NO: 43141

SEQ ID NO: 43371 - DNA, 601 bp, Human; identical to SEQ ID NO: 43142

SEQ ID NO: 43372 - DNA, 601 bp, Human; identical to SEQ ID NO: 43143

SEQ ID NO: 43373 - DNA, 601 bp, Human; identical to SEQ ID NO: 43144

SEQ ID NO: 43374 - DNA, 601 bp, Human; identical to SEQ ID NO: 43145

SEQ ID NO: 43375 - DNA, 601 bp, Human; identical to SEQ ID NO: 43146

SEQ ID NO: 43376 - DNA, 601 bp, Human; identical to SEQ ID NO: 43147

SEQ ID NO: 43377 - DNA, 601 bp, Human; identical to SEQ ID NO: 43148

SEQ ID NO: 43378 - DNA, 601 bp, Human; identical to SEQ ID NO: 43149

SEQ ID NO: 43379 - DNA, 601 bp, Human; identical to SEQ ID NO: 43150

SEQ ID NO: 43380 - DNA, 601 bp, Human; identical to SEQ ID NO: 43151

SEQ ID NO: 43381 - DNA, 601 bp, Human; identical to SEQ ID NO: 43152

SEQ ID NO: 43382 - DNA, 601 bp, Human; identical to SEQ ID NO: 43153

SEQ ID NO: 43383 - DNA, 601 bp, Human; identical to SEQ ID NO: 43154

SEQ ID NO: 43384 - DNA, 601 bp, Human; identical to SEQ ID NO: 43155

SEQ ID NO: 43385 - DNA, 601 bp, Human; identical to SEQ ID NO: 43156

SEQ ID NO: 43386 - DNA, 601 bp, Human; identical to SEQ ID NO: 43157

SEQ ID NO: 43387 - DNA, 601 bp, Human; identical to SEQ ID NO: 43158

SEQ ID NO: 43388 - DNA, 601 bp, Human; identical to SEQ ID NO: 43159

SEQ ID NO: 43389 - DNA, 601 bp, Human; identical to SEQ ID NO: 43160

SEQ ID NO: 43390 - DNA, 601 bp, Human; identical to SEQ ID NO: 43161

SEQ ID NO: 43391 - DNA, 601 bp, Human; identical to SEQ ID NO: 43162

SEQ ID NO: 43392 - DNA, 601 bp, Human; identical to SEQ ID NO: 43163

SEQ ID NO: 43393 - DNA, 601 bp, Human; identical to SEQ ID NO: 43164

SEQ ID NO: 43394 - DNA, 601 bp, Human; identical to SEQ ID NO: 43165

SEQ ID NO: 43395 - DNA, 601 bp, Human; identical to SEQ ID NO: 43166

SEQ ID NO: 43396 - DNA, 601 bp, Human; identical to SEQ ID NO: 43167

SEQ ID NO: 43397 - DNA, 601 bp, Human; identical to SEQ ID NO: 43168

SEQ ID NO: 43398 - DNA, 601 bp, Human; identical to SEQ ID NO: 43169

SEQ ID NO: 43399 - DNA, 601 bp, Human; identical to SEQ ID NO: 43170

SEQ ID NO: 43400 - DNA, 601 bp, Human; identical to SEQ ID NO: 43171

SEQ ID NO: 43401 - DNA, 601 bp, Human; identical to SEQ ID NO: 43172

SEQ ID NO: 43402 - DNA, 601 bp, Human; identical to SEQ ID NO: 43173

SEQ ID NO: 43403 - DNA, 601 bp, Human; identical to SEQ ID NO: 43174

SEQ ID NO: 43404 - DNA, 601 bp, Human; identical to SEQ ID NO: 43175

SEQ ID NO: 43405 - DNA, 601 bp, Human; identical to SEQ ID NO: 43176

SEQ ID NO: 43406 - DNA, 601 bp, Human; identical to SEQ ID NO: 43177

SEQ ID NO: 43407 - DNA, 601 bp, Human; identical to SEQ ID NO: 43178

SEQ ID NO: 43408 - DNA, 601 bp, Human; identical to SEQ ID NO: 43179

SEQ ID NO: 43409 - DNA, 601 bp, Human; identical to SEQ ID NO: 43180

SEQ ID NO: 43410 - DNA, 601 bp, Human; identical to SEQ ID NO: 43181

SEQ ID NO: 43411 - DNA, 601 bp, Human; identical to SEQ ID NO: 43182

SEQ ID NO: 43412 - DNA, 601 bp, Human; identical to SEQ ID NO: 43183

SEQ ID NO: 43413 - DNA, 601 bp, Human; identical to SEQ ID NO: 43184

SEQ ID NO: 43414 - DNA, 601 bp, Human; identical to SEQ ID NO: 43185

SEQ ID NO: 43415 - DNA, 601 bp, Human; identical to SEQ ID NO: 43186

SEQ ID NO: 43416 - DNA, 601 bp, Human; identical to SEQ ID NO: 43187

SEQ ID NO: 43417 - DNA, 601 bp, Human; identical to SEQ ID NO: 43188

SEQ ID NO: 43418 - DNA, 601 bp, Human; identical to SEQ ID NO: 43189

SEQ ID NO: 43419 - DNA, 601 bp, Human; identical to SEQ ID NO: 43190

SEQ ID NO: 43420 - DNA, 601 bp, Human; identical to SEQ ID NO: 43191

SEQ ID NO: 43421 - DNA, 601 bp, Human; identical to SEQ ID NO: 43192

SEQ ID NO: 43422 - DNA, 601 bp, Human; identical to SEQ ID NO: 43193

SEQ ID NO: 43423 - DNA, 601 bp, Human; identical to SEQ ID NO: 43194

SEQ ID NO: 43424 - DNA, 601 bp, Human; identical to SEQ ID NO: 43195

SEQ ID NO: 43425 - DNA, 601 bp, Human; identical to SEQ ID NO: 43196

SEQ ID NO: 43426 - DNA, 601 bp, Human; identical to SEQ ID NO: 43197

SEQ ID NO: 43427 - DNA, 601 bp, Human; identical to SEQ ID NO: 43198

SEQ ID NO: 43428 - DNA, 601 bp, Human; identical to SEQ ID NO: 43199

SEQ ID NO: 43429 - DNA, 601 bp, Human; identical to SEQ ID NO: 43200

SEQ ID NO: 43430 - DNA, 601 bp, Human; identical to SEQ ID NO: 43201

SEQ ID NO: 43431 - DNA, 601 bp, Human; identical to SEQ ID NO: 43202

SEQ ID NO: 43432 - DNA, 601 bp, Human; identical to SEQ ID NO: 43203

SEQ ID NO: 43433 - DNA, 601 bp, Human; identical to SEQ ID NO: 43204

SEQ ID NO: 43434 - DNA, 601 bp, Human; identical to SEQ ID NO: 43205

SEQ ID NO: 43435 - DNA, 601 bp, Human; identical to SEQ ID NO: 43206

SEQ ID NO: 43436 - DNA, 601 bp, Human; identical to SEQ ID NO: 43207

SEQ ID NO: 43437 - DNA, 601 bp, Human; identical to SEQ ID NO: 43208

SEQ ID NO: 43438 - DNA, 601 bp, Human; identical to SEQ ID NO: 43209

SEQ ID NO: 43439 - DNA, 601 bp, Human; identical to SEQ ID NO: 43210

SEQ ID NO: 43440 - DNA, 601 bp, Human; identical to SEQ ID NO: 43211

SEQ ID NO: 43441 - DNA, 601 bp, Human; identical to SEQ ID NO: 43212

SEQ ID NO: 43442 - DNA, 601 bp, Human; identical to SEQ ID NO: 43213

SEQ ID NO: 43443 - DNA, 601 bp, Human; identical to SEQ ID NO: 43214

SEQ ID NO: 43444 - DNA, 601 bp, Human; identical to SEQ ID NO: 43215

SEQ ID NO: 43445 - DNA, 601 bp, Human; identical to SEQ ID NO: 43216

SEQ ID NO: 43446 - DNA, 601 bp, Human; identical to SEQ ID NO: 43217

SEQ ID NO: 43447 - DNA, 601 bp, Human; identical to SEQ ID NO: 43218

SEQ ID NO: 43448 - DNA, 601 bp, Human; identical to SEQ ID NO: 43219

SEQ ID NO: 43449 - DNA, 601 bp, Human; identical to SEQ ID NO: 43220

SEQ ID NO: 43450 - DNA, 601 bp, Human; identical to SEQ ID NO: 43221

SEQ ID NO: 43451 - DNA, 601 bp, Human; identical to SEQ ID NO: 43222

SEQ ID NO: 43452 - DNA, 601 bp, Human; identical to SEQ ID NO: 43223

SEQ ID NO: 43453 - DNA, 601 bp, Human; identical to SEQ ID NO: 43224

SEQ ID NO: 43454 - DNA, 601 bp, Human; identical to SEQ ID NO: 43225

SEQ ID NO: 43455 - DNA, 601 bp, Human; identical to SEQ ID NO: 43226

SEQ ID NO: 43456 - DNA, 601 bp, Human; identical to SEQ ID NO: 43227

SEQ ID NO: 43457 - DNA, 601 bp, Human; identical to SEQ ID NO: 43228

SEQ ID NO: 43458 - DNA, 601 bp, Human; identical to SEQ ID NO: 43229

SEQ ID NO: 43459 - DNA, 601 bp, Human; identical to SEQ ID NO: 43230

SEQ ID NO: 43460 - DNA, 601 bp, Human; identical to SEQ ID NO: 43231

SEQ ID NO: 43461 - DNA, 601 bp, Human; identical to SEQ ID NO: 43232

SEQ ID NO: 43462 - DNA, 601 bp, Human; identical to SEQ ID NO: 43233

SEQ ID NO: 43463 - DNA, 601 bp, Human; identical to SEQ ID NO: 43234

SEQ ID NO: 43464 - DNA, 601 bp, Human; identical to SEQ ID NO: 43235

SEQ ID NO: 43465 - DNA, 601 bp, Human; identical to SEQ ID NO: 43236

SEQ ID NO: 43466 - DNA, 601 bp, Human; identical to SEQ ID NO: 43237

SEQ ID NO: 43467 - DNA, 601 bp, Human; identical to SEQ ID NO: 43238

SEQ ID NO: 43468 - DNA, 601 bp, Human; identical to SEQ ID NO: 43239

SEQ ID NO: 43469 - DNA, 601 bp, Human; identical to SEQ ID NO: 43240

SEQ ID NO: 43470 - DNA, 601 bp, Human; identical to SEQ ID NO: 43241

SEQ ID NO: 43471 - DNA, 601 bp, Human; identical to SEQ ID NO: 43242

SEQ ID NO: 43472 - DNA, 601 bp, Human; identical to SEQ ID NO: 43243

SEQ ID NO: 43473 - DNA, 601 bp, Human; identical to SEQ ID NO: 43244

SEQ ID NO: 43474 - DNA, 601 bp, Human; identical to SEQ ID NO: 43245

SEQ ID NO: 43475 - DNA, 601 bp, Human; identical to SEQ ID NO: 43246

SEQ ID NO: 43476 - DNA, 601 bp, Human; identical to SEQ ID NO: 43247

SEQ ID NO: 43477 - DNA, 601 bp, Human; identical to SEQ ID NO: 43248

SEQ ID NO: 43478 - DNA, 601 bp, Human; identical to SEQ ID NO: 43249

SEQ ID NO: 43479 - DNA, 601 bp, Human; identical to SEQ ID NO: 43250

SEQ ID NO: 43480 - DNA, 601 bp, Human; identical to SEQ ID NO: 43251

SEQ ID NO: 43481 - DNA, 601 bp, Human; identical to SEQ ID NO: 43252

SEQ ID NO: 43482 - DNA, 601 bp, Human; identical to SEQ ID NO: 43253

SEQ ID NO: 43483 - DNA, 601 bp, Human; identical to SEQ ID NO: 43254

SEQ ID NO: 43484 - DNA, 601 bp, Human; identical to SEQ ID NO: 43255

SEQ ID NO: 43485 - DNA, 601 bp, Human; identical to SEQ ID NO: 43256

SEQ ID NO: 43486 - DNA, 601 bp, Human; identical to SEQ ID NO: 43257

SEQ ID NO: 43487 - DNA, 601 bp, Human; identical to SEQ ID NO: 43258

SEQ ID NO: 43488 - DNA, 601 bp, Human; identical to SEQ ID NO: 43259

SEQ ID NO: 43489 - DNA, 601 bp, Human; identical to SEQ ID NO: 43260

SEQ ID NO: 43490 - DNA, 601 bp, Human; identical to SEQ ID NO: 43261

SEQ ID NO: 43491 - DNA, 601 bp, Human; identical to SEQ ID NO: 43262

SEQ ID NO: 43492 - DNA, 601 bp, Human; identical to SEQ ID NO: 43263

SEQ ID NO: 43493 - DNA, 601 bp, Human; identical to SEQ ID NO: 43264

SEQ ID NO: 43494 - DNA, 601 bp, Human; identical to SEQ ID NO: 43265

SEQ ID NO: 43495 - DNA, 601 bp, Human; identical to SEQ ID NO: 43266

SEQ ID NO: 43496 - DNA, 601 bp, Human; identical to SEQ ID NO: 43267

SEQ ID NO: 43497 - DNA, 601 bp, Human; identical to SEQ ID NO: 43268

SEQ ID NO: 43498 - DNA, 601 bp, Human; identical to SEQ ID NO: 43269

SEQ ID NO: 43499 - DNA, 601 bp, Human; identical to SEQ ID NO: 43270

SEQ ID NO: 43500 - DNA, 601 bp, Human; identical to SEQ ID NO: 43271

SEQ ID NO: 43501 - DNA, 601 bp, Human; identical to SEQ ID NO: 43272

SEQ ID NO: 43502 - DNA, 601 bp, Human; identical to SEQ ID NO: 43273

SEQ ID NO: 43503 - DNA, 601 bp, Human; identical to SEQ ID NO: 43274

SEQ ID NO: 43504 - DNA, 601 bp, Human; identical to SEQ ID NO: 43275

SEQ ID NO: 43505 - DNA, 601 bp, Human; identical to SEQ ID NO: 43276

SEQ ID NO: 43506 - DNA, 601 bp, Human; identical to SEQ ID NO: 43277

SEQ ID NO: 43507 - DNA, 601 bp, Human; identical to SEQ ID NO: 43278

SEQ ID NO: 43508 - DNA, 601 bp, Human; identical to SEQ ID NO: 43279

SEQ ID NO: 43509 - DNA, 601 bp, Human; identical to SEQ ID NO: 43280

SEQ ID NO: 43510 - DNA, 601 bp, Human; identical to SEQ ID NO: 43281

SEQ ID NO: 43511 - DNA, 601 bp, Human; identical to SEQ ID NO: 43282

SEQ ID NO: 43512 - DNA, 601 bp, Human; identical to SEQ ID NO: 43283

SEQ ID NO: 43513 - DNA, 601 bp, Human; identical to SEQ ID NO: 43284

SEQ ID NO: 43514 - DNA, 601 bp, Human; identical to SEQ ID NO: 43285

SEQ ID NO: 43515 - DNA, 601 bp, Human; identical to SEQ ID NO: 43286

SEQ ID NO: 43516 - DNA, 601 bp, Human; identical to SEQ ID NO: 43287

SEQ ID NO: 43517 - DNA, 601 bp, Human; identical to SEQ ID NO: 43288

SEQ ID NO: 43518 - DNA, 601 bp, Human; identical to SEQ ID NO: 43289

SEQ ID NO: 43519 - DNA, 601 bp, Human; identical to SEQ ID NO: 43290

SEQ ID NO: 43520 - DNA, 601 bp, Human; identical to SEQ ID NO: 43291

SEQ ID NO: 43521 - DNA, 601 bp, Human; identical to SEQ ID NO: 43292

SEQ ID NO: 43522 - DNA, 601 bp, Human; identical to SEQ ID NO: 43293

SEQ ID NO: 43523 - DNA, 601 bp, Human; identical to SEQ ID NO: 43294

SEQ ID NO: 43524 - DNA, 601 bp, Human; identical to SEQ ID NO: 43295

SEQ ID NO: 43525 - DNA, 601 bp, Human; identical to SEQ ID NO: 43296

SEQ ID NO: 43526 - DNA, 601 bp, Human; identical to SEQ ID NO: 43297

SEQ ID NO: 43527 - DNA, 601 bp, Human; identical to SEQ ID NO: 43298

SEQ ID NO: 43528 - DNA, 601 bp, Human; identical to SEQ ID NO: 43299

SEQ ID NO: 43529 - DNA, 601 bp, Human; identical to SEQ ID NO: 43300

SEQ ID NO: 43530 - DNA, 601 bp, Human; identical to SEQ ID NO: 43301

SEQ ID NO: 43531 - DNA, 601 bp, Human; identical to SEQ ID NO: 43302

SEQ ID NO: 43532 - DNA, 601 bp, Human; identical to SEQ ID NO: 43303

SEQ ID NO: 43533 - DNA, 601 bp, Human; identical to SEQ ID NO: 43304

SEQ ID NO: 43534 - DNA, 601 bp, Human; identical to SEQ ID NO: 43305

SEQ ID NO: 43535 - DNA, 601 bp, Human; identical to SEQ ID NO: 43306

SEQ ID NO: 43536 - DNA, 601 bp, Human; identical to SEQ ID NO: 43307

SEQ ID NO: 43537 - DNA, 601 bp, Human; identical to SEQ ID NO: 43308

SEQ ID NO: 43538 - DNA, 601 bp, Human; identical to SEQ ID NO: 43309

SEQ ID NO: 43539 - DNA, 601 bp, Human; identical to SEQ ID NO: 43310

SEQ ID NO: 43540 - DNA, 601 bp, Human; identical to SEQ ID NO: 43311

SEQ ID NO: 43541 - DNA, 601 bp, Human; identical to SEQ ID NO: 43312

SEQ ID NO: 43542 - DNA, 601 bp, Human; identical to SEQ ID NO: 43313

SEQ ID NO: 43543 - DNA, 601 bp, Human; identical to SEQ ID NO: 43314

SEQ ID NO: 43544 - DNA, 601 bp, Human; identical to SEQ ID NO: 43315

SEQ ID NO: 43545 - DNA, 601 bp, Human; identical to SEQ ID NO: 43316

SEQ ID NO: 43546 - DNA, 601 bp, Human; identical to SEQ ID NO: 43317

SEQ ID NO: 43547 - DNA, 601 bp, Human; identical to SEQ ID NO: 43318

SEQ ID NO: 43548 - DNA, 601 bp, Human; identical to SEQ ID NO: 43319

SEQ ID NO: 43549 - DNA, 601 bp, Human; identical to SEQ ID NO: 43320

SEQ ID NO: 43550 - DNA, 601 bp, Human; identical to SEQ ID NO: 43321

SEQ ID NO: 43551 - DNA, 601 bp, Human; identical to SEQ ID NO: 43322

SEQ ID NO: 43552 - DNA, 601 bp, Human; identical to SEQ ID NO: 43323

SEQ ID NO: 43553 - DNA, 601 bp, Human; identical to SEQ ID NO: 43324

SEQ ID NO: 43554 - DNA, 601 bp, Human; identical to SEQ ID NO: 43325

SEQ ID NO: 43555 - DNA, 601 bp, Human; identical to SEQ ID NO: 43326

SEQ ID NO: 43556 - DNA, 601 bp, Human; identical to SEQ ID NO: 43327

SEQ ID NO: 43557 - DNA, 601 bp, Human; identical to SEQ ID NO: 43328

SEQ ID NO: 43558 - DNA, 601 bp, Human; identical to SEQ ID NO: 43329

SEQ ID NO: 43559 - DNA, 601 bp, Human; identical to SEQ ID NO: 43330

SEQ ID NO: 43560 - DNA, 601 bp, Human; identical to SEQ ID NO: 43331

SEQ ID NO: 43561 - DNA, 601 bp, Human; identical to SEQ ID NO: 43332

SEQ ID NO: 43562 - DNA, 601 bp, Human; identical to SEQ ID NO: 43333

SEQ ID NO: 43563 - DNA, 601 bp, Human; identical to SEQ ID NO: 43334

SEQ ID NO: 43564 - DNA, 601 bp, Human; identical to SEQ ID NO: 43335

SEQ ID NO: 43565 - DNA, 601 bp, Human; identical to SEQ ID NO: 43336

SEQ ID NO: 43566 - DNA, 601 bp, Human; identical to SEQ ID NO: 43337

SEQ ID NO: 43567 - DNA, 601 bp, Human; identical to SEQ ID NO: 43338

SEQ ID NO: 43568 - DNA, 601 bp, Human; identical to SEQ ID NO: 43339

SEQ ID NO: 43569 - DNA, 601 bp, Human; identical to SEQ ID NO: 43340

SEQ ID NO: 43570 - DNA, 601 bp, Human; identical to SEQ ID NO: 43341

SEQ ID NO: 43571 - DNA, 601 bp, Human; identical to SEQ ID NO: 43342

SEQ ID NO: 43572 - DNA, 601 bp, Human; identical to SEQ ID NO: 43343

SEQ ID NO: 43573 - DNA, 601 bp, Human; identical to SEQ ID NO: 43344

SEQ ID NO: 43574 - DNA, 601 bp, Human; identical to SEQ ID NO: 43345

SEQ ID NO: 43575 - DNA, 601 bp, Human; identical to SEQ ID NO: 43346

SEQ ID NO: 43576 - DNA, 601 bp, Human; identical to SEQ ID NO: 43347

SEQ ID NO: 43577 - DNA, 601 bp, Human; identical to SEQ ID NO: 43348

SEQ ID NO: 43578 - DNA, 601 bp, Human; identical to SEQ ID NO: 43349

SEQ ID NO: 43579 - DNA, 601 bp, Human; identical to SEQ ID NO: 43121

SEQ ID NO: 43580 - DNA, 601 bp, Human; identical to SEQ ID NO: 43122

SEQ ID NO: 43581 - DNA, 601 bp, Human; identical to SEQ ID NO: 43123

SEQ ID NO: 43582 - DNA, 601 bp, Human; identical to SEQ ID NO: 43124

SEQ ID NO: 43583 - DNA, 601 bp, Human; identical to SEQ ID NO: 43125

SEQ ID NO: 43584 - DNA, 601 bp, Human; identical to SEQ ID NO: 43126

SEQ ID NO: 43585 - DNA, 601 bp, Human; identical to SEQ ID NO: 43127

SEQ ID NO: 43586 - DNA, 601 bp, Human; identical to SEQ ID NO: 43128

SEQ ID NO: 43587 - DNA, 601 bp, Human; identical to SEQ ID NO: 43129

SEQ ID NO: 43588 - DNA, 601 bp, Human; identical to SEQ ID NO: 43130

SEQ ID NO: 43589 - DNA, 601 bp, Human; identical to SEQ ID NO: 43131

SEQ ID NO: 43590 - DNA, 601 bp, Human; identical to SEQ ID NO: 43132

SEQ ID NO: 43591 - DNA, 601 bp, Human; identical to SEQ ID NO: 43133

SEQ ID NO: 43592 - DNA, 601 bp, Human; identical to SEQ ID NO: 43134

SEQ ID NO: 43593 - DNA, 601 bp, Human; identical to SEQ ID NO: 43135

SEQ ID NO: 43594 - DNA, 601 bp, Human; identical to SEQ ID NO: 43136

SEQ ID NO: 43595 - DNA, 601 bp, Human; identical to SEQ ID NO: 43137

SEQ ID NO: 43596 - DNA, 601 bp, Human; identical to SEQ ID NO: 43138

SEQ ID NO: 43597 - DNA, 601 bp, Human; identical to SEQ ID NO: 43139

SEQ ID NO: 43598 - DNA, 601 bp, Human; identical to SEQ ID NO: 43140

SEQ ID NO: 43599 - DNA, 601 bp, Human; identical to SEQ ID NO: 43141

SEQ ID NO: 43600 - DNA, 601 bp, Human; identical to SEQ ID NO: 43142

SEQ ID NO: 43601 - DNA, 601 bp, Human; identical to SEQ ID NO: 43143

SEQ ID NO: 43602 - DNA, 601 bp, Human; identical to SEQ ID NO: 43144

SEQ ID NO: 43603 - DNA, 601 bp, Human; identical to SEQ ID NO: 43145

SEQ ID NO: 43604 - DNA, 601 bp, Human; identical to SEQ ID NO: 43146

SEQ ID NO: 43605 - DNA, 601 bp, Human; identical to SEQ ID NO: 43147

SEQ ID NO: 43606 - DNA, 601 bp, Human; identical to SEQ ID NO: 43148

SEQ ID NO: 43607 - DNA, 601 bp, Human; identical to SEQ ID NO: 43149

SEQ ID NO: 43608 - DNA, 601 bp, Human; identical to SEQ ID NO: 43150

SEQ ID NO: 43609 - DNA, 601 bp, Human; identical to SEQ ID NO: 43151

SEQ ID NO: 43610 - DNA, 601 bp, Human; identical to SEQ ID NO: 43152

SEQ ID NO: 43611 - DNA, 601 bp, Human; identical to SEQ ID NO: 43153

SEQ ID NO: 43612 - DNA, 601 bp, Human; identical to SEQ ID NO: 43154

SEQ ID NO: 43613 - DNA, 601 bp, Human; identical to SEQ ID NO: 43155

SEQ ID NO: 43614 - DNA, 601 bp, Human; identical to SEQ ID NO: 43156

SEQ ID NO: 43615 - DNA, 601 bp, Human; identical to SEQ ID NO: 43157

SEQ ID NO: 43616 - DNA, 601 bp, Human; identical to SEQ ID NO: 43158

SEQ ID NO: 43617 - DNA, 601 bp, Human; identical to SEQ ID NO: 43159

SEQ ID NO: 43618 - DNA, 601 bp, Human; identical to SEQ ID NO: 43160

SEQ ID NO: 43619 - DNA, 601 bp, Human; identical to SEQ ID NO: 43161

SEQ ID NO: 43620 - DNA, 601 bp, Human; identical to SEQ ID NO: 43162

SEQ ID NO: 43621 - DNA, 601 bp, Human; identical to SEQ ID NO: 43163

SEQ ID NO: 43622 - DNA, 601 bp, Human; identical to SEQ ID NO: 43164

SEQ ID NO: 43623 - DNA, 601 bp, Human; identical to SEQ ID NO: 43165

SEQ ID NO: 43624 - DNA, 601 bp, Human; identical to SEQ ID NO: 43166

SEQ ID NO: 43625 - DNA, 601 bp, Human; identical to SEQ ID NO: 43167

SEQ ID NO: 43626 - DNA, 601 bp, Human; identical to SEQ ID NO: 43168

SEQ ID NO: 43627 - DNA, 601 bp, Human; identical to SEQ ID NO: 43169

SEQ ID NO: 43628 - DNA, 601 bp, Human; identical to SEQ ID NO: 43170

SEQ ID NO: 43629 - DNA, 601 bp, Human; identical to SEQ ID NO: 43171

SEQ ID NO: 43630 - DNA, 601 bp, Human; identical to SEQ ID NO: 43172

SEQ ID NO: 43631 - DNA, 601 bp, Human; identical to SEQ ID NO: 43173

SEQ ID NO: 43632 - DNA, 601 bp, Human; identical to SEQ ID NO: 43174

SEQ ID NO: 43633 - DNA, 601 bp, Human; identical to SEQ ID NO: 43175

SEQ ID NO: 43634 - DNA, 601 bp, Human; identical to SEQ ID NO: 43176

SEQ ID NO: 43635 - DNA, 601 bp, Human; identical to SEQ ID NO: 43177

SEQ ID NO: 43636 - DNA, 601 bp, Human; identical to SEQ ID NO: 43178

SEQ ID NO: 43637 - DNA, 601 bp, Human; identical to SEQ ID NO: 43179

SEQ ID NO: 43638 - DNA, 601 bp, Human; identical to SEQ ID NO: 43180

SEQ ID NO: 43639 - DNA, 601 bp, Human; identical to SEQ ID NO: 43181

SEQ ID NO: 43640 - DNA, 601 bp, Human; identical to SEQ ID NO: 43182

SEQ ID NO: 43641 - DNA, 601 bp, Human; identical to SEQ ID NO: 43183

SEQ ID NO: 43642 - DNA, 601 bp, Human; identical to SEQ ID NO: 43184

SEQ ID NO: 43643 - DNA, 601 bp, Human; identical to SEQ ID NO: 43185

SEQ ID NO: 43644 - DNA, 601 bp, Human; identical to SEQ ID NO: 43186

SEQ ID NO: 43645 - DNA, 601 bp, Human; identical to SEQ ID NO: 43187

SEQ ID NO: 43646 - DNA, 601 bp, Human; identical to SEQ ID NO: 43188

SEQ ID NO: 43647 - DNA, 601 bp, Human; identical to SEQ ID NO: 43189

SEQ ID NO: 43648 - DNA, 601 bp, Human; identical to SEQ ID NO: 43190

SEQ ID NO: 43649 - DNA, 601 bp, Human; identical to SEQ ID NO: 43191

SEQ ID NO: 43650 - DNA, 601 bp, Human; identical to SEQ ID NO: 43192

SEQ ID NO: 43651 - DNA, 601 bp, Human; identical to SEQ ID NO: 43193

SEQ ID NO: 43652 - DNA, 601 bp, Human; identical to SEQ ID NO: 43194

SEQ ID NO: 43653 - DNA, 601 bp, Human; identical to SEQ ID NO: 43195

SEQ ID NO: 43654 - DNA, 601 bp, Human; identical to SEQ ID NO: 43196

SEQ ID NO: 43655 - DNA, 601 bp, Human; identical to SEQ ID NO: 43197

SEQ ID NO: 43656 - DNA, 601 bp, Human; identical to SEQ ID NO: 43198

SEQ ID NO: 43657 - DNA, 601 bp, Human; identical to SEQ ID NO: 43199

SEQ ID NO: 43658 - DNA, 601 bp, Human; identical to SEQ ID NO: 43200

SEQ ID NO: 43659 - DNA, 601 bp, Human; identical to SEQ ID NO: 43201

SEQ ID NO: 43660 - DNA, 601 bp, Human; identical to SEQ ID NO: 43202

SEQ ID NO: 43661 - DNA, 601 bp, Human; identical to SEQ ID NO: 43203

SEQ ID NO: 43662 - DNA, 601 bp, Human; identical to SEQ ID NO: 43204

SEQ ID NO: 43663 - DNA, 601 bp, Human; identical to SEQ ID NO: 43205

SEQ ID NO: 43664 - DNA, 601 bp, Human; identical to SEQ ID NO: 43206

SEQ ID NO: 43665 - DNA, 601 bp, Human; identical to SEQ ID NO: 43207

SEQ ID NO: 43666 - DNA, 601 bp, Human; identical to SEQ ID NO: 43208

SEQ ID NO: 43667 - DNA, 601 bp, Human; identical to SEQ ID NO: 43209

SEQ ID NO: 43668 - DNA, 601 bp, Human; identical to SEQ ID NO: 43210

SEQ ID NO: 43669 - DNA, 601 bp, Human; identical to SEQ ID NO: 43211

SEQ ID NO: 43670 - DNA, 601 bp, Human; identical to SEQ ID NO: 43212

SEQ ID NO: 43671 - DNA, 601 bp, Human; identical to SEQ ID NO: 43213

SEQ ID NO: 43672 - DNA, 601 bp, Human; identical to SEQ ID NO: 43214

SEQ ID NO: 43673 - DNA, 601 bp, Human; identical to SEQ ID NO: 43215

SEQ ID NO: 43674 - DNA, 601 bp, Human; identical to SEQ ID NO: 43216

SEQ ID NO: 43675 - DNA, 601 bp, Human; identical to SEQ ID NO: 43217

SEQ ID NO: 43676 - DNA, 601 bp, Human; identical to SEQ ID NO: 43218

SEQ ID NO: 43677 - DNA, 601 bp, Human; identical to SEQ ID NO: 43219

SEQ ID NO: 43678 - DNA, 601 bp, Human; identical to SEQ ID NO: 43220

SEQ ID NO: 43679 - DNA, 601 bp, Human; identical to SEQ ID NO: 43221

SEQ ID NO: 43680 - DNA, 601 bp, Human; identical to SEQ ID NO: 43222

SEQ ID NO: 43681 - DNA, 601 bp, Human; identical to SEQ ID NO: 43223

SEQ ID NO: 43682 - DNA, 601 bp, Human; identical to SEQ ID NO: 43224

SEQ ID NO: 43683 - DNA, 601 bp, Human; identical to SEQ ID NO: 43225

SEQ ID NO: 43684 - DNA, 601 bp, Human; identical to SEQ ID NO: 43226

SEQ ID NO: 43685 - DNA, 601 bp, Human; identical to SEQ ID NO: 43227

SEQ ID NO: 43686 - DNA, 601 bp, Human; identical to SEQ ID NO: 43228

SEQ ID NO: 43687 - DNA, 601 bp, Human; identical to SEQ ID NO: 43229

SEQ ID NO: 43688 - DNA, 601 bp, Human; identical to SEQ ID NO: 43230

SEQ ID NO: 43689 - DNA, 601 bp, Human; identical to SEQ ID NO: 43231

SEQ ID NO: 43690 - DNA, 601 bp, Human; identical to SEQ ID NO: 43232

SEQ ID NO: 43691 - DNA, 601 bp, Human; identical to SEQ ID NO: 43233

SEQ ID NO: 43692 - DNA, 601 bp, Human; identical to SEQ ID NO: 43234

SEQ ID NO: 43693 - DNA, 601 bp, Human; identical to SEQ ID NO: 43235

SEQ ID NO: 43694 - DNA, 601 bp, Human; identical to SEQ ID NO: 43236

SEQ ID NO: 43695 - DNA, 601 bp, Human; identical to SEQ ID NO: 43237

SEQ ID NO: 43696 - DNA, 601 bp, Human; identical to SEQ ID NO: 43238

SEQ ID NO: 43697 - DNA, 601 bp, Human; identical to SEQ ID NO: 43239

SEQ ID NO: 43698 - DNA, 601 bp, Human; identical to SEQ ID NO: 43240

SEQ ID NO: 43699 - DNA, 601 bp, Human; identical to SEQ ID NO: 43241

SEQ ID NO: 43700 - DNA, 601 bp, Human; identical to SEQ ID NO: 43242

SEQ ID NO: 43701 - DNA, 601 bp, Human; identical to SEQ ID NO: 43243

SEQ ID NO: 43702 - DNA, 601 bp, Human; identical to SEQ ID NO: 43244

SEQ ID NO: 43703 - DNA, 601 bp, Human; identical to SEQ ID NO: 43245

SEQ ID NO: 43704 - DNA, 601 bp, Human; identical to SEQ ID NO: 43246

SEQ ID NO: 43705 - DNA, 601 bp, Human; identical to SEQ ID NO: 43247

SEQ ID NO: 43706 - DNA, 601 bp, Human; identical to SEQ ID NO: 43248

SEQ ID NO: 43707 - DNA, 601 bp, Human; identical to SEQ ID NO: 43249

SEQ ID NO: 43708 - DNA, 601 bp, Human; identical to SEQ ID NO: 43250

SEQ ID NO: 43709 - DNA, 601 bp, Human; identical to SEQ ID NO: 43251

SEQ ID NO: 43710 - DNA, 601 bp, Human; identical to SEQ ID NO: 43252

SEQ ID NO: 43711 - DNA, 601 bp, Human; identical to SEQ ID NO: 43253

SEQ ID NO: 43712 - DNA, 601 bp, Human; identical to SEQ ID NO: 43254

SEQ ID NO: 43713 - DNA, 601 bp, Human; identical to SEQ ID NO: 43255

SEQ ID NO: 43714 - DNA, 601 bp, Human; identical to SEQ ID NO: 43256

SEQ ID NO: 43715 - DNA, 601 bp, Human; identical to SEQ ID NO: 43257

SEQ ID NO: 43716 - DNA, 601 bp, Human; identical to SEQ ID NO: 43258

SEQ ID NO: 43717 - DNA, 601 bp, Human; identical to SEQ ID NO: 43259

SEQ ID NO: 43718 - DNA, 601 bp, Human; identical to SEQ ID NO: 43260

SEQ ID NO: 43719 - DNA, 601 bp, Human; identical to SEQ ID NO: 43261

SEQ ID NO: 43720 - DNA, 601 bp, Human; identical to SEQ ID NO: 43262

SEQ ID NO: 43721 - DNA, 601 bp, Human; identical to SEQ ID NO: 43263

SEQ ID NO: 43722 - DNA, 601 bp, Human; identical to SEQ ID NO: 43264

SEQ ID NO: 43723 - DNA, 601 bp, Human; identical to SEQ ID NO: 43265

SEQ ID NO: 43724 - DNA, 601 bp, Human; identical to SEQ ID NO: 43266

SEQ ID NO: 43725 - DNA, 601 bp, Human; identical to SEQ ID NO: 43267

SEQ ID NO: 43726 - DNA, 601 bp, Human; identical to SEQ ID NO: 43268

SEQ ID NO: 43727 - DNA, 601 bp, Human; identical to SEQ ID NO: 43269

SEQ ID NO: 43728 - DNA, 601 bp, Human; identical to SEQ ID NO: 43270

SEQ ID NO: 43729 - DNA, 601 bp, Human; identical to SEQ ID NO: 43271

SEQ ID NO: 43730 - DNA, 601 bp, Human; identical to SEQ ID NO: 43272

SEQ ID NO: 43731 - DNA, 601 bp, Human; identical to SEQ ID NO: 43273

SEQ ID NO: 43732 - DNA, 601 bp, Human; identical to SEQ ID NO: 43274

SEQ ID NO: 43733 - DNA, 601 bp, Human; identical to SEQ ID NO: 43275

SEQ ID NO: 43734 - DNA, 601 bp, Human; identical to SEQ ID NO: 43276

SEQ ID NO: 43735 - DNA, 601 bp, Human; identical to SEQ ID NO: 43277

SEQ ID NO: 43736 - DNA, 601 bp, Human; identical to SEQ ID NO: 43278

SEQ ID NO: 43737 - DNA, 601 bp, Human; identical to SEQ ID NO: 43279

SEQ ID NO: 43738 - DNA, 601 bp, Human; identical to SEQ ID NO: 43280

SEQ ID NO: 43739 - DNA, 601 bp, Human; identical to SEQ ID NO: 43281

SEQ ID NO: 43740 - DNA, 601 bp, Human; identical to SEQ ID NO: 43282

SEQ ID NO: 43741 - DNA, 601 bp, Human; identical to SEQ ID NO: 43283

SEQ ID NO: 43742 - DNA, 601 bp, Human; identical to SEQ ID NO: 43284

SEQ ID NO: 43743 - DNA, 601 bp, Human; identical to SEQ ID NO: 43285

SEQ ID NO: 43744 - DNA, 601 bp, Human; identical to SEQ ID NO: 43286

SEQ ID NO: 43745 - DNA, 601 bp, Human; identical to SEQ ID NO: 43287

SEQ ID NO: 43746 - DNA, 601 bp, Human; identical to SEQ ID NO: 43288

SEQ ID NO: 43747 - DNA, 601 bp, Human; identical to SEQ ID NO: 43289

SEQ ID NO: 43748 - DNA, 601 bp, Human; identical to SEQ ID NO: 43290

SEQ ID NO: 43749 - DNA, 601 bp, Human; identical to SEQ ID NO: 43291

SEQ ID NO: 43750 - DNA, 601 bp, Human; identical to SEQ ID NO: 43292

SEQ ID NO: 43751 - DNA, 601 bp, Human; identical to SEQ ID NO: 43293

SEQ ID NO: 43752 - DNA, 601 bp, Human; identical to SEQ ID NO: 43294

SEQ ID NO: 43753 - DNA, 601 bp, Human; identical to SEQ ID NO: 43295

SEQ ID NO: 43754 - DNA, 601 bp, Human; identical to SEQ ID NO: 43296

SEQ ID NO: 43755 - DNA, 601 bp, Human; identical to SEQ ID NO: 43297

SEQ ID NO: 43756 - DNA, 601 bp, Human; identical to SEQ ID NO: 43298

SEQ ID NO: 43757 - DNA, 601 bp, Human; identical to SEQ ID NO: 43299

SEQ ID NO: 43758 - DNA, 601 bp, Human; identical to SEQ ID NO: 43300

SEQ ID NO: 43759 - DNA, 601 bp, Human; identical to SEQ ID NO: 43301

SEQ ID NO: 43760 - DNA, 601 bp, Human; identical to SEQ ID NO: 43302

SEQ ID NO: 43761 - DNA, 601 bp, Human; identical to SEQ ID NO: 43303

SEQ ID NO: 43762 - DNA, 601 bp, Human; identical to SEQ ID NO: 43304

SEQ ID NO: 43763 - DNA, 601 bp, Human; identical to SEQ ID NO: 43305

SEQ ID NO: 43764 - DNA, 601 bp, Human; identical to SEQ ID NO: 43306

SEQ ID NO: 43765 - DNA, 601 bp, Human; identical to SEQ ID NO: 43307

SEQ ID NO: 43766 - DNA, 601 bp, Human; identical to SEQ ID NO: 43308

SEQ ID NO: 43767 - DNA, 601 bp, Human; identical to SEQ ID NO: 43309

SEQ ID NO: 43768 - DNA, 601 bp, Human; identical to SEQ ID NO: 43310

SEQ ID NO: 43769 - DNA, 601 bp, Human; identical to SEQ ID NO: 43311

SEQ ID NO: 43770 - DNA, 601 bp, Human; identical to SEQ ID NO: 43312

SEQ ID NO: 43771 - DNA, 601 bp, Human; identical to SEQ ID NO: 43313

SEQ ID NO: 43772 - DNA, 601 bp, Human; identical to SEQ ID NO: 43314

SEQ ID NO: 43773 - DNA, 601 bp, Human; identical to SEQ ID NO: 43315

SEQ ID NO: 43774 - DNA, 601 bp, Human; identical to SEQ ID NO: 43316

SEQ ID NO: 43775 - DNA, 601 bp, Human; identical to SEQ ID NO: 43317

SEQ ID NO: 43776 - DNA, 601 bp, Human; identical to SEQ ID NO: 43318

SEQ ID NO: 43777 - DNA, 601 bp, Human; identical to SEQ ID NO: 43319

SEQ ID NO: 43778 - DNA, 601 bp, Human; identical to SEQ ID NO: 43320

SEQ ID NO: 43779 - DNA, 601 bp, Human; identical to SEQ ID NO: 43321

SEQ ID NO: 43780 - DNA, 601 bp, Human; identical to SEQ ID NO: 43322

SEQ ID NO: 43781 - DNA, 601 bp, Human; identical to SEQ ID NO: 43323

SEQ ID NO: 43782 - DNA, 601 bp, Human; identical to SEQ ID NO: 43324

SEQ ID NO: 43783 - DNA, 601 bp, Human; identical to SEQ ID NO: 43325

SEQ ID NO: 43784 - DNA, 601 bp, Human; identical to SEQ ID NO: 43326

SEQ ID NO: 43785 - DNA, 601 bp, Human; identical to SEQ ID NO: 43327

SEQ ID NO: 43786 - DNA, 601 bp, Human; identical to SEQ ID NO: 43328

SEQ ID NO: 43787 - DNA, 601 bp, Human; identical to SEQ ID NO: 43329

SEQ ID NO: 43788 - DNA, 601 bp, Human; identical to SEQ ID NO: 43330

SEQ ID NO: 43789 - DNA, 601 bp, Human; identical to SEQ ID NO: 43331

SEQ ID NO: 43790 - DNA, 601 bp, Human; identical to SEQ ID NO: 43332

SEQ ID NO: 43791 - DNA, 601 bp, Human; identical to SEQ ID NO: 43333

SEQ ID NO: 43792 - DNA, 601 bp, Human; identical to SEQ ID NO: 43334

SEQ ID NO: 43793 - DNA, 601 bp, Human; identical to SEQ ID NO: 43335

SEQ ID NO: 43794 - DNA, 601 bp, Human; identical to SEQ ID NO: 43336

SEQ ID NO: 43795 - DNA, 601 bp, Human; identical to SEQ ID NO: 43337

SEQ ID NO: 43796 - DNA, 601 bp, Human; identical to SEQ ID NO: 43338

SEQ ID NO: 43797 - DNA, 601 bp, Human; identical to SEQ ID NO: 43339

SEQ ID NO: 43798 - DNA, 601 bp, Human; identical to SEQ ID NO: 43340

SEQ ID NO: 43799 - DNA, 601 bp, Human; identical to SEQ ID NO: 43341

SEQ ID NO: 43800 - DNA, 601 bp, Human; identical to SEQ ID NO: 43342

SEQ ID NO: 43801 - DNA, 601 bp, Human; identical to SEQ ID NO: 43343

SEQ ID NO: 43802 - DNA, 601 bp, Human; identical to SEQ ID NO: 43344

SEQ ID NO: 43803 - DNA, 601 bp, Human; identical to SEQ ID NO: 43345

SEQ ID NO: 43804 - DNA, 601 bp, Human; identical to SEQ ID NO: 43346

SEQ ID NO: 43805 - DNA, 601 bp, Human; identical to SEQ ID NO: 43347

SEQ ID NO: 43806 - DNA, 601 bp, Human; identical to SEQ ID NO: 43348

SEQ ID NO: 43807 - DNA, 601 bp, Human; identical to SEQ ID NO: 43349

SEQ ID NO: 43808 - DNA, 601 bp, Human
caataaactttcttcctgaggcttttagttaactcttgtattttagccatcatctgagcgggaagccggtatgactctgcaaggcgttcgtttaaaagttgtgctacttttgaggtgaagttaagagtgtctccatccacgccctctgcttcccagtcaatgtccctgcactgctcacgtccctttagctctctccctgcaaaccatagcggtgggtcctagacacgggacatcgctccaaccttggccaaactctcccaccctcagggttcccagatgtcctttgaataatcaaactgargaaggagaagcaagatgtctccacaccccaatccctacagccttagccaatgcatgtgtgtaactgagacagaattttagcaaaaggtctcctgcttccaggactaaacagagcctctggcaggccactgcccgacacccaactccatcctccaattttcttaaatgtccaggtaaacatctccatagtgccagcctgctatagtctcccgaagacctcagcaattcttccccaaagcgtctccttctgcaccgtttttttctttgggcaaccatttgtgacctggctattgagcccacc

SEQ ID NO: 43809 - DNA, 601 bp, Human
ctcagggttcccagatgtcctttgaataatcaaactgaagaaggagaagcaagatgtctccacaccccaatccctacagccttagccaatgcatgtgtgtaactgagacagaattttagcaaaaggtctcctgcttccaggactaaacagagcctctggcaggccactgcccgacacccaactccatcctccaattttcttaaatgtccaggtaaacatctccatagtgccagcctgctatagtctcccgaagacctcagcaattcttccccaaagcgtctccttctgcaccgtttttttytttgggcaaccatttgtgacctggctattgagcccacctgggcctcttctctttgtttgctgatagcctcgttaagtattaaaaacctactcccccccttcaggagccctcttttaatgaaagtttgggtactgggatcagatttgggacttggctacatttatttcctgtgtcattctgagaagagaaagtaatagaggcaagaaatttggcaccctattgatctattttattactttgttgagcaacttgtgcttcccgctgaagatgctgcatcccaacatgattctcttattatta

SEQ ID NO: 43810 - DNA, 601 bp, Human
tacagaggaaatactgtggatctgagtgatattaggccctgaggatacaagccaaagtataaaaatggtctttgccgtagagagatagtagtcaagctaagcacatattttggcatgggtctctaatagcctaatgctagtagggtgggaagccatttaaaaatggcccctccttctgtcctgcctttcagaccagatggtgtgtctaaagtggtcacactgtttggttctggccacttctgtaataaccactgctcctttcccctcctcgtgagattataactcctttgacagtatggayggcacctaacgcatccttgttttcttttactaaatgttccacggagtcacttgcttgcctgtttgttgcttatttgtttgtttttggctaaaactacagaaaatgttaaatacattttcagacctttatattttaaaaaagaaatgttaagaaataaataatttttctaatctcatttagatacactgtcctattacacacaatgacaaatttgatgcttttgtcttgctaattgaagagctaagcatgaatacagtttttcagtctacagcagcaatgacaagggtaaagtggagaaaa

SEQ ID NO: 43811 - DNA, 601 bp, Human
ccttcttttctccccctgtcctcattccccctgttgagacacattgtattacaaattaggaggaaaccatctaaaattatctcacgtatcccagttcccatattagcatcatgagtatcacctgagagtttgttggaactgcagaatctcagaccctgtccagacccattgattgcataagaatctgcattttagcaaaatcctcaggtgattcaaatgcacattaagggaaaagaaacacagtgtaccgtacctgtggcttgtttagaataattatgaagaggtgttttcttggctcttmactaacgtttttaataaagctaatatttattgagtacataaatgtgccaaacacaacgttcagtctttctttaaattttttttatttaatcctcacaacaaccctgtgagatagtttctgttttatccttattttatagattgggataccaagtaataatgagataagtagtttacccaaaagctgtaactgatacagtcgagatgtaaacataagaattctaatttcattgcctgttctcttagctgttacctacagtgtctgctctatactgggctacctactttttaaggccaacta

SEQ ID NO: 43812 - DNA, 601 bp, Human
tcttttctccccctgtcctcattccccctgttgagacacattgtattacaaattaggaggaaaccatctaaaattatctcacgtatcccagttcccatattagcatcatgagtatcacctgagagtttgttggaactgcagaatctcagaccctgtccagacccattgattgcataagaatctgcattttagcaaaatcctcaggtgattcaaatgcacattaagggaaaagaaacacagtgtaccgtacctgtggcttgtttagaataattatgaagaggtgttttcttggctcttaackaacgtttttaataaagctaatatttattgagtacataaatgtgccaaacacaacgttcagtctttctttaaattttttttatttaatcctcacaacaaccctgtgagatagtttctgttttatccttattttatagattgggataccaagtaataatgagataagtagtttacccaaaagctgtaactgatacagtcgagatgtaaacataagaattctaatttcattgcctgttctcttagctgttacctacagtgtctgctctatactgggctacctactttttaaggccaactaatt

SEQ ID NO: 43813 - DNA, 601 bp, Human
tcagtctttctttaaattttttttatttaatcctcacaacaaccctgtgagatagtttctgttttatccttattttatagattgggataccaagtaataatgagataagtagtttacccaaaagctgtaactgatacagtcgagatgtaaacataagaattctaatttcattgcctgttctcttagctgttacctacagtgtctgctctatactgggctacctactttttaaggccaactaattatttgaaaatttatttaaagttttaatttgagatcaaaatctgtttccctcataaattttttttaaaaaaagcaaacaagatctattccattttgatctaatgttttcctgtcaccttacctttaagtgcaataatgggaaattctagaaattccttctttaactgtttgaaaaaataccaaaactatgacagcctgtccaaatccactaaaatatatttttatatgcatgctttttgtatatcaattatacttcaataaagctttttaaaaaaatagtagatgacatacttttaaaaattaactttggagcccaggtatggtggctcagacctgtaatcccagcactttgggagga

SEQ ID NO: 43814 - DNA, 601 bp, Human
tctttaaattttttttatttaatcctcacaacaaccctgtgagatagtttctgttttatccttattttatagattgggataccaagtaataatgagataagtagtttacccaaaagctgtaactgatacagtcgagatgtaaacataagaattctaatttcattgcctgttctcttagctgttacctacagtgtctgctctatactgggctacctactttttaaggccaactaattatttgaaaatttatttaaagttttaatttgagatcaaaatctgtttccctcataaattttttttwaaaaaagcaaacaagatctattccattttgatctaatgttttcctgtcaccttacctttaagtgcaataatgggaaattctagaaattccttctttaactgtttgaaaaaataccaaaactatgacagcctgtccaaatccactaaaatatatttttatatgcatgctttttgtatatcaattatacttcaataaagctttttaaaaaaatagtagatgacatacttttaaaaattaactttggagcccaggtatggtggctcagacctgtaatcccagcactttgggaggatcacttga

SEQ ID NO: 43815 - DNA, 601 bp, Human
gtatggtggctcagacctgtaatcccagcactttgggaggatcacttgaggccaggagtttgagaccagctgaggcaacaaactgagacccccatctctacaaaaaataaaaaattgccagagcatggtggcgcacaccatgtagtagttgggacctgtagtcccaactactcaggagactgagttgggaggattgcttgagtctgggaggtgaaggctgcagtgagccatgatcacaccactgcactccagcctgagcaacagagaaagaccctgtctcgaataataataataataatamcaacttttgatatctctattttttcccataaaaatccaaaattttctgtttactttttggtgctctcatgctataaagtaaattctcccttggattggacaagttattttctgttttctacatacacatagactgttcagcattccaactcaaattacatattactttttcagcttttaatataaatgcttatttactacaagcatggtttacaaaaatgtagtaaaatatagttactaaccagtcaatgctcaagccagtgactccccaaatgattcagtccctgagctgtttcaccca

SEQ ID NO: 43816 - DNA, 601 bp, Human
tatgcatgtgtatacaagtcctagaaggagacataggtaactattagtagtacctctgggaagtaaatgcagagaaaagtaatagagggtaaggatatgtttacttttattttacatccttctgtaacttgacatttatacgacgcgttagcattacttctgggaaaaagaaaaacagaaaaggtaatcttttaaaaaggtattttttaaattatggtacaataaaatgtgcataagctttatactaagtaatagaatcatttaagtttagctgtagattcacaagtaaaaatccaatctrttttcatattcttacatttatagacatttcttacatgtctatagaaagaaatggctaggaatgagactgcactattttaccctaaaacgttctttttctctttgcctaatgtatatctacaagggcattggggaagatgttgaccacaggcaggaagatgatgagatcctgtgcccaccacttaatgcagtctagctctatataaggaaaaatatgttcttgatgtgaaccagatggtttcactcccttcaaaaacactcttaagatgcagtgtggaagcttactctgtaaattaaaaaa

SEQ ID NO: 43817 - DNA, 601 bp, Human
gactatattcagtggaatgcgttaatcatttttttctttttaggtttgatatttgacaaattgatctaaaatggctgggtttttatctgaataactcactgatgccatcccagaaagtcggcaccaggtaaatgccttacatctacagcagtgggtctgtcagcagttttctttaatgtgtcagcagtggggagagcgcaaaaacccacacacaccattatcttgtgaaagaagtagaggaagcagaaaataatgaaatcccagtgttaccacatcccctccaatatacagattaagagcrtttgtatttatatggttttaaacataaataacatcagaattactaagctatttccattcatgtactgataatgaatcatgtgagaaagtcctttggcaaggactccacatggccacaggtgattcctttgagcagtgttcttcctgtatagggcttaagaggaccagaagggaaatgattgtactctcttgtcagctacttcctgggcgatttgggttctttgataccccagtgctcactttcggaagtgttaagaccataaaccttaacagttgaccttctcaccttcagaaaacccaa

SEQ ID NO: 43818 - DNA, 601 bp, Human
catgccagacactattctcagcattgagcacaaagtcgtgagcaaggtagacaaaaatgcttggcctcataaaacttacattccagtgcataaagatgagaacaatcacgtaaaatttataatatgttggatggcatggaaaatggaaataaagtggaagggaggcttcaggttaaaaagagtgtttagggaaggtcttcttaggaagaaggaggaagctatgtggacatctgggagaagatcgctccaggcagagggtagagcaaatgcaaattccttgaggcagcaatgtgctggcatrgtcaaggcacagcgagtatgccagggtcttcagaaaccacagagaagagtggataacaaaagtgaaatcaagtattgaagagtatgaactgacaggaactagagacatatttagaatggatgccagaacaggagaaatgggtgggattttaaaagctaaatgatttaaagacttaaaatgctctgaagtgtagtgaaatgttccccaaactgcagattttcccaggaaaccaggtgcataatttagtcatcgatgactggttctgtggcaatgactctagtaattagacccctgcatttt

SEQ ID NO: 43819 - DNA, 601 bp, Human
gttggatggcatggaaaatggaaataaagtggaagggaggcttcaggttaaaaagagtgtttagggaaggtcttcttaggaagaaggaggaagctatgtggacatctgggagaagatcgctccaggcagagggtagagcaaatgcaaattccttgaggcagcaatgtgctggcatggtcaaggcacagcgagtatgccagggtcttcagaaaccacagagaagagtggataacaaaagtgaaatcaagtattgaagagtatgaactgacaggaactagagacatatttagaatggatgccrgaacaggagaaatgggtgggattttaaaagctaaatgatttaaagacttaaaatgctctgaagtgtagtgaaatgttccccaaactgcagattttcccaggaaaccaggtgcataatttagtcatcgatgactggttctgtggcaatgactctagtaattagacccctgcattttatgtcagttccttctggatactcagctacattatttggtgcttttggtatacttcaaatatgcattgcctatcactgacctgtaatcctgtgtctctgggcctgaaaatataacttttcatgtag

SEQ ID NO: 43820 - DNA, 601 bp, Human
gacatctgggagaagatcgctccaggcagagggtagagcaaatgcaaattccttgaggcagcaatgtgctggcatggtcaaggcacagcgagtatgccagggtcttcagaaaccacagagaagagtggataacaaaagtgaaatcaagtattgaagagtatgaactgacaggaactagagacatatttagaatggatgccagaacaggagaaatgggtgggattttaaaagctaaatgatttaaagacttaaaatgctctgaagtgtagtgaaatgttccccaaactgcagattttcccargaaaccaggtgcataatttagtcatcgatgactggttctgtggcaatgactctagtaattagacccctgcattttatgtcagttccttctggatactcagctacattatttggtgcttttggtatacttcaaatatgcattgcctatcactgacctgtaatcctgtgtctctgggcctgaaaatataacttttcatgtagtagagaattagggctgtgcaacattgccactagattatttttaatgaaagctttgcccttttagataaatacagcaatgtattcaaacaagtcctaggga

SEQ ID NO: 43821 - DNA, 601 bp, Human
tcagaaaccacagagaagagtggataacaaaagtgaaatcaagtattgaagagtatgaactgacaggaactagagacatatttagaatggatgccagaacaggagaaatgggtgggattttaaaagctaaatgatttaaagacttaaaatgctctgaagtgtagtgaaatgttccccaaactgcagattttcccaggaaaccaggtgcataatttagtcatcgatgactggttctgtggcaatgactctagtaattagacccctgcattttatgtcagttccttctggatactcagctacmttatttggtgcttttggtatacttcaaatatgcattgcctatcactgacctgtaatcctgtgtctctgggcctgaaaatataacttttcatgtagtagagaattagggctgtgcaacattgccactagattatttttaatgaaagctttgcccttttagataaatacagcaatgtattcaaacaagtcctagggataccactgagtgcaaaatgtcatgtactagttattccatttaaattattttatcttcaagtctaataagaaaattctaaataaaattatatatttgggattgtgt

SEQ ID NO: 43822 - DNA, 601 bp, Human
agtggataacaaaagtgaaatcaagtattgaagagtatgaactgacaggaactagagacatatttagaatggatgccagaacaggagaaatgggtgggattttaaaagctaaatgatttaaagacttaaaatgctctgaagtgtagtgaaatgttccccaaactgcagattttcccaggaaaccaggtgcataatttagtcatcgatgactggttctgtggcaatgactctagtaattagacccctgcattttatgtcagttccttctggatactcagctacattatttggtgcttttggyatacttcaaatatgcattgcctatcactgacctgtaatcctgtgtctctgggcctgaaaatataacttttcatgtagtagagaattagggctgtgcaacattgccactagattatttttaatgaaagctttgcccttttagataaatacagcaatgtattcaaacaagtcctagggataccactgagtgcaaaatgtcatgtactagttattccatttaaattattttatcttcaagtctaataagaaaattctaaataaaattatatatttgggattgtgtgtgtatcatccatccaca

SEQ ID NO: 43823 - DNA, 601 bp, Human
gtgtagtgaaatgttccccaaactgcagattttcccaggaaaccaggtgcataatttagtcatcgatgactggttctgtggcaatgactctagtaattagacccctgcattttatgtcagttccttctggatactcagctacattatttggtgcttttggtatacttcaaatatgcattgcctatcactgacctgtaatcctgtgtctctgggcctgaaaatataacttttcatgtagtagagaattagggctgtgcaacattgccactagattatttttaatgaaagctttgcccttttrgataaatacagcaatgtattcaaacaagtcctagggataccactgagtgcaaaatgtcatgtactagttattccatttaaattattttatcttcaagtctaataagaaaattctaaataaaattatatatttgggattgtgtgtgtatcatccatccacatgtaagtaggaataaaattatttaatggaaaatttcaaataggctaactctaaaaatgtacagataatctggatgagagaaaactatcctcactttgtgttatttttcaatggtagcattttctcataatccccatgctt

SEQ ID NO: 43824 - DNA, 601 bp, Human
atgtagtagagaattagggctgtgcaacattgccactagattatttttaatgaaagctttgcccttttagataaatacagcaatgtattcaaacaagtcctagggataccactgagtgcaaaatgtcatgtactagttattccatttaaattattttatcttcaagtctaataagaaaattctaaataaaattatatatttgggattgtgtgtgtatcatccatccacatgtaagtaggaataaaattatttaatggaaaatttcaaataggctaactctaaaaatgtacagataatctgratgagagaaaactatcctcactttgtgttatttttcaatggtagcattttctcataatccccatgcttttttcatgtcctgctattctttaagatttcctaatgaggattagggaataggcatatttaacaatctgtgttcgcaggttgaaaacaagaaaatgaagactaatagtttctctcctgttaatttgattttctacagctcctctcctaccagcttaggcagaggacttagttactatttccaatagatgggagccaaggaaaagacaagcatctgtgatgtcatgtctccccc

SEQ ID NO: 43825 - DNA, 601 bp, Human
ttaagatttcctaatgaggattagggaataggcatatttaacaatctgtgttcgcaggttgaaaacaagaaaatgaagactaatagtttctctcctgttaatttgattttctacagctcctctcctaccagcttaggcagaggacttagttactatttccaatagatgggagccaaggaaaagacaagcatctgtgatgtcatgtctcccccaaacgggtagctgcctcaccagcctccattagagacatcccccagagtaagaaataagaaataatcatgagtagaatgagaaaaaaatrcagcttcctttatctgagaaaaacaatagtagctcaatgctgtggcctaaagggctttgaaaataatgcaatttctgataaaaataaatgccattattcttgcttattgtcactgttttagtcaaataagattttagcaagcatatttcaaattgttctaaatctaagtaaattggtaattaaatgctatcattagaaagtattttaatatcagaaaaattggaccataagaaagttagtttacccttgtattcatatatacatgtgctttgtgctaaaaattgttatcatttagtgaga

SEQ ID NO: 43826 - DNA, 601 bp, Human
attcctaattaaaaaaaataagctagttcatcacaacttccttcaaatccttctgccactgatttctctcctgaaaagagatattatacggcattttagagaaaacaaacatctctaagtcacaaggagtggaataatcaaagttgcattttaagcaagattatggttttttctttgagttctctgaatttgaatagtttcttaaccttagttttttaactgctctgaaaatggtttctgtccctggtggactcttgtttcaatgcagttattttgtctggtagagtcacagagttaagcygtcattcagatcagaaaaaataaaagagagagatgaattaatctcaatggcacagtctccttattcaaaaaataaaaataaaaataaatctcaagtccaacaatgaatcatctttgagactctcccaagtgatctagttttaagggcaaaaactttggggaaactgttgggggagcaactggtgcccagtactgtttcacacacgtggtttttcttatctattgctcacacacttagacataactggaattattgcctttgtattgttgttgccattttataaaggaagacaaaaaagat

SEQ ID NO: 43827 - DNA, 601 bp, Human
agctgtcattcagatcagaaaaaataaaagagagagatgaattaatctcaatggcacagtctccttattcaaaaaataaaaataaaaataaatctcaagtccaacaatgaatcatctttgagactctcccaagtgatctagttttaagggcaaaaactttggggaaactgttgggggagcaactggtgcccagtactgtttcacacacgtggtttttcttatctattgctcacacacttagacataactggaattattgcctttgtattgttgttgccattttataaaggaagacaaaaargatcagacaaaataatagtgaacatctattaattggacacttactggtgtcaggcactgtgtcatgcactgtgtcaggcactgtattttcttatttaatccaacaaaaaaaaataggctaaattatcttattggctcaattttctttacagaaactgagcctaaatttcccaaatggctaaccaatgccagggccagcaactcaaatttgggagtaattccgacacctaggttccaaccatttttctcccagaaataacccaccaaattcaccagagtctaagatcttactgttactgtt

SEQ ID NO: 43828 - DNA, 601 bp, Human
agatattttaatgtctcatttcagtgaggaaaattgttaattcatatgccaccagccatcggcagaaatgtaacaggaaatgaagaaaaacttaattactttaaatacagtggtctgtagtacaaattattgtgccgtgaattagtttccttctgctgtagaattgatcattttgattatgtagccaagcagtgtaagacattactaaaattattcttgaatcctacctttgagatctatataaaacactaggcaatttgcctgcaaatacatagaaaacaatttttaaaaggattgggaygagttattttcccctctgttaaatattagcctttgaaatgaacccagctgatctgccaaataacacttggaaattgttgtgttttaataaagtgacagactgagagggaagccacactagacgtccttatgcttttagaggccttacagggcaggaacattatgcaataatgccttttaaaagaagtgagcttcctagtattacaccttgcctggcaacaaatgtagccacttactgaaatgcaggcgtaattagaatctatgaaaatctagcatcagaatcccaaacctctatgcaata

SEQ ID NO: 43829 - DNA, 601 bp, Human
gaatctatgaaaatctagcatcagaatcccaaacctctatgcaatactcagtaaattacagcttttatgtctgtaatattttcaaccattctacttaaatatgtgaatacatgagtgtggagttctttaggaggcctgctgcatatgctagggaaaggtttcatcatttctaatcaggatggctctgtaaatgggatgcctcatgttcaggtttctggaaggctcagagcctgggcttctactggcagagggtagacccaaatggactactctagtgaaaatctccaggtgaacatggaaygcagtgaaaacctggggtatccaacttgcagtataggccaccagcaagtgtcacctctattataactttaaccaggcaagctcagtctcatgcattagtttataaaattgcaacagagccttctaagactgaaaggacattagtttttaaacctatatattatgacctaattaaatgaaattttattttaaagccctcataaaagtagtaaaattggtgttttaaataaaccaaatgggaattcaaccactttaatttttcttttgttccaataggaaaataaatgctttaaaatttgaa

SEQ ID NO: 43830 - DNA, 601 bp, Human
caaatggaagggctcctattcggttttctccttcatttcttaaagtgttgtgatttttttattccctggtgttatgtcttgagattttaaatcttaaaacatgcaattaggtattgaagttgaaagctggaagtctcagccagctagtaatggttttttaaaataggtaatacagacctctagtggttgaacagtttgaaagcctctgcaagaaaaggaaattgcgcagaaagtgcctgcattttaaggggaaaagttagttaaaattattcagatgataaaattcacatatttcataggaaaaaaaaagccagaatgggcttcaagggaaggtggcacacttcccatccttttagatgttcctcaattcctctaaataagcaaaaactctctggccaaagtcacagtaagaagtctggatctgtattatttttctctaaaagatcttgtgaacagagctgctagatctctgtattatatgaaacatatatttttgtacacagttttgcctcactggggctttgcttcctttgtactccagaggctccccatgaaaacaatctgcagccacctcaacttgcctgtgctgttctcaggttct

SEQ ID NO: 43831 - DNA, 601 bp, Human
attcagtgtcatctctttatcttgaaaagttcatggtagttgtgagcatctctctaaccacttgaagctattgggttagaggtagctacaattaaatatctgattagccatattgggagagtgggtgaaaacaggttttgtgcatgtggtagatgtgtaggaagctaaggacccaaaaaacaaccacatcataaaatcaagcagaaacacacacacaccacacacacacacagaggctcaaagcataagtgtcaacagatcagaagaaaacatgggagaatgtattttttcataccaaatcattaaaattccatcatctaaataacttcctatcatagcatgttgtcgacctcatttttcaaatccataattttagaacttatgtcgtggggtagtctaaaagcctcttgcaaacttttaacatctagtttcaaatcaaaaataatatattaacaagctgtagcatagagggagtacataaattatcatcattgccctgcatgaatagtaattcacaggtttggctcacacacaacttagatgaaataattaactatgtacagtacttaacagtataaaagtaattaatctagctgcctcg

SEQ ID NO: 43832 - DNA, 601 bp, Human
tctaaccacttgaagctattgggttagaggtagctacaattaaatatctgattagccatattgggagagtgggtgaaaacaggttttgtgcatgtggtagatgtgtaggaagctaaggacccaaaaaacaaccacatcataaaatcaagcagaaacacacacacaccacacacacacacagaggctcaaagcataagtgtcaacagatcagaagaaaacatgggagaatgtattttttcataccaaattattaaaattccatcatctaaataacttcctatcatagcatgttgtcgacctyatttttcaaatccataattttagaacttatgtcgtggggtagtctaaaagcctcttgcaaacttttaacatctagtttcaaatcaaaaataatatattaacaagctgtagcatagagggagtacataaattatcatcattgccctgcatgaatagtaattcacaggtttggctcacacacaacttagatgaaataattaactatgtacagtacttaacagtataaaagtaattaatctagctgcctcgtaccggtttggcctaaataaacatgcaataaaaaagccataggattttatta

SEQ ID NO: 43833 - DNA, 601 bp, Human
gttttcaagagagtggacatcagataacaaagggcagtgatccctggaggataggaaacaaatgacctgggattgtcccagcccactgcctggagggagtttgcaggcatgatacagggatggtacacccaggcagaactcgaggtcctctctgagttaaggacacagagctgggagtccagagaggccaaggaggctagagttcagagtaccagagagttgagagctgcacagagaacccagagatctgcaaatggtaccccttgtgcttcagtgcatgtgggcaaataatcacccaaaygtattagagagaacaagccccagaggtcatcaagagctagaaaatagttgctatttccaccagccacagtggaaagtctcataattcatggagcatcaggtagcatactcagtaggttcttgcctcaggaatgggaaaaatttagccctagactaattgctgctctggtaccacctaagaaaccgtaaaagtcagactcaaaagaattaaattatttgcaagtaactcaactgcttttcagaaaacaactggagaaattttgtaggaatacaaaagcatccaatatccaacaaagtaaaa

SEQ ID NO: 43834 - DNA, 601 bp, Human
ggccaaggaggctagagttcagagtaccagagagttgagagctgcacagagaacccagagatctgcaaatggtaccccttgtgcttcagtgcatgtgggcaaataatcacccaaacgtattagagagaacaagccccagaggtcatcaagagctagaaaatagttgctatttccaccagccacagtggaaagtctcataattcatggagcatcaggtagcatactcagtaggttcttgcctcaggaatgggaaaaatttagccctagactaattgctgctctggtaccacctaagaaaccrtaaaagtcagactcaaaagaattaaattatttgcaagtaactcaactgcttttcagaaaacaactggagaaattttgtaggaatacaaaagcatccaatatccaacaaagtaaaattcacaatgtttagcatccattataaaatcaccaggcatgcgaagaagctggaaagtacaacccataaaaagaaaaaaatgaatagaaacagacccagtcagtaatgacacagatgataggattattacactattacattaaatggttattatgactatttcatatgttcaaaatgcttgatgga

SEQ ID NO: 43835 - DNA, 601 bp, Human
tctcttgaaaccctaatgatgaatctgagctcaaattccctcttcagccttatctgtgcagaatcctgaagttatgaaaaatgcttacagaaggtaatttctagaatgatctaacacagcagatatttagtaaactccctgtttgagagctcctactaagcacccaacacagctttagactttggtcacccaataggattttatcttttgtgagggatctgtagttttccccggaagatataatgcatgaaataaaagcctccaataaaattcagtatacagttaatttatttcataaaargtgagagatataaattatcaaaggttaaaacaaaaagtaggaaccagagcagggtttttcagtagcaactctattgacattttggattagataattttttggtgtgggagactgtcccacgcattgtaaaatggttagcagtatcacttgtctgcctgctagatgctagtaataccccccacacctccctctcccacattgggaaaatcaaaaatgtctcgagacattgccaaatatccctggagtacaaaatcagtctaattgagaggcactagactggagtataaagagatgaccatg

SEQ ID NO: 43836 - DNA, 601 bp, Human
ttggcacatagtaagcatccaatgaataataagtgatcagtgttactattgctaatattaagccactattataagtcctttctgttaatcagcagaaacaaaaagaagtataaaataatggtacattaaatgaacttaaacacttgtatgtcattttgtgctaaagttatgaagctgaaaagattgaattgacattttccccattgatagaaatcatctcaaaaatgctccatcttccttgtgaaagccaaaggccagcagtttccacatacccagcatctgataagtagttaatgatccwgaaataaactgttaggtgcttcagggaatttctgtgtatagagaagttccatgtaaatatttctccgagaggtggatggagaatgataattcacttttaccctctgaatttgatttataagcttcacctatctggcaggagataagaaccaaagttaactgaggagaaaaaaaataaatgatttcaagtgaccatgatcttcagctggaaccagttgaaactgcaaagcaactgggctgaagaagttcagccaaaattatttgtttataaaaactagagagtgttagatatttctatcac

SEQ ID NO: 43837 - DNA, 601 bp, Human
tttaattagaaaacgcaagtagcctaacatagaaaagaaatggagtggtagataatagtagatagaatggtctaaatatttttattacagtgatgtaatatcactgtaatttatgtttaaaaattatgtaatactcaaaaggaattctcagagctggcgaaacagtctggtccaagcagcctctcagcagtgcctttcagcctcccctctctgagtctttccaccccttgctggtactttagtttcttccacttctagcaccacgtgtagtttcccaatttctcttacccaaatttgctcrcagggaaaaaaataaattaaattagccatttacaccacagtgtgaacttaataacaccaacaaaagttccaaagctctagggtctcatagcacctccagatccatgatctcattcggtgtttccaacaatgttttgcaccaaactggacacatgcttgctacttcatcatcctcatcgtgaacattattattattatcatcattttccagatgaagaaaatgaatcacaagtcaactgacagtccaaaggctccacagctcagaggaggtaaatcatgtgcttaattcagaacttttggc

SEQ ID NO: 43838 - DNA, 601 bp, Human
gtagtttcccaatttctcttacccaaatttgctcgcagggaaaaaaataaattaaattagccatttacaccacagtgtgaacttaataacaccaacaaaagttccaaagctctagggtctcatagcacctccagatccatgatctcattcggtgtttccaacaatgttttgcaccaaactggacacatgcttgctacttcatcatcctcatcgtgaacattattattattatcatcattttccagatgaagaaaatgaatcacaagtcaactgacagtccaaaggctccacagctcagagraggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtaagtttctcatattcagtttttga

SEQ ID NO: 43839 - DNA, 601 bp, Human
tcattttacttacccttgtattatagaacaattatatttttaaaaatgcttttatgtcttccaaagaactttttatttttagcagtccatgaaatagaggtgagaacaggtgttggtattctcattctaaatatcttgtaatatttaaaggaaaccaaagtgaaagattaaattgccatgtaagattgtgttgccggttactggcagagcagactctttgccaggacagcagtccagtgctttctcttccaggctgttctgctcttcctcaatttttacagcatttttatgttaatcaatmaataaataaaaagtaaagaactataatgcatacaaaactgtgatggaagaaaaggaaactatgtgataaaatcaaataaatatgacccttatagctttagttttcttagaacagaggccctttaacttcagaatgttgaaaccttctcttgaagttctcttataatactctgccctcacctctgtgtttttatctgggcaattagaccacattaactaattgctaaactttaaaaagttgtattttcttacaaagaatctgagaatagggttgattttctatgttattttaacagtatca

SEQ ID NO: 43840 - DNA, 601 bp, Human
ccatgaaatagaggtgagaacaggtgttggtattctcattctaaatatcttgtaatatttaaaggaaaccaaagtgaaagattaaattgccatgtaagattgtgttgccggttactggcagagcagactctttgccaggacagcagtccagtgctttctcttccaggctgttctgctcttcctcaatttttacagcatttttatgttaatcaatcaataaataaaaagtaaagaactataatgcatacaaaactgtgatggaagaaaaggaaactatgtgataaaatcaaataaatatgamccttatagctttagttttcttagaacagaggccctttaacttcagaatgttgaaaccttctcttgaagttctcttataatactctgccctcacctctgtgtttttatctgggcaattagaccacattaactaattgctaaactttaaaaagttgtattttcttacaaagaatctgagaatagggttgattttctatgttattttaacagtatcacattgcgcccccctcttcacaggaccatgtaatcttgactctctaacttcatggcaagcttttaattttgattttcaaccatgttc

SEQ ID NO: 43841 - DNA, 601 bp, Human
cttagaacagaggccctttaacttcagaatgttgaaaccttctcttgaagttctcttataatactctgccctcacctctgtgtttttatctgggcaattagaccacattaactaattgctaaactttaaaaagttgtattttcttacaaagaatctgagaatagggttgattttctatgttattttaacagtatcacattgcgcccccctcttcacaggaccatgtaatcttgactctctaacttcatggcaagcttttaattttgattttcaaccatgttccaaactgtactctttgacytggtagtgtcaataaataacgtaagggatgtctgacaggcttacagcctttggccataaatggaatgaaacaaagtagtccagatagggctcaaactcataacattgacctcgttagtctagaaccacaaccagctatccaaatgtgcctgggaaatatttctttgagtaatagttaattttttaaaagaaagaaaaaaacctgtgactatgataatcttatgttgagtttctttattcatcttgagtaaacagtaaatttttttcactttgttgtttcaatacaaagagttcttgtgtt

SEQ ID NO: 43842 - DNA, 601 bp, Human
catgtcgaaggaagatgtttaaagcatgtgaattagacttgatcatatatgtttcattggcacctgtttctctactttttggaataaaataaaaacgacaaaaacagctaagaattttggatagtgatgtgggtgggagggattggggcattcatcacaactgagttgtttaatttatagtaagtgggaacttttagagttgagagaagtttaattgtagtttagagtttcattattagacagtagtcttaaacaattcccaagaagctaaaatgtgggattaacattttactttcattgkaattcatatcctaaatataaatgttaatataaattataaagtttctgaatttcctttcataaaactgggttctttgggttcttagttattttggatgaaacaaggggagggctagttggaaatgatggaacatttaaccactgtcaccacagttagtcacaattggtacatgcagaattaataaagcagcttgccttgtttttatttcttgtgaggtcagatgacagtggatgatattgacttgggaagatggccagaagccactatttaccatgtacatatatcagagagccatttatt

SEQ ID NO: 43843 - DNA, 601 bp, Human
acctcagtagagatgaaatggacgaagcaggcatggaaactgcccttcctgccttaaatacagaatgccagatcacagctctgaataaaagttaagaccacattgggccagatcaggactaacactagatacacagctgagataaagttccagtgactttggcagtgtgaaagtcaggaccagtaggcacatatactgaaggcaatttaagctgtgtttcctgattaaagccagggactgaaaaatcactacctattcatgatgaaagactagaaaacttctgaagaccagacagagtttsagagtggtatagttactaatctactaaatactgcaaatatatagtatctgcaaatatatatataaggttgaaaactaagctcagaaatgagcattaaaaacttttccagatcaagggagtgctgtacccccaagctgaggtttcataggctaccatcatccaggcactcagtcttcccaagcaagttaattcccaccaaaaatgaacacagtcaaagattacaaaacctaagcagaagtccattatcaagaaacagtgtccacaagtgcaataaatataatttatacctgaggaactata

SEQ ID NO: 43844 - DNA, 601 bp, Human
cattgggccagatcaggactaacactagatacacagctgagataaagttccagtgactttggcagtgtgaaagtcaggaccagtaggcacatatactgaaggcaatttaagctgtgtttcctgattaaagccagggactgaaaaatcactacctattcatgatgaaagactagaaaacttctgaagaccagacagagtttcagagtggtatagttactaatctactaaatactgcaaatatatagtatctgcaaatatatatataaggttgaaaactaagctcagaaatgagcattaaaarcttttccagatcaagggagtgctgtacccccaagctgaggtttcataggctaccatcatccaggcactcagtcttcccaagcaagttaattcccaccaaaaatgaacacagtcaaagattacaaaacctaagcagaagtccattatcaagaaacagtgtccacaagtgcaataaatataatttatacctgaggaactataaatagtaaagcaattgggtaggggctcttaacagacagatattcaaaatgttaaggaaaataaaagaagaagtagacttcgtaaaataggaacagagggc

SEQ ID NO: 43845 - DNA, 601 bp, Human
aggaaactatggggaatttttttttctttagattgcaaactagttttaaaaagagcttgtaatgaacaatttaattagattggttttggcttgcctaaaagcttaagaaggtattaatattctaatcaaaagtcttgggaaagcattcttagaataaaaaaaggaaagaaaatcttcattcttatgctttaagaaccaggaaagctgtcaaaggatataaggtaactcttacaaaagcaattgtaaaataaacgtggtttggccacaatgagccaacacctatgtttgccacagacttagrttcccacctcactcatggcaaatttattcagctgcttaagattattttttactcatacttcgaaagaacaacagcctggaatttttagacttttaatggcaatggaaggaacttacctatgataaacatttttctttactctcacgctttcttaacccatggctgttctgagtcaatgtttgccttgcattcaaaaaataatagtaaagattcaagtaaaacatattcattaagcactatttgaaagatataccaagtgctttaacattatctcactttattcctacaaagatcatgtgc

SEQ ID NO: 43846 - DNA, 601 bp, Human
gacttttaatggcaatggaaggaacttacctatgataaacatttttctttactctcacgctttcttaacccatggctgttctgagtcaatgtttgccttgcattcaaaaaataatagtaaagattcaagtaaaacatattcattaagcactatttgaaagatataccaagtgctttaacattatctcactttattcctacaaagatcatgtgcaataaatatcactgttcatgtttcctacagatgaaaaaaaactgagggtcatgttcagagaaattggatgacttacccagagccacayagatttgtacgtggcaaaggaggattccatttcaagtctttcaaccccaaattcatcttcctttctctaaggggaaatggtgctatggaattcatgtaagccacagagcttggataaaaggaatagtaagaccaaaaataggaaaagtaggaagaggtggatcctcctatgtttttaatcagggttctatctacctgtaactcttctgggaaaagaagcaggatgtgactgaaacatagctgctttctagatctcacaaatctggcttttctagtcaatcacatctctctctccttcggc

SEQ ID NO: 43847 - DNA, 601 bp, Human
tgttctgagtcaatgtttgccttgcattcaaaaaataatagtaaagattcaagtaaaacatattcattaagcactatttgaaagatataccaagtgctttaacattatctcactttattcctacaaagatcatgtgcaataaatatcactgttcatgtttcctacagatgaaaaaaaactgagggtcatgttcagagaaattggatgacttacccagagccacacagatttgtacgtggcaaaggaggattccatttcaagtctttcaaccccaaattcatcttcctttctctaaggggamatggtgctatggaattcatgtaagccacagagcttggataaaaggaatagtaagaccaaaaataggaaaagtaggaagaggtggatcctcctatgtttttaatcagggttctatctacctgtaactcttctgggaaaagaagcaggatgtgactgaaacatagctgctttctagatctcacaaatctggcttttctagtcaatcacatctctctctccttcggcttctcaccaaaccagcatccgttcagcttcaaagaaaaaagagccctactgtttcccactcatttatcatcaatct

SEQ ID NO: 43848 - DNA, 601 bp, Human
tacaaagatcatgtgcaataaatatcactgttcatgtttcctacagatgaaaaaaaactgagggtcatgttcagagaaattggatgacttacccagagccacacagatttgtacgtggcaaaggaggattccatttcaagtctttcaaccccaaattcatcttcctttctctaaggggaaatggtgctatggaattcatgtaagccacagagcttggataaaaggaatagtaagaccaaaaataggaaaagtaggaagaggtggatcctcctatgtttttaatcagggttctatctacctrtaactcttctgggaaaagaagcaggatgtgactgaaacatagctgctttctagatctcacaaatctggcttttctagtcaatcacatctctctctccttcggcttctcaccaaaccagcatccgttcagcttcaaagaaaaaagagccctactgtttcccactcatttatcatcaatctaaagtaactgccaatcacaaaagtcccatctttatttctttccttagaaacaaatttctctagggaagcttatcagtagcagaagtgcagactgggaaatggcctatgtcaccctcccatc

SEQ ID NO: 43849 - DNA, 601 bp, Human
tcaaccccaaattcatcttcctttctctaaggggaaatggtgctatggaattcatgtaagccacagagcttggataaaaggaatagtaagaccaaaaataggaaaagtaggaagaggtggatcctcctatgtttttaatcagggttctatctacctgtaactcttctgggaaaagaagcaggatgtgactgaaacatagctgctttctagatctcacaaatctggcttttctagtcaatcacatctctctctccttcggcttctcaccaaaccagcatccgttcagcttcaaagaaaaaasagccctactgtttcccactcatttatcatcaatctaaagtaactgccaatcacaaaagtcccatctttatttctttccttagaaacaaatttctctagggaagcttatcagtagcagaagtgcagactgggaaatggcctatgtcaccctcccatctagaaatgcccagtgcacatccagatcccacacccccaagagcgttgtgcaatatctgttaatttatgagagctgtttcccatagatgatgctgcaggcattagtaaggagggcaaagttcaagtgatgacaccatctctactc

SEQ ID NO: 43850 - DNA, 601 bp, Human
tgctttctagatctcacaaatctggcttttctagtcaatcacatctctctctccttcggcttctcaccaaaccagcatccgttcagcttcaaagaaaaaagagccctactgtttcccactcatttatcatcaatctaaagtaactgccaatcacaaaagtcccatctttatttctttccttagaaacaaatttctctagggaagcttatcagtagcagaagtgcagactgggaaatggcctatgtcaccctcccatctagaaatgcccagtgcacatccagatcccacacccccaagagckttgtgcaatatctgttaatttatgagagctgtttcccatagatgatgctgcaggcattagtaaggagggcaaagttcaagtgatgacaccatctctactccacctggctggtttccaggtgccatctcctgatccctctccccacccccactgccctctcaccatccttcccccaaaccccacactccccaccaatctgggtcagtgataaacacagagtattccacatgcctctgatatgatgtaacattcgacacactaaagataatactgcctttaaggctcctgtccccctggcta

SEQ ID NO: 43851 - DNA, 601 bp, Human
gtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcmttagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgaga

SEQ ID NO: 43852 - DNA, 601 bp, Human
atatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatrtatatgtatatctatatctctaaactgctgttaattgattaaaatctggcaaagttatatttactttaaaataaaataattttattgcaatgtatttatcttcattacttaaaatagatgctaatttattttaaaataagactaccttgaatgagtatgaatatatttttatttaaattttgatacaactgatagtttaatactattggttatagattttttatcctgacattgaaaagttaaagaaaaaacattttgttctactgcatgtcatggaataaacacatcgttttgaatttt

SEQ ID NO: 43853 - DNA, 601 bp, Human; identical to SEQ ID NO: 43808

SEQ ID NO: 43854 - DNA, 601 bp, Human; identical to SEQ ID NO: 43809

SEQ ID NO: 43855 - DNA, 601 bp, Human; identical to SEQ ID NO: 43810

SEQ ID NO: 43856 - DNA, 601 bp, Human; identical to SEQ ID NO: 43811

SEQ ID NO: 43857 - DNA, 601 bp, Human; identical to SEQ ID NO: 43812

SEQ ID NO: 43858 - DNA, 601 bp, Human; identical to SEQ ID NO: 43813

SEQ ID NO: 43859 - DNA, 601 bp, Human; identical to SEQ ID NO: 43814

SEQ ID NO: 43860 - DNA, 601 bp, Human; identical to SEQ ID NO: 43815

SEQ ID NO: 43861 - DNA, 601 bp, Human; identical to SEQ ID NO: 43816

SEQ ID NO: 43862 - DNA, 601 bp, Human; identical to SEQ ID NO: 43817

SEQ ID NO: 43863 - DNA, 601 bp, Human; identical to SEQ ID NO: 43818

SEQ ID NO: 43864 - DNA, 601 bp, Human; identical to SEQ ID NO: 43819

SEQ ID NO: 43865 - DNA, 601 bp, Human; identical to SEQ ID NO: 43820

SEQ ID NO: 43866 - DNA, 601 bp, Human; identical to SEQ ID NO: 43821

SEQ ID NO: 43867 - DNA, 601 bp, Human; identical to SEQ ID NO: 43822

SEQ ID NO: 43868 - DNA, 601 bp, Human; identical to SEQ ID NO: 43823

SEQ ID NO: 43869 - DNA, 601 bp, Human; identical to SEQ ID NO: 43824

SEQ ID NO: 43870 - DNA, 601 bp, Human; identical to SEQ ID NO: 43825

SEQ ID NO: 43871 - DNA, 601 bp, Human; identical to SEQ ID NO: 43826

SEQ ID NO: 43872 - DNA, 601 bp, Human; identical to SEQ ID NO: 43827

SEQ ID NO: 43873 - DNA, 601 bp, Human; identical to SEQ ID NO: 43828

SEQ ID NO: 43874 - DNA, 601 bp, Human; identical to SEQ ID NO: 43829

SEQ ID NO: 43875 - DNA, 601 bp, Human; identical to SEQ ID NO: 43830

SEQ ID NO: 43876 - DNA, 601 bp, Human; identical to SEQ ID NO: 43831

SEQ ID NO: 43877 - DNA, 601 bp, Human; identical to SEQ ID NO: 43832

SEQ ID NO: 43878 - DNA, 601 bp, Human; identical to SEQ ID NO: 43833

SEQ ID NO: 43879 - DNA, 601 bp, Human; identical to SEQ ID NO: 43834

SEQ ID NO: 43880 - DNA, 601 bp, Human; identical to SEQ ID NO: 43835

SEQ ID NO: 43881 - DNA, 601 bp, Human; identical to SEQ ID NO: 43836

SEQ ID NO: 43882 - DNA, 601 bp, Human; identical to SEQ ID NO: 43837

SEQ ID NO: 43883 - DNA, 601 bp, Human; identical to SEQ ID NO: 43838

SEQ ID NO: 43884 - DNA, 601 bp, Human; identical to SEQ ID NO: 43839

SEQ ID NO: 43885 - DNA, 601 bp, Human; identical to SEQ ID NO: 43840

SEQ ID NO: 43886 - DNA, 601 bp, Human; identical to SEQ ID NO: 43841

SEQ ID NO: 43887 - DNA, 601 bp, Human; identical to SEQ ID NO: 43842

SEQ ID NO: 43888 - DNA, 601 bp, Human; identical to SEQ ID NO: 43843

SEQ ID NO: 43889 - DNA, 601 bp, Human; identical to SEQ ID NO: 43844

SEQ ID NO: 43890 - DNA, 601 bp, Human; identical to SEQ ID NO: 43845

SEQ ID NO: 43891 - DNA, 601 bp, Human; identical to SEQ ID NO: 43846

SEQ ID NO: 43892 - DNA, 601 bp, Human; identical to SEQ ID NO: 43847

SEQ ID NO: 43893 - DNA, 601 bp, Human; identical to SEQ ID NO: 43848

SEQ ID NO: 43894 - DNA, 601 bp, Human; identical to SEQ ID NO: 43849

SEQ ID NO: 43895 - DNA, 601 bp, Human; identical to SEQ ID NO: 43850

SEQ ID NO: 43896 - DNA, 601 bp, Human; identical to SEQ ID NO: 43851

SEQ ID NO: 43897 - DNA, 601 bp, Human; identical to SEQ ID NO: 43852

SEQ ID NO: 43898 - DNA, 601 bp, Human; identical to SEQ ID NO: 35317

SEQ ID NO: 43899 - DNA, 601 bp, Human; identical to SEQ ID NO: 35316

SEQ ID NO: 43900 - DNA, 601 bp, Human; identical to SEQ ID NO: 35315

SEQ ID NO: 43901 - DNA, 601 bp, Human; identical to SEQ ID NO: 35314

SEQ ID NO: 43902 - DNA, 601 bp, Human
gggcttcacagtcaggtgagtttgcctggcagggagaggtggcagccagtaacatgggcaagttgtgacagaaagtttggaagtgaggagagatgagtctggccaggtctgcagggccaggggcccaactgtgagcacagggactgggactgtcaggctgaggggctcaggctttgtggacctgagtggcctccagagtccaataagcctaggaagcgatggggcctttgctgtgctgataatacacactgcaaatttctgagaggagacggtggcgggcagtgcttcttcaactcctttracatctcccaggacaggagcacgctttcggaaacgctgctacagaacaatgttaggcaggagcagcatgggcctgaggcccctctgtgggctaacgggatggatggttccaaggggacaccctgagtgggcattgaggaggctggtgtggagactaaggggacccgcaggtagtagtgagggcgggcaacagggccaggaggtgatgaggagagacactgaggcaggtactccaggggccaggctgggctctgccaccttcccaggcccccactgccaagcagcgatgcccaggagagaa

SEQ ID NO: 43903 - DNA, 601 bp, Human
ttccagctgtttttccttctactcttggacattaggcggctccagctaatctcatattgagaacacttaagtgtttcccactagtcctctggcttccaacagatggatcttctctggctgacaacctaagttgtgtgtcagatccctgtgggggtgtccatggggcggtgtccaggcaggacttgggaagctgggcaggctggaaatcagtgtgagtgttttaagcatgaaggtgattgaagccatgagggtgagtaaggtcacccaggtccccaagagggcaggagcaggtgggggcagygaggccagagaggaggctgctgggacaaagatggagcctgaggtgggggtggtgagggagaccagctggcccactgggtcctgaccctctgctctctcccacccgcagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagc

SEQ ID NO: 43904 - DNA, 601 bp, Human
caggcagcagccctttccatttactctttgttcccaggttacagctcagttgtggcagacagcccggcagaggtggctttgagcagcagtgggggcaacaatgccagcagccaggccttgggccccccttccggcccccacaacccacctcccagcacctcgtgagtgtctcggccatcggcagggttgggatggcagccttttgaaacagagaggcgcaggcgcctcacccccgcatcggtgggttctgaaccccccgcccttgctgctgggaatggccaagcgctatcctccatctccmtcgggtgttacacccccacttctttccagcaaggaaactacatcagcctccctgctttgcccttcagaacattctaaaatacgttctcatctaagtggaagttttctcaagagccccataccctttcctccccatttctgttacctgcctgaggccaattgactgccaccggagggtcactgtttcacttttcaaagtgaattgtcccgaagtccttattcctctgcagccactccttcaaatcttagctcagaccattccactgggtctgcctgtttcccgaagaatgccctaagaaag

SEQ ID NO: 43905 - DNA, 601 bp, Human
gcagcagccctttccatttactctttgttcccaggttacagctcagttgtggcagacagcccggcagaggtggctttgagcagcagtgggggcaacaatgccagcagccaggccttgggccccccttccggcccccacaacccacctcccagcacctcgtgagtgtctcggccatcggcagggttgggatggcagccttttgaaacagagaggcgcaggcgcctcacccccgcatcggtgggttctgaaccccccgcccttgctgctgggaatggccaagcgctatcctccatctccatcrggtgttacacccccacttctttccagcaaggaaactacatcagcctccctgctttgcccttcagaacattctaaaatacgttctcatctaagtggaagttttctcaagagccccataccctttcctccccatttctgttacctgcctgaggccaattgactgccaccggagggtcactgtttcacttttcaaagtgaattgtcccgaagtccttattcctctgcagccactccttcaaatcttagctcagaccattccactgggtctgcctgtttcccgaagaatgccctaagaaagatc

SEQ ID NO: 43906 - DNA, 601 bp, Human
cctcttccatgctctctctccaggaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggtgggctcctcggacatcccccgagcctctgtgtcctgactctgttgtttctttcctccaggtctctagctgcaccccytgcccccaccctctttctggatctctctctggctttctgtccccttctcacacttgctctttctccaggtctttctgtaccaccctccccgtgaccttgatctctgggggctctcatacctcctctcttgttccctccaaagctctgtttctctgggtctcttttcctttctcttggttgcacttgttgcttgctctctctgggtctccatcttcatcccccccgcaggccctcagtttctgtccccgtttgtcctcacaaggcatagactggtgtactttctgcacaagtagaaagact

SEQ ID NO: 43907 - DNA, 601 bp, Human
ggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggtgggctcctcggacatcccccgagcctctgtgtcctgactctgttgtttctttcctccaggtctctagctgcaccccttgcccccaccctctttctggatctctctctggctttctgtccccttctcacacttgctctttctccaggtctttctgtaccaccctccccgtgaccttgatctctgggggctctcatacctcctctcttgttccctccaaagctctgtttctctgggtctcttttcctttctcttggttgcacttgttgcttgctctctctgggtctccatcttcatcccccccgcaggccctcagtttctgtccccgtttgtcctcacaaggcatagactggtgtactttctgcacaagtagaaagactggttgggtgaatgcagcctggttcca

SEQ ID NO: 43908 - DNA, 601 bp, Human
ggttgggtgaatgcagcctggttccaccctttaggaagcttccctgctggggcagctgcagggaaggttgcggtgggcccaccgaggggcatctgacctgacctgggagacaggcccaggaaggtctgagagggggtgatgtttaagctgagacctggaccaggcaggggggctaacagctgcaggaagggcttcaggaggtgctttaggaggagcatgcatctgcctgtgtgcttaggaagctgggcaggatgcagcagagaggagagaggtgtccactctgcaggagacagtgccaccrgctgcagggctgagatagtgggtgtagcaggataggacggtggggtcctgatcatcgagggtcaggagctggggcttggcttgtgagccagtatactgtagcgcagcttccatggggggaccagtgtgtatgcccaggctgtccaggaggcagtgtgcgcgcccaggctgtccaggaggcagtgtgcgcgcccaggctgtccaggtccaagtcttggcattgtcctttctgtgccttcatctgggaaacggcaatagtcacgattatacctactatgtagggttatttggaagactaaat

SEQ ID NO: 43909 - DNA, 601 bp, Human
gggttatttggaagactaaatcatcctcataaagctcttggaacagtttctggcccaacagaagcattaattttttttttttttcttttttgagacagagtcttgctctgtcacccaggctggagtgcagtggtgcaatctcagctgaatgcaacatccgcctcctgggttcaagcgattctcctgccgcagcctactgagtagctgggattacaggcgcctgccaccacgccaggctaatttttatatttttaatagagatggggttttgccatgttggtcaggcaggtcttgaactcckaacctcaggtgatccacccacctcgacctcccaaagtgctgggattacaggtgtgagccaccgtgcccggcccaaattttagaagtaggtggacaggatatttatagtgcgtgcatttttctggaaaaagggaaacagcagctttgagattttcagaaggggtccatatcttttaacaccaccaacaacaaaaatgaatcgctggggtgggtggtcgggaaccatggcaaggtttggagtagagaaggaacaacatgacttcattggaaaggtcccctggggctggtgaggacaggatag

SEQ ID NO: 43910 - DNA, 601 bp, Human
cctcataaagctcttggaacagtttctggcccaacagaagcattaattttttttttttttcttttttgagacagagtcttgctctgtcacccaggctggagtgcagtggtgcaatctcagctgaatgcaacatccgcctcctgggttcaagcgattctcctgccgcagcctactgagtagctgggattacaggcgcctgccaccacgccaggctaatttttatatttttaatagagatggggttttgccatgttggtcaggcaggtcttgaactccgaacctcaggtgatccacccacctygacctcccaaagtgctgggattacaggtgtgagccaccgtgcccggcccaaattttagaagtaggtggacaggatatttatagtgcgtgcatttttctggaaaaagggaaacagcagctttgagattttcagaaggggtccatatcttttaacaccaccaacaacaaaaatgaatcgctggggtgggtggtcgggaaccatggcaaggtttggagtagagaaggaacaacatgacttcattggaaaggtcccctggggctggtgaggacaggatagagggagggtggtctgggcaggaga

SEQ ID NO: 43911 - DNA, 601 bp, Human
gagggagggtggtctgggcaggagaggacaggcctgggctgtgtgggacatggtggcacgacagggaagggagccatccagtggggtttagaagcaggacggatagctgggcgtggtggctcacacctgtaatcccagctcttagggaggcagaggcgggaggatagcttgagcccaggagtttgagacctgcctgggcgatatagcgagacaggatggataagccttggcgactgactcgttgtggagagtccagcacagggctggggtttgggacagctgcacgtggctggaggagatrggaggaaccagccctgactttggggaacagaagcctgctgtaacctttgtaataggaaacgaggctgtggctgcggggctggagacccaacctacctgtttccagcaaggagactgaagcctagccgggctgggcccaccccgattccagtcaccccatgccagtcacaggcagacagctgagcatgtagacctcctgcctccttcaagacaggcgggagctctcccagcgtgtaggtgtccctagtgaaggagcgtgtactattggcacatcctttgacaaaaatggtagcgcactgta

SEQ ID NO: 43912 - DNA, 601 bp, Human
gaggagatgggaggaaccagccctgactttggggaacagaagcctgctgtaacctttgtaataggaaacgaggctgtggctgcggggctggagacccaacctacctgtttccagcaaggagactgaagcctagccgggctgggcccaccccgattccagtcaccccatgccagtcacaggcagacagctgagcatgtagacctcctgcctccttcaagacaggcgggagctctcccagcgtgtaggtgtccctagtgaaggagcgtgtactattggcacatcctttgacaaaaatggtagygcactgtacatattctgcaggttggcgtttacttctgtagtatgtcacgaacttgtattttgaaaatctcggcgtagtattccatgctgcagagtcccactcacgagacgttcctctgctgatgaatgcgtcgtggtctccgattgtttccctacagtttgatgcttttacctgtcatgggtagattgtggggagtgggtcgttggccctccacggcccccaaacagggcaggtgagagcatctggggcctgtgtcaggctgcacttgctcctgcagcccaagtgctcaggccaggcctc

SEQ ID NO: 43913 - DNA, 601 bp, Human
gagcatgtagacctcctgcctccttcaagacaggcgggagctctcccagcgtgtaggtgtccctagtgaaggagcgtgtactattggcacatcctttgacaaaaatggtagcgcactgtacatattctgcaggttggcgtttacttctgtagtatgtcacgaacttgtattttgaaaatctcggcgtagtattccatgctgcagagtcccactcacgagacgttcctctgctgatgaatgcgtcgtggtctccgattgtttccctacagtttgatgcttttacctgtcatgggtagattgkggggagtgggtcgttggccctccacggcccccaaacagggcaggtgagagcatctggggcctgtgtcaggctgcacttgctcctgcagcccaagtgctcaggccaggcctcttgtttcctccccaggcccctgagcctctgagctccttgaagtccatggcggaacgggcagccatcagctctggcattgaggaccctgtgccaacgctgcacctgaccgagcgaggtgagggacccaggatggtggggaagcagcgggccaaagaggaggggctgcccctgacccatcctcaccactga

SEQ ID NO: 43914 - DNA, 601 bp, Human
ggtgagggccccgccccctctcttcccgctgctagggttggggtagagtccccaggctccaggcagcccctgctggcctctgctcccttgcctccacctttcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcytggggtgtgggattttcccagtatgtgtccctgcaccaggctgtgggctctgctgccgagggaccttgatggcccccacttcacctccaggtcccagcactcagcagggcaggggctcagtgcggaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaaatggggggaagac

SEQ ID NO: 43915 - DNA, 601 bp, Human
gaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcttggggtgtgggattttcccagtatgtgtccctgcaccaggctgtgggctctgctgccgagggaccttgatggcccccacttcacctccaggtcccagcactcagcagggcaggggctcagtgcsgaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaaatggggggaagaccacctacctaatgcagttgttatgaagattaaatgagttaataacatgtaagtacttaatggtgactgctacatagtcagtgtcatggattttttttttcaaattactttcagttggtgtgttc

SEQ ID NO: 43916 - DNA, 601 bp, Human
tgtcccttcctcaaagaaaccttcctggagccacccagcccagtgcctcccctttgcagtgctgggcacactcgcttggggtgtgggattttcccagtatgtgtccctgcaccaggctgtgggctctgctgccgagggaccttgatggcccccacttcacctccaggtcccagcactcagcagggcaggggctcagtgcggaaactattttttttgaatgggcttctcaagttctaatactgggaaattcctgctgcttgcaaacactctggaaccaacctacctgggtttcagcccagtscagctgggcgactctaggcaagtcactcgaacctctgtgtctcaattaacttatctgtaaaaatggggggaagaccacctacctaatgcagttgttatgaagattaaatgagttaataacatgtaagtacttaatggtgactgctacatagtcagtgtcatggattttttttttcaaattactttcagttggtgtgttctacagtgatgtttttttccaccaaatacttccctgatgccgagccccttcatggggatgaagtagtacaaggtccttgtcctcagagaactcagtcccctc

SEQ ID NO: 43917 - DNA, 601 bp, Human
cagttggtgtgttctacagtgatgtttttttccaccaaatacttccctgatgccgagccccttcatggggatgaagtagtacaaggtccttgtcctcagagaactcagtcccctctcctggttctcccaggttgccatctttgaagcacttaagacattcatttagaacctaggtcctctcccattgtgtcctcagatgttaaccacagacttcctgtcctttcctggtttggcccaaaaccatcctccaagttagtacatttcagggcatccagtcattcagaaattcccacaccacttcgtcaccaataaaatgtccctgcagagtgcttggatttagactctgagactgttccattctctagaacaagggtgacagtacccactgcctcgaggtctttgtgaagattaaatgctaggctgtgcatcctgtactcacgtgagaggtgctcaaaagccacagccctcgaggaaacgaaggctgtgcactcacacctggggctggggccccgttctggcagctggcttcggtggaacctctgcggccccctccgtttcctcctcgctgaagtggcatgataacatttcctacccaagaaga

SEQ ID NO: 43918 - DNA, 601 bp, Human; identical to SEQ ID NO: 34711

SEQ ID NO: 43919 - DNA, 601 bp, Human; identical to SEQ ID NO: 34712

SEQ ID NO: 43920 - DNA, 601 bp, Human; identical to SEQ ID NO: 34713

SEQ ID NO: 43921 - DNA, 601 bp, Human; identical to SEQ ID NO: 34714

SEQ ID NO: 43922 - DNA, 601 bp, Human; identical to SEQ ID NO: 34715

SEQ ID NO: 43923 - DNA, 601 bp, Human; identical to SEQ ID NO: 34716

SEQ ID NO: 43924 - DNA, 601 bp, Human; identical to SEQ ID NO: 34717

SEQ ID NO: 43925 - DNA, 601 bp, Human; identical to SEQ ID NO: 34718

SEQ ID NO: 43926 - DNA, 601 bp, Human; identical to SEQ ID NO: 34719

SEQ ID NO: 43927 - DNA, 601 bp, Human; identical to SEQ ID NO: 34720

SEQ ID NO: 43928 - DNA, 601 bp, Human
tttcgcattctcattcagataaagatattactccctacggcccgggaatgtcagccagccccggggaagggcggcggccaggctgcggagcctctcctggaccccctgcgggcgcgcggggcctcccccagtcgctcctggaacgccccgcccacccctcccccggggcggcgcccccgcccgcactggagctggtgaaacaggtagtgagttgatcggtcaataaacttaatccggttccttaacaagatgggccgggcagtaaaaatacaaagacctcgtgaaatggactgaggtctakgctggcgcttgcccgggaacataaattatggagccttggctcgcaggggtcaagggcggtgggaaaggttttggccactggactgccctggccaccccaggccctgccaggacagcccccatctccccagggggccgtattcctggttgggacctggagtgaccccccagggtgcagggaggtacacaaggtcggctctcccacagtcccaccccacccagcaggggtctgggggtgcagggcctttcccgaaggtgctggctgcaacctcccccactcctcctctgcagggctggactt

SEQ ID NO: 43929 - DNA, 601 bp, Human
tcccccagtcgctcctggaacgccccgcccacccctcccccggggcggcgcccccgcccgcactggagctggtgaaacaggtagtgagttgatcggtcaataaacttaatccggttccttaacaagatgggccgggcagtaaaaatacaaagacctcgtgaaatggactgaggtctaggctggcgcttgcccgggaacataaattatggagccttggctcgcaggggtcaagggcggtgggaaaggttttggccactggactgccctggccaccccaggccctgccaggacagcccccatytccccagggggccgtattcctggttgggacctggagtgaccccccagggtgcagggaggtacacaaggtcggctctcccacagtcccaccccacccagcaggggtctgggggtgcagggcctttcccgaaggtgctggctgcaacctcccccactcctcctctgcagggctggactttgagccgcgtgggcctctgggtggttcattaacctgggctgagcctggcctccaggtccttgtgtgagcctaggaaccccttgttacccaccccccagctccccagccctcaggtctcacttg

SEQ ID NO: 43930 - DNA, 601 bp, Human
ctggagctggtgaaacaggtagtgagttgatcggtcaataaacttaatccggttccttaacaagatgggccgggcagtaaaaatacaaagacctcgtgaaatggactgaggtctaggctggcgcttgcccgggaacataaattatggagccttggctcgcaggggtcaagggcggtgggaaaggttttggccactggactgccctggccaccccaggccctgccaggacagcccccatctccccagggggccgtattcctggttgggacctggagtgaccccccagggtgcagggaggtasacaaggtcggctctcccacagtcccaccccacccagcaggggtctgggggtgcagggcctttcccgaaggtgctggctgcaacctcccccactcctcctctgcagggctggactttgagccgcgtgggcctctgggtggttcattaacctgggctgagcctggcctccaggtccttgtgtgagcctaggaaccccttgttacccaccccccagctccccagccctcaggtctcacttggggctagatctggggctgtggcaccccttgttacagctgagcttgagtgggagcccaggggc

SEQ ID NO: 43931 - DNA, 601 bp, Human
cctggttgggacctggagtgaccccccagggtgcagggaggtacacaaggtcggctctcccacagtcccaccccacccagcaggggtctgggggtgcagggcctttcccgaaggtgctggctgcaacctcccccactcctcctctgcagggctggactttgagccgcgtgggcctctgggtggttcattaacctgggctgagcctggcctccaggtccttgtgtgagcctaggaaccccttgttacccaccccccagctccccagccctcaggtctcacttggggctagatctggggctgyggcaccccttgttacagctgagcttgagtgggagcccaggggcttggggtctcctggaggacggggatctaaagtcacctcatctagggaggcatgcagccctcacctgagtgattcaggagtgaatgagccaggagtggagccacctttggtggggtaggggtcagcctggacctctaggctgccagctcaggctcgggtgccctcttcgaacctcagtttccttacctgtccaagagaaccgataatggcaggctgtttgaaggattaggccagataaccctggcaagccctctttag

SEQ ID NO: 43932 - DNA, 601 bp, Human
aggtgctggctgcaacctcccccactcctcctctgcagggctggactttgagccgcgtgggcctctgggtggttcattaacctgggctgagcctggcctccaggtccttgtgtgagcctaggaaccccttgttacccaccccccagctccccagccctcaggtctcacttggggctagatctggggctgtggcaccccttgttacagctgagcttgagtgggagcccaggggcttggggtctcctggaggacggggatctaaagtcacctcatctagggaggcatgcagccctcacctgartgattcaggagtgaatgagccaggagtggagccacctttggtggggtaggggtcagcctggacctctaggctgccagctcaggctcgggtgccctcttcgaacctcagtttccttacctgtccaagagaaccgataatggcaggctgtttgaaggattaggccagataaccctggcaagccctctttagcctgcccagcctccagatcccttttttccggactttattgtgaaactccaggtggggagacagggaggctggacttttgggggccccctcctcttaggctattttatagct

SEQ ID NO: 43933 - DNA, 601 bp, Human
gccactgaagtccctgacatggagctgcccacgggcttcttgggggtgggtgcggcttgggcagcagtggtgccccaggacaggagggcagtgtggccaagccctccaggccccctctgggcctcagaggcggtggctgagccccgacctggccgattggctctcgtcagctgtgtgcagtggggcccgagctcactgtctgcccgcctcctgaagcccttagctttgttcccatggctgccgggtgggggccactgaattgggacggttgcgacactcaaagcccaaagagaaacatctrttcagagagaagacggtctcttgggggcggggagcaggcgcagggcgagggtggagtccagaccccgcccagagaggccgcctcgggccctgtccagggtgcaggttctgcaagagcccgggggagggcaggccagtgaccagaggttgtctgagggtctgggctgggttgttggggtggaggcagagacgtgcatcctgtgaaaccacagccaccgtgaagtgcctccacgcctcctccaggcagcctttggggctgacgcagcccagcctcgatctgtaccttgggggtctcccacat

SEQ ID NO: 43934 - DNA, 601 bp, Human
ggaggggcctggcttcgggctcagtaccggtgtaccaggcggagggccctcagccgcgtggcggtgaccaagttggcgatggctgaggagttggtggtggcggcgttttccttgcagcggctggatcctgccgtgtggactctgtgcggtgcccgcagggcggtgctggcgctcgcctatcgctctgctctctctttgtagacggcgggcgctaacaccaccgacaaggagctagaggttctctccttgcacaacgtcacctttgaggacgccggggagtacacctgcctggcgggcaatactattgggttttctcatcactctgcgtggctggtggtgctgccaggtaccggcttctgctgctgctgctgctccgcactgtctgggggacgctggctcgggacacgccaaagctgccaggacggacgggaatcctgtgacttacggccgtcccgcttcttgagccctcactcctggccctgtgcccagtgtggggacaaagttggcctggcccggtcctggtcccagaggggccccctcagccccctcgagcccacttcccatctgggtccccaaaggcctctcctgtggctctggtgtc

SEQ ID NO: 43935 - DNA, 601 bp, Human
ctggtggcggtgtgggactggctggctctgctgggctccttctctccagggtctggccctctagactcactggcgttactgactgcgagaccctccagacaaggcgcgtgctgaggttctgagcccccttccgctcccagtggtgcctgcggctctgggccaggggcatccatgggagccccgtgggggggggggccaggccaggcctcaacgcccatgtctttgcagccgaggaggagctggtggaggctgacgaggcgggcagtgtgtatgcaggcatcctcagctacggggtgggctkcttcctgttcatcctggtggtggcggctgtgacgctctgccgcctgcgcagcccccccaagaaaggcctgggctcccccaccgtgcacaagatctcccgcttcccgctcaagcgacaggtaacagaaagtagataccaggttctgagctgcctgcccgccaggcctcctggagccccacctcggcccacgctggtcctgggctgtgtgagccctctctgcagccaggcgggctcccctctcctcgtctctgctcaccatgtagagcctagggtactttggggcacgaaacattctaaaaa

SEQ ID NO: 43936 - DNA, 601 bp, Human
tgcctaccaggtggcccggggcatggagtacttggcctcccagaaggtgggcagggcggcaggtgtgggtggagtaggctgggccctgccctgagatgctgggagcagcggggagaggtggagaggcttcagccctgcctcccaccccttccccagtgcatccacagggacctggctgcccgcaatgtgctggtgaccgaggacaacgtgatgaagatcgcagacttcgggctggcccgggacgtgcacaacctcgactactacaagaagacaaccaacgtgagcccggccctggggtgcrggggtgggggtcatgccagtaggacgcctggcgccaacaccgccttcccacaccctcccagggccggctgcccgtgaagtggatggcgcctgaggccttgtttgaccgagtctacactcaccagagtgacgtgtacgtgtcctgcagagctcaggcttcaggggtggaggcgggaactgggcagagccaggaccccagctgcagtccccaggcctgtgccctggagctcctgggtgtggtttctacccctccctgggggcagcagcgcagccctggcctattcccctggtgcccgcccag

SEQ ID NO: 43937 - DNA, 601 bp, Human
cactccagaaggagaccctttctctagaataaataaatgtgcacttagtaggaatgcctgtatcatggaagaaactcaataaacagtataaaatgcatcttagttaatttctagcctatgtatgctctgataggatttatgttacatatgattcattcaggcactggtgttcagaatgcaagtgtgatgataatttaatcagagctgcaaaggtgtgttctaaatactgcataaacctaatcatctttgtctccacctttctgaatgctctaaatacccataaagaggtgggtgtggtctycacaggttcttataaaaggacacggaagagacaagctcagttttctctgaaggagaaggactgcacttagaactgcattttggcgacctctgaaattcagtactgcagtgaatgagcttctgatcttgaggtgaacttaacaaaattatttttggaaaaatcgttgtgggaaccattaaaagaactccagggtgagtgaaacatattgataaaattatatcatctttcctttacacaataataaattagagtgttaaaaatatctcattatctgaaatctacacaatgataccatttgta

SEQ ID NO: 43938 - DNA, 601 bp, Human; identical to SEQ ID NO: 39262

SEQ ID NO: 43939 - DNA, 601 bp, Human; identical to SEQ ID NO: 39263

SEQ ID NO: 43940 - DNA, 601 bp, Human; identical to SEQ ID NO: 39264

SEQ ID NO: 43941 - DNA, 601 bp, Human
aacagaggcagttggagaagagctggccccagcagacgcagcagatgggcagcttctttccttggaaacatttctggccccttgctgtttcctagaccacctccccccaccctcctgttccctgtgtcctatttcagggccccccagcagggtccacgggttctgctgtgggacgggagccgccaggcctaagatcacacatcctgtgtgtctcggaggctttagggctcagcttggagctgggcagacgggaagggagaaggcgggcagggaggcagaatcgtgaggtggttaagagtcrgcgagcctgggcatgaatctggcttttaacctgtcaaaactgggcaaggagactgagctttctgaaccagaagtttgtagtgggattgttgtgaggattaaattagatgagcgtacgaaggacttggctccaaacacagtgcttggagcagtgcctggaacacagtaagaagacctgagctgttgttagggtatgcaggcagcagttagttggggggcaaggtcaaggcctcacccagagaggacagggcagtggtggtgccacagaggggaggtgggggtccgggcccttaagggagga

SEQ ID NO: 43942 - DNA, 601 bp, Human
aaagggagagaaaggaacagaggcagttggagaagagctggccccagcagacgcagcagatgggcagcttctttccttggaaacatttctggccccttgctgtttcctagaccacctccccccaccctcctgttccctgtgtcctatttcagggccccccagcagggtccacgggttctgctgtgggacgggagccgccaggcctaagatcacacatcctgtgtgtctcggaggctttagggctcagcttggagctgggcagacgggaagggagaaggcgggcagggaggcagaatcgtgrggtggttaagagtcggcgagcctgggcatgaatctggcttttaacctgtcaaaactgggcaaggagactgagctttctgaaccagaagtttgtagtgggattgttgtgaggattaaattagatgagcgtacgaaggacttggctccaaacacagtgcttggagcagtgcctggaacacagtaagaagacctgagctgttgttagggtatgcaggcagcagttagttggggggcaaggtcaaggcctcacccagagaggacagggcagtggtggtgccacagaggggaggtgggggtccgg

SEQ ID NO: 43943 - DNA, 601 bp, Human
ttctcccctctaaagctagcaaaaagggagagaaaggaacagaggcagttggagaagagctggccccagcagacgcagcagatgggcagcttctttccttggaaacatttctggccccttgctgtttcctagaccacctccccccaccctcctgttccctgtgtcctatttcagggccccccagcagggtccacgggttctgctgtgggacgggagccgccaggcctaagatcacacatcctgtgtgtctcggaggctttagggctcagcttggagctgggcagacgggaagggagaaggygggcagggaggcagaatcgtgaggtggttaagagtcggcgagcctgggcatgaatctggcttttaacctgtcaaaactgggcaaggagactgagctttctgaaccagaagtttgtagtgggattgttgtgaggattaaattagatgagcgtacgaaggacttggctccaaacacagtgcttggagcagtgcctggaacacagtaagaagacctgagctgttgttagggtatgcaggcagcagttagttggggggcaaggtcaaggcctcacccagagaggacagggcagtggtggtgcca

SEQ ID NO: 43944 - DNA, 601 bp, Human
tccatcacttccagaatcccattctcccctctaaagctagcaaaaagggagagaaaggaacagaggcagttggagaagagctggccccagcagacgcagcagatgggcagcttctttccttggaaacatttctggccccttgctgtttcctagaccacctccccccaccctcctgttccctgtgtcctatttcagggccccccagcagggtccacgggttctgctgtgggacgggagccgccaggcctaagatcacacatcctgtgtgtctcggaggctttagggctcagcttggagctgrgcagacgggaagggagaaggcgggcagggaggcagaatcgtgaggtggttaagagtcggcgagcctgggcatgaatctggcttttaacctgtcaaaactgggcaaggagactgagctttctgaaccagaagtttgtagtgggattgttgtgaggattaaattagatgagcgtacgaaggacttggctccaaacacagtgcttggagcagtgcctggaacacagtaagaagacctgagctgttgttagggtatgcaggcagcagttagttggggggcaaggtcaaggcctcacccagagag

SEQ ID NO: 43945 - DNA, 601 bp, Human
catccagaagacccttccagtgcccccttccccagcctcctgggcccaaactctgggcaaaatccaggtgtctcagccctgtggctccatcacttccagaatcccattctcccctctaaagctagcaaaaagggagagaaaggaacagaggcagttggagaagagctggccccagcagacgcagcagatgggcagcttctttccttggaaacatttctggccccttgctgtttcctagaccacctccccccaccctcctgttccctgtgtcctatttcagggccccccagcagggtccacrggttctgctgtgggacgggagccgccaggcctaagatcacacatcctgtgtgtctcggaggctttagggctcagcttggagctgggcagacgggaagggagaaggcgggcagggaggcagaatcgtgaggtggttaagagtcggcgagcctgggcatgaatctggcttttaacctgtcaaaactgggcaaggagactgagctttctgaaccagaagtttgtagtgggattgttgtgaggattaaattagatgagcgtacgaaggacttggctccaaacacagtgcttggagcagtgcctg

SEQ ID NO: 43946 - DNA, 601 bp, Human
ttgcgggggccgggggatgtgtttgttcttcttcttgggcagcttctgcttggccatggccagcgaatagtacatgccaaagttgttgacaatgacgggcacaggcatggcgatggtcagcacccccgccagggcacacagcgccccgaccagcatccccgaccacgtcttggggtacatgtctccatagcccagggtcgtcatggtgaccacagcccaccagaagccaatggggatgttcttgaagtaggtgtggttggagcccaggatgtcatcggggtcggcgccaatgcgctcagcrtagtaaatcatggtggcgaagatgagcacccccagggccaggaagatgatgagcagcaggaactcgttggtgctggcgcggagcgtgtgtcccagcacgcgcagccccacgaagtgccgggtcagcttgaagatgcgcaggatgcggacgaagcggaccacccgcaggaagcccagcacgtctttggcggccttggagctgaggcccgagaggcccacctcgagatagaagggcaggatggccacacagtcgatgatgttgaggctgcttttaagaaactccaccttgtctgggcagaag

SEQ ID NO: 43947 - DNA, 601 bp, Human
gggaggcggaggttgcagtgagccaagatgtttccactgcactccggcctgggagacagagtgagactccgtcttggaataagaaaaaaaaaagagagagatggttgcggatgaagcaagctgggtgtcggggagaagatgaggcagtgttggggggtggttggctggagcaaacttcagggggcttggctggggtaggggtagcgggtggaggcatggctggagaggatgtggcaagctaggaagtggctgttcagggaagagtgctgggctctgggaagggcaccaaggggaagggctrggttaggtgagagatgggaggtgggacgtgggggtcccctaggctctgactccagctatttttaactggtgtgaaactgggtcagcggctgagggagcaagatgggggccaagtggcccagctccctttcttgacctacttaaggcggggcagtgcaggggggggccaccagcctctccttcctcctagactcccaagccactgcctctgaggcatagacaccccctgggggaggaacacacacagaagcacaggtaactttcttctccctcatctctcgcttgtctcttcctctgagca

SEQ ID NO: 43948 - DNA, 601 bp, Human
gtctctactaaaaatacaaaaattagctgggcacagtggcgggcgcctgtaatcccagctactccggaggctgaggtaggtgaatcacttgaacccgggaggcggaggttgcagtgagccaagatgtttccactgcactccggcctgggagacagagtgagactccgtcttggaataagaaaaaaaaaagagagagatggttgcggatgaagcaagctgggtgtcggggagaagatgaggcagtgttggggggtggttggctggagcaaacttcagggggcttggctggggtaggggtagygggtggaggcatggctggagaggatgtggcaagctaggaagtggctgttcagggaagagtgctgggctctgggaagggcaccaaggggaagggctaggttaggtgagagatgggaggtgggacgtgggggtcccctaggctctgactccagctatttttaactggtgtgaaactgggtcagcggctgagggagcaagatgggggccaagtggcccagctccctttcttgacctacttaaggcggggcagtgcaggggggggccaccagcctctccttcctcctagactcccaagccactg

SEQ ID NO: 43949 - DNA, 601 bp, Human
tcgagaccagcctggccaacatggtgaaaccccgtctctactaaaaatacaaaaattagctgggcacagtggcgggcgcctgtaatcccagctactccggaggctgaggtaggtgaatcacttgaacccgggaggcggaggttgcagtgagccaagatgtttccactgcactccggcctgggagacagagtgagactccgtcttggaataagaaaaaaaaaagagagagatggttgcggatgaagcaagctgggtgtcggggagaagatgaggcagtgttggggggtggttggctggagcraacttcagggggcttggctggggtaggggtagcgggtggaggcatggctggagaggatgtggcaagctaggaagtggctgttcagggaagagtgctgggctctgggaagggcaccaaggggaagggctaggttaggtgagagatgggaggtgggacgtgggggtcccctaggctctgactccagctatttttaactggtgtgaaactgggtcagcggctgagggagcaagatgggggccaagtggcccagctccctttcttgacctacttaaggcggggcagtgcaggggggggccacca

SEQ ID NO: 43950 - DNA, 601 bp, Human
attggctcatgcctataatcccagcactttgtgaggctgaggtgggagaattgcttgaggccatgagtttgagaccagccctggcaacatagcaaaactccatctctacaaaaaatagaaaaattagctgggtatagtagtacacgcctatagtcccagctactctgcaggctgaggcaggaggatcacttgaaactgggaggtcggcctgcagtgagccataatagtttcactgcttcagcctgggtgatagagtgagaccctgtctccaaaaaagataaaagataaaagatgccaggcrtggtggcttacgcctgtaatcccagcactttgggaggccgaggtgggtagatcacttaaggtcaggagttcgagaccagcctggccaacatggtgaaaccccgtctctactaaaaatacaaaaattagctgggcacagtggcgggcgcctgtaatcccagctactccggaggctgaggtaggtgaatcacttgaacccgggaggcggaggttgcagtgagccaagatgtttccactgcactccggcctgggagacagagtgagactccgtcttggaataagaaaaaaaaaagagagagat

SEQ ID NO: 43951 - DNA, 601 bp, Human
ctgtcttatccccctcacttctgcatggccggcagcccccagtctgtcccttctgatccctgaccccgactctctcggcctcgtcccttcctctccatcctcacagccctggccccagctcacgcttccacctgtcacctcagcctcctaacttccagcctcccacctccagtccatcctcacaagaccccagagctgcccctcccagctcacctgcctcctccccaagcccctagacaaggtggcagcctctcagcccggtgcctgcctcatatctacctgagaatcctccctccacagwctagtctcctaagctctgtcctgcggttcccttcaaccgttcctgtcgatgggatttcttcctctgcgtgtggtcagaactcctgctcaaccttaaggccccactgcagatatcgagtcttccctgatgcccggccccatcccctgggagtttctagtgttcctctcactgtctgtgctccctccattttagcatacatcgcctcaaaccatgactttctaggtccgtgtctgcctcctgctccaaagcggaagctcctgggggcatggtttttgttcacggttgaactccccatgccca

SEQ ID NO: 43952 - DNA, 601 bp, Human
aggactgcttgagcccaggagttcaagaccaacctggccaacatagcgagaccccaacacttgaatccaggaggcggaggttgcagtgagccgagattgcaccattgcactccagcccaggtgacatagcaagacagtctcaaaaaaaaaaaaaaaaaaaaaaagaatcagttgctgaaacagtgaatgaatggattgaatacatgaatgaaaggagctaggagttggcttggattgttacaaggattaaagaatatatgttaaattcctagcatgtggtaggtacttggtgatatttgckgaatgattcgtctactaaatagcaccactgtcttatccccctcacttctgcatggccggcagcccccagtctgtcccttctgatccctgaccccgactctctcggcctcgtcccttcctctccatcctcacagccctggccccagctcacgcttccacctgtcacctcagcctcctaacttccagcctcccacctccagtccatcctcacaagaccccagagctgcccctcccagctcacctgcctcctccccaagcccctagacaaggtggcagcctctcagcccggtgcctgcctcat

SEQ ID NO: 43953 - DNA, 601 bp, Human
ggaccccttacaatctggagactgtaaaccgtgatggcagattcacgctttgttttatcccaaatttgtagtgcctgcaactgtgttctcaagaatcagttgtggccatgggtggtggctcatgcctgtaatcttagcacttcgggaggccaaggcaggaggactgcttgagcccaggagttcaagaccaacctggccaacatagcgagaccccaacacttgaatccaggaggcggaggttgcagtgagccgagattgcaccattgcactccagcccaggtgacatagcaagacagtctcaaaaaaaaaaaaaaaaaaaaaaagaatcagttgctgaaacagtgaatgaatggattgaatacatgaatgaaaggagctaggagttggcttggattgttacaaggattaaagaatatatgttaaattcctagcatgtggtaggtacttggtgatatttgctgaatgattcgtctactaaatagcaccactgtcttatccccctcacttctgcatggccggcagcccccagtctgtcccttctgatccctgaccccgactctctcggcctcgtcccttcctctccatcctcacagccctggcc

SEQ ID NO: 43954 - DNA, 601 bp, Human
tcttgttcttttatctttatcttaattgcttcttttcttcttcttcttcttcttcttttttttgagagggagtctcactctatttgtagcccaggctggagtgcagtggtgtgatcttggctcactgcaacctccacctcccgggttcaagtgattctcctaccccagcctcccaagtagctgggactacaggtgcccaccaccacgcatggctaatttttgtatttttagtagagatggggtttcaccatgttggccaggctggtctcgaactcctgacctcaagtgatccactgtcctsggcctcccaaagtgctgggattacagatgtgagccacccccgccgcccagccttaattgcttattttctgcttcttcctatgagcggctggaaacttttcctgtaaaaggccagatagtaaatctctttggctataggggctgtatagtctttgtcccaattattccactctgctgtcgtggcttaacatggttgtgttccaataaagctttgtttacaaaaacagatgctgaaagatcaggccctcaggctggagttagtttgcggaccccttacaatctggagactgtaaaccgtgat

SEQ ID NO: 43955 - DNA, 601 bp, Human
gcccaggctggtctcaaatttctaggctcaaatgatactcccaccttggcctcccaaagtgctggggttataggcggcagccactgtgcccagccagacctctttaactgaagtggccagagtaatagtcttgttcttttatctttatcttaattgcttcttttcttcttcttcttcttcttcttttttttgagagggagtctcactctatttgtagcccaggctggagtgcagtggtgtgatcttggctcactgcaacctccacctcccgggttcaagtgattctcctaccccagcctcmcaagtagctgggactacaggtgcccaccaccacgcatggctaatttttgtatttttagtagagatggggtttcaccatgttggccaggctggtctcgaactcctgacctcaagtgatccactgtcctcggcctcccaaagtgctgggattacagatgtgagccacccccgccgcccagccttaattgcttattttctgcttcttcctatgagcggctggaaacttttcctgtaaaaggccagatagtaaatctctttggctataggggctgtatagtctttgtcccaattattccactct

SEQ ID NO: 43956 - DNA, 601 bp, Human
accctctccccctcaatcccataggggcccctctagacctgggggtggggaacagaggaaggtaaaggactgggagtgggtgcaagcagggggaggagttagataggagcagggaggggagtgggggggtaatgagctggaaatggacaatgacggggaggttacaaaaaggagaggtggggggatggaacaagaggagccagacagtcccccctctggactaggagcccggaagcctggggtctcggcccttgtgctctgtggcctggggtggtgggttggtcatggccttccctgaatstctgtgaaacacaggggtttaggtgaggccattcctggaagccccccaggttcccctatggcatctccttaggctgtggacagggatcctttaggatgtgtctctgcatttctaaagaagattccacagacggctgttgaatgaatgcatgatggatcacataccttcaggtggcttcccttcacgtttaagataaagtcccgcctcctcaccatggccgaaaatccgtcctgatctttctccctggactccagcagccctctccccttggccactgggatcagcctcactgtgctcctt

SEQ ID NO: 43957 - DNA, 601 bp, Human
cagggcaccagggatagaagcttcagccaaccccatcagctccagccatgatttgagttcaatgaatggattttggcatcataggcaagagaagcagggacctcccccacccagccacccccaccccaatcctccctcacccataggcccacaccctctccccctcaatcccataggggcccctctagacctgggggtggggaacagaggaaggtaaaggactgggagtgggtgcaagcagggggaggagttagataggagcagggaggggagtgggggggtaatgagctggaaatggacmatgacggggaggttacaaaaaggagaggtggggggatggaacaagaggagccagacagtcccccctctggactaggagcccggaagcctggggtctcggcccttgtgctctgtggcctggggtggtgggttggtcatggccttccctgaatgtctgtgaaacacaggggtttaggtgaggccattcctggaagccccccaggttcccctatggcatctccttaggctgtggacagggatcctttaggatgtgtctctgcatttctaaagaagattccacagacggctgttgaatgaatgc

SEQ ID NO: 43958 - DNA, 601 bp, Human
gagagctctttaacgtgagatatccccacaatgaagcaaatcgcccagttatcaaagtgagctatccttaggagttgtcagaaaatgcatcaggattatcagagaaaagtatcagaaagatttttttttctgatacgttgtataaaataaacaaactgaaattcaataacatataaggaattctgtctgggctctgaagacaatctctctctgcatattgagttcttcaaacattgtagcctctttatggtctctgagaaataactaccttaaacccataatctttaatacttcctaaactttcttaataagagaagctctattcctgacactacctctcatttgcaaggtcaaatcatcattagttttgtagtctattaactgggtttgcttaggtcaggcattattattactaaccttattgttaatattctaaccataagaattaaactattaatggtgaatagagtttttcactttaacataggcctatcccactggtgggatacgagccaattcgaaagaaaagtcagtcatgtgcttttcagaggatgaaagcttaagataaagactaaaagtgtttgatgctggaggtgggagt

SEQ ID NO: 43959 - DNA, 601 bp, Human
aagatttttttttctgatacgttgtataaaataaacaaactgaaattcaataacatataaggaattctgtctgggctctgaagacaatctctctctgcatattgagttcttcaaacattgtagcctctttatggtctctgagaaataactaccttaaacccataatctttaatacttcctaaactttcttaataagagaagctctattcctgacactacctctcatttgcaaggtcaaatcatcattagttttgtagtctattaactgggtttgcttaggtcaggcattattattactaaycttattgttaatattctaaccataagaattaaactattaatggtgaatagagtttttcactttaacataggcctatcccactggtgggatacgagccaattcgaaagaaaagtcagtcatgtgcttttcagaggatgaaagcttaagataaagactaaaagtgtttgatgctggaggtgggagtggtattatataggtctcagccaagacatgtgataatcactgtagtagtagctggaaagagaaatctgtgactccaattagccagttcctgcagaccttgtgaggactagaggaaga

SEQ ID NO: 43960 - DNA, 601 bp, Human
accatttaaaaagtaaaaataaaaaactgttgcaaggtttttatgcacctaatttcttgccagaaattcagattcaggtggtctcctgtgaggttgtaaagttcaagagtctttttttttggcagtggtgcaatctccatacgctgcaacttccgcctcccaggttcaagtgattcttctgcctcagtctccctagtagctgggactacaggggcccgccaccactcccagctaattttttgtacttttagtagagatggggtttcaccctgttggccaggctgctcttgaactcttgacytcaagtgatctgtccgcctcagactcccaaagtgctgggattgcaggcctgagccatcaagctgggccttcaagtgtttgcatttttaaaccctcattttgtgattctaatgtgcagccagcactgagaatcattgagttaatggagattgttttggtatctttttactttcactttacaaaaacgcatgttctgtaataaacacaccattaatttgaatgcctttgtccaaattgaatgcttaaattaagaactagactatttgtgtgagatgagatcaaatagtttctagattgagtt

SEQ ID NO: 43961 - DNA, 601 bp, Human
gcacttgtaacttttcattacatgtagtggttttccagcctgtctgtatctgccagcctgtcagtcgctccaaggtggtgatcatttctaaatatttttgtatccacagagcacaggactataatatacacatggaacaggctttataaatacatgctgaatttaacatcaaagaaacgttagctccaatgctaacatacataaaatattaaactctgcatgggtagatttctaggaccattcactgcagtttttttatagcactggattcccaatgccaaggatacaacaatgtcaacartagccacttactcaaatttgggtataatatatcttgtgtcgttctctctggtagttccatatgtatgtctgcgtgtgtgcatgcaaagaaagacaatacaagagagaagatgaagcaaggtgcaacatagctgagtgtgatttaaatgaagttaatatttattggtcagagttttctgttaaatatgttaaaatcaggtaattaatttatttggaaatattgtgttcctaattcatgtctgttgtttgctcatttatttaactcccaaagctttaaattaggggccatgtttatcatcaa

SEQ ID NO: 43962 - DNA, 601 bp, Human
gtctgtatctgccagcctgtcagtcgctccaaggtggtgatcatttctaaatatttttgtatccacagagcacaggactataatatacacatggaacaggctttataaatacatgctgaatttaacatcaaagaaacgttagctccaatgctaacatacataaaatattaaactctgcatgggtagatttctaggaccattcactgcagtttttttatagcactggattcccaatgccaaggatacaacaatgtcaacagtagccacttactcaaatttgggtataatatatcttgtgtcrttctctctggtagttccatatgtatgtctgcgtgtgtgcatgcaaagaaagacaatacaagagagaagatgaagcaaggtgcaacatagctgagtgtgatttaaatgaagttaatatttattggtcagagttttctgttaaatatgttaaaatcaggtaattaatttatttggaaatattgtgttcctaattcatgtctgttgtttgctcatttatttaactcccaaagctttaaattaggggccatgtttatcatcaattaaaatagttcattatatttggaggtggagggttgcttaa

SEQ ID NO: 43963 - DNA, 601 bp, Human
aatttaagagaacagtatttaggttcaccttcctcattaatatatctatttcttctatctccccttttttctttgacttggaacacttgatcgtccccccagcatatgttataaatcacttgcgttgaaatagaaaaaaaacagagtcatcatcagaacatccaggctcaaattctacccctgccatttagtagacgacattggaccagttatttaaaatctttgacctttgttttttccaaagagaaaaaaaatgaggtagaattaccatctatacatgttttgtgtgtgtgctaatagraggattaaatggaatgggaaacagaataatgtagtggaaagagtatagtcttttcagtcacatcagcatgaatttgagtgaactttcatacttacttagctacaagaccctaagttacttaattattctgagacgatttttgtccctaaaattagaataatataggttaaagcattactgtgaagggattcaataagatgtgtttatatggcttgtttaggatctgacctattgtttgagtttcatgtgtggaaataatatatttttaaatgatacatcaaagttagatataataatgaa

SEQ ID NO: 43964 - DNA, 601 bp, Human
aaaatatcctgagattactcaaagaggaataaaaatgatttagtctacatacttgtagcgtccagttaacccaaattataaaagcatccaacatattacattcaatgtaaaagttaggttagttttattcaaccattcctaagccattaacacgtcataattaatgtagtgggtattgcttcagaataaggaaacttgtgtttcagtgctttggttttgactctaaatatcatatggccctaagacaagtcactcaacagttctagttctcaattatatatggataaaaggatttaggaaygttatgaggtataaggcaaactagaaactggcatttgttgaaacagaaattatttgttgaatagtttcttttcgtatattatgtcatagtacagtttaaaaaaattgagatttagcaagtctaaaaaacatgttcattgccagtaagaaaattagccagaattgaagttgcatctacctgtattacggagcccaattttttctctaccacacaatgcataaattcttaagttatgtcttagtgaccaaaaattaagagtaggttctctaagcatttcttatctaacacagtagcagccat

SEQ ID NO: 43965 - DNA, 601 bp, Human
cgttatgaggtataaggcaaactagaaactggcatttgttgaaacagaaattatttgttgaatagtttcttttcgtatattatgtcatagtacagtttaaaaaaattgagatttagcaagtctaaaaaacatgttcattgccagtaagaaaattagccagaattgaagttgcatctacctgtattacggagcccaattttttctctaccacacaatgcataaattcttaagttatgtcttagtgaccaaaaattaagagtaggttctctaagcatttcttatctaacacagtagcagccayctatggtggggggactgcccattcaattctatttgagatgactacatttgtttatacatgcttatagatagcaaattcagtgggataggaggaccaataaaatagtcttgattattttcaaatgtgatgcaaacagttgaccgggaagacattttaccttcaaattattattctatacgtctcgcctactgttcacaaaattataaatcataacatgggtctttatatcccgttagccttttgtagtcttccacagtctggcttagtatcctcatcatgaaaatagagataaaatcataa

SEQ ID NO: 43966 - DNA, 601 bp, Human
ccacagggtagttgtgagaatttctaattttaatgtatatggagatatctcccttatggcctaggacagagtagtgactcaatataggtttaaaaaaataagttctagaaatatattctatggtagaggtggtaccaacaacatgaccaagaaaaatgagcactcaacacatactttttgtaggagattctttggctcatccactgactctgttcattcatccaacaaattcttactgcacatcaacagggtgctagaaactgtactagattctgagagaaaagaaataaacaacaatgtraaaataaatgtgtcttcatgaaggatgcgtttttataagggacgtaacaatcattgtttattagagacgaaaatgagtaagtgtaagttgggtaaagaacaatgttatctccctagtggccccaagcctcccacggaagcatgcacctgttgtgaacagtcaatgacggcagggtggactctcctgaatttcatcttttgcttcgaatgtatctctcactacctaattactctattttattaaatctaaggtatcaatgaatttaagtgatgcattcatttatgtaccactaagaaaaat

SEQ ID NO: 43967 - DNA, 601 bp, Human
taagtgtaagttgggtaaagaacaatgttatctccctagtggccccaagcctcccacggaagcatgcacctgttgtgaacagtcaatgacggcagggtggactctcctgaatttcatcttttgcttcgaatgtatctctcactacctaattactctattttattaaatctaaggtatcaatgaatttaagtgatgcattcatttatgtaccactaagaaaaataaaaaaatatatttatcttaaaagccctttttggcttacgtagtcacatatttttatcatagtttattcttctgcctmcatataaatgaaactacaagaaaaataatttggtgaaggattcctgaaatgtttttacattcagagtcagccccttttgagttacttttaaagtcagagtcaacaatgcctgtttttactaattatttgctttggccttaaagaatgggtaggatattagatgcatggcaaagagtgggcatgcttagccacaatcagagtcatggaatggagaagcacaagcagtgtccagagaaagtaggccatctgactttagcagcaggatcacacaggatgtgagcacatggagaatggttgcct

SEQ ID NO: 43968 - DNA, 601 bp, Human
aactacaagaaaaataatttggtgaaggattcctgaaatgtttttacattcagagtcagccccttttgagttacttttaaagtcagagtcaacaatgcctgtttttactaattatttgctttggccttaaagaatgggtaggatattagatgcatggcaaagagtgggcatgcttagccacaatcagagtcatggaatggagaagcacaagcagtgtccagagaaagtaggccatctgactttagcagcaggatcacacaggatgtgagcacatggagaatggttgcctgactcgagatattttttggaggtagaattgccaatataaaagcagtgccatcgcacaatgctccatgctcagaagcagaccctacatttgaggtttaatgatctgtggtcttggtgttgaaattcttattaatcttatctttgggtttgtgctttataagtgaagttatagggacaatggagcatatgcttggttcatatgcatcctgcagaccttttgttctttgttttcctgggatgggtcttggctaccactacccatccaccagccctacctagtttccacctcctcaccctctgcccaaggccactg

SEQ ID NO: 43969 - DNA, 601 bp, Human
gactcgagatattttttggaggtagaattgccaatataaaagcagtgccatcgcacaatgctccatgctcagaagcagaccctacatttgaggtttaatgatctgtggtcttggtgttgaaattcttattaatcttatctttgggtttgtgctttataagtgaagttatagggacaatggagcatatgcttggttcatatgcatcctgcagaccttttgttctttgttttcctgggatgggtcttggctaccactacccatccaccagccctacctagtttccacctcctcaccctctgcmcaaggccactggtgggaggaaagaggtcaacatttcactgtcactctccatccctggtggggtccttggtgcaagcaaaaagaggtgtgaggttgggtgttgatcccatgatttgttggttcagagtaaaacagaggccttctctaccgaggctggctgcaccttagcacggtgcacaggtgattacatatagacctctcagccagtattatggactgaattgtgtctcccaaaaacgtgtgtgttgaatccctaatttccagtgtgactatttggaggtaggtctttaaggaagtaatt

SEQ ID NO: 43970 - DNA, 601 bp, Human
gtgctttataagtgaagttatagggacaatggagcatatgcttggttcatatgcatcctgcagaccttttgttctttgttttcctgggatgggtcttggctaccactacccatccaccagccctacctagtttccacctcctcaccctctgcccaaggccactggtgggaggaaagaggtcaacatttcactgtcactctccatccctggtggggtccttggtgcaagcaaaaagaggtgtgaggttgggtgttgatcccatgatttgttggttcagagtaaaacagaggccttctctacygaggctggctgcaccttagcacggtgcacaggtgattacatatagacctctcagccagtattatggactgaattgtgtctcccaaaaacgtgtgtgttgaatccctaatttccagtgtgactatttggaggtaggtctttaaggaagtaattgaggttaagtgaggtcattaacagtggggtcctaatccaacagtactcatgtcctcataagaagacaaaaaagacagagccatctctttctttgtgtatgcgtagagaaacggcaatgtgaagacagagaaaaggtttcctctgcaag

SEQ ID NO: 43971 - DNA, 601 bp, Human
atcctgcagaccttttgttctttgttttcctgggatgggtcttggctaccactacccatccaccagccctacctagtttccacctcctcaccctctgcccaaggccactggtgggaggaaagaggtcaacatttcactgtcactctccatccctggtggggtccttggtgcaagcaaaaagaggtgtgaggttgggtgttgatcccatgatttgttggttcagagtaaaacagaggccttctctaccgaggctggctgcaccttagcacggtgcacaggtgattacatatagacctctcasccagtattatggactgaattgtgtctcccaaaaacgtgtgtgttgaatccctaatttccagtgtgactatttggaggtaggtctttaaggaagtaattgaggttaagtgaggtcattaacagtggggtcctaatccaacagtactcatgtcctcataagaagacaaaaaagacagagccatctctttctttgtgtatgcgtagagaaacggcaatgtgaagacagagaaaaggtttcctctgcaagacataagagaggcctcagcagataccttgatcttggacttccaaactcatgaac

SEQ ID NO: 43972 - DNA, 601 bp, Human
cctcctcaccctctgcccaaggccactggtgggaggaaagaggtcaacatttcactgtcactctccatccctggtggggtccttggtgcaagcaaaaagaggtgtgaggttgggtgttgatcccatgatttgttggttcagagtaaaacagaggccttctctaccgaggctggctgcaccttagcacggtgcacaggtgattacatatagacctctcagccagtattatggactgaattgtgtctcccaaaaacgtgtgtgttgaatccctaatttccagtgtgactatttggaggtaggkctttaaggaagtaattgaggttaagtgaggtcattaacagtggggtcctaatccaacagtactcatgtcctcataagaagacaaaaaagacagagccatctctttctttgtgtatgcgtagagaaacggcaatgtgaagacagagaaaaggtttcctctgcaagacataagagaggcctcagcagataccttgatcttggacttccaaactcatgaactttgagaaaataaatgtctgctgtttaagccacccagtctgtagtattttcttatggcagcctgaactaatctacccaccta

SEQ ID NO: 43973 - DNA, 601 bp, Human
caaggccactggtgggaggaaagaggtcaacatttcactgtcactctccatccctggtggggtccttggtgcaagcaaaaagaggtgtgaggttgggtgttgatcccatgatttgttggttcagagtaaaacagaggccttctctaccgaggctggctgcaccttagcacggtgcacaggtgattacatatagacctctcagccagtattatggactgaattgtgtctcccaaaaacgtgtgtgttgaatccctaatttccagtgtgactatttggaggtaggtctttaaggaagtaattraggttaagtgaggtcattaacagtggggtcctaatccaacagtactcatgtcctcataagaagacaaaaaagacagagccatctctttctttgtgtatgcgtagagaaacggcaatgtgaagacagagaaaaggtttcctctgcaagacataagagaggcctcagcagataccttgatcttggacttccaaactcatgaactttgagaaaataaatgtctgctgtttaagccacccagtctgtagtattttcttatggcagcctgaactaatctacccacctactcaaacaagtcttagc

SEQ ID NO: 43974 - DNA, 601 bp, Human
ggccactggtgggaggaaagaggtcaacatttcactgtcactctccatccctggtggggtccttggtgcaagcaaaaagaggtgtgaggttgggtgttgatcccatgatttgttggttcagagtaaaacagaggccttctctaccgaggctggctgcaccttagcacggtgcacaggtgattacatatagacctctcagccagtattatggactgaattgtgtctcccaaaaacgtgtgtgttgaatccctaatttccagtgtgactatttggaggtaggtctttaaggaagtaattgagsttaagtgaggtcattaacagtggggtcctaatccaacagtactcatgtcctcataagaagacaaaaaagacagagccatctctttctttgtgtatgcgtagagaaacggcaatgtgaagacagagaaaaggtttcctctgcaagacataagagaggcctcagcagataccttgatcttggacttccaaactcatgaactttgagaaaataaatgtctgctgtttaagccacccagtctgtagtattttcttatggcagcctgaactaatctacccacctactcaaacaagtcttagcatg

SEQ ID NO: 43975 - DNA, 601 bp, Human
accaacaaagaacaacatcctgttgtcagccacaactgagatacaggactagaactctctattttattttaacctagaacctacttttaaaaattttttaatgttgagttctgctagactagttataaaagcacaaaatacactaaagatgaagttggaaaacttgggttgccatcacaacactgccatttatttgccatataacctgagaaatgccacttaccctctctgagtctcattttccttatttgtgaagcgaaatgtattgttttgtgatgtaaatgaaacaatgcatgtgccrtgttttcttaaaaagttttgcttatagaaaggtgagaaattcttatttttaagacggtatttctacaatgaaaatcaccttggttctagctaaaggatcagagaaatttcttttcttaaaaaacaatcaaccacgagtattgtactgcacatcaaaaaaaaaagggacaataataggatattttatgaacaaaaagcacaaaatgaaactatttctagtccttgacattctgaatataatatagattaatgtttttaaagctactgtttattgagtgttttctgttggtcatgccatgtg

SEQ ID NO: 43976 - DNA, 601 bp, Human
tacaggactagaactctctattttattttaacctagaacctacttttaaaaattttttaatgttgagttctgctagactagttataaaagcacaaaatacactaaagatgaagttggaaaacttgggttgccatcacaacactgccatttatttgccatataacctgagaaatgccacttaccctctctgagtctcattttccttatttgtgaagcgaaatgtattgttttgtgatgtaaatgaaacaatgcatgtgccgtgttttcttaaaaagttttgcttatagaaaggtgagaaatwcttatttttaagacggtatttctacaatgaaaatcaccttggttctagctaaaggatcagagaaatttcttttcttaaaaaacaatcaaccacgagtattgtactgcacatcaaaaaaaaaagggacaataataggatattttatgaacaaaaagcacaaaatgaaactatttctagtccttgacattctgaatataatatagattaatgtttttaaagctactgtttattgagtgttttctgttggtcatgccatgtgctatgggctttatatacagtaagatgcctatctctattgtt

SEQ ID NO: 43977 - DNA, 601 bp, Human
ttggaaaacttgggttgccatcacaacactgccatttatttgccatataacctgagaaatgccacttaccctctctgagtctcattttccttatttgtgaagcgaaatgtattgttttgtgatgtaaatgaaacaatgcatgtgccgtgttttcttaaaaagttttgcttatagaaaggtgagaaattcttatttttaagacggtatttctacaatgaaaatcaccttggttctagctaaaggatcagagaaatttcttttcttaaaaaacaatcaaccacgagtattgtactgcacatcaaaaaaaaaagggacaataataggatattttatgaacaaaaagcacaaaatgaaactatttctagtccttgacattctgaatataatatagattaatgtttttaaagctactgtttattgagtgttttctgttggtcatgccatgtgctatgggctttatatacagtaagatgcctatctctattgttaccaaccccagcctcagcacttggcacagtgcttaatatataataggtgtttaataaatattttattttctataactatgtgaggtagttgttattatcttcatttgatagat

SEQ ID NO: 43978 - DNA, 601 bp, Human
atttgtgaagcgaaatgtattgttttgtgatgtaaatgaaacaatgcatgtgccgtgttttcttaaaaagttttgcttatagaaaggtgagaaattcttatttttaagacggtatttctacaatgaaaatcaccttggttctagctaaaggatcagagaaatttcttttcttaaaaaacaatcaaccacgagtattgtactgcacatcaaaaaaaaaagggacaataataggatattttatgaacaaaaagcacaaaatgaaactatttctagtccttgacattctgaatataatatagaytaatgtttttaaagctactgtttattgagtgttttctgttggtcatgccatgtgctatgggctttatatacagtaagatgcctatctctattgttaccaaccccagcctcagcacttggcacagtgcttaatatataataggtgtttaataaatattttattttctataactatgtgaggtagttgttattatcttcatttgatagatgaggcctagacagttaaatcattttcttaagtggtagatgcaacactagaatcctgttccaggttttaacttttatggctcattctgtaacc

SEQ ID NO: 43979 - DNA, 601 bp, Human
cagaagcagaagaagcagcagtagcagctttagtgaaatatatgaatatattcatcatggtaataaatacaggcaataggcaacctaatggtgagtaaagtcagttttttccattaaaagagaaaaattaatttcatttccagaacattttgtattgtggaatttcagatataagtctgtggactgatactattttcctacgttttagtgttttagttttctcctgtttaaaatattctaggcagtgggttctttgaggtaagttcattcatttaactgtaataaggacacagcacatagstaaagcctccctctcattatcccttaagttttctgttcttcatcagagattacatctcatgatcttctctaactcctaaatatttatcctacaaatgttttcatcttgcttgcattttgcattcaaacatcgattcattcttttctgcttatagctgactcagtcatgaaacccatttcactcacataaatttgcattaggaaaacaaaatcacaaacaaacacaacaaaacaaaaacaaacaaaaaaaaactcaatcaagtcacaaatttaccaggagtttggggaagacataggcact

SEQ ID NO: 43980 - DNA, 601 bp, Human
tctgtggactgatactattttcctacgttttagtgttttagttttctcctgtttaaaatattctaggcagtgggttctttgaggtaagttcattcatttaactgtaataaggacacagcacataggtaaagcctccctctcattatcccttaagttttctgttcttcatcagagattacatctcatgatcttctctaactcctaaatatttatcctacaaatgttttcatcttgcttgcattttgcattcaaacatcgattcattcttttctgcttatagctgactcagtcatgaaacccwtttcactcacataaatttgcattaggaaaacaaaatcacaaacaaacacaacaaaacaaaaacaaacaaaaaaaaactcaatcaagtcacaaatttaccaggagtttggggaagacataggcactgacttgtggcaaggcagacaactcaaaatttaacactagacatcgcagctcctaaaaggcctgtgacaccttaacatgtagaaaaactttcctctcttttgtaatcctttctccttgacttgttctttttttttcctttttgtcattgttttacaccccaacttttattattgta

SEQ ID NO: 43981 - DNA, 601 bp, Human
agtttggtcttttgacataagaaggcaagacataatgccaggtaatctcagagcctatataacaaatctaaggtacacaatttcaaagtcaccatctgggaggattgggtgacccactggactcttcagggattaacaacagtactcagaatgctgatattaatgacattgcaaagcgaagctacatctttaaggaaactggagcattttgctgttttttcagccataagtgacaaagcatatattttattattaagaagcatgggttagttgcagaaataaggcaggggaacatcactcrtctagggtctcaagtcaaagaaaaaaagtggctcaagatgtgtcaactcagccagtggttttcaagtgagagtctaatacacacaggtgaggagggaacagcagatttactacaaataatttgctactacaaataatttatgtttgtaaattattttttcccataatttattctcattcttacacactttagtaggcaaagtgtgtgagaagcaaacagatgcaacatagcatattgtctggcacacagtcgttcggtaagtatctgataaccgagtatgtaaataatagctagaatctt

SEQ ID NO: 43982 - DNA, 601 bp, Human
agagatgttgtgaaaataaaagcaatacaaaaaacatgaatatatattttacccaaacttacttacattgtatcctgtttctctctctctctctcccagtctgagccattttaagggtaaattgcatagactgtaactctttacccctgaatattttagtgtgtatttcctaagaataggaatagactcatatagccacagaacagttttcaacttcagtaaactctatattgatataatgcttttatcaaatctactgtatatcagtttttaaaattagatataataatatcctcagtawttttcctctccaaaatagaatctagtctaggatcaaatagcatttagttttcatggttctttagtctgaaatatttccataaccttgtacatatgtgtctttatgtgcttgacagctctggaggatatagttcctcctcttcctcctcatttttttaatagaacattcttcattttgagtgtatctaatatttcttcatgactagatccaggtaatgcactattagccaaaattccacataggtgattatgcatctttctgagatggtgtcacatctggaggcacatcatgaccatctgt

SEQ ID NO: 43983 - DNA, 601 bp, Human
atcttgtacctacaatgctccaggcctgaaattagccatgactccaaggagtaatgttttctttcattgggaaggaaactcaagatcaagattcggaagcaagttttcctcaccagagagacacattttatctcacatcatgaataggacagggatgtggggtgtcttggtctataaggagtacacaagtgaatatagcagtgaggacagtaggacttgagaggagagcaaatgtcaaaattatactctgctctctcaataaatgcatatgaaatggaattgttacttttgattatacctyaaagttattgcttccttttctttcttggtctcgtgagaagtgtataatgcacttcccatggaacaaaatattcatagtcattgctaggacaaaggaactgttttatttttgtctactgaagttatttaagtaaactcagctttcctcttagatttcattgctgaaatagtgaagatgtgtaatttgtgaattgtgtaagagagacctcatggccgggtgtggtggctcacgcctgtaaacccagcaatttggaagtccaaggcaggtggatcacctgaggtcaggagcttgagaccagcc

SEQ ID NO: 43984 - DNA, 601 bp, Human
catgactccaaggagtaatgttttctttcattgggaaggaaactcaagatcaagattcggaagcaagttttcctcaccagagagacacattttatctcacatcatgaataggacagggatgtggggtgtcttggtctataaggagtacacaagtgaatatagcagtgaggacagtaggacttgagaggagagcaaatgtcaaaattatactctgctctctcaataaatgcatatgaaatggaattgttacttttgattatacctcaaagttattgcttccttttctttcttggtctcgtgwgaagtgtataatgcacttcccatggaacaaaatattcatagtcattgctaggacaaaggaactgttttatttttgtctactgaagttatttaagtaaactcagctttcctcttagatttcattgctgaaatagtgaagatgtgtaatttgtgaattgtgtaagagagacctcatggccgggtgtggtggctcacgcctgtaaacccagcaatttggaagtccaaggcaggtggatcacctgaggtcaggagcttgagaccagcctggccaacatagagaaaccccgtttctactaaaaat

SEQ ID NO: 43985 - DNA, 601 bp, Human
aatttgtgaattgtgtaagagagacctcatggccgggtgtggtggctcacgcctgtaaacccagcaatttggaagtccaaggcaggtggatcacctgaggtcaggagcttgagaccagcctggccaacatagagaaaccccgtttctactaaaaatacaaaaattagccaggcatggtggcacatgtctgtaatcccagctacttgggaggctgaggcaggagaatcgcttgaacccaggaggcagaggctgcagtgagcctagatcatgccactgcactccagcctgagtgagactcttyccataaataaataaataaataaataaaaataaaataaaaacctcatgtttctagataaagcaaagaaaaataagtctgtattataagaagttttctgattaggttaaataggggaccctgtgcagtgtcagttgtcacattaaaacagaaattttctctcatgaaactctctatccattatgtcctgtatttcagagtttacaagagattttttgtttactttttcttttatttatttttttaatagcactgttggagaatgggacatggggactgaaatttcaatgaattggttaaaag

SEQ ID NO: 43986 - DNA, 601 bp, Human
aataaataaaaataaaataaaaacctcatgtttctagataaagcaaagaaaaataagtctgtattataagaagttttctgattaggttaaataggggaccctgtgcagtgtcagttgtcacattaaaacagaaattttctctcatgaaactctctatccattatgtcctgtatttcagagtttacaagagattttttgtttactttttcttttatttatttttttaatagcactgttggagaatgggacatggggactgaaatttcaatgaattggttaaaagtaatcaaactgactaggwttacatcctagctcaaccacttcctagatgtgtgaccttgggtatgttatttaacttctcatatgtaaaatgtggataacaataataatgtataagattcaaagaattaaatgatgcaatacatataaggtagttagaacattttttcaacaaagggcacaacagtattgtgttaagctgtggttagttactgacaacttagcaatcattaacttctctggcaattagcttaacaaagtaagtttacagtgagtcctgagaaaatatattataatggcctacatttagtggaaaaataag

SEQ ID NO: 43987 - DNA, 601 bp, Human
ctgtggttagttactgacaacttagcaatcattaacttctctggcaattagcttaacaaagtaagtttacagtgagtcctgagaaaatatattataatggcctacatttagtggaaaaataagggaaaggggaggatggaaaattcatgaagatagaaccaaaaataaataatgtttctggagacagataggatttcaggacaagtttcaaaaatgaggtgacagcaggaacaaaggtatcttctgttacccaaaagggaaaaaggagacaggaacaaggaacaacttcttggcgtttaayggtgtgtttccaattctgagcacagtggctgcctatagtaggtgctcattaagtattggctgacagactgataaatcaataaataaaagaaaactaccttcattgtaaaacttacatataccaagaatagtgtaaaatcaaattaatcataggtaggaccaagtcaatcttggttgatcatatattgtttcaaaccacccccttctaacaaatgcagtttatgactatggaaacttactattggaggagacttctcagtatattcagtccgacatcccacactatgctaagatgcccatt

SEQ ID NO: 43988 - DNA, 601 bp, Human
tgatcatatattgtttcaaaccacccccttctaacaaatgcagtttatgactatggaaacttactattggaggagacttctcagtatattcagtccgacatcccacactatgctaagatgcccattgggataacaccaccatgtgacccatcaagggaaaacctaccccacaagggaaaacatgaagttctttaggctaaaccaaaatctaattccattcgacttaaatagagccatccatgaacctggtattatggtatactatggaagtacaaaaaaatacaaagatgacttacacagyttatcttactgaaaagctcaccatcaagtgaagaaactccacgtaaatacataaaatggtaattgatataaaatgaggtaggaacccagatacaccagaaatatttcctaaggaggtgaaaatagaattggatcttgaaatatcagtaactgctcactgagcagagaagaggaggagaggcatttccagcagagggaacaacatatgcaatgacacagaggtgtgaaagtgtgagatgagttaccaaaaaatgagaagttctacgtggctagaatattgagtttgtagtgggaaataaca

SEQ ID NO: 43989 - DNA, 601 bp, Human
gagcaatctacagagtggtaaatgagctgtgggctttaatgagaaacaagggaagttttgaaatttttaatgacatttaaacaagaatagtgtgtgtatttgcagagaaaagccagctggaaaactacaatgaagcctccataggtaatctagttttcagtcttcctgcctgagaaatggacttccttagttcatgcaacaacaacaacaaaaaaaaaggtcacacagattcaaaaaataaattcatttgacactaattgtataaactagatagccaaggagatagttaacatggagtgaygcattctagtaattggaaggctaaactatttccctagtatcttcctcactaattctgagggaatcagaaactcagtagtttggtgtaccctgactccgagagaggcagaaggttttgaaagatgattgccagaccaggaaaacctttccgggcctgttttaattaatcccccagatttaccaccttgataaccacattggtattctgatcaggcaataatcctgataataacaataagaattcctatgtgccagacattaatactcctcacatgttatcttatttagtcctcacaacagt

SEQ ID NO: 43990 - DNA, 601 bp, Human
agcaatctacagagtggtaaatgagctgtgggctttaatgagaaacaagggaagttttgaaatttttaatgacatttaaacaagaatagtgtgtgtatttgcagagaaaagccagctggaaaactacaatgaagcctccataggtaatctagttttcagtcttcctgcctgagaaatggacttccttagttcatgcaacaacaacaacaaaaaaaaaggtcacacagattcaaaaaataaattcatttgacactaattgtataaactagatagccaaggagatagttaacatggagtgacrcattctagtaattggaaggctaaactatttccctagtatcttcctcactaattctgagggaatcagaaactcagtagtttggtgtaccctgactccgagagaggcagaaggttttgaaagatgattgccagaccaggaaaacctttccgggcctgttttaattaatcccccagatttaccaccttgataaccacattggtattctgatcaggcaataatcctgataataacaataagaattcctatgtgccagacattaatactcctcacatgttatcttatttagtcctcacaacagtc

SEQ ID NO: 43991 - DNA, 601 bp, Human
gatgtgtatttatccaagctaaagagcttttgtttaatttttcatgatttgaactcactgctgtggaaaatggctatttaaaagggataatgtcattttccaagaattcaattgagggtcctagaagatctttatggagcaaaataataatacaccttttctaagtatagagtcaggcattaagacatatagacatttcacttccttgggataagtcttgggaaaaatatcactacacattagcaatacatattgcaaataaaatttataactctattttatgcatttattaaacaaataygagttaaaagacttcaggagttttggtctgtagcccaggctggaatgcaacggtgcaatcttggctcactgaaacctctgcctcccgggttcaaaggattctcaagccacagtctcccgagtatctgggactataggtgtgtgccaccatgcctcgctaatttttttgtatttttagtagagatgggatttctccatattggctgggctggtctcaaactcctgacctcaagagatccaccaccttagcctcccaaaatgctgggattacaggcttgagccaccacacctggcctaactt

SEQ ID NO: 43992 - DNA, 601 bp, Human
tgcctcccgggttcaaaggattctcaagccacagtctcccgagtatctgggactataggtgtgtgccaccatgcctcgctaatttttttgtatttttagtagagatgggatttctccatattggctgggctggtctcaaactcctgacctcaagagatccaccaccttagcctcccaaaatgctgggattacaggcttgagccaccacacctggcctaacttcaaggtatcaaagacaaattaacaatgtctgatgcatacataggactgctttgtaatcttctacactaatgatttgtastattttggtttcagaatccatttataactcttacaatatatgaaaaatttctgccagcttttatttatgtgggttatatttatgactacttctcatttgtaaaactgaaataaaaagatcttgcatatttgtattaatttatttaaaaaattaatttgttatgtgatagtataaataatataattttaatatttcaaaaatactaagtggaatgagattactttatattttttaaaaacacactacatctgactacttctacattcaatatattataatttattgtttggttgaagaact

SEQ ID NO: 43993 - DNA, 601 bp, Human
ttcatttttactgcaagtctgtggctggtgaagaatataataattacagtacacttggttgccactaccttgatttgtgctaagacaccagaagatttgcccaccattgcttttgcaccatcagtgcaaatgtgaacacagaaaaaggcaaaatcacatcatagtatcattaggaaaatagttttgacattgcaaatcctctgaaagagtttcagggacttcaaggggtctgttggccccattttgttaagcaataaaatattgggattgtagaataatttcttttttaaaaataagggcrtctgggaagaccttattaatttcaaatacaattctgcattttcaggatgaaatgtcaaagaatgttgatatctaaaggcacatttgcgaaatccaaaaagacatggtggctaacaacgtacattatcaggcctttcctctagagattttggttcagtaggtctggcagtggaagtgggggtgtttatgacctccagtgagccacagtgacttatataataatgttatatatatatgtgtgtgtggagatatagatatatcacataattatttgtatttatatattaaaccttattatcaa

SEQ ID NO: 43994 - DNA, 601 bp, Human
ctaccttgatttgtgctaagacaccagaagatttgcccaccattgcttttgcaccatcagtgcaaatgtgaacacagaaaaaggcaaaatcacatcatagtatcattaggaaaatagttttgacattgcaaatcctctgaaagagtttcagggacttcaaggggtctgttggccccattttgttaagcaataaaatattgggattgtagaataatttcttttttaaaaataagggcatctgggaagaccttattaatttcaaatacaattctgcattttcaggatgaaatgtcaaagaatkttgatatctaaaggcacatttgcgaaatccaaaaagacatggtggctaacaacgtacattatcaggcctttcctctagagattttggttcagtaggtctggcagtggaagtgggggtgtttatgacctccagtgagccacagtgacttatataataatgttatatatatatgtgtgtgtggagatatagatatatcacataattatttgtatttatatattaaaccttattatcaatacaaagagcacacacccacacacttatttttgtgggggcagggtaaaaggtgttttcctgcaa

SEQ ID NO: 43995 - DNA, 601 bp, Human
gaaaattgcacagtaaaagcacacactgttgagctatgaaaatgaagcagttttttttttatagtaaatagtaggtcattgtgtttcccaaacgtgatctaattggctattacaaattatctggcacatatattgattccagatgtgattagtgttcacttggttttagggttttacatatacgccaatttggcagtcctaacgtgttgatgttgataatgtttcatggccaaaactagaatatattttcataatacacacacacacacacacacacacacacacacacacacacacactstatagctggatcctaggaaactttaattttagtaaatgcctcagatgatttttatgatcaggcatacagggcagctctgctctatagctggttactatattcacatttcttttcttaagatgtaataattaatggagggggagcagattttataatcaactgtagaaatatggttataaaaactcgttatttcatggcttatacttctcttcattgcaagctcctcttacctcaaggacagaaaaaaatgatgctgtttctatgaaaagatttttctgtttagtaaaatctctagtgtaa

SEQ ID NO: 43996 - DNA, 601 bp, Human
tggcacatatattgattccagatgtgattagtgttcacttggttttagggttttacatatacgccaatttggcagtcctaacgtgttgatgttgataatgtttcatggccaaaactagaatatattttcataatacacacacacacacacacacacacacacacacacacacacacactgtatagctggatcctaggaaactttaattttagtaaatgcctcagatgatttttatgatcaggcatacagggcagctctgctctatagctggttactatattcacatttcttttcttaagaygtaataattaatggagggggagcagattttataatcaactgtagaaatatggttataaaaactcgttatttcatggcttatacttctcttcattgcaagctcctcttacctcaaggacagaaaaaaatgatgctgtttctatgaaaagatttttctgtttagtaaaatctctagtgtaaaaggagtggcctgttttcaatttgcaagtctgatcattagcctttgattcatataacataaatagacttctttgatatctaaaaagcttggctatattaaagtaagaaagtaatagatact

SEQ ID NO: 43997 - DNA, 601 bp, Human
atttggcagtcctaacgtgttgatgttgataatgtttcatggccaaaactagaatatattttcataatacacacacacacacacacacacacacacacacacacacacacactgtatagctggatcctaggaaactttaattttagtaaatgcctcagatgatttttatgatcaggcatacagggcagctctgctctatagctggttactatattcacatttcttttcttaagatgtaataattaatggagggggagcagattttataatcaactgtagaaatatggttataaaaactcgytatttcatggcttatacttctcttcattgcaagctcctcttacctcaaggacagaaaaaaatgatgctgtttctatgaaaagatttttctgtttagtaaaatctctagtgtaaaaggagtggcctgttttcaatttgcaagtctgatcattagcctttgattcatataacataaatagacttctttgatatctaaaaagcttggctatattaaagtaagaaagtaatagatacttgcatttccacattacaagtgagcaacagagaaaacaaaattagtacttgttgagcacctgatacc

SEQ ID NO: 43998 - DNA, 601 bp, Human
ctaggaaactttaattttagtaaatgcctcagatgatttttatgatcaggcatacagggcagctctgctctatagctggttactatattcacatttcttttcttaagatgtaataattaatggagggggagcagattttataatcaactgtagaaatatggttataaaaactcgttatttcatggcttatacttctcttcattgcaagctcctcttacctcaaggacagaaaaaaatgatgctgtttctatgaaaagatttttctgtttagtaaaatctctagtgtaaaaggagtggcctrttttcaatttgcaagtctgatcattagcctttgattcatataacataaatagacttctttgatatctaaaaagcttggctatattaaagtaagaaagtaatagatacttgcatttccacattacaagtgagcaacagagaaaacaaaattagtacttgttgagcacctgataccttgtacattttcaaataaatcacttgaaatttgcaattacaccatgagacaggttttcccttgattttacggatagggaacctgatagtcacatggttgataacaaccatagttaagtctactatt

SEQ ID NO: 43999 - DNA, 601 bp, Human
ttgtcagaggaggcctactggatagttaggtcttctagcactgtctagtggtaattaggccacccaatccatggcattaggggaaagtagttgaggagcagtaatgaggggtattcttacctctcctagcaaggaagacatcagtagaggcctagtggggagccaggtcggtggggaacttggacttctattgctacttaaaagtaataatgcagtgtttcccttctgctggagctgagtcagagaaagccaggagattatacatttttttttttttgagatggagtctttgctgtgttgyccaggctggtgtaaagtagcgtgatctcagcccactgcaacctccacctcccagagtagctgggattcccctgcctcagtttcccgagtagctcagattgcaggtgcccaccaacaagcccggctaattttttttatatttttagtagagacaggatttcactatgttggtctggctagctcccaactcctagcttcaagtgatccacccactttggcctcccaaagtactgggattacaggtgtgagccactgcgcccagctgagattataaacttttataaaacagaagatttaataa

SEQ ID NO: 44000 - DNA, 601 bp, Human
agacatcagtagaggcctagtggggagccaggtcggtggggaacttggacttctattgctacttaaaagtaataatgcagtgtttcccttctgctggagctgagtcagagaaagccaggagattatacatttttttttttttgagatggagtctttgctgtgttgtccaggctggtgtaaagtagcgtgatctcagcccactgcaacctccacctcccagagtagctgggattcccctgcctcagtttcccgagtagctcagattgcaggtgcccaccaacaagcccggctaatttttttwatatttttagtagagacaggatttcactatgttggtctggctagctcccaactcctagcttcaagtgatccacccactttggcctcccaaagtactgggattacaggtgtgagccactgcgcccagctgagattataaacttttataaaacagaagatttaataagatctgtagtctcataaaatacccaaaatgtccaggttgaaaacagaaaataatcccttatcatactaagaaaagttacatccttgaattaaaaaaaaaaaaaagacagcagacgttaacactgaagtaacagat

SEQ ID NO: 44001 - DNA, 601 bp, Human
ttaaaaaaaaaaaaaagacagcagacgttaacactgaagtaacagatatgttaaaattatctcaaataataggttgaagcaaaagtaattgtggtttttgccattgaacagaatggtgaaaaccgcaattacgtttgtaccaagttaatagatttaaaacactcatttttgaattcctcaatgaataattataaacatagttgaaacaaatgaaaaaaatagaatgacttcgcaagaaaatggaagatatcacaaagaacaaaacaaaattagaactaaaaaatacagttaccaaagtaamagtctcaatactaggttcaacagcagaatggagaggaaagaagaaagaataagtgaactggaagatagaaaaatagaaattaccaaatctgaaaaacagaaaacacactggaaaaaaaattaaaaaggctcaaagagttgaataactacatgaaaatgattgaacttttgtgttattagtgtcctagaaagaggggagaaaaatcagttctaagaactcaatgaaatagtgactgaaaacttcccaaatttagcaaaagaaactacaaattaaagaatcagagttaaacccaatttaata

SEQ ID NO: 44002 - DNA, 601 bp, Human
atgaataattataaacatagttgaaacaaatgaaaaaaatagaatgacttcgcaagaaaatggaagatatcacaaagaacaaaacaaaattagaactaaaaaatacagttaccaaagtaaaagtctcaatactaggttcaacagcagaatggagaggaaagaagaaagaataagtgaactggaagatagaaaaatagaaattaccaaatctgaaaaacagaaaacacactggaaaaaaaattaaaaaggctcaaagagttgaataactacatgaaaatgattgaacttttgtgttattagygtcctagaaagaggggagaaaaatcagttctaagaactcaatgaaatagtgactgaaaacttcccaaatttagcaaaagaaactacaaattaaagaatcagagttaaacccaatttaataaatcccatagcaatccacatcaaaatatatcactattaaacttctaaaaactaaaacaaatattcaaagtagtgagaaattaattatatcttatctattgtggaaaaaaatgaatgacagatctttcctttgacactatggaggccagaaggtggcactgcatttttcaaatgctgaaaa

SEQ ID NO: 44003 - DNA, 601 bp, Human
aaatacagttaccaaagtaaaagtctcaatactaggttcaacagcagaatggagaggaaagaagaaagaataagtgaactggaagatagaaaaatagaaattaccaaatctgaaaaacagaaaacacactggaaaaaaaattaaaaaggctcaaagagttgaataactacatgaaaatgattgaacttttgtgttattagtgtcctagaaagaggggagaaaaatcagttctaagaactcaatgaaatagtgactgaaaacttcccaaatttagcaaaagaaactacaaattaaagaatcwgagttaaacccaatttaataaatcccatagcaatccacatcaaaatatatcactattaaacttctaaaaactaaaacaaatattcaaagtagtgagaaattaattatatcttatctattgtggaaaaaaatgaatgacagatctttcctttgacactatggaggccagaaggtggcactgcatttttcaaatgctgaaaaaaatgaactgttaacccagtgttctatgcccagggaaaatactcaggaatgaaggagaactcaaggtctcctcagatgaagtaaaatgaaaagattttgt

SEQ ID NO: 44004 - DNA, 601 bp, Human
ctagattttatttaaaaatgacctatattgagcctagaggaaattcactttagatataacaatatttgtgaaagttaaaggatggaaaaaatcataaaacattaatcaaaacaaagttaaagtggctatattaatatctaataaaatagacttcagagcaaaaacaattattggagtaagagaggcacattttatcaagattaatgagtcaatccagtaagaagacatcacaatcctaaatgtgtatgcaccaaacaagcttaaaatttgtgaagcaaaagctggtagagctaaaaggaakaaatagacaaattcacaattacagttggagaattcaatactgctgtttaaccaacaggactaggcaaaacatctgcagtgataaagaacttaacaccatcagccagaagaatctaatcaacattgatagaacattccattcaataacaacacaacaaaaaatatttatttgaagtgctgataaaacatatgctaaacatatgactgccccttgagccataaagcaaatatcaacaaatttaaaaagattggaattatacagactgtgttctcctaccccaatggaatcaaactagaaatc

SEQ ID NO: 44005 - DNA, 601 bp, Human
aaagattggaattatacagactgtgttctcctaccccaatggaatcaaactagaaatcaataacatgagggaaagatcttcaaacacttagaaactaaacaaagcacttctaaataacccaaggagtaaagagaaagacttaaggaaaataaaatacatttaaataaataaaattaaaaaccaaacttaccaaaatttgtcagacatactataaaattgtgctgagagggggaagtatagtactaaatgcacacatgtggaaagaggtaaagtctcaagtcagtaatacaaactcaaactmcagaacctagaaatagaagagcaaaataaaaccaaagcacagagaatgaaggaaataataaagataggagcagaaagcagtgaaattaaaaacaggaatcaatacaggatatgaatataacaagcagctggtttttgggaaatattaataaaattgacgaattagcaagattgaaaagggaaaaagagaaaagacacaaattaccaatatcaagaatcaaaaaagggatatcaatacagatcttgcagacatcaaaagggtaataaaagcgtactatgagcactctatgtacataacatt

SEQ ID NO: 44006 - DNA, 601 bp, Human
gtatagtactaaatgcacacatgtggaaagaggtaaagtctcaagtcagtaatacaaactcaaactccagaacctagaaatagaagagcaaaataaaaccaaagcacagagaatgaaggaaataataaagataggagcagaaagcagtgaaattaaaaacaggaatcaatacaggatatgaatataacaagcagctggtttttgggaaatattaataaaattgacgaattagcaagattgaaaagggaaaaagagaaaagacacaaattaccaatatcaagaatcaaaaaagggatatcamtacagatcttgcagacatcaaaagggtaataaaagcgtactatgagcactctatgtacataacatttgacaacttagatgaaatgaactaattcctaaaaaagcgcaaactataccactcacccaataagaaatagacaacttgaatagccctataaatgtaaaggaaattgaattggtaattttaaaactaccaaaatagaaatcctaaggaatagaatgttttccttgagaatcaaccaggaatttaacaaattaacataaattctatacaatctgttccagaatgtagaagggaaca

SEQ ID NO: 44007 - DNA, 601 bp, Human
accctatttcagtcaagcaaggagcaatacttacttttatttattgacctttcttgatgcataaacatcaagagaaccaatgtgtaacatcatccaagataatatcaacagttatcaatatatgtgagaaaagacttagggaggacttccaatatatattttattctaaattttacattatacaaacagctattatcactttgttttctgccaatttgagatgaataattattgtgccagagaataaaataattgctcagtgagtatgcaattcatctgaatctatggatcatttacagasaatctccttaaaatatgcatcataattttaatcactaacatatacccaaatccctaattttgtaagtacttctaaaacatatctaatgatctttgtaatcattcttcttagacgtatttactttgtttttatttatccaccagcattagcaattgcttatttttgttgcttactttataaagaaagattttccatatcaatcaatttttatggccactatttatgttattgtaaagtaagaacaaaggtaagaccttttgctcaactttcagttgagtttaaatccttgctttgggagag

SEQ ID NO: 44008 - DNA, 601 bp, Human
tcaatatatgtgagaaaagacttagggaggacttccaatatatattttattctaaattttacattatacaaacagctattatcactttgttttctgccaatttgagatgaataattattgtgccagagaataaaataattgctcagtgagtatgcaattcatctgaatctatggatcatttacagagaatctccttaaaatatgcatcataattttaatcactaacatatacccaaatccctaattttgtaagtacttctaaaacatatctaatgatctttgtaatcattcttcttagacrtatttactttgtttttatttatccaccagcattagcaattgcttatttttgttgcttactttataaagaaagattttccatatcaatcaatttttatggccactatttatgttattgtaaagtaagaacaaaggtaagaccttttgctcaactttcagttgagtttaaatccttgctttgggagagcttccaagatgactgaacaggaagagctctggtctacatctcccagggagatcaatgcagaagatgggtgatttctgcatttccaactgaggtatctgattcatctcattggga

SEQ ID NO: 44009 - DNA, 601 bp, Human
caaacagctattatcactttgttttctgccaatttgagatgaataattattgtgccagagaataaaataattgctcagtgagtatgcaattcatctgaatctatggatcatttacagagaatctccttaaaatatgcatcataattttaatcactaacatatacccaaatccctaattttgtaagtacttctaaaacatatctaatgatctttgtaatcattcttcttagacgtatttactttgtttttatttatccaccagcattagcaattgcttatttttgttgcttactttataaaraaagattttccatatcaatcaatttttatggccactatttatgttattgtaaagtaagaacaaaggtaagaccttttgctcaactttcagttgagtttaaatccttgctttgggagagcttccaagatgactgaacaggaagagctctggtctacatctcccagggagatcaatgcagaagatgggtgatttctgcatttccaactgaggtatctgattcatctcattgggactggtcggacagtgggtgcagcccacagaaggtgaaccaaagcaggatggggggtcacctcacctggg

SEQ ID NO: 44010 - DNA, 601 bp, Human
tgctagtgcagcagtctgagatagacctggcatgctggagcttggcagggagaggggcatccaccattgctgaggcttgagtaggcgattctatgctcacagtgtaaacaaagcagcagggaaactagaactgggtggagcccactgcagctcagcaaggcctactgcctctttagattccacctctgggggcagggcatatctgaacaaaaggcatcagacagcttatgcagaattaaacgtccttgtctgacagctctgaagagagcagtggctcttggagcacagcgttcgagctccrataatggacagacggcctcctcaagtgggtccctgaccccgtgtagcctgactgggagacactacccagtagaggccgacagctgcctcatacaggcaggtgcccctctgggacgaagcttccagaggaaggatcgggcagcaatatttgctgttctgcaggctccattggtgatacccaggcaaacagggtctggagcggacctcaagcaaactccaacagacctgcagctcaggggcctgtctgttacaaggaaaactaactaacagaaaggaataccatcaacatcaaacaaacagg

SEQ ID NO: 44011 - DNA, 601 bp, Human
aacaaaacaaaagaaaaaagcaggggttgcaatcctggtctttaaactaacaaaaatcaaaagaaaaaaagaaggccattacataatggtaatgggatcaattcaacaagaagagctaactgtcctaaatatacgtgcacccaatataggagcacctagattcataaagcaagttcttagagacctacaaagagagttagactcccatacaataatagtgggagactttaacaccccactgtcaatattagacagatcaatgagacagaaaattagcaaggttatccgggaattgaactcrgctctggaccaaatggacctaatagacatctacagaactctccaccccaaatcaacagaatatacgttcttctcggcaccacatcacactgtaaaattgaccacataattggaagtaaaacactccacagcaaatgtaaaagaacagaatcacaacaaactgtctctcagaccacagtgcaatcaagttagaactcaggattaagaaattcactcaaaaccacacaactacatggaaactgaacaacctgctcctaaatgactgctgggtaaataacaaaatgaaggcagaaataaagtt

SEQ ID NO: 44012 - DNA, 601 bp, Human
caagaaaatcccttcaaaaaaatcaatgaatccacgagctgtttttttgaaaagatcaacaaaatagatagaacattagcaagactaataaaagagagaagaatcaaatatatgcaataagaaatgataaagaggatattgccactgatcccccagaaatacaaactaccatcagagaatactataaacacctctatgcaaataatctagaaaatctagaagaaatggataaattcctcaacacatacaccctcccaagactaaaccaggaagaagttgaatctctgaatagaccaataayaggtgctgaaattgaggcaataattaatagcctaccaactaaaaaaagtccaggatcagatggattcacagccgaattccaccagaggtacaaagaggagctggtaccattccttctgaaaatattccaatcaatagaaaaacagggaatccttcttaattcattttatgaggccagcatcatcctcataccaaagcctggcagagatacaaccgaaaaaggagaattttaggccaatatccctgatgaacatcgatgcgaaaatcctcaataaaatactggcaaactgagtccaacagc

SEQ ID NO: 44013 - DNA, 601 bp, Human
tggtcatcagagaaatgcaaatcaaaaccacaatgccataccatctcatgcctgttagaatggcgatcattaaaaggtcaggaaacaacagatgctagagaggatgtagagaaataggaacccttttacactgctggtgggagtgtaaattagttcaaccattgtggaagagagtgtgacgattcctcaaggatctagaactagaaataccatttcacccagcgatcccattactgggtatacccaaaggattatatatcatgctattgtaaagacacatgcacgtgtatgtttattgcgraactatttacaatagcaaagacttggaaccaacccaaatgtccatcaataatggacaggataaagcaaatatggcacatatacaccatggaatactatgcagccataaaaaatggatgaactcacaggtcagacccactgaaatagcaccaaatatcagatccaagggatgaacagagctctaaagtaaatcaaaagcccagaaatcaggagactaagaggcagtaaatcatgtgattaagaacatagattttagcatcaaacatgcctcattttgaatcccaaagctgctacatctagc

SEQ ID NO: 44014 - DNA, 601 bp, Human
ccaaaggattatatatcatgctattgtaaagacacatgcacgtgtatgtttattgcggaactatttacaatagcaaagacttggaaccaacccaaatgtccatcaataatggacaggataaagcaaatatggcacatatacaccatggaatactatgcagccataaaaaatggatgaactcacaggtcagacccactgaaatagcaccaaatatcagatccaagggatgaacagagctctaaagtaaatcaaaagcccagaaatcaggagactaagaggcagtaaatcatgtgattaagawcatagattttagcatcaaacatgcctcattttgaatcccaaagctgctacatctagctacataatctttggcaagctgcttattcttccctaagccttctttttctcaccataaaatggtgctaatatttgtagccatctaaagttacagctttgatttttagtacgatattgtaaaaatatatatgtaacaacgttcttagcacacaattactagatagacaaggaacttgctattaaaatatttgcattctagtgaggagaagcataagcaaaccagaaaagaaataagcacaaaatt

SEQ ID NO: 44015 - DNA, 601 bp, Human
agctgacttctctgatgaagctgaaaaccatcattctcagcaaaatatcacaaggacacaaaaccaatcaccgtatgttctcactcataagtgggagttaaacaatgagaacacatggacacaggatggggaacatccctgtttgggggtggggggctgggggagggatagtgttaggagaaatatctaatttaaataacgagctgatgggtgcagcacaccaacacggcacatgtacacctatgtaacaaacctgctcattgtgtacatctaccctagaacttaaagtataataatagtaataaaataaaataaaaattattgctttggcaaagaataaatggctatatcccattggctttaaaaatttgagtctaagcaatccattaaaataatctattttaacttaaaattttttatagatttaggggtacaatcatgattgtgttgcacagatatattgcacagtggtgaagtctgggctttgagtgcacctgtcaatcaaatagtgttcatagtgttactaagaaatgtttagaaatgtcataagaatcccaccatttttggagagagatcattaatactaaagacgcaagaccct

SEQ ID NO: 44016 - DNA, 601 bp, Human
attttgtgcagtgagtgacttcacttaccaatagaaggtgtgaaagcttatgaacctggtgaaagcttatgaacctggaattgtgactttagtgtataaataaacagaagaaaatgcagtaagaaaaagcatcagatttataggtgaaatacttaaaggatggcacttaaacagagtaagaaatatgacttgtatgtatactaaaagcaactgtggctcagattattccttctgaggttctatctgccattcatttcatggaatattgtggaattagcctatttcaccttctattaaatgrggcccactttatggtatcataagaaaactcaaggctgaggtgcactgattgcctcagctctggagtttgacacgagcccaggcaacatggtgaaaccccatctctactaaaaatacaaaaaattagccaggcatggtgatgcacccctgtagtctcagctactcagtaggctgaggctgcagaatcgcttgaacccaggaggcagaggtcgcagtgagccgagatcgcaccactgcactccagcctggatggagtttttccatctcaaaaaaaaaaaaaaaaaaaaaaataggtaaaccc

SEQ ID NO: 44017 - DNA, 601 bp, Human
aaatatgacttgtatgtatactaaaagcaactgtggctcagattattccttctgaggttctatctgccattcatttcatggaatattgtggaattagcctatttcaccttctattaaatggggcccactttatggtatcataagaaaactcaaggctgaggtgcactgattgcctcagctctggagtttgacacgagcccaggcaacatggtgaaaccccatctctactaaaaatacaaaaaattagccaggcatggtgatgcacccctgtagtctcagctactcagtaggctgaggctgsagaatcgcttgaacccaggaggcagaggtcgcagtgagccgagatcgcaccactgcactccagcctggatggagtttttccatctcaaaaaaaaaaaaaaaaaaaaaaataggtaaacccaaataatatgccttttaagaaaaagaagttgattttgctcttatgaaacaatatgaagttagatcttcaagatctggtagtgcaattctgtcatccttaactcacagcttccatctcttgatcttcatcctgttttcaccctaatcgaaagggtgaaagtgggaagaatagcgtatgact

SEQ ID NO: 44018 - DNA, 601 bp, Human
atcatgctattctgttttccataatcattatatattcttttttccccatggtatttcccaaaaatttattattccatgttttatgggtgaatagttatttctattaactacttttttagagtgaagaatcatcgacctcttctatcctaacatctactgttatcccctccatgctgaacaacaccaaaactatttttcatgtaggttgttcagggctttctctctattcacttaattattccatcaggagactattgagagaggcctataacataaaaacataagggttaaattcaaagcyatcgtcaatcttactcaaagacataaaccttagaacattataggaatcttcaaaaaagttagcttaattgattttaaaattatgccagcaactaaagctacatgttttagaaagagaaatatatgcctcatgtttattgattaaaaaacatttatagatactttgcaatatactaggaataaatgacatattctgccctcttgaaacttaatataattaagaactagattgtgaaaaactaattataatccaaagaaaataaatgattaaaagaggcaaatttaagtgtcattaaatgaa

SEQ ID NO: 44019 - DNA, 601 bp, Human
ccaattgacaatgttacagagctaacaggtagaaaacatggatcattagcaagggagatcatgtcctcaagtgttccaaatagaaaagccaagttttagatgcagctagagaaaagcagttaagagttggactacctgggtttaaattctagtactatcacttactagttaaatgacttttgtaaatttaacctgcccttgcctgaggtccctcacttacaaagtgataataatcacaatacctacctcatatgctattgtgaagattacataagtcagtatttgtaaattacttagaacyatccttttattgcaataatgaaagttccttaaagttactgtcttgcatgctgatgcacacactgtaattttctagccctatatagaagccaaattccaaacaatagactaggacttgagactcaaactggacaaaaattgtttcaggaaaatattagtcctaaattaaacttatatccaaagtgtaaagagcagcagaatgacagagtgacttttttttttttttttggagacagagtcccactctattgcccaggctggagtgcagtggagcgatcttggctctctgcaacctgtgtct

SEQ ID NO: 44020 - DNA, 601 bp, Human
agttaaatgacttttgtaaatttaacctgcccttgcctgaggtccctcacttacaaagtgataataatcacaatacctacctcatatgctattgtgaagattacataagtcagtatttgtaaattacttagaaccatccttttattgcaataatgaaagttccttaaagttactgtcttgcatgctgatgcacacactgtaattttctagccctatatagaagccaaattccaaacaatagactaggacttgagactcaaactggacaaaaattgtttcaggaaaatattagtcctaaatyaaacttatatccaaagtgtaaagagcagcagaatgacagagtgacttttttttttttttttggagacagagtcccactctattgcccaggctggagtgcagtggagcgatcttggctctctgcaacctgtgtctcccaggttcaaacgattctcctgcctcagcctctcgagtagctgggactacagacatgcaccatcacccctggctaatttttgtatttttagtagagacaccatgttggccaggctggttttgaacccctaatgtcaagtgatccacctgtctcggcctcccaaag

SEQ ID NO: 44021 - DNA, 601 bp, Human
tgaggtccctcacttacaaagtgataataatcacaatacctacctcatatgctattgtgaagattacataagtcagtatttgtaaattacttagaaccatccttttattgcaataatgaaagttccttaaagttactgtcttgcatgctgatgcacacactgtaattttctagccctatatagaagccaaattccaaacaatagactaggacttgagactcaaactggacaaaaattgtttcaggaaaatattagtcctaaattaaacttatatccaaagtgtaaagagcagcagaatgayagagtgacttttttttttttttttggagacagagtcccactctattgcccaggctggagtgcagtggagcgatcttggctctctgcaacctgtgtctcccaggttcaaacgattctcctgcctcagcctctcgagtagctgggactacagacatgcaccatcacccctggctaatttttgtatttttagtagagacaccatgttggccaggctggttttgaacccctaatgtcaagtgatccacctgtctcggcctcccaaagtgctaggagtacaggcgtgacccactgtgcccggcct

SEQ ID NO: 44022 - DNA, 601 bp, Human
tcacttacaaagtgataataatcacaatacctacctcatatgctattgtgaagattacataagtcagtatttgtaaattacttagaaccatccttttattgcaataatgaaagttccttaaagttactgtcttgcatgctgatgcacacactgtaattttctagccctatatagaagccaaattccaaacaatagactaggacttgagactcaaactggacaaaaattgtttcaggaaaatattagtcctaaattaaacttatatccaaagtgtaaagagcagcagaatgacagagtgacttttttttttttttttggagacagagtcccactctattgcccaggctggagtgcagtggagcgatcttggctctctgcaacctgtgtctcccaggttcaaacgattctcctgcctcagcctctcgagtagctgggactacagacatgcaccatcacccctggctaatttttgtatttttagtagagacaccatgttggccaggctggttttgaacccctaatgtcaagtgatccacctgtctcggcctcccaaagtgctaggagtacaggcgtgacccactgtgcccggcctgatagaatg

SEQ ID NO: 44023 - DNA, 601 bp, Human
catcacccctggctaatttttgtatttttagtagagacaccatgttggccaggctggttttgaacccctaatgtcaagtgatccacctgtctcggcctcccaaagtgctaggagtacaggcgtgacccactgtgcccggcctgatagaatgcttttaaaagcaacctttaggatgaaattatgtccttccacaaattcttacaatctagtaaaaaaattaaatttgataagaacaaaaattggccataagtatgtgggtattgggtcttatacaatatcttggtgacactaccaaaaattyttgccttctctgatccagttgactatgtgccctggagtcctgtgataggaagctgatgaagttttcatccagagagtaagaaccagcatgatagggccttttctaccccaagagagtactctgtgaaaaagctgggttgcagctttttattccaatggatatgacaagaattaaaggaaataaaggaactatcataactgcaacagaacatctattgtctattttaaattttattgcaactaatggctttatatcaactgaaagaatgtaacagaataattaagagcaaagcttggaagt

SEQ ID NO: 44024 - DNA, 601 bp, Human
tgatagggccttttctaccccaagagagtactctgtgaaaaagctgggttgcagctttttattccaatggatatgacaagaattaaaggaaataaaggaactatcataactgcaacagaacatctattgtctattttaaattttattgcaactaatggctttatatcaactgaaagaatgtaacagaataattaagagcaaagcttggaagtttggcagataattggccaaaattctgaccctgccacttatctgcttgtggtaggccgttctcacattgctttaaagaaatctcagactrggtaattaaaaaaaaaatggttttatttactcacagttctgtaggccgtacaggaagcacagtgctgacatctgcctggcttctggggaggctgaaacttacaattatggtagaaggcagagagcacgcacattatatcgccagagcaggagccagcgtgaagggtagcaggtgccacacacttttaaatcatcagatcttgcgagaactcactcactattgtgagaacagcaccaaacggatggtactaaactattcatgagaaatttgccccatgatcaaatcaccttccaccaggtc

SEQ ID NO: 44025 - DNA, 601 bp, Human
ccttttctaccccaagagagtactctgtgaaaaagctgggttgcagctttttattccaatggatatgacaagaattaaaggaaataaaggaactatcataactgcaacagaacatctattgtctattttaaattttattgcaactaatggctttatatcaactgaaagaatgtaacagaataattaagagcaaagcttggaagtttggcagataattggccaaaattctgaccctgccacttatctgcttgtggtaggccgttctcacattgctttaaagaaatctcagactaggtaattaaaaaaaaaatggttttatttactcacagttctgtaggccgtacaggaagcacagtgctgacatctgcctggcttctggggaggctgaaacttacaattatggtagaaggcagagagcacgcacattatatcgccagagcaggagccagcgtgaagggtagcaggtgccacacacttttaaatcatcagatcttgcgagaactcactcactattgtgagaacagcaccaaacggatggtactaaactattcatgagaaatttgccccatgatcaaatcaccttccaccaggtcccacctcc

SEQ ID NO: 44026 - DNA, 601 bp, Human
gatggtactaaactattcatgagaaatttgccccatgatcaaatcaccttccaccaggtcccacctccaaaagtggggattacatttcaacatgacatttgggctaggacacatatccaaactatatcattactgaatgaccttagataaaccacctatcctctttgagacttagtttcaacacctgaaagttggttaaataatatcttctttacagagttactacgaagatagccgggcgtggcgggtgcctgtaatcccagctactcagaaggctgaggcagaaaaatcgcttgaaccygggaggcggaggttgcagtgagcggagatcacaccactgcactccagcgcctgggcaacaagagcgaaactccgtctcaaaaaaacaaaactcaaaacaaaacaaaacaaaacaaaaacagagttgctatgaagatgaagttctataaaaacttaaggaaatgcagcctagcacctaccacataggaatagaaggtgtagtaatagcagtaatctttgttgtagagaggcaattaagtagtagagaagagaaaacacaaacaccgaggttaacaagtagagaagcccacttaaaataata

SEQ ID NO: 44027 - DNA, 601 bp, Human
ctgggcaacaagagcgaaactccgtctcaaaaaaacaaaactcaaaacaaaacaaaacaaaacaaaaacagagttgctatgaagatgaagttctataaaaacttaaggaaatgcagcctagcacctaccacataggaatagaaggtgtagtaatagcagtaatctttgttgtagagaggcaattaagtagtagagaagagaaaacacaaacaccgaggttaacaagtagagaagcccacttaaaataataaacactttaataacacaaaaacctttcttgaatttatggaaatgacttatmattcattgtgatttgtcattgtctttgtgcaaacaatgaaaagaatgagagcagctgttttcaaaccttatttgcattagaatcacctgtagaactggttaacacacacgatgggtccccacctgactttctgttcagtgactcactgttagggttagaggatttgtgtttgtaacaagtttacaggtgatgctgctaactctgggaccacatttttgaaaaacacaaaatatgtggagtgtttgtgccctgggctctgctgtaataattacatagtatgaaacactcatgcaccacttc

SEQ ID NO: 44028 - DNA, 601 bp, Human
aggtgtagtaatagcagtaatctttgttgtagagaggcaattaagtagtagagaagagaaaacacaaacaccgaggttaacaagtagagaagcccacttaaaataataaacactttaataacacaaaaacctttcttgaatttatggaaatgacttataattcattgtgatttgtcattgtctttgtgcaaacaatgaaaagaatgagagcagctgttttcaaaccttatttgcattagaatcacctgtagaactggttaacacacacgatgggtccccacctgactttctgttcagtgaytcactgttagggttagaggatttgtgtttgtaacaagtttacaggtgatgctgctaactctgggaccacatttttgaaaaacacaaaatatgtggagtgtttgtgccctgggctctgctgtaataattacatagtatgaaacactcatgcaccacttcatttgcttcgttactctattcctcataatcaaagaaatctcctgagtcaaattaaaagtattttctaataaacataaatgctaattaattacatttatggctgtagagctagcactttgagcaaactggaagttggttgaaa

SEQ ID NO: 44029 - DNA, 601 bp, Human
gtatttcttctgtaagtagtttaaattacaagccttttcaaagtattcagccatcaaatacagcctcctaaaaccattgtgcataaccttttgaagctgtgtacttaattcctcaatcaagttgcacattaggagagtaaattggaggaatataagtcagtgggtcttaagtcactttttaaaaaatcttcagatgcactaatgtacattttctatcttctttttatttcctcttctccaattccatctctgaaacactatgaaatgttaaaataggttaaaaatgcacttaaatgaaatkcaataaattaaatgtgctctattcttctgaagatttaactacacaccttttcatatttcagactcttagcaggtatgattaaagtgcaacatctgtaactcatcttcctcaaaggaaagatacggaattatatgagatgatttatgtgccaatgcctagccagtgactgttacatagtagttgctcaatttcttaaatcataattttcaaaggaacatggaacagttaccaggaagaaaatatgtcaaggcataagtttatagtgtaagattttaaaggcagaaggatttttggactgtc

SEQ ID NO: 44030 - DNA, 601 bp, Human
tggaggaatataagtcagtgggtcttaagtcactttttaaaaaatcttcagatgcactaatgtacattttctatcttctttttatttcctcttctccaattccatctctgaaacactatgaaatgttaaaataggttaaaaatgcacttaaatgaaatgcaataaattaaatgtgctctattcttctgaagatttaactacacaccttttcatatttcagactcttagcaggtatgattaaagtgcaacatctgtaactcatcttcctcaaaggaaagatacggaattatatgagatgatwtatgtgccaatgcctagccagtgactgttacatagtagttgctcaatttcttaaatcataattttcaaaggaacatggaacagttaccaggaagaaaatatgtcaaggcataagtttatagtgtaagattttaaaggcagaaggatttttggactgtcagaatatagaaggtgaaaatttcatatcaaggaaatcatatattcacaggtagtttttgaagcatgagctcaggtttagagaatggagatcagtccagcttaattcagtgcagtgcaaccctggtcacatgttagaacgacc

SEQ ID NO: 44031 - DNA, 601 bp, Human
cctcttctccaattccatctctgaaacactatgaaatgttaaaataggttaaaaatgcacttaaatgaaatgcaataaattaaatgtgctctattcttctgaagatttaactacacaccttttcatatttcagactcttagcaggtatgattaaagtgcaacatctgtaactcatcttcctcaaaggaaagatacggaattatatgagatgatttatgtgccaatgcctagccagtgactgttacatagtagttgctcaatttcttaaatcataattttcaaaggaacatggaacagttaycaggaagaaaatatgtcaaggcataagtttatagtgtaagattttaaaggcagaaggatttttggactgtcagaatatagaaggtgaaaatttcatatcaaggaaatcatatattcacaggtagtttttgaagcatgagctcaggtttagagaatggagatcagtccagcttaattcagtgcagtgcaaccctggtcacatgttagaacgacccggagtggttttcaaactccaagtgcctgagtcccattctaaaccagttatatctgaatctctaggtatgagagctaagcatcaata

SEQ ID NO: 44032 - DNA, 601 bp, Human
gtatagtgcaaagaaatttccaagggtaagtcagtacagacactacccaactgtatatgcaaaaaggagcacaggaattggaatcaattattcagttcattgattccccaactactagctttaatgtatgtgttatttaacttctataagctgtagttttcacatttgtaaaactgaggtaatgataatattcatatcacaagtagccctgagattcaaatgagattatttacatgaaagatatttgaaaagctggatatatatgggcactattttggggtacttagaatttcctctttgrcttattcttccaaaacagagtcaaatctcagccagagaagctaccgatgttggagtaattatttctattttttttcaagttgacttcaccaaccaagaaaataaactctatgaaaagataaaatagaaaatagtttgttcacatttttatattatttgtcattcataacattttctctgttttgtcacttgacaggtgccagagtagagctctctaaaattccctcgtaggttttttggaaattgtctctcttattcccaatctctgtaggatatataagtgaaagattgagagtatttt

SEQ ID NO: 44033 - DNA, 601 bp, Human
tttttcttaataatattaggggcttttctagatgcaacatctgtcaggtcagtatagtagtgagtaatgaaataccagcctggctgaaaacgctcttaaaatgtcagtccattctacttcctaagacacctaagaacacctgatataggatgagagcaggcagcaggcaggtttctacagaacaatgaagtttaggaaggagggagatgcgtgatgctagggtggtacctaatggttgcagcaaaagagatacttttgcattgagagtgcaccatattcttggttagcagcaactatttaycacatgcaacatgattatagaaatactagttactactcaggaagtattcactttgcaccagatctgtactaggtgcttttatacctgctatcaaaattaatccttgccaccaactgataagtggacattatttacttcctctcttatcattgaagcccaaaaaatataaataacttgacaaggattatacttccagtatgtaacacagaatttaagccaagttctactcagttcaaaaatcttttttacagcagtatcttcaaagtggcatagatacactactgcaggttcacaaaaact

SEQ ID NO: 44034 - DNA, 601 bp, Human
acactactgcaggttcacaaaaactttctaaggggtacatggtgcagagagttttaagaaaatttatttttagctcatccttccaagcatacttttccaaatgaatctgattgagaagactcctgaagattctccttcaccaactctcctttcaaaatctcccttctctgatgtttcagaagagcctatcttccacctatcctgaattcattctcaatacagtctgctcccagaatgggaaaaacttccagagtgtttaacaagtggggaatccgaaacattggtgctagtgttgccaacrtgtataactttaattactaggcaacaaacttcttacaagttgggtagtttataaataaattcatcatttgtgaaattgcttttatcaaataattcttgcttgagttgtcagttgatggatcaaattgtaaaaactatttttttttttgctggattgtatcattattagcatatttagctcaaatgagttcaaaaagataagtaaaatttaaataaaaatttctttacccttatctagttatttatgggaacaaagcttcttggcagttatttatttttttaaaatttagaatataattga

SEQ ID NO: 44035 - DNA, 601 bp, Human
atcctcactaatatttttcaaatattttaagcataacatatataacatttagatataattgtgtagaaaaatagtatacaaatacaagttcaagtataaaaaggtaactccagaaagttacagactatcaaagaagagtttaagttgtttttgatatggatgatggaatcaaataattatggtggatacattttttgaaagtaatattatatgttcatttttaaattgacactatttgcaatatccttttattatatcctctgaaactatttatgattatgattaaaacaatttgatagtrcagtaggaaaattatagttaacaacaatttattctattgtatatttttaaatagctagaatagaagatttgtaagattcccaacacaaagaaaagataaatgatcgaggtgattgatattccaattactctgatttgatcattacaccttgtacattataggcatcaaaatatcacatgtaccccaaagatatgtacaattgttacataccaatgaaaaatataaaactttaaaaattcttttaaattaaaaaaatcagtttgggacctactttaaaaagtgtgagagtatacactttaa

SEQ ID NO: 44036 - DNA, 601 bp, Human
atatttttaaatagctagaatagaagatttgtaagattcccaacacaaagaaaagataaatgatcgaggtgattgatattccaattactctgatttgatcattacaccttgtacattataggcatcaaaatatcacatgtaccccaaagatatgtacaattgttacataccaatgaaaaatataaaactttaaaaattcttttaaattaaaaaaatcagtttgggacctactttaaaaagtgtgagagtatacactttaaaaagtgtgagagttttaaatttttcatttggtgctactcaragataaaatcttgaaaacaacttctatgaagaacattgtcctcagtgacatgatttattgctacatagcaaaggaagtaaaccattgtatttaggagcataagttctacactaaaacaggcatctgctctaaccttaacgtccaatttgttattttaccttagacaagttctttgtcccctctaagccctttctttccatttctataataatgtaggtacttaattggtcagatccttctaaatgtcacataaaattatgtcaagatctagaaaaatttctacacagattaagtgtcatg

SEQ ID NO: 44037 - DNA, 601 bp, Human
taccccaaagatatgtacaattgttacataccaatgaaaaatataaaactttaaaaattcttttaaattaaaaaaatcagtttgggacctactttaaaaagtgtgagagtatacactttaaaaagtgtgagagttttaaatttttcatttggtgctactcaaagataaaatcttgaaaacaacttctatgaagaacattgtcctcagtgacatgatttattgctacatagcaaaggaagtaaaccattgtatttaggagcataagttctacactaaaacaggcatctgctctaaccttaaygtccaatttgttattttaccttagacaagttctttgtcccctctaagccctttctttccatttctataataatgtaggtacttaattggtcagatccttctaaatgtcacataaaattatgtcaagatctagaaaaatttctacacagattaagtgtcatgtatgtatattcacagaagttgtcatagacaaaactgtgtaaaggagagggatgtgcatgttcttaggctaatctcccagagggatcagggattggtatggtctcccagaatgaataaaataagttcaaaaggaggtaaa

SEQ ID NO: 44038 - DNA, 601 bp, Human
ccaaagatatgtacaattgttacataccaatgaaaaatataaaactttaaaaattcttttaaattaaaaaaatcagtttgggacctactttaaaaagtgtgagagtatacactttaaaaagtgtgagagttttaaatttttcatttggtgctactcaaagataaaatcttgaaaacaacttctatgaagaacattgtcctcagtgacatgatttattgctacatagcaaaggaagtaaaccattgtatttaggagcataagttctacactaaaacaggcatctgctctaaccttaacgtcyaatttgttattttaccttagacaagttctttgtcccctctaagccctttctttccatttctataataatgtaggtacttaattggtcagatccttctaaatgtcacataaaattatgtcaagatctagaaaaatttctacacagattaagtgtcatgtatgtatattcacagaagttgtcatagacaaaactgtgtaaaggagagggatgtgcatgttcttaggctaatctcccagagggatcagggattggtatggtctcccagaatgaataaaataagttcaaaaggaggtaaaagga

SEQ ID NO: 44039 - DNA, 601 bp, Human
agatgttcctgtgaaagaggaattgaaatgtgaagagtcacaaattttacgctttctctggaaccagaaaccaaacttaaagtgttctccagaactggaaagcaaggggacacataacaggctgaaaagatctgctatgagtgttgttacagactgaagtgaaagtgactgctggttattataaaatgttcctatgacttgtccatattgaaacagaaattataggcagaatgaacaggagggaacacaaattggctcaacctcttttacctggttaagctctccattgtacccaaatttrggccatttaattccacaaatatttattgaatacacactgggtatccagaatgtaaagagtctcaatacggaatgaattttatttttgattttatattttgaaacagtcttcaagttatagttataaatcaaatgggataatcacataggttttcagtcattaaagtaaacatatttttttcatttttttttaatgaacaggatttgctagtccacttactgggatagcggatgcctctcaaagcagcatgcacaatgccttgcacatctatatgaatggaacaatgtcccaggtacaggg

SEQ ID NO: 44040 - DNA, 601 bp, Human
ttggggcatagattttgcttacctacggaatacttattttaaacgctttgtattgaagcattgttttcggtttagaacaacccatgtgaaattgtttttgttaaatatagtacactcataaaataggttttagctcaaggttgggggaataaacgggccattttatattggaaattttgattttgtgaggacgttctatggttgcaaccagtggttggaaaaactatctagtcttttgtatttgaaattctataaataaatacagcatctagctgaaaggtgtgcagatgtacataacaggagagttagttcaatagatgaaacattttaaataagtctcattggatctatttattgtaaaatttaatattcagttacaagcttgtggcatagaattacgggggactcttggaaacgggggcgaattgacaggtttcatggccatgtctttatctcgtttgccacaggaaaattaaagggtggtagtcttctttgtgtacctctgtggggtgtgtgtgtgtgtgtttgtgtgtttgtgtccgtcttccccacccccctttaaatataatcttttgtaatgtatagaattttgctgaatggt

SEQ ID NO: 44041 - DNA, 601 bp, Human
tacctcgcacaccctcttgggaatagtgttactctcttagaatcaaatggcttgaactttagattgctcttattctcttttttaatattcaggttttccttaactctttgctgcttcagaaaaagtttcgctcatcttattattcatttatcatctctgtttaagccaaaatttgactagaaccaagagtatatttattgctgctgataggaccacattagacttcctctgtggtagatttaattctgttagattgtaaaatagtcatgtctagacagaacattgatttcaaattgactatgaacatgaaaattccaggaatagtgtatagaggaaggaggaggaggaggagaaatcaagaaggtaagaaaactactgtagatagcaagtgactttctgtcattctccacctagatttcttgttagtcacttttgtatacccagtgcatctagaggtcaggctttgttttaataaagggacttaaaggaaatatgtttttgtctctgagattggattttttgaactgttagagtggtggacctaagggaaagaattggaaacttcatatggatagtgatcaagaatgtggtcgtagaggtt

SEQ ID NO: 44042 - DNA, 601 bp, Human
aagaaacaatggactaaatcgtctctatttattagtgggaatttaaaatatctttttttcttggacaacttctcttaaactttttaagtgttttaaaactttttagtagaagtaaagttttgaaagattctcaagtctgttttttaggtaccagctactttaagctttgaaaacacaaagctattcaatgactgtactttgagatcaatattttgaatgtggtataatattttggactaaaacttaagagtctgtcattcaaattcctactttcctactgactcttctttgacctttgacrgccattaagatttcactttactcaccctaaattaaagagggtgaaataggtattcattcacttaacaaatcaatattgaactacatgctagacactatggtaagtgcttgggatacattattaaacatgaagacagatatgattatgcctttctgaagcttatagtcataaagtaagtagtcaaatgaacaacataattacagattgtcatacgtgctcggacagaaactaacagggtgccgagaggattactctttatttgccttatcacatatcacatctgtttactttatctgccta

SEQ ID NO: 44043 - DNA, 601 bp, Human
aatattaacatttctgggtagtttccgtgttttatagttttttaagtgatttcatgtctgtttctgttgatcctatttgagcctgtttgaactaggttctgttttgttttaactcaaaccctgagataatgcaatttgcctgaagtcactaatcagtggagctagaactaaaaccctgattttcaagttcagtgttcttttgtagtagcaaaaaatgctttctggcttttagagagtccccttccactgtctcccatccttagtgtttgcagtgatttatagagttggttgctttgcagayaatctttgtaccacactttcagaaacccatgtttagagtctggggagccagaagtagcaatatagcaataataagcaccaaagcgaactctaattctagggcagattttttttttttttggagtaggggtcttgcttggctagcttgatgttgtaactataaatccacatgttaattgttgcctgaagtaaatttgtaggtaaatcctgccattgattgctgcagatgtgcttttctcaatcacttttgcttttgattaagaacatttaaaattgttttcctgggcagggcaccatggct

SEQ ID NO: 44044 - DNA, 601 bp, Human
ttgtttctttctgaatttattgctgctaaaataaaaccaccacgaggatagggattgtggccctcgtgtttattaccacagtcctagtgtccagtgctcaataaatactgttgaataaattaatatgaaagtcttcctttttcctctcaccgtccagtttcttcaaatgattcctctgtatgtggctccacatccgtaccttttgttccctctttaaccaactgttaacctaaagtaagtgacataattctctcaaagattaaggattttttagtagcctaatctaaagcattcttattakatttgattatgaattgacttttctataagtttgacgctattgtctgcctgtttcttctcaaagttctcttgtcctgttacactcccaattctgtagccccttgctacctcagtattcattctgcccatcctttttgtgttgctgtttctcagagtttaatccttaatggaattttgctctacatacccttcctgttgaagtaatcccatctcatcttcactttttgactaagtgtaggagatgtccagagttaccttgctgattctgatctccctcctgagctccaaacttatttattag

SEQ ID NO: 44045 - DNA, 601 bp, Human
gcatacgcaagagctttgaggcagtcaagatgataatatttatagataatgctgaaaactccctttagacaggagagaagaagtggaaaatgtaatggcagataacgttagaaaaataagttgggcacagatgaaatggagcctgggatgccatgttttaagatttttctttccttttttccactgtagcagtgggcaacctttgtgtattgttaaaaagtagaaaataacaccaactcttgaattttgaagaaaggttctgtattttctggaagtatctgatgtggataatctgttcccygccccccccaaggttttagtcatttctgtttctgttatattttattttattttatttatttatttatttatttatttagagacagggtctccttctgtagcccaggctggagtgcagtgacgggaacatggcttactacagcctccacctcccaggcccaagcgatcctgtcacctcagcctcctgagaagctaggaccacaggcatgccaccacacctggctaattttttaattttttttgtagaaatagggatcttgccatgttgcccaggctggtctccacctccagggctcaagca

SEQ ID NO: 44046 - DNA, 601 bp, Human
atatagtttatatttaaatgcaaaattgcatgagaaaccagatgaataccagctgagtaactaagaaatccaggacaaagaaaaatcaagaggcaaagtaggctggaaagcttcatgaaggaaatgggacttcagtgaaccttgaaagatgagttaaaatctatatagctggaaaagtggttgtggttgagggggtgagaagttgcggggaaggcaagggaaggggcatgaactaagatggggtgggacagtgagaacagtatgtttgcagtgtagggtttagaactgggttgggagggtmaattattgccaggttatttatgtaggtccttgaatgtcagagtaaaagagttggaaaggtgtttggggctgtatgaaggggtataggtgggtgtaggggtatatgggaggacgtatgaggaggggggatgtgaggtatgtgggggatgtgaaggtgttgtcaggtgtgtgagaaggtcttaatgtggtgtattctctaaagcaaaataaaaaaattagtagagtgaaaaatgtctgacctataagaaaaccttctataatcgtaaatgcctgttagtcattgtgattagcataacattac

SEQ ID NO: 44047 - DNA, 601 bp, Human
gatacggttattgttacaagctcagtctcctgtcctgtgcctagagctcatgtgtggaaaggtgcctcccctgctttattaaaagtcctctggttctcagacttgatttttttttttaaatatacatttgctaggaagaaattgtttttcctttgtctttgtcaatgttgagtaaatgccaatgagttaatatattaatactacttaaattagtggttgaatacgctttattgtgcatttagctcctgctaataattttctttgcattttaatacctaaattctaagaacctgaagggacwtcaagaaataatttaatttgatctacttttaggtcatggttttattcaaataagaaaatttgcagaatatctagcctagatgtctctgcatttacgtaggtatgtataaaattataagtacatttttatatcagatatatcaatattttgtgaagaaaaagtaaaaagaaagaatatgctgtttgctgtatgttctagcaagcaaaagtgtagaatagctgctcttatgccttgcactgccttttcagtttcaatggaattgagcagatatatattgaaaaactcattgtgtaatattct

SEQ ID NO: 44048 - DNA, 601 bp, Human
tctttcctaggctgggcatggtggctcatgcctgtaattccagcacttcaggaggccgaggttggtggattgcttgagctcagaagtttgagactagcctgggcaacatggcaaaaccctgtctctacaaaaaaatacaaaaaaaagccggtgtggtggcagccacctgcagtcccagctatttgggaggctagggtgggaagatcaattgagcccagcaggttaaggctgcagtgaactgttaccatgccactgcactccagcctgggtgacagaaagagacctgtctttaaaaaaaaaatctttttttggaggaaaaggtaatggttatagaaaaatcatataagcttaactgattattttaattttttaagagtttagagaatagtatgatagtttcttgggagtagaccatatggtaaatgtatgtttttcaaacttactaaatgcaatcaaactgttttcagtggttcaagaagtatttgcaaattagagatgatattttgctttttttcatttcattttgtgaactggtgataactgtttttcaactttgttttactctgttttgtgttgctattacagaatacctgagaggagg

SEQ ID NO: 44049 - DNA, 601 bp, Human
gctttttttcatttcattttgtgaactggtgataactgtttttcaactttgttttactctgttttgtgttgctattacagaatacctgagaggaggtaacttataaagaacagaaatttcttctcttacagttctggagactccaagatcaaggcaaaggcatctggtgtgggtctgtttactgtgtcctcacagggcagagggcagaaggacaagagacagcccactcctaaaagccctttttataatggcattaatctgtgacctaaacgccaccattaggccccacctctcaatacaytggcaattaaatttcaacataaattttggaaggggtgaacatttaaaccatagcaaactttttcaaacattttctcaatgttttagtccactccattatctcacctattaaaaggaagttagggatggggagaaagtggtagaaagaatgtatcaaggcctgagatagtttgatgttcaaagagtgtccacttgtctcatgtgagttgaggctaaagaagagccaaactgtggaaaggcctgtaagatttgttaaagattttgattttaaggccaagggtagtgggaagccattgaatgg

SEQ ID NO: 44050 - DNA, 601 bp, Human
caggaattaacattagaagaccttaaataacgctggatgcagttgctcatgactgtaatcccagcactttgggaggcccagtggggcggatcacttgaggtcaggagttcgagaccagcctggccatcatggcgaaaccctgtctctaccaaaaatacaaaaattagctgggtgtggtggcgtgcgcctgtaattccagccacttgggagtttgaggcaggagaatcgcttgaacctgggaggcagaggttgtagtgagccgctaagattgggccactgcactccagcctgaacaacagartgagactctgtctcaaaggaaaacagcaacaaaaagaagtccctaagtaactagtggttaaatgttgacttccaagtatttttactctccttacacatgccacatgcacattgtctagtgccacaacatataatgtttatatttttagtttattctgtgctagttgtgcttttagtttagtaatagaaatatattactttagttagatggatggaatcttgtaatgttttgtcagactgatagtaagtactaagtatggggtattacagacaagaggaaaaaaaatttctgggaagaaag

SEQ ID NO: 44051 - DNA, 601 bp, Human
tcataatgcttaaaagcaacccagggcagccaaataggaaaggtgactgcctctaggatgtgtatcaatatagaaaagaaaagatatcaaaagactcaatgtgtagtaaaatgagtttttttgtttttgtttttgtttctgttttttgagacggagttttgctcttgttgcccaggctggagtgcaatggcacgatctcagctcaccacaacctccatctctcaggttcaagcaattcttctacctcagcctcccgagtagctgggattataggcgcacgctaccacacccagctaatttytgtatttttggtagagacagcgttttgccatgttggccaggctggtctaaaactcctgacctcaggttatctgcccgccttggcttcccaaagtgctgggattacaggcatgagccactgtgcctggcaaaatgagttttcaagtaggaaagaaactacataatacacaaaagtaataaacaagacattgagatttttttttaatactcataatcttgcttcttaaaagttgaagcaacatagttatgaaaaaaactgttggtgattatggcctgttaagtgattctatatccattgtta

SEQ ID NO: 44052 - DNA, 601 bp, Human
ttgtactataccagaattttccaagtacctaaaatcattcttttgtatagtattcttgatacttaaaaaaaactatactgtaagatgttttggattaaaaccatcattcaatttaatccatcttctatagctgattctttggacttgtggtttgtccccagagtggcaggagcaatgacacgtgaaagggaaacaagaattgctttttaagttggatttattacatttgaaacttcattaactcttcccagaggactaagttgcctgtggtaggcacaagtttaggaaagagattgtttcrtacctctttatactgtttctcaatgactttttgatgatttcagacagcattagaatgtttttccagaaattcctcaaatttgtaagttcccgaaacagttcttatttttctgcttaacattggttgcatacataggagaattgtgataggtaagctagtcacaggactatgaaagatattgtcatcttaatcagaaaaaagtgtagtgaaattgataattgtaaaagatttacatttcatccacctgtttcaaagagtagagggaaatcagtagtagttgagtttttattcagttataat

SEQ ID NO: 44053 - DNA, 601 bp, Human
tgacttgtttctgagctcagcaaaaacatttgttgtttcactgttaagtatgacatcaactgtaggttttttggtaggtgctttttatgacattgagtaagttcccttctattcctagtgtactgatagttttttttttattgtgaatagtattcaattttatctaatgctttttctgcaaccaccgatatgaccatatgatttttcacttttagtctgttgatttgttagattgtgtgattgatttttgaatcttgagacagccatgtatgtctggagcagatcccactttgctgtgatrtaatacttttaaaaaatatattgttggattctctttgctaaaattttgttgaggacttttgcacctaagttaatgagagataccggtctgtgtttttctttttgggctttgtttttgatatcgagatgatactggtctcataaaatgagttgggaagtctcttttgtttctggaagaggttgtataaaattggtgttgatatattaatcatgtttttaaaaaacaaaacttgaattgtcctcagatacagttgcttgaggtgaaaattttctcatagaagtagacttttggccgggcgca

SEQ ID NO: 44054 - DNA, 601 bp, Human
ttgtgaaacagattccagattcaggccaactctattaagccagtgggttttacatagggaggaacattagattaccagtgggtctttgcagaaaaacaaaaacaacaacaaaccccacacatgtgcatatactatattctgtatacattagaagtagcagcccttcttctatagaatacaggtgagacagattaccagaggagtttgcagtatgtcagttcatgctattttttcttccgtagttgagaggaagtccatggcaccattagtatagtgtgtgtgtgtgtgtgtgtgtgtgtgggtgtatacacacatacatgtactctttatatatagtagcatgtatatatatagtgtatgtatgtgtatatttatatatattctcaaaataaacttttcagctccccattcccaggacctacatagtggcactcagacatatgaatgtgagaaaatatagaggggattctgatgcacatcattggttaagaactgctgtactaaaccctgcacgcaaaccttttatacttatttatttcttttgaaaatgtcagtagtaactatttagagttactttgatagaataaacctatgggtagag

SEQ ID NO: 44055 - DNA, 601 bp, Human
aaaaaaaaaaaaatccaaaaaaagaatagtattttgtgagttgtaaaaactaccaaaaaaatccaaaaaaagaataatattttgtgagttgtaaaaactacatgaaatccaattttcagtgtccataaataaagttttaatgcaacataatcatgttcattcatgtattgtctatggatgcttttatgctacaagggcagagttaagtagttgtgacagaccacatggcctgtaaagcctgaaatatttactgtctgaatctttacataaaaaaattgccattcctgttttaagataacartgggggcattgaatattgcttttgtattatttggtaaaggaggaaacttaccttgctcatattttcaacatgtttctgaaaataatttagaaagtgcctattgtttgcatacagataagtggtggtagcagcccttcttttttttgttttttttgttttgttttgtttttttgagacagagtctctttctgttgcccaggctggcgtgcagtggtacgatctcggctcactgcaacctccacctcctgggttcaagggattctcctgccttagcctcctgagtagctgggattacaggtg

SEQ ID NO: 44056 - DNA, 601 bp, Human
atatttctggttccattgaaatagtgaaacaaggttgttggctggatgatatcaactgctatgacaggtaagaacacatttaagattttatggtagtattgagtaattttcacacttcccctctttttgaaaggggaaagatcagtgcataaattttcacttaaatgtttcttgctttttaaaaaatgggattataaagaacattataacatgctgtaatgacagtatattttaaagtaataaacatggcatatatatgttttatctttgatatattttgaataatctacccagtagtgagaactctgaaataaaaaccattttccccaatattgttacgattataaacttttaaaatgccagttttaaggaaaacatttaaaaaattactttaaaagagtatatctgttgaaaatctgtcctcaagaagaataaaacttaatcatgtgtttaattttctttcagtttccttctttatgtatctggaagaaattgatcttactacattcccccctccccccgccccttttttttttcttgcaaagtaggcctttcgctctttacccgaagagactttttatttttgagacagatttcgctc

SEQ ID NO: 44057 - DNA, 601 bp, Human
tatttttcccccccttttccacagccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagtaagttattgtcctgtactttgtagtgttttaaattgtatatttttgagaaatattactgtggtgaaacccactaacttattacagattattttcctttggagttaatttttgaatgtttrttgtcatgagaactctagctaactttgcaaacttattaatgtacctaccgtgtccttaacttttctcactttagggttgaggtcgagtagaatgaagggatattcccatttctattcctctttggagagttttactctcatgctaacactaacctgctttgcttcttgagaagtcatttatgatggagaagtgaaatcataaccctgtctttgccctctgtcccctcctccatttctagatttctgtgcctttttcaagaccacttggcaaaacattttatccatggggatagacttagg

SEQ ID NO: 44058 - DNA, 601 bp, Human
taattgtggggagaagtgtcataagttatctcgacatgcaggttgacaaaaaaaattactctcatcaggcatatataatttattccacttacaaatgctcagacaaggccagttggagattgtctaaaattctgtgtccaaaagcaaaaagggaggaaggggagaaagtagaaaatttaaacctttatcaatagcttaaaataaggtaaagttgcacattaaaattaattagtgcaccttatttctaaaagtgacttctgtttaaattttgaaatcttgagttcaggttttctttggcttktacagggtctcgtctgtcagttgattggtgcatatggaccagactatataatttatcctccttctctggcaaggagatgtgtatttaggaggaagtgagtttgtttttttcctgtgttcttcatttcctggacctcatcctagaccttgttctttcattcctagttacttcattgctgtcaaatcttttttttttaaattaagataatagaaatgaaaaacgtcccattgttagctaaagctgcttgtagcacatgagctaggaattgttcagggttttcatttttgcttaaccgctcac

SEQ ID NO: 44059 - DNA, 601 bp, Human
tactgattgggagaggagccacatgtgggtgcctagctaatgctaagtgctcagtaagtattcactgttattggtgttagagtaacagcttcaaaattgaactcaaacagaatcatttttactgaaattattgttgatatatgttaatactttgaaattaacttggtgtaataaaagattcattttgagtattatatcaggcactatacagatcactttacacatattaactcatttaatttgttagtaccatggggttctgtcctgtttatcaagtccatttttttttttttttttttttaactttaaattctgggatacatgtgcagaacatgcaggtttgttacataggtatatctgtgccatggtggtatgctgcacctatcaacccgtcagctaggttttaagccccacatgcattaactatttgtcctgatgctccccttcccttgttcccctgccccttgacaggccccagtgtacgttgttcacctccctgtgtccatgtgttctcattgttctactcccacttatgagtgagaacatgtggtgtttgggtttctgttcctgggttagtttgctgaggattatggcttccagc

SEQ ID NO: 44060 - DNA, 601 bp, Human
tcagcatgtgttcatttttaacaggggtcgattttctaatccagcccattgtatttaaatgtgaaatagatatttttagatagcttcatctttggcatctttagcaaatgaactagctacaggagtataacttttgatgatattttgctatctgaggtttaagcgtttaattagattaaaattcacccttcaaatggagaactcagaataagtaaaatgatcagagatgactttgtagcttcccacctctaataatttattccactgttggttatagtaatgatattgggtagtggtttgsgggcaggagattactttttaccaggttatcatttcagtatgtgttctgaagctgatgtcttctgataccataatttttacatataaatgagtaaagaagaaatgtaatcagaactgtgtttgaatgcatatctttttagttttgcaaaatagcatggatgttgtaagagaactggaaatttagggaagtttttaggaattctgaaatccttctaggtgcctctcagctccccattggtttctctatgtagccaggtaaagccatattttgtgtatgacatcagaaattgcttgtcatttt

SEQ ID NO: 44061 - DNA, 601 bp, Human
gatgtcctttagaacagagaatgggtaatgtgtagattaactatagagacattaccagtgtacataaaagctattaaaaatcttaatattgtaatttagcactgtattccctctacctagttatttttcctcttcagctttcagccattttctgtatactttagtttttagtttttggcatcccctctggtttgaaacctatctctctacctttctaacattttctatttagtttaaatatgtctttatgcagttatacaataactctttgcccttgaggactgaatggtttcctttcctrtagaagagttgttttcaagctttttttctcttgtctccacattcatataagcagtctgctctgatcagtagaatttctcggatagaggtgatcacttgaagaatgagggagggagggtgtagtttttaataaaaactctctagaggttcttgtgtcccctccactgagaatcacacttgagagcccatccttcctataagatttatatctgacctccttgacccgtcactctgctaaacagaaacgttctttcatgttttgaatgtgggaaggacaagcaacttgtagacaaaaaaaaaa

SEQ ID NO: 44062 - DNA, 601 bp, Human
gatgcattttcagaggcaatcgagacttcaaataattggtttactgttgaattgtttttaaggttggctggacttctcataaaactctgatctaatgtacctctgagctattcttgtgttttgttttgttccgttggtggtatagatttatgatgattctgtcttccccatctcttgcttatataccctggcagctcatgatatccttggtactgacgtcttggctggatttggtgttgcaggctctaccaccatacttagagagtggatgtttctttttccaaagttatcatataagcartttctttgtcttaatatacctagattttaacctttttacctcctctgttcaatcttacctcctctgttcagtctataaactgtttacatagagtttatgaactgtattacatttttttttggtagctgtaaaccacagtttagttttcagagagaaagtgtattctgttgtgccaagattcataaataagataagggaagaaattatttccatgtgtaaggaagcataaagctcagagaaaggcatttggatgatattaacaagcccgacaacagcaacaacagtagctaacattttatt

SEQ ID NO: 44063 - DNA, 601 bp, Human
aaaggcatttggatgatattaacaagcccgacaacagcaacaacagtagctaacattttattgtatgcttttattgggtcaggtaggggtgttttacatatatgagtactcactaatatgtgtacgtatattacccacatgtacataaaatgcaacatataatacaacaattctataagacagacactacaatgccttttctacttaatgaggacactgaaggattatgtaacttgccagaggttagtgggagagccaggatttaagtttggacagtttggatgcagagagtttctaaggrtttctaaccattatgccatagtgcctcttactattattgtcttttagtagtgaaaagaagctaatcttttataagtagatacttagtagacatggattgcttgcaggcacaagtgaatatatggtgtcttaaattattgcattgcatatctttgccccttgctttctcatagaccttgtagggtatgctaaacattttttgaaggatgtttgatattatgttagtttttgaaaagaagaagttttctatttagaggaagtcattctgccggaatttcatctttcaaggagattattctga

SEQ ID NO: 44064 - DNA, 601 bp, Human
tctgaatagtaccacaagtaacttcacaccatgatgaaattacagtgtaatacttgcagtaacttacgtgttgccattgtaagacacagaatgcagcatttccgatcaccttctgtgtttgtaaactagaaacacagaaaagtacgttttgagggaatgaaaagggcaggcatttagtataaatttgttaacctattgtcagagctttttcttattacaaaacagaacaaaaaattttttaagacttttttgttttgttttgttttactttggaacttatttgagtaatctcttatgcatsgtttattaaacctgtattccttgtgttcttactattctttctttttgactctaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaaggtaaaactacttaacgttttactttagtaaagtctgagttggcctgcctacctaatgctggctataaatccctcagagttatttttcgagacatcttatagt

SEQ ID NO: 44065 - DNA, 601 bp, Human
ttcctcaatttttctacttttagagtcagtgtgaaagtaccattaatgaagtaggaaattatgtttttggtaattggtttcatcattgtgaaatgtaagtggttcttttacttctcttatcttgacctaaaggacaacaataatctagaggaatattctacatattagttgttattttatgttgttattttgtgttctgctagtcccatgatataacaactctatagtcaggatattttaacttttaaaatattttctagaaccttagattttcaactagtctttaaaaaaaaaaaaaaamaaacttgtcttatagattggtggaaattgactattcttgtaacaaaagtttaaagctctggtatttccttctggtcaaatgtttattaatgtgaaatggaaggaaatttgaaccatttgaaccattccagaaagattgtttcttggatattatttttccctgaaagggaaactcacaacctcttataggtaaaaagaaaagtctccttatacatatggcctttgtcaagaacataagtttctttttttccctctttttttagggttcactatcagactttcttaaggctaatgtggtctc

SEQ ID NO: 44066 - DNA, 601 bp, Human
tcatatatgaatgttgtcaagcaccaaccaaagctagctgtactagcttagtaaccatagttacagtactaagaaataccaaattgttggggacagttataaataaaggactccaagacagaagaatttatgaataaacaaatacatagattttgtacagatagaactttttaacatcagtctgtcctttacttagctaattctttttataacattttattagtttttttaatacagagaaaagacctcaaaaaaagttttttttttaaagctacatttcaaacagtatgcaaaggtacarttgaaaagtatgcagcatccttctcccagctgacaattggttcagtttcttgtgattacatccagaaaggggaacataaaaacttctaagtctgtaccagcataatgtctgttgatatattttttaagtatacgcagaaaggatctttctatttatacgctatagtctgtataccttaccctggtaatagaccacatttggttttgattcatcttacaaaatcatatgttagttcataaagttaatgaatgagtactctttgcttttaacatctttttcaggttggtacccggaggtaca

SEQ ID NO: 44067 - DNA, 601 bp, Human
tttttaacatcagtctgtcctttacttagctaattctttttataacattttattagtttttttaatacagagaaaagacctcaaaaaaagttttttttttaaagctacatttcaaacagtatgcaaaggtacaattgaaaagtatgcagcatccttctcccagctgacaattggttcagtttcttgtgattacatccagaaaggggaacataaaaacttctaagtctgtaccagcataatgtctgttgatatattttttaagtatacgcagaaaggatctttctatttatacgctatagtstgtataccttaccctggtaatagaccacatttggttttgattcatcttacaaaatcatatgttagttcataaagttaatgaatgagtactctttgcttttaacatctttttcaggttggtacccggaggtacatggctccagaggtattagagggtgctataaacttccaaagggatgcatttttgaggatagatatgtatgccatgggattagtcctatgggaactggcttctcgctgtactgctgcagatggtaagggaaaaaaatatttttaaaaaagatatatatgcctaccacac

SEQ ID NO: 44068 - DNA, 601 bp, Human
ttttgattcatcttacaaaatcatatgttagttcataaagttaatgaatgagtactctttgcttttaacatctttttcaggttggtacccggaggtacatggctccagaggtattagagggtgctataaacttccaaagggatgcatttttgaggatagatatgtatgccatgggattagtcctatgggaactggcttctcgctgtactgctgcagatggtaagggaaaaaaatatttttaaaaaagatatatatgcctaccacacatatatgaaaagggatgatacactccaaggtaatrttttaaagtacagtttttttttaattgactccaagagatggtagagaattcaggaggcaggggagcagtgggtggggtaggagaggaaaggaattgctatgtattgatcctttaccattactagctatgttgctggacacttcacataccttaaggttatttcctaaaacggtttcagaggtagttattatgctttacatatgaggaaattgagatgcagagaaattaagtagtttgcctactttagcctcaaactggtgaatgatgaaacctagatttgaaactctgatccagacatag

SEQ ID NO: 44069 - DNA, 601 bp, Human
ggtacccggaggtacatggctccagaggtattagagggtgctataaacttccaaagggatgcatttttgaggatagatatgtatgccatgggattagtcctatgggaactggcttctcgctgtactgctgcagatggtaagggaaaaaaatatttttaaaaaagatatatatgcctaccacacatatatgaaaagggatgatacactccaaggtaatattttaaagtacagtttttttttaattgactccaagagatggtagagaattcaggaggcaggggagcagtgggtggggtaggasaggaaaggaattgctatgtattgatcctttaccattactagctatgttgctggacacttcacataccttaaggttatttcctaaaacggtttcagaggtagttattatgctttacatatgaggaaattgagatgcagagaaattaagtagtttgcctactttagcctcaaactggtgaatgatgaaacctagatttgaaactctgatccagacatagggagaggtctgctttaaggtcatatgggtcctgccccccaggttaaagggtttctattacttgttcttgttattgaagtccat

SEQ ID NO: 44070 - DNA, 601 bp, Human
agggaaaaggcatgccagactcggaaactgtggatagttgggtaactttgctgatgaccacttccaatatgacaacattttaaaaagtttatgaagcaccatgttttctcctctccatgggagtttgttgtagccttttaatttcggcttagactttcaagtcttaatagtgctttaaaactatagagaccaggcacataacagtattgccctggttatttcagtctaaatataactagaaacctggctaaaaccaggtagagaaatcccaagggtggctttctgatcttctgtttaattktaagatagaaatgctgatattaactaagaaaacaataaaaattggtaggtcccctttatccttgatttttgagtccatttgaagggttagcattgaaatgacctgggttatgaacaagggatagagattttttttttggagttaaaaaaattcctcttgtgatagtctcatgcttaaaaaaaaagttctgtttgtgcttttctttatgattctgcacatggtagtcaataaaagtgaatgttgacagaaacttctttgacccagaaaaatagccatttcttcatgaaaattttattgttt

SEQ ID NO: 44071 - DNA, 601 bp, Human
ttatacattaactcatttaatgtgaatccctagataaaaacagattattcattcatatactcctggttgtactagaacaagtcataccaaatttacattttttgtttctgaagggagatacggtaggtaaacagaaagtcattttacgaaatattttggtatctacctaagaacaaactggagtcctggagcctgagtgaaaatacagtcttgctagaatgttgccctccatgagagcagatacaccattcgtctcattcactatggtatacctagagctacaacagtgccagggacccaraaagcactcattatttgctgaatgagggatggctcatagccgacttgagtgtcaatactcggagaacattgggtgctccgtgtcaatttatggcacagggtctctagtaaggctttgaggttgaccttaacctagtctagctcagtatttgaatcaataacttgaatgaagataacttatcacattcaaagataacaccaagggcagctaacttattagaaggcagaagttaggattaaaaaagatctccatggctaggagagtaaggtgaaattaacaagatagaagttaagaggataa

SEQ ID NO: 44072 - DNA, 601 bp, Human
cccatctcaaggaagctaaaaaccttgaaaaaagattagacgaatggctaactagaataaacagtgtagagaagaccttaaatgacctgagggagctaaaaaccatggcacaagaacttcatgatgcatacacaagcttcaataactgatttgatcaagtagaagaaagggtatcagtgattgaagatcaaattaatgaaataaagcgagaaaacaaggttagagaaaaaagaataaaaagaaacgaacaaagcctccaagaaatatgggactatgtgaaaagaccaaatctacgtttgaytggtgtacctgaaagtgatggggagaatggaaccaagttggaaaacactcttcaggatattatccaggagaacttcctcaacctagcaagacaggccaacattcaaattcaggaaatacagagaataccacaaagatactccttgaggagagcaaccccaaggtacataattgtcagatttgccaaggttgaaatgaaggaaaaaaatgttaagggcagccagagagaaaggtcaggttacccacaaagggaagcccatcagactaacagtggatctcttggcataaaccctacaagcca

SEQ ID NO: 44073 - DNA, 601 bp, Human
cttctctgagctaaaggagcatgtttgaacccatctcaaggaagctaaaaaccttgaaaaaagattagacgaatggctaactagaataaacagtgtagagaagaccttaaatgacctgagggagctaaaaaccatggcacaagaacttcatgatgcatacacaagcttcaataactgatttgatcaagtagaagaaagggtatcagtgattgaagatcaaattaatgaaataaagcgagaaaacaaggttagagaaaaaagaataaaaagaaacgaacaaagcctccaagaaatatgggaytatgtgaaaagaccaaatctacgtttgactggtgtacctgaaagtgatggggagaatggaaccaagttggaaaacactcttcaggatattatccaggagaacttcctcaacctagcaagacaggccaacattcaaattcaggaaatacagagaataccacaaagatactccttgaggagagcaaccccaaggtacataattgtcagatttgccaaggttgaaatgaaggaaaaaaatgttaagggcagccagagagaaaggtcaggttacccacaaagggaagcccatcagactaacagt

SEQ ID NO: 44074 - DNA, 601 bp, Human
ctcttctcctccaaaggattgcagctcctcgccagcaatggaacaaagctggacggagaatgactttgatgagttgacagaatgaggcttcaaaaggtcggtaataacaaacttctctgagctaaaggagcatgtttgaacccatctcaaggaagctaaaaaccttgaaaaaagattagacgaatggctaactagaataaacagtgtagagaagaccttaaatgacctgagggagctaaaaaccatggcacaagaacttcatgatgcatacacaagcttcaataactgatttgatcaagtrgaagaaagggtatcagtgattgaagatcaaattaatgaaataaagcgagaaaacaaggttagagaaaaaagaataaaaagaaacgaacaaagcctccaagaaatatgggactatgtgaaaagaccaaatctacgtttgactggtgtacctgaaagtgatggggagaatggaaccaagttggaaaacactcttcaggatattatccaggagaacttcctcaacctagcaagacaggccaacattcaaattcaggaaatacagagaataccacaaagatactccttgaggagagcaacccca

SEQ ID NO: 44075 - DNA, 601 bp, Human
atgtggtgactagtaacttctcaacacggagtggaaatcaagtaaaccgggagttacagtcagtctcctagaacatacatctgaggtgtgttagaagccaagacttagcaagcctcattgggccttctgctgattcacacagaacacacaatgaaatcagaagaaatctgatatgtacttgctaatgaatgacacattttataaaggaaatcaaggcacagctggcacttttaactctagaattggaaggccatgactatggaagaaaaggcagatcagaactcctggcatgatgacgtargatttaaaatgctatttggggcaggggtggaggggtgggggactatagactgcaggccaaatctagccttgcccatcattttgcgaccatctaaggctgctctcacgcttcaatggcagagttaagcacctgtgacacagaccagctgtcccacaaagccaacaatatttactatctggccctttaaagaaaatgtttgcccctgttttaggggaaagataagaaaaaggtccaaacagaaaaagtggataacaaagacgagctggaatgataaaaaagctatgcaaaactagaagaact

SEQ ID NO: 44076 - DNA, 601 bp, Human; identical to SEQ ID NO: 37606

SEQ ID NO: 44077 - DNA, 601 bp, Human; identical to SEQ ID NO: 37605

SEQ ID NO: 44078 - DNA, 601 bp, Human; identical to SEQ ID NO: 37604

SEQ ID NO: 44079 - DNA, 601 bp, Human; identical to SEQ ID NO: 37603

SEQ ID NO: 44080 - DNA, 601 bp, Human; identical to SEQ ID NO: 37602

SEQ ID NO: 44081 - DNA, 601 bp, Human; identical to SEQ ID NO: 37601

SEQ ID NO: 44082 - DNA, 601 bp, Human
tgtacctactgatggtgctgtaaccacctcacagattccagcttcggaacaagagaccctggttagtatttttgtctcgtgtaacttttaagaataatttattttatgaagtgataaactaaatttcgtatacctcaattgtagcatggctctgtaaataaaattgtatgtgcatagcttaaagtgtgctacctctggcgtaactgcgtggagttaaaaactgttaagaactggtcagtatttttttagccatttgccacatttgctttaaaaattagttccattacattgttaagcgtgrttgaagttacgtttgttacgtgactgatttttttttcctttttgacctcccagtatttaatttttaaaaatggtttctaaaagtcaaaaaaattattcgtgcttgttttaaagatttttgtcattagagaaattttaaagtaaaacctgaaaattccaggctttttgctccatgtttccttttagattttttgtgtgcgtacccacatatatttacatttgaatttaaatctatgttattgtcctgtttgttgtactaacaagatgaaactgtagttgttctgtgacttgcatccttgtc

SEQ ID NO: 44083 - DNA, 601 bp, Human
aataatttattttatgaagtgataaactaaatttcgtatacctcaattgtagcatggctctgtaaataaaattgtatgtgcatagcttaaagtgtgctacctctggcgtaactgcgtggagttaaaaactgttaagaactggtcagtatttttttagccatttgccacatttgctttaaaaattagttccattacattgttaagcgtggttgaagttacgtttgttacgtgactgatttttttttcctttttgacctcccagtatttaatttttaaaaatggtttctaaaagtcaaaaaaattattcgtgcttgttttaaagatttttgtcattagagaaattttaaagtaaaacctgaaaattccaggctttttgctccatgtttccttttagattttttgtgtgcgtacccacatatatttacatttgaatttaaatctatgttattgtcctgtttgttgtactaacaagatgaaactgtagttgttctgtgacttgcatccttgtcaataaataaagtctacagaattctttttaatggctgcatagtattccacagcatgagtataccattttaaaaattatttatgcctttactga

SEQ ID NO: 44084 - DNA, 601 bp, Human
gttaaaaactgttaagaactggtcagtatttttttagccatttgccacatttgctttaaaaattagttccattacattgttaagcgtggttgaagttacgtttgttacgtgactgatttttttttcctttttgacctcccagtatttaatttttaaaaatggtttctaaaagtcaaaaaaattattcgtgcttgttttaaagatttttgtcattagagaaattttaaagtaaaacctgaaaattccaggctttttgctccatgtttccttttagattttttgtgtgcgtacccacatatawttacatttgaatttaaatctatgttattgtcctgtttgttgtactaacaagatgaaactgtagttgttctgtgacttgcatccttgtcaataaataaagtctacagaattctttttaatggctgcatagtattccacagcatgagtataccattttaaaaattatttatgcctttactgataggtttttaaaaattgcctcctgtttttgagtattacagatagtgccgctttgtacatgcatcccgtgtgactatttctgtaagaaagattttatagaattataggctggcctcggtgg

SEQ ID NO: 44085 - DNA, 601 bp, Human
gcatggtggcgcgcgcctataatcccctgctgaggaggctggggcaggagaatcgcttgaacccaggaggcagaggttgcggtgagccaagattgcgccatttcactccagcctgggcgataagagcgaaactccgtctaaaaaaaaaaaaaagaaaagaaaaagattttagagaattagaactcctgagttctcaattttactatttgattgctactggtaacttgctcaccaaaaggctctaacagtttcactcctgccaatactgaatatcaccaatctttaattattattattattwttttttttgaggcggagtcttgctctgtctcccaggctggagtgcagtggcacaatctcggctcactgcaatctccgttccccgggttcacgccattcccctgcctcagcctcccgagtagctgggactacaggcgcccaccaccacgcccggctaattttttgtatttttagtagagacggggtttcaccatgttagccaggatgatcttgatcccctgacctggtgatccgcccgcctcggcctcccaaagtgctgggattacaggcgtgagtcactgcgcctggcctcttttattat

SEQ ID NO: 44086 - DNA, 601 bp, Human
atttttcttagtaattggagtagctctatgtgtttcaagtatatttaacttttgttgtttactaatgtagcatttaattttatgttgtcttttccccattgagaacaattctgtgaagtaaaatttgttggcttttgaatttcatatcatgctttggaagaactctcctgtcccaagatcttgcaaatatattcctatattttcttctagatttaaattttttaaatatttagatcttcacctgtaatttaccttcttgttcttcaatgtaagattacaaatgctattatcttttatagcygttttctcattaatacatgtcttttaagtcactaatatactgatggctttccattacagatttttttttttttttttttttgagactgagtcttggtctgttgcccaggctggagtgcagtggcatgatctcggctcactgcaacctctgcttcctgggttcaagcaattctgccgcagcctcccgagtagctgggattacaggcacccacctccacacccggataatttttgtacttttagtagagatagggtttcaccatgttgtccaggctggtcttgaacttctgacctcctgatc

SEQ ID NO: 44087 - DNA, 601 bp, Human
actgatggctttccattacagatttttttttttttttttttttgagactgagtcttggtctgttgcccaggctggagtgcagtggcatgatctcggctcactgcaacctctgcttcctgggttcaagcaattctgccgcagcctcccgagtagctgggattacaggcacccacctccacacccggataatttttgtacttttagtagagatagggtttcaccatgttgtccaggctggtcttgaacttctgacctcctgatctgcctgtcttggcctcccaaagtgctgggattaaaggcrtgagccactgcgcctggcccacacctgggtaatttttgtatatttaatagagacggagtttcactgtgttggccaggctggtctcacactcctgacctcaggtgatctgcctgcctcggcctcccaaagtgctgggattacagacctgagccactgcacctggcttccattacagatttttactttgaattattttatctaatttgaagctaatatagcatataataaaaattcaggagaaaaaaggttatttttaaatcttttttgagagagtccattctttagcctgaaagtaaagtg

SEQ ID NO: 44088 - DNA, 601 bp, Human
gtaatttttgtatatttaatagagacggagtttcactgtgttggccaggctggtctcacactcctgacctcaggtgatctgcctgcctcggcctcccaaagtgctgggattacagacctgagccactgcacctggcttccattacagatttttactttgaattattttatctaatttgaagctaatatagcatataataaaaattcaggagaaaaaaggttatttttaaatcttttttgagagagtccattctttagcctgaaagtaaagtgcatatgtaagcacagttaaaaaaaaaaaagtgatcagaaaaattaataattcaattctatatgtattttaaatttttcaattgttaaataatatttgttttattgattagctggaaataggcaatttttaaaaatctgtttttaaggcatccccaatgggggtgctgtcagattttaaagttagacagaggaccggggcatattaaagagaggtgcagaggtaccagtttgtgtggtagtggcaagctgtaaagatacttgagttttgcagattttgataaaccaaaaggaagggagaaagtgcatagtatattacattcccctccccc

SEQ ID NO: 44089 - DNA, 601 bp, Human
gaggtaccagtttgtgtggtagtggcaagctgtaaagatacttgagttttgcagattttgataaaccaaaaggaagggagaaagtgcatagtatattacattcccctcccccatgacaattatttttctcaagaccatttgtaaaacctctagataaggggcaggcaaatgttagcctgtcagccaactttggcctgttacctgtttttgttttagtttttaaattttttttgtagaggtggagtctctcagtgtggcccaggctggtcttgaacacctagcctcaagcaaacctctagcrctgtctcccaaagtgctggggttataggcaagagccacctctcccagccagctgcctttctttctgtaaggaaaattttactggaatgcaaccatgcccgttggtttacatagtagccatgctttttacttggatagaaccatttgtatgaaaagcttaaaatacttacagtctggctctttacagaaaaaaattgacccctaatctagttggcaggctccttgcatacaggtcatatgtcttatttgtaatttcttttgcagtacctaccactgtccagtgcatagtagaagctcaata

SEQ ID NO: 44090 - DNA, 601 bp, Human
gaactcagataaatggaagccccgtaagggtgcttgaccattttatgctgtcaaccctttggtagactccttcccagaatcatgtttttaaatgtatgaaataaaatgtatagaattacaaaggaaacatactaaaatacggttaccaaaatagtaaactagtttgtgatatgtgtgcttttgttattaacataataaatactaagatttagaagaagatataataaatataatgtttttttgttttttgagacgaagtctcgctctgtcacccaagctggagtgcagtggcacgatctcrgctcactgcaacctccgcctcctagattcaagcccttcttctgccttacccttccaagtagctgggattataggcacctgccaccacgcctggctaattttttgtctttttagtagagatggggtttctccatgttggccaggctggtcttgaactcctagtctcaggtgatccacttgccttggcctcccaaaatgctgggattataggcatgagccaccatgcctggccaataaatattatcttgatatagtgaggaatataagtcatattttgaaatgtttgccataagtacagtat

SEQ ID NO: 44091 - DNA, 601 bp, Human
tctctactaaaaatacaaaattagctgggtgtggtggtgcatgcctgtaattccagctactcgggaggctgaggcagtagaatcacttgaaccaggcaggtggaggttgtggttgaggtgagccgagattgcgccactgcactccagcctgggcaacgagcaaaactgcatctgaaaaaaaaatttttttaatatatatttttctaaaattattcttttttttgtttgtttgttttgagagggagtcttgctctatggcccaggctggagtgcagtggcatgatcttggctcactgcaacmtccgtctcctgggttcaagtgattctcctgcctcggcttcccgagtagctgggattacaggtgcctgctgccatgcctaatttttgtatttttagtagagacagggtttcacgatgttgaccaggctggtcttgagctcctaaccttcggtaatccacctgccatggcctcccaaagtgctgggattacagatgtgagcaaccacacccggcctacatttggaattctttgtcacatttggtttagcacaggcaatccgtgttgagccttagcattcattacattaataaatggaatgaa

SEQ ID NO: 44092 - DNA, 601 bp, Human
tgggattacaggtgcctgctgccatgcctaatttttgtatttttagtagagacagggtttcacgatgttgaccaggctggtcttgagctcctaaccttcggtaatccacctgccatggcctcccaaagtgctgggattacagatgtgagcaaccacacccggcctacatttggaattctttgtcacatttggtttagcacaggcaatccgtgttgagccttagcattcattacattaataaatggaatgaatacgttcacctgagacaattaactagcttctgctagtatttaatgctcartagtatagctgaaaagatgataattaaatgggattttattttattaaaaaacataacttcctcagctgagcaagggattttataactttaaaacaaccttattattgtaaacatagtatatattattattgaacattaggagatgacagaaaactaagaaaagtaaaggaaaaaaaaggactgtagtttgttaacaaaaggtatttttaccagtcatttgtgtattatgtgcaactgtgtgttttaacctagttatgaatatagtactatatttaaatttcatctagcttcttaatttgt

SEQ ID NO: 44093 - DNA, 601 bp, Human
atcttctattttttttcttttttttttgagatgaagtcttgctctgttgcccaggctgcaacctctgcctcctgggttcaagcgattctcttgcctcagcctcctgagtagctgggattacaggtgcacactactatgagcagctaattttttgtatttttagtagagatggggttttgccatgttggccaggctggtctcgaactcctgacttcaagtgatctgcctgtcttggcctcccaaagtgctgggattacagacgtgagccactgtgcctggtctgaatattgaatcttcggayaatgtttggaagtatgatttccttggacttgaattctaaatgttgagagataagaaataggagaaattactgacttgaaaaggatatgaattaaaaatattgtgggtttaggttgctgtatccttattcccaaggatgaaaaaagatagttgggattcatatttcctcttaatattgagtgagaaacaatattttgtgacaaacactctcttaaatccttagtttaaaaacaaaaggaaaaatccattgtgacatcaacgaatactggggtaaatgaattatcctcctgttaggatataa

SEQ ID NO: 44094 - DNA, 601 bp, Human
gatttattttgaaaggtctgtaatttcaaaagctcctgtttaggagtgatctaccttgaaaatgtattgaaaggctttgggaaataatattgttacctaggtaggaccatgtgtaaggatgaaggatgagtctttttctttggttatagacaaaattttgtttaccaatttgtggaagtggaattttatgttcctacttccgtttcttaactggttatttttgggtcacatctctctttaataagctgataaaagcattgggttcttgttccagaaagatgcacatgtatatatacatggrtaagtcaataagtgttttacaacctactttccatgagaaaagccctgatttatgtgcttgctgacttccatagtataatactctcatttgaaggctaaaaacatggagttgggaagagatgtacacagtttgctttttttttttttttttttttgagaaggaatcttgctctgtcactcaggctggagtgtagtggcatgatctcgactcactgcaacctccgcctcccaggttcaagcaattcttctgcctcagcctcccgagtagatgggactacaggcgtatgccaccacgcccggc

SEQ ID NO: 44095 - DNA, 601 bp, Human
ctcctattccatgttctcaactttgtcacttttttttttttgagatggagtctcactctgtcacccaggctggagtgcagtggtgcgatctcggatcactgcaacctctgcttcccgggtttaagtgattctccttcctcagcctcccgagtaggtgggattacaggtgcctgccaccacgtccggttaatttttgtatttttagtagagaaagggtttcaccatgttgaccaggctggtctcaaactcctgacctcaggtgatcctcccaccttggcctcccaaagtgctgggattacargtgtgagccactgcacccacccagcctagggcttcctttttattacatcttttttgtagcatctgtttatactaatccaaaattcctggacaatataacctattatgtacaacttaagaaaattagtgtaatgccttacccatagtataaagagaaaattaatctatgataatgcataatttcaaaatgttaatgtccaggcatgagttcactgttaagatgaaaatgtttccaaggggggtagtaaagggtatttgatgataattgtctgtatatcccaactctgaaactttgactttt

SEQ ID NO: 44096 - DNA, 601 bp, Human
ggttgagatgaattaacctctgagtttttttcattcgtgattttatttgatttacaaattgcttatttagcaatatttttctggctgactacagcaggcacagtttactgtgccccactggagtttatagttagccaactctctgttaagatagtaggaggtggctggggtgtggtggctcacgcctggctcacgcctgtaatcccggcactttgggaggccgaggctggcggatcacgaggtcaggagttcgagaccagcctgaccaacgtggtgaaaccccatctctactaaaaaaaawacaaaaagtagctgggcctggtggcgcacacttgtaatccagctactcaggaggttgaggaaggagaatcacttcaacccgggaggtagaagttacagtgagccgaaattgcgccactgcactccagcctgggtaaccgtgtgagacttcgtctaaaaagaaagataataggagacaggcatataaactctattttcaccattattcttagtcaccttaacagttaaatttttaaattgttatttttaataaatggtagtacatacctatgagttttaaaacagaaagtaaatagcattt

SEQ ID NO: 44097 - DNA, 601 bp, Human
gggaggccgaggcgggtggatcatgaggtcaggagatcgagaccatcctgtctaacatggtgaaaccccatctctactaaaaatacaaaaaattagctggatgtggtggcgggtgcctgtagtcccagctactcgggaggctgaggcaggagaatggcatgaactggggaggcagagcttacagtgagccgagatcacgccactgcactccgcctgggcgacacagtgagactgtctaaaaaaaagagagagagagaaaatagttgacagagagaaaatagttgagaacagttagtagacrtagtagacgagaaggctgttgcctgaggaagtcgcagtaactaagaccgtatgattcagatgaaagagaatgtcagatcagtgaaacagaataaatgaacccagaccagaatctcgtacatgcgggcagaagacaggaagggcagaggtgtctagggcagaggtggaactagaacaaatggtagttacttggggaaaaggtgaagttagatctgtaccttatgccaaaatgaatttcaaatgagtttaaaagttaaatgaaaaatagaatacaacatatttgaaagatagtcactttaaa

SEQ ID NO: 44098 - DNA, 601 bp, Human
gatttgtctaacattctgacccattcagagataatttattatttaaaatgaaatggaaactttttactggttttgatttctgtttaaaatatagggtactgaagagccgggcttagtggcttaggcctgtaatcccagcactttgggaggctgaggcaggaggatcacttaaggccaggagtttgagaccagtgtggccaacatggtgaaaccctgtctctaccaaaaatacaaaaattatccaggcatggtggtgtgcacctttaatcccagctacttggaagctgaagtcacaagaatsacttgaacctgggaggcagaggttgcaatgagctgagaatgtaccactgcactccagcctgggtggtcgagtgtgactctgtctcaaaagaaaaagtgtagggtactgaagaaattgaaacattaagaataccatatgagtaaattaaacactttggctcttttcggaaaaaaacagatgagctcttatattttaaagtttggttttgacagaaaaaaattcctagattttttggttaataaaaactttattagatagattaaattgtgatgtatggagataaagttctgaaagaagaat

SEQ ID NO: 44099 - DNA, 601 bp, Human
aaaaaaaaaaaaatgcaggtttattattgcatggatgacgggagagtatcagtactttctcattactaatacagacttccaaaatattagtgagcagcatttcttaagagatgtcactgaaagaagtttggtaaaaaatttttttgttaacaagaatgcttgacaaatggaatattttgttttgtatgtctttaatcaagcttgtccaacccatgccctgtgggccatatgccaggatggctttgaatgtggcccaacacaaattcataaactttcttaaaatattatgatttttttttttacaattttttttctgctcatcagctattgttagtgtattttatgtgtggcccaagacaattcttccaatgtcgcccacggaaaccaaaggattggatacattttttggtaatatggcagtgtctcatggccattattctgggtattagtaatcattgtatagtactctagaagatgtaggaagtggaaccaattgtgatagtaatcctagtcttttacctattcttgttacttcctgtattatctttttttctcttccaaagcagtgattgtatgaacgcatacctgccctctagagtta

SEQ ID NO: 44100 - DNA, 601 bp, Human
atgccctgtgggccatatgccaggatggctttgaatgtggcccaacacaaattcataaactttcttaaaatattatgatttttttttttacaattttttttctgctcatcagctattgttagtgtattttatgtgtggcccaagacaattcttccaatgtcgcccacggaaaccaaaggattggatacattttttggtaatatggcagtgtctcatggccattattctgggtattagtaatcattgtatagtactctagaagatgtaggaagtggaaccaattgtgatagtaatcctagtyttttacctattcttgttacttcctgtattatctttttttctcttccaaagcagtgattgtatgaacgcatacctgccctctagagttactgtacctaacggagctgttacttatgtagaccgctagatggcatgatgagctcctgctcagtctgagagcaggttcttcatttgtagatatttaagtttataccaaattccatacagttgagatggcactgcagatacagtggtagtcaaggtagatatggttcttgccttcattgggagatagatcattaatgacaaaaatgaaaacatt

SEQ ID NO: 44101 - DNA, 601 bp, Human
gggggcggccatgctgttaggtacctgatggagcaagggcaagaggacaacggtgggaatcgccatgttgggtggaccctcttgcatttgcatcttaaaggttgccagcctttaagagccagggcttttatgctagacaagaaatttttctggagctacgaaaaaccttccaaggaccacttttcctctccatttgcctaaaataatttcttaataactcgtgtggagtagaggggtatttctttttttctttttgttagtcctgtcctgcattctcttaaaaaatcctatctataaaaaatctcagccgggcgtggtggctcatgcctgtaatcccagcactttggaaggcccaggcgggcggatcacctgaggtcaggagttcaggaccagcctcgccaacatgttgtgaaaacccatctctactaaaaataccaaaaattagctgggcatagtggcgggcacctgtaatctagctactcaggaggctgagacaggagaatcgcttgaacccgggaggcggaggttgcagtgagctgagatcacgccattgcactgcagcctgggcaacgagaacgaaattccatctcaaacaacaaca

SEQ ID NO: 44102 - DNA, 601 bp, Human
agagccagggcttttatgctagacaagaaatttttctggagctacgaaaaaccttccaaggaccacttttcctctccatttgcctaaaataatttcttaataactcgtgtggagtagaggggtatttctttttttctttttgttagtcctgtcctgcattctcttaaaaaatcctatctataaaaaatctcagccgggcgtggtggctcatgcctgtaatcccagcactttggaaggcccaggcgggcggatcacctgaggtcaggagttcaggaccagcctcgccaacatgttgtgaaamcccatctctactaaaaataccaaaaattagctgggcatagtggcgggcacctgtaatctagctactcaggaggctgagacaggagaatcgcttgaacccgggaggcggaggttgcagtgagctgagatcacgccattgcactgcagcctgggcaacgagaacgaaattccatctcaaacaacaacaacaaaatctcgtttttcaggttaagtccctagttgtgaaagcttttggtagggccagtttttttttcttcttcgttttaatttccctcatttgagaatgttgtagtcatcattg

SEQ ID NO: 44103 - DNA, 601 bp, Human
ggaatttgagctgcaacttgatgaatgttgcttttactctccttcctaacattactctaaaaaagtcttttgatgtcagaggctgtaaaataatatactttgtttctgtttttaaaactgatacagatatggaaatcatttaatctaagctccttttctagatgaagtagctacagcctttagaagttaaatgatatgggctgggcgaggtggctcacaggtgtaatcccagcattttgggaggccgaggtggcggatcactagaggtcaggatttcgagaccagcccagccaacatgacraaaccccgtctccactaaaaacataaaaattagccgggtgtggtagtggacacctgtaatctcagctacttgggaggctgaggcaggagaatagcttgaaccccggaggcggaggttgcagtgagctgagatcatgccactgcatttcatcttgggtgacagagcaagactcttgtctcaaaaaaaaaaagggccgggcatggtggctcacacctgtaatcctaacactttgggaggccaaggcggttgaattgcttgaggtcaggagttcaagaccagcctggccaacatggtgaagcc

SEQ ID NO: 44104 - DNA, 601 bp, Human
tttcatcttgggtgacagagcaagactcttgtctcaaaaaaaaaaagggccgggcatggtggctcacacctgtaatcctaacactttgggaggccaaggcggttgaattgcttgaggtcaggagttcaagaccagcctggccaacatggtgaagccctgcctctactaaaaatacaaaaattagccaggcatggtggcatgcgcctgtagtcccagctacttgggaggctgaggcaggagaattgcttgaacttgggaggtgtaggttgcagtgagctgagatcaggccactgcactccakcctgggtgatggagcaagattccatctcaaaataaataaaataagttaaatgatgttgtttaaggttaaattagctacttagtggcaagtgtagaataagccatatcccgacttctagactttttccaattgtagccttctgcttatatatgctcctacccttagccactgacagcaaatattattgccctgaaggtcttactaggttcttatacaatttattgaagtcctgaaacgaagaatcagatgagcagctacagaattttttttaattgtctaaaggctctttaaaagaaaatc

SEQ ID NO: 44105 - DNA, 601 bp, Human
tcgagacatttttctaagaaaaaaaacccataagtattacaagtgttgtgtcttgttacgtgtattctaccaatttggacatagaaagatgagtgacaggttttagctcaaagtatatataattcagatgagaaacatgcctgcaaaattatgttttgcataatttatgtgtgagactatataattcattattatacaagtagtaaggataattaaaggtggaagagccttttcagttatggtattgacaaaggcttagtcaaagaaggatgaataggattttgaaactgaaattattctrgttagagggggaaagtgtggaagttgaaatgccaagattagttgaggaagcaatctagatctggcgggattatccatatttagtaagggaggaggggtgtctagttgaagacagacgaagatgttaatacagtcacactgtaggtactttcgatgccaagaggctttggtgtttttcctttatgcagtggggttttgaacagggaaaataatgtagtaataaccttgaaaccttaatctagtttcagtatgcaggatggatctgaggaggaaatgtgcgtggcaaccggctccgggatgg

SEQ ID NO: 44106 - DNA, 601 bp, Human
tatatcaagttactgtgtatcaggcaggggagagtgatacagattcatttgaagaagatcctgaaatttccttagctgtaagtatacatctacttttttaagaaataaaaatttcattaaggtcaagattaggagactatatctagcttctttctgaaatgaactgatttttataaagttaaaatgtttttgtaaagtctgaataatttaaagcatttttcttttatttgttgtgatgagacctgtagctataatttttatttttaggtgctggaatttgaacttttttttttttttttttaaacagggtcttacccttctcccaagctggagtgcagtggtgcaatctcagtgcactgcagcctccacctcccaggttcaagtgattctcgtgcctcagtctcctgagtagctggaattacaggcatgcaccactataccccactaatttttttatttttagtagagatggggtttcaccatgttggccaggctggtcatgaactcctgacctcaagtgatctgcccaccttggtctctcaaagtgctgggattacaagcatgagtcactgcccagctgaatttgtacattttgatgtta

SEQ ID NO: 44107 - DNA, 601 bp, Human
tgcccaggatggtcttgaactcctgggctcaagtgatccacctgcctcagtctcccaaagtgcaaggattacaggtgtgagccatcacacccagccaaatgtaaacatttttattactgatttgtattatagaatgtggtaggatttgccattaaagaaattaacacttaaatgtttacatctcatgcatacttcactgagttcctgaggtattataggtttttttaaaactattgtgctttagtttttgttcttaatattgcctttattatatttgaataggaaataaattccattttttctgagttatagacagttactaattattcaagtgcaaaaaaggatgaaaattcaagagtttccaaaatttttactgtattagaaaataaataactaattgaatcatttgatgtcaagttgagtaaaatattttagatacttttaattttttaaatctattttaagactcaaattattttagatattcatcttggaatttattggactttttgatgcacttttactcccatattgcaagacctttttctttggttttatgagctgtgaaaaacccccttctataacttgaaaaaagaagaat

SEQ ID NO: 44108 - DNA, 601 bp, Human
aggatgaaaattcaagagtttccaaaatttttactgtattagaaaataaataactaattgaatcatttgatgtcaagttgagtaaaatattttagatacttttaattttttaaatctattttaagactcaaattattttagatattcatcttggaatttattggactttttgatgcacttttactcccatattgcaagacctttttctttggttttatgagctgtgaaaaacccccttctataacttgaaaaaagaagaatgaatagtctatctttattgctcctgtcttaacatcatttrtgaggcaatctcaaaatggttacggaaatacctcttacttaagagttttcacttgttaaatgtcctcaggcaagaaccatgcttcagctaaggcaagaagataggttatgtaaaaaggctggggatgtgggagagtttgttatccaaattgcatggtggaaaggtttgtgggataaaacgttgggaaaaggaagaagcattgagcagttacaaagatgagaacacaggaaaggatagacaggtaaaggaaaggatattacggttagtgaccaaggatgataggttttagcagcaatactt

SEQ ID NO: 44109 - DNA, 601 bp, Human
agagtaaaagatcccatagacttgcttcaactaaaggaagcaactgcatttgtatcctgaaacagataactttataggtacatgattaatatcacatcacagttaatatatttttagtttagaatttttcaggatggtaagggtgaaaaaaatgggtgtacttactctactttaggagagactgttacatattgacctttaaaaatctgttttgtgtataattgagacatataacgtgatgttttgacacacatgtaaatagtgaaatgatcactacagtcaagcaaattaatgtaatccrttatcttgaatagttaacctttcttgtgtgtatggttaaaatacctaaaatctattcttttagtaaatttccagtataccaatatataactaactatagtcctcatgctgtttacagtgactattttatataaaacatgaaacactgaatattgagccctatgatatactttaccttagacatagcaaagttgctagcattcctgtgactgagcagttaaagggttacagaaactgactgtgtgtcttatttcattgaaggactattggaaatgcacttcatgcaatgaaatgaatcccc

SEQ ID NO: 44110 - DNA, 601 bp, Human
tattttatataaaacatgaaacactgaatattgagccctatgatatactttaccttagacatagcaaagttgctagcattcctgtgactgagcagttaaagggttacagaaactgactgtgtgtcttatttcattgaaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgargagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaa

SEQ ID NO: 44111 - DNA, 601 bp, Human; identical to SEQ ID NO: 44082

SEQ ID NO: 44112 - DNA, 601 bp, Human; identical to SEQ ID NO: 44083

SEQ ID NO: 44113 - DNA, 601 bp, Human; identical to SEQ ID NO: 44084

SEQ ID NO: 44114 - DNA, 601 bp, Human; identical to SEQ ID NO: 44085

SEQ ID NO: 44115 - DNA, 601 bp, Human; identical to SEQ ID NO: 44086

SEQ ID NO: 44116 - DNA, 601 bp, Human; identical to SEQ ID NO: 44087

SEQ ID NO: 44117 - DNA, 601 bp, Human; identical to SEQ ID NO: 44088

SEQ ID NO: 44118 - DNA, 601 bp, Human; identical to SEQ ID NO: 44089

SEQ ID NO: 44119 - DNA, 601 bp, Human; identical to SEQ ID NO: 44090

SEQ ID NO: 44120 - DNA, 601 bp, Human; identical to SEQ ID NO: 44091

SEQ ID NO: 44121 - DNA, 601 bp, Human; identical to SEQ ID NO: 44092

SEQ ID NO: 44122 - DNA, 601 bp, Human; identical to SEQ ID NO: 44093

SEQ ID NO: 44123 - DNA, 601 bp, Human; identical to SEQ ID NO: 44094

SEQ ID NO: 44124 - DNA, 601 bp, Human; identical to SEQ ID NO: 44095

SEQ ID NO: 44125 - DNA, 601 bp, Human; identical to SEQ ID NO: 44096

SEQ ID NO: 44126 - DNA, 601 bp, Human; identical to SEQ ID NO: 44097

SEQ ID NO: 44127 - DNA, 601 bp, Human; identical to SEQ ID NO: 44098

SEQ ID NO: 44128 - DNA, 601 bp, Human; identical to SEQ ID NO: 44099

SEQ ID NO: 44129 - DNA, 601 bp, Human; identical to SEQ ID NO: 44100

SEQ ID NO: 44130 - DNA, 601 bp, Human; identical to SEQ ID NO: 44101

SEQ ID NO: 44131 - DNA, 601 bp, Human; identical to SEQ ID NO: 44102

SEQ ID NO: 44132 - DNA, 601 bp, Human; identical to SEQ ID NO: 44103

SEQ ID NO: 44133 - DNA, 601 bp, Human; identical to SEQ ID NO: 44104

SEQ ID NO: 44134 - DNA, 601 bp, Human; identical to SEQ ID NO: 44105

SEQ ID NO: 44135 - DNA, 601 bp, Human; identical to SEQ ID NO: 44106

SEQ ID NO: 44136 - DNA, 601 bp, Human; identical to SEQ ID NO: 44107

SEQ ID NO: 44137 - DNA, 601 bp, Human; identical to SEQ ID NO: 44108

SEQ ID NO: 44138 - DNA, 601 bp, Human; identical to SEQ ID NO: 44109

SEQ ID NO: 44139 - DNA, 601 bp, Human; identical to SEQ ID NO: 44110

SEQ ID NO: 44140 - DNA, 601 bp, Human; identical to SEQ ID NO: 44082

SEQ ID NO: 44141 - DNA, 601 bp, Human; identical to SEQ ID NO: 44083

SEQ ID NO: 44142 - DNA, 601 bp, Human; identical to SEQ ID NO: 44084

SEQ ID NO: 44143 - DNA, 601 bp, Human; identical to SEQ ID NO: 44085

SEQ ID NO: 44144 - DNA, 601 bp, Human; identical to SEQ ID NO: 44086

SEQ ID NO: 44145 - DNA, 601 bp, Human; identical to SEQ ID NO: 44087

SEQ ID NO: 44146 - DNA, 601 bp, Human; identical to SEQ ID NO: 44088

SEQ ID NO: 44147 - DNA, 601 bp, Human; identical to SEQ ID NO: 44089

SEQ ID NO: 44148 - DNA, 601 bp, Human; identical to SEQ ID NO: 44090

SEQ ID NO: 44149 - DNA, 601 bp, Human; identical to SEQ ID NO: 44091

SEQ ID NO: 44150 - DNA, 601 bp, Human; identical to SEQ ID NO: 44092

SEQ ID NO: 44151 - DNA, 601 bp, Human; identical to SEQ ID NO: 44093

SEQ ID NO: 44152 - DNA, 601 bp, Human; identical to SEQ ID NO: 44094

SEQ ID NO: 44153 - DNA, 601 bp, Human; identical to SEQ ID NO: 44095

SEQ ID NO: 44154 - DNA, 601 bp, Human; identical to SEQ ID NO: 44096

SEQ ID NO: 44155 - DNA, 601 bp, Human; identical to SEQ ID NO: 44097

SEQ ID NO: 44156 - DNA, 601 bp, Human; identical to SEQ ID NO: 44098

SEQ ID NO: 44157 - DNA, 601 bp, Human; identical to SEQ ID NO: 44099

SEQ ID NO: 44158 - DNA, 601 bp, Human; identical to SEQ ID NO: 44100

SEQ ID NO: 44159 - DNA, 601 bp, Human; identical to SEQ ID NO: 44101

SEQ ID NO: 44160 - DNA, 601 bp, Human; identical to SEQ ID NO: 44102

SEQ ID NO: 44161 - DNA, 601 bp, Human; identical to SEQ ID NO: 44103

SEQ ID NO: 44162 - DNA, 601 bp, Human; identical to SEQ ID NO: 44104

SEQ ID NO: 44163 - DNA, 601 bp, Human; identical to SEQ ID NO: 44105

SEQ ID NO: 44164 - DNA, 601 bp, Human; identical to SEQ ID NO: 44106

SEQ ID NO: 44165 - DNA, 601 bp, Human; identical to SEQ ID NO: 44107

SEQ ID NO: 44166 - DNA, 601 bp, Human; identical to SEQ ID NO: 44108

SEQ ID NO: 44167 - DNA, 601 bp, Human; identical to SEQ ID NO: 44109

SEQ ID NO: 44168 - DNA, 601 bp, Human; identical to SEQ ID NO: 44110

SEQ ID NO: 44169 - DNA, 601 bp, Human; identical to SEQ ID NO: 44082

SEQ ID NO: 44170 - DNA, 601 bp, Human; identical to SEQ ID NO: 44083

SEQ ID NO: 44171 - DNA, 601 bp, Human; identical to SEQ ID NO: 44084

SEQ ID NO: 44172 - DNA, 601 bp, Human; identical to SEQ ID NO: 44085

SEQ ID NO: 44173 - DNA, 601 bp, Human; identical to SEQ ID NO: 44086

SEQ ID NO: 44174 - DNA, 601 bp, Human; identical to SEQ ID NO: 44087

SEQ ID NO: 44175 - DNA, 601 bp, Human; identical to SEQ ID NO: 44088

SEQ ID NO: 44176 - DNA, 601 bp, Human; identical to SEQ ID NO: 44089

SEQ ID NO: 44177 - DNA, 601 bp, Human; identical to SEQ ID NO: 44090

SEQ ID NO: 44178 - DNA, 601 bp, Human; identical to SEQ ID NO: 44091

SEQ ID NO: 44179 - DNA, 601 bp, Human; identical to SEQ ID NO: 44092

SEQ ID NO: 44180 - DNA, 601 bp, Human; identical to SEQ ID NO: 44093

SEQ ID NO: 44181 - DNA, 601 bp, Human; identical to SEQ ID NO: 44094

SEQ ID NO: 44182 - DNA, 601 bp, Human; identical to SEQ ID NO: 44095

SEQ ID NO: 44183 - DNA, 601 bp, Human; identical to SEQ ID NO: 44096

SEQ ID NO: 44184 - DNA, 601 bp, Human; identical to SEQ ID NO: 44097

SEQ ID NO: 44185 - DNA, 601 bp, Human; identical to SEQ ID NO: 44098

SEQ ID NO: 44186 - DNA, 601 bp, Human; identical to SEQ ID NO: 44099

SEQ ID NO: 44187 - DNA, 601 bp, Human; identical to SEQ ID NO: 44100

SEQ ID NO: 44188 - DNA, 601 bp, Human; identical to SEQ ID NO: 44101

SEQ ID NO: 44189 - DNA, 601 bp, Human; identical to SEQ ID NO: 44102

SEQ ID NO: 44190 - DNA, 601 bp, Human; identical to SEQ ID NO: 44103

SEQ ID NO: 44191 - DNA, 601 bp, Human; identical to SEQ ID NO: 44104

SEQ ID NO: 44192 - DNA, 601 bp, Human; identical to SEQ ID NO: 44105

SEQ ID NO: 44193 - DNA, 601 bp, Human; identical to SEQ ID NO: 44106

SEQ ID NO: 44194 - DNA, 601 bp, Human; identical to SEQ ID NO: 44107

SEQ ID NO: 44195 - DNA, 601 bp, Human; identical to SEQ ID NO: 44108

SEQ ID NO: 44196 - DNA, 601 bp, Human; identical to SEQ ID NO: 44109

SEQ ID NO: 44197 - DNA, 601 bp, Human; identical to SEQ ID NO: 44110

SEQ ID NO: 44198 - DNA, 601 bp, Human; identical to SEQ ID NO: 44082

SEQ ID NO: 44199 - DNA, 601 bp, Human; identical to SEQ ID NO: 44083

SEQ ID NO: 44200 - DNA, 601 bp, Human; identical to SEQ ID NO: 44084

SEQ ID NO: 44201 - DNA, 601 bp, Human; identical to SEQ ID NO: 44085

SEQ ID NO: 44202 - DNA, 601 bp, Human; identical to SEQ ID NO: 44086

SEQ ID NO: 44203 - DNA, 601 bp, Human; identical to SEQ ID NO: 44087

SEQ ID NO: 44204 - DNA, 601 bp, Human; identical to SEQ ID NO: 44088

SEQ ID NO: 44205 - DNA, 601 bp, Human; identical to SEQ ID NO: 44089

SEQ ID NO: 44206 - DNA, 601 bp, Human; identical to SEQ ID NO: 44090

SEQ ID NO: 44207 - DNA, 601 bp, Human; identical to SEQ ID NO: 44091

SEQ ID NO: 44208 - DNA, 601 bp, Human; identical to SEQ ID NO: 44092

SEQ ID NO: 44209 - DNA, 601 bp, Human; identical to SEQ ID NO: 44093

SEQ ID NO: 44210 - DNA, 601 bp, Human; identical to SEQ ID NO: 44094

SEQ ID NO: 44211 - DNA, 601 bp, Human; identical to SEQ ID NO: 44095

SEQ ID NO: 44212 - DNA, 601 bp, Human; identical to SEQ ID NO: 44096

SEQ ID NO: 44213 - DNA, 601 bp, Human; identical to SEQ ID NO: 44097

SEQ ID NO: 44214 - DNA, 601 bp, Human; identical to SEQ ID NO: 44098

SEQ ID NO: 44215 - DNA, 601 bp, Human; identical to SEQ ID NO: 44099

SEQ ID NO: 44216 - DNA, 601 bp, Human; identical to SEQ ID NO: 44100

SEQ ID NO: 44217 - DNA, 601 bp, Human; identical to SEQ ID NO: 44101

SEQ ID NO: 44218 - DNA, 601 bp, Human; identical to SEQ ID NO: 44102

SEQ ID NO: 44219 - DNA, 601 bp, Human; identical to SEQ ID NO: 44103

SEQ ID NO: 44220 - DNA, 601 bp, Human; identical to SEQ ID NO: 44104

SEQ ID NO: 44221 - DNA, 601 bp, Human; identical to SEQ ID NO: 44105

SEQ ID NO: 44222 - DNA, 601 bp, Human; identical to SEQ ID NO: 44106

SEQ ID NO: 44223 - DNA, 601 bp, Human; identical to SEQ ID NO: 44107

SEQ ID NO: 44224 - DNA, 601 bp, Human; identical to SEQ ID NO: 44108

SEQ ID NO: 44225 - DNA, 601 bp, Human; identical to SEQ ID NO: 44109

SEQ ID NO: 44226 - DNA, 601 bp, Human; identical to SEQ ID NO: 44110

SEQ ID NO: 44227 - DNA, 601 bp, Human
gtgtccatgactgcggacatctctggcactccattccacctgcgaagcgcccaacgggcctccctctctgccaggtctcctaggggttcccaggaagccaggatccctctatttccttagacctgggctctggcctgacctcactgctagggccaggctggtcaacggtggcaaaatcccgaaggaggtggaaggaggaaggcaagaagaaatgcacactttaaatagtcttccctgcaaaagaacacttctgggagccttgttttaaatctcattctctttttctctcaaaaaaaaaaaatgactgtttaacagaagagggaaaaaagcctccttgacacaaagcttttgttatccagttgatcagcaacgtgctttagatacttgtaagagggggaaaaaagccccacaacagacattgattttagaaaatcaataaccaacatttaataaaaggaacagaggaaacacaagagaggagagggggacattaggtgtaattttagtgtctactaaattactcagagatggggaaggggaggtctcctgtgtaaggaccaccttaaataatgccagacaccagagtgaaaaaaaaattaaa

SEQ ID NO: 44228 - DNA, 601 bp, Human
agagcattaaatcaagcaaaactgtgacaaggccaatatgcacatggatgatgccagcaaggcatcttcagccctttgttcacagcttaacaaaactgtgccgtcacaccactttagttcaacagtgcctgtcgaatgggcatcagcagatcagccaatgcctgtcatacacagagctagaaaacggtttgaaagcaagggcttattcgacccccaagtctagttggaaagtaaggaggattttaaatcatctagtaaaaacaccagccccctcccactccaaagttagaagagacggggmaggatgacaatttttttttttaagacatcaaggagaaaaaatgttctcaggcaaaggaaacacttttcatatttgttttctttgtaaaagcaattatacaagttttgcaatcatagaatttttcttaaagtgaccttgttgagagtaaaagttgagtatcttagacatcttaaggttttgccatgttttttgaccttttaaacaacttaatacgtgttctcatattaccaggatagtagggcattatttgacagagaacttgcaaacccatgtcattcaaaggagtatctcttcaaatat

SEQ ID NO: 44229 - DNA, 601 bp, Human
aacatctgtgctcctgctggcagatgccatcccaccaacctttctatgggcggtttgtctttgagagaaaataaagtacctgatcccaggccttagtcagtcttagctccctgtatcttctcactctgacccactgcgcgttccttcaagcagagagctgcctcccatggctacctcctcaatataaacttgctaactaatctcttagcaaacacttgaagaaaacctgaagagtggaaagagaggcagagggggaacaaaaacccagcgtagataaagctcaagacacattcaacgggaygctggaatctaaatttagtaccaaacttaagatttctttagataggcgagctgttgcctctggaacagggattttcataacaattattttgtttttaagtctcaatcttaattcttctgctatctcttaaatagggctcactttaacataaactcccttgatttttttttttctctcagtggtgatgtgcctacccttataggtattcttataggctttcttttattactgaatatctctttaataatttgtcattttaaaaagtctactctgactgcactgagtacacacaaggtaact

SEQ ID NO: 44230 - DNA, 601 bp, Human
agaatattttacatgagagaatttgatcatcagattgatctgccacaattaaataagcatattcttaggatgagctttatatggagagatcattttgcagaatgccaaacacagaagaggatgcttaaaaagccccacaaagtctcttaactccagtggtatcaagccagatactcaaaccccatattctcaattcattattaaaatattttaaattcatattgttcagagggtcagaataagcacatgaaagttaaatttcttccattaaaagattttaaaagtctagcggtttaatagyaaaaatacagcgtaaatagaaataatttttaaccagtatctaatctatagaatccactcatttgccaatagaacgcttgaaatatagtaagttgatagcataatgttttgtagaaagttgcatctttgttgaaaggaaagatgacattgaaaaacagttaatttctgtaaacgctttttctagtgataactttattaactggttttagatgtttctagatggaataacaaagttacggttcaagattctaagaaaaatatcagccttattataaattttctgtttctttcttaaacttta

SEQ ID NO: 44231 - DNA, 601 bp, Human
gcatgccacttggaacaaccagctgagctgtcacctctaaattgcacttttcatttgtgtcctaaaaatgatcaggaagggtcatgagggaaggcccgaaactaggcctgaaatcagaggatagaaagatactcccagagatcccttgagcccaggaatctcagctgctgtgagctaggatggtgccactgcactctagtctgaaccacagagtgagaccctgtctctaaaaatgaatgaatgaatgaataaagatgacactcccagagatacagtatttcttatttttcacctttctccygaaaatgtccgtattaccacaaaacataacttcagagtgaagtgaaattattgatttctgcctgaaacagcaaaaaacacgtagaatattttacatgagagaatttgatcatcagattgatctgccacaattaaataagcatattcttaggatgagctttatatggagagatcattttgcagaatgccaaacacagaagaggatgcttaaaaagccccacaaagtctcttaactccagtggtatcaagccagatactcaaaccccatattctcaattcattattaaaatattttaaattc

SEQ ID NO: 44232 - DNA, 601 bp, Human
taaatgggaaacagatttaaatatgagagaaacgatggcatgccacttggaacaaccagctgagctgtcacctctaaattgcacttttcatttgtgtcctaaaaatgatcaggaagggtcatgagggaaggcccgaaactaggcctgaaatcagaggatagaaagatactcccagagatcccttgagcccaggaatctcagctgctgtgagctaggatggtgccactgcactctagtctgaaccacagagtgagaccctgtctctaaaaatgaatgaatgaatgaataaagatgacactcycagagatacagtatttcttatttttcacctttctcctgaaaatgtccgtattaccacaaaacataacttcagagtgaagtgaaattattgatttctgcctgaaacagcaaaaaacacgtagaatattttacatgagagaatttgatcatcagattgatctgccacaattaaataagcatattcttaggatgagctttatatggagagatcattttgcagaatgccaaacacagaagaggatgcttaaaaagccccacaaagtctcttaactccagtggtatcaagccagatactcaaacc

SEQ ID NO: 44233 - DNA, 601 bp, Human
gcccagaaactgaagtgcctccatcgtagggttcctggcatcctgattagtcacaccttgaaacagtcataatcagaatttagtgagcgttttctaggctccagacactgtctttagaattttgtgtaatactcccaaagattctataaaacaaatactgctccccatttttaagcattaagaaccgaagttcagagtggttaagaaacgcacccaggggcacatggcatggagagtaaatggcagaatcagaatgtggacacaaatttgtttgggtctgaatcctgtgttcttttcattrtatcgagtgtctggcctccttggggagggaggagaactgggctccatttgttacaagtgaatagatctagagatgttattggagcaggagtctgggtggtggagattggaacatgaaacagtgaagcagctcgccttgcagcctctagcagacagcacatgcagagtatgtggaccaattcatagcttctaactttcatccttagttgtgtaacctctttgtgatattaaaatagtatcttaaattcccatcccattcacctctcttatggctgctgtccaaatcctattatttaggaac

SEQ ID NO: 44234 - DNA, 601 bp, Human
tctgaaccaaatcaaaacacatagagtaatactcaaggggacctttaaatgaatactgcttaaatgaataagcatcttaaatggacatgcttctcttgaaaggcaaacagtattttcatgttctctaagtttaattaaaggaagaaaatccatgacttttttttttggatgtattgtcattctttggaattaagcaggaaaagttgcttaaataacactttaagtgctataaatattatttttcttaaggataattgctcgtgtgtgagtgtgtgtgtgtgtgtgtgtgtgtgtgtgtgtgtgtgatgggcattggctcatgggagacaaactcttgaaacaactgagctcatccatttgttaggcatcttacctacggtaaatgaagttagaaaaacattaaagtttctaaagtgcctgccacaaccctatgagacagagaaatggactggttacttttaacatatagtttatttgcctctttagaaagtgttgttctttctccagcatggttgactaaaagcatcaactcccttaatctaacgatgatttgtaataagaggctcctttgcacatactgggtactcaaaataatgttttt

SEQ ID NO: 44235 - DNA, 601 bp, Human
agtgctctaaataaatgatcttattactcgtcacaacaatccattttacagatgaggaagctgaggtgaagtgctgtcaggtaactgcccaatgtcataggtagcaagtggtggaaatggaagttttgaacctgggcgtgctcacaaagaggacactttgctacatcagaaaggaagcacggatggactaccgaaagaaagtgtcagaatctgcccttgagtggtgtgtaccaggaacatgtataccatgagaagagtttctgaagaagtgtgagaacgataaaaaaagaagtaccagaacagcttacctccaaaaagaaagaaaaaagattggaacaattaggaggtagctggatgaagaggtgacatgtatgaagtgaacattagaagccagtccagagagcagctggcagtctcaatggagctcagagagaatgaatggaccaaaaacatagacaagagaaaaaaaaatttgtcagtgttattaaataaagtaagctggaatttgatatgtgaatgtggtgggagaggggaaagaaggctgcaaagtccccatgggccaaggccaaagcctagactaagaccacaactatgagaatgg

SEQ ID NO: 44236 - DNA, 601 bp, Human
aagccataagttgcttttttgttaaataatccacttaagcttcttttctttcctagagcctgggttgtgtcccttcttttgggaaaaaaatattccagcatttagtcagcagactggaacaagacccctacacttttcattctaaggctctctttctttgttgccattcagttatgtaccccagttctgaagtaaccctttgcatttacttattaccaaagcctgttgttcttcaatgaaaaattagtatatcatcatgttttttcaagtggcagagtcataactctcacatgtttcggtactaggacaaaaagaaaataaggatgtgtctcattgcaaagcctgaatcactctcacatttgaagaccttgaacacaaatgctttatttctggaccttaatatgtttcacttgctatgcctgcataacagcggtagttacctgatgtaagtgattaaaatccttcctgtttagaaagaagaagaatatttagcgacaggacatcagcatgcaaagagttaactagttaaacttctacaaacccccagagtaactttccaaaagctgacaataagtaaaagaagtgctggttatccattttt

SEQ ID NO: 44237 - DNA, 601 bp, Human
cgataaatgtgtttacctttgattaggtgagcttcttgataagataacatggagaagcactttccaagagtaaatatgtacagaaattgctggccactactgttctgttgagattccacatgcaacagaaacacctcacttgtccaactcacctttccgccagctaatttggctttggcaatggaaagagtagctcgtataagaaatctttaccccgtttgtagaccccaacagttctcagaaaaccctttcctggattctaaactctgtgctattatacaactcaatcataactctttayatgttgtagtgtaactgttttcttatttgtctgttcctcagtaaactatgagcactgagattttacttccctcatgtttgtctcctccaaagctaggatggtgcctggtccatggtggacagtaactggtctgttttgaatgcatgaattttcatcgtagtttttgtgattgtgtttatgaagacactggagcaacaatgttctgcaattctagagatcttgatgtggtggcagccttgtatccagtcctatgtatgtacattttgatatcttactgccttttgccaaatagggcaataa

SEQ ID NO: 44238 - DNA, 601 bp, Human
ttatgggttctgaatgcaaaccccaatagggtagcaactgccacggtaaacaatttgtgaaaaagcccttctgagcagttggactatggtcagaagtaacccccaaagttaaaagggcaaagcaaatggtggctatcgtacgccgtggtgctgaatgcttctgactcaaaggccttgaaagaaatagggcaaaggacagaaaaactatataatataaactcagtcaaccgaagttcttgttagaagtatggaaatttttggacagcctgtgaaggatgtaacgagatctaattgggaatayaacatgtatgtttcaaaactaatagccaaagcaaatcataagaaaaaaaaagaaaagaggttacctattctccgtcacattggctatttaagcaaatattgaagctttcttggcacctggttatctcatttaaacacatggtgaaataaaataatatacacgtgacatgccatagtttcaaatagcaccatctttattgaaaacatgggctgggtgcagtggctcacacttgtaatcccagcactttgggaggctgaggtgggagaatcacttgagcccaggaattcaagaccagtttgg

SEQ ID NO: 44239 - DNA, 601 bp, Human
acagccaaaagattcggagagcgcagatcaccgttttattacacacgtggtaacatatgctaaaaattaggcctgaaatatgcagcattttcaccaggttacagaaataactactaacatcacacttatttcataattaaaggaaatcctccacccacctccccatttttaccaataaaagcagaaaatatcactgaatatgtaacctttgtaccacagccactctttgccatcctttcctctgtacagggtaaggaggggggacaggcttattaaaatcccagcacttgttagtaaagargtgcaataactttgggaggaatacttcacttgaggcattctgggaaaaaagaagaataaaagaaaaaaaagaagcctcgttttaattataatccaaatataactgctctggagtaatgaggagcatttgagaagacagccttcattcagacacggaacttgggtgatgtttttcttccttttaaatggttctgttggttatacagttttaacatgcctgaaaaacaaaagaaggcccttggtgatgactccgcttctcccctccccagcaaaaacaaaacaaaaacaaaacaaaaaacaa

SEQ ID NO: 44240 - DNA, 601 bp, Human
ttggtgactgttctctcatcttgggccagcctagggatctgagaacctgctgtagttagaaagaagtcacctgacctcgaagtttccctcctgtcttttctcaatcgttccagctctcacactcaagagtcagagctctccaccactgtcctggccagagcagcaccccccaaaggtctgcatgtacctctggcaagataaatgcatatagaagacaatgcatttttagtccctatagactttctataacgtctacgtttccagaatctcatgtgtgccttaaaaacccttttcttctacatttaaaaggacagtttgattatataataatacctggatttatgcattaatctactgacagcagagcccgttaatagacatttttccacttgctcctcataacaaacctttgaaggggggagcaattattatgaggatgattttatagatgagtaaattgaatctcagaaattttaactgactttttcccacatcacctcgtgttagaatctggatctgattcctgactccagaaactatttgtctctagattctatctgtgctctcttcatcaccttgggtgtacaaatctaagtgagca

SEQ ID NO: 44241 - DNA, 601 bp, Human
acagtggccagggcttaagctctggtactgtatgagtatgcaaacaagcagatttcacaatcagatgacactgagacttaggcttactgtgccagactctctttggtgactgttctctcatcttgggccagcctagggatctgagaacctgctgtagttagaaagaagtcacctgacctcgaagtttccctcctgtcttttctcaatcgttccagctctcacactcaagagtcagagctctccaccactgtcctggccagagcagcaccccccaaaggtctgcatgtacctctggcaagakaaatgcatatagaagacaatgcatttttagtccctatagactttctataacgtctacgtttccagaatctcatgtgtgccttaaaaacccttttcttctacatttaaaaggacagtttgattatataataatacctggatttatgcattaatctactgacagcagagcccgttaatagacatttttccacttgctcctcataacaaacctttgaaggggggagcaattattatgaggatgattttatagatgagtaaattgaatctcagaaattttaactgactttttcccacatcacct

SEQ ID NO: 44242 - DNA, 601 bp, Human
tccacaaattctttaatatactgtgtatctggtgtaaaaaaaattatgtaaaatacaataattgatgctattaatgtatttggtgagataatctaatagatttccttgaagtaactctaataaatttttcttccttagtaaaaacaaccccttggtcttagattctgctcttgtacagtcatccgtacagtggccagggcttaagctctggtactgtatgagtatgcaaacaagcagatttcacaatcagatgacactgagacttaggcttactgtgccagactctctttggtgactgttytctcatcttgggccagcctagggatctgagaacctgctgtagttagaaagaagtcacctgacctcgaagtttccctcctgtcttttctcaatcgttccagctctcacactcaagagtcagagctctccaccactgtcctggccagagcagcaccccccaaaggtctgcatgtacctctggcaagataaatgcatatagaagacaatgcatttttagtccctatagactttctataacgtctacgtttccagaatctcatgtgtgccttaaaaacccttttcttctacatttaaaaggaca

SEQ ID NO: 44243 - DNA, 601 bp, Human
gtgaatgctcctgcctgatagacattttatatttctgtaggttctgggatcaggatgcttcaatttgaatccagctgactaacttcctaacttgtgacttttgttaagttatctaacctgcctccatgtcctcctttattaagtggaggacaagaatatctatccactgggtcagtggatggttgtgaaggttacatgtaaagcacctagagaccagctcccagaaagtgcttagtaataaatgctaggtattattataattattagccaagtctagggacagttttttggtgacagtgasttccgtatcattctttcacatgctaattttgtgacaatcctattgtgacttacagtggtaagattttatttttactccgtttctaagttggataaagggcaatgcagggcattgaaaggtcatgacatttaagcatgaaatatataatttaggagtttgggggcacctgctgtggaaagggggcatcccagacactaaactaggttccatgctgccaccctatgaggtaggcagccggactccattttacagaagaaaatgctaaacgttcaagatgataaaggacttactgaaagttca

SEQ ID NO: 44244 - DNA, 601 bp, Human
accagtgatcatatttctttaaatgacatattctaagttcttcagatcccagttctgttttacacgcaagatttctctggctgctaagtacttggtcggtaatagcctttactgtataaataagagggttctgactgcactggcttcctctgctttatgcagtggtagcaatggaaaaatgactggggtaatcaataagtagttcataaaaaagtagagaaaatttgcataactggttcttcttagcttacccataaaatgtattatgatatttctcatatgtctaacatgcctatatatrttcttccttccatcactagattttgttgagggcctacaaatatgctctttattatttattattatcccttaccacatcccccagttactcccatcttgtccattcatcacaactacaggagaatttttgactagaaaacaacacattttctcacaactctaaattctcccaacttatcttcaattaaagataaattaatgagccataaaaactgtaccatggtactggactacctaaacatgctgaggccatttcccctttgaagcatgatggtccctaactcgtagctgagtaagggac

SEQ ID NO: 44245 - DNA, 601 bp, Human
aagatgtcagggggacctggcctctcagatgggataaagatcagaaggaaagctgtccaggtgatgcccaggcccctgaacaggcctatctgcactttcattcaaatgataatgagtgtgtaaatcacatctgttccccctctgtgcctgtatccttgtcacctgaatagcatccccaccaggtatcaaatgagctacaggaaataggttttctttttatccaacttcactctgaaatgagaaaatgagcaccctgacaaggaagcccacaaaccaacagggattccaagcccagatttcmtcataataaagaatgtttaattgttagatgaaggttcagtcggtgagggggaacaccaaggttttgatacaaaggtagctctctggctcctcactgcccaattcttgaatagcctcagaaaagtagcctgataattagtagtcactgacttttaatgatctgatctcattctaatggcacaaccccaaaatctcaggcaagaccagcaattctcacctctctgtcttcttttaagtatggaaacaagggctgatgagatggaagcactcctggaagcctgacagtaagtaatattttgca

SEQ ID NO: 44246 - DNA, 601 bp, Human
atttattatggtggaaaatcacagaatcactgtacaaatcacttttgtattgagcccaaagaggtcacactgttgcatatatgctcttttagtgaagaaattcctgatacaagcaatatcaaaatattcagttaaattatttaaaaaatttagtttcatatcatcagaactacccagaatctatataagttcatgaatatgctttacataatgtaactcactaacataggaaaagaaagctatgtactgttaggctcactcaattttcaagccaaggaacatatttattgttaagacttawaagaataagaaatcactcttcccttattcttcaaatattttttgcaaaataaattaatcaatacctacaggaacacctaatttactatttttgaaagaggtaaaataaagatttaagtgatgagtttattcaaaatttcaaattgcctgacaagttaagatatagtaaacatatattttatgaagacatcttgattttttttggtgaataatttacctttccttacaaagcatgtatattttaatagaaagacactttaggtatatttttctcaatactatttttgaacttacaacactg

SEQ ID NO: 44247 - DNA, 601 bp, Human
tgcttggacaccacagcgcctaactccagacttgcccctaaagtcgttcaatgatcaccctcttttccttccttctcttcctttagctgcacgagagagagagagagagagagagagagagagagagagagagagaacctcatgcctccctagtatgcttcaactgcttctccccatgcctcaattccccttccctgccgccttctgtcattttcaggtagtggaatttgctgaccctggccgcttggcggcctaagcctggacgtggcaaaagtcagatagtcacagtgcactattgagwtcatctgtgtcacaaaagggcttttgctttagatctctagtttggttcagtaatttccatggacttccttccttcactgaaaagagaggccaaatcatatgcttcttcctcattttacctcaaggaacaggttacacaagttaaacaatcacaccagcattaattttctaaaaaaaaaaaaaaaaaaggagtaaattttcactttctgaggtggcaaggaaaattcctcaaacaaagagaccactcttttactgtaaacaaatgtacttacaatttttttactccctaattctttgggaa

SEQ ID NO: 44248 - DNA, 601 bp, Human
gatgacatcggcatatggttaagtcttcttgcagctgatgtcacccagactttcccctttttttgccacccaaactgcatgtaaacaaacagtccaacaacaagtgtcctcaagcagggcgctccatgcttggagcaatctagtttgccgccaccagacacggctctgcttggacaccacagcgcctaactccagacttgcccctaaagtcgttcaatgatcaccctcttttccttccttctcttcctttagctgcacgagagagagagagagagagagagagagagagagagagagagaaaacctcatgcctccctagtatgcttcaactgcttctccccatgcctcaattccccttccctgccgccttctgtcattttcaggtagtggaatttgctgaccctggccgcttggcggcctaagcctggacgtggcaaaagtcagatagtcacagtgcactattgagttcatctgtgtcacaaaagggcttttgctttagatctctagtttggttcagtaatttccatggacttccttccttcactgaaaagagaggccaaatcatatgcttcttcctcattttacctcaaggaacaggtta

SEQ ID NO: 44249 - DNA, 601 bp, Human
acagctcttccagaggaaaacaattaccttcaaggtagcaagaggtgtggctcatcttaatagatcttagtggatggggagaagtgaaatcattgagggggaaatagagtcataggtctttagaagagatgtggctcgaagtaggggggctggagatctgcttgtggtagaggtttcatcagtagctttctcctgatcgctgtggcttaaagtatgggtcgttacaaacttgatcacatgcaaaaaattctaatctcagtcaatcttgcctcttaccccaaagaaatgcctgaaaggggakcatgcaatggagtccaattcttcatactgccctgaccagatttatctttgaaatctcagttttaagctacatctaatacctgagaaaggcatgtaaagttcacttccctacccaaaggatttctcttaaggcttagcagtagattcaggtctattgggctaatgacattatttactgtgtagtatgtttaaaactgcagccaccctactcacatagcaacaccctgactaggaccctgttttcaaaacagcatcattgcacctcacaattgacaaaaccagacaacggtgaaagggacag

SEQ ID NO: 44250 - DNA, 601 bp, Human; identical to SEQ ID NO: 37779

SEQ ID NO: 44251 - DNA, 601 bp, Human; identical to SEQ ID NO: 37780

SEQ ID NO: 44252 - DNA, 601 bp, Human; identical to SEQ ID NO: 37781

SEQ ID NO: 44253 - DNA, 601 bp, Human
gccctggcctcagctttctacttgcttcaacaaatacactcagttgtaaatctcatagtcctgtgtgatcttgaacatgatctgagtatatttgcataactctcaaatctctatctccagccctgacttcttgggtttcaattcctcatttccaaaggacattcctatattcccatatctatatatcttttatatgaaaatacttgtgtctaaaggctggttcaagatcttctcaaaattagatccttcttctgtaaatctagaaatagcaagtactgctatatgctaaacatgcagatcygtaattttgaagccattttgcctccatcattcagagaatcaattgtttgttaagaagtcatgttgctaatttcatcactgtctccaccttaggacaagatttttatcacttcacacctggataactacagtgacttccagttggtctctcagagtctggttttcacccacagaaatcatggtagcataacatgacccagactcttctgtctggtgctttatattctccaccatctggctttaacttaaatgtccagctttatttcccagaaattgcctcctaggactctctgattcagcc

SEQ ID NO: 44254 - DNA, 601 bp, Human
actatttttgagatagggtcttgctctgtcacccaggctggagtgcagtggattatggctcactgtagcctccaactcctggactgaagccatcctccagcctcgacctcctgagtagctgagattatgggccagaccaccacaactggcttcattatttatttaattacctcagtaattatttatttaattactggctagagaacaaggtcagccaatgaggtagataccaggatgatccaccctcatttttcagctgaagaaacctcttgtcttcatgaaattgactacatgaaataarggcaaacaatataaggaggaacgatgaaacatgctgaagttagccacatacaccttagggttgtgggatttcagaaccccacaagggttctgaagagattgctgtcgtttggggtgttcagagatgaccacattaaggaaatgggatgtgacctggacttgaagaacagaaggatggggagaatttggatgactggaagaaaggagctgggggattagggtctgaagggatagcatgggcagagattcagaggttggtataaatgtggttcttttttgttgtcaccaagggatttggtct

SEQ ID NO: 44255 - DNA, 601 bp, Human
ctgtatactgcaagcaaaatgacgcctgtcccatgattacatttcccacaggatgccattgcattctgggaaacttcatcacttaatagatagtccatgcagaacctggcttcacagtgcttaggctttctctaatccagcaacatggatggccacacttgctcctgggctaaccctgggacaagaaccagaaccgcgaactttcgctctctgatttctactttctccccttgcctatcatccagtttctcattcccttgaaacgtgtacttcaatgtgacaatcaggccctgaaaagttycctagtcccttttacccattctgattttatttacctcagttcaccttggaacttgaaatcatcacttccatctctgtcccttacacttgtatcattcttaccctgctgaactacgatccagtccaatttctggagtatcaaacgtatcttaaaaaaatcttaaataatagtatagtcttgttgcagactatgttttcaaaatgggatattccttcctaataattgaatctccacgcattgtccacagcaattattctacatgtccatgtctcaagattccaactgtattcctattccctt

SEQ ID NO: 44256 - DNA, 601 bp, Human
catggagaaacaccatctctactaaaaatacaaaattagccgggtgtggtggcacatgcctataatcccagctactagggaggctgaggcaggagaatcacttgaacctgggaggcggaggttgcggtgagccgagatcgtgccactgcactccagcctgggcaacaagagtgaaactccatctcacacacacaaagaaaaattcccaatatagacaatatgcacttgtctttcacattactgtgtaacctaaaaatttggaattggcatattaccaaaaagatagactagtttattatawtttagaggagttgatgaagtaaggtgattttgcccagcaattcaatgctcttttcttatgctttatgtagagacacgtgaaacctaagaatgctcaggacagtcagtgattttcaaaagtcagtggcatccgtatcatctgggagcttgcttgaaatgcaaattattggggcccatccaaacctatggaaccagcaatctgtgttttaacaagtctttcacgaaattctgacccttgtccaatttaagaactctacaaattcaatcctctgcctcgcatggctaaatgagacattcataa

SEQ ID NO: 44257 - DNA, 601 bp, Human
tagtaatatacagtttttctgcccagtacttcaacattcaccttgtcctaggaatgcttctccatttcctgattgccaaggcttatggtacccaaggagctgctgtgttaccatgtgatcctgctcccctagccacaattgatctctgttgctcaggtgagccaatctcagtcctctcttctccaggccaacttgttgattggtccagggtagccaatagatccaattaaattcaataaatcccttccctatgattttaggactttgttccagaaaaagcatcaaggcagtttttttttttctgccaagtgactgtagctataaaatgtggaatgaaggaattgttattttccatctagaaaaagaagatttatgaagagagaataaagcagacatacagagaaaagcagacaagattgcatgttctgacagttcatttctagctcttctcgttcctgaggccgaggtgcaccttgcagtggttcggttgaccaccttccttaaattccgtgagccaagaaacttccttttctgcttgaaggtatgttgtgtttcagtctcttaaaactaaaatcaccctaacagttacaatactaggaca

SEQ ID NO: 44258 - DNA, 601 bp, Human
cttgaaattttgcttaaatctgttattagctggacttaataaagaatatgggctttagataagatcactttccccttgctgtatgcacaatgtcatggatgctttccaatggatacttattggtggtgactgtgatgatgtcatttcacttgcatcactgagcccctatggagtatgtagaaactgtcaacttgcataaagtatttgctcattgttttggatcatcaaaataacatcagatctataaaaaaatcaccttttacttttgatgggaagaaaggataaaaggggcaaaatggcrgagccatgatgaatgtcttttgagtaacttcactgattttatcagtgactgacttctttttcagtactatgacagcacaaagtaacgtaatagctcctttctgaattcgtatctacttgagggttgtcaatggtttatgttaagggttaagacatggtttaagttttttgagaatattgtcctacttgatgaccttagtgtaacctagtaaacatagatggatgtacatttaatatcctaattttatcttgatatttcagcaactatttgaatgatctggctatctttgcatgaattttc

SEQ ID NO: 44259 - DNA, 601 bp, Human
aacaacggtctattccaagaccgtatttccctcaaaaatagatttggaatgtacagtagtggattaagattttataccttgaaattttgcttaaatctgttattagctggacttaataaagaatatgggctttagataagatcactttccccttgctgtatgcacaatgtcatggatgctttccaatggatacttattggtggtgactgtgatgatgtcatttcacttgcatcactgagcccctatggagtatgtagaaactgtcaacttgcataaagtatttgctcattgttttggatcrtcaaaataacatcagatctataaaaaaatcaccttttacttttgatgggaagaaaggataaaaggggcaaaatggcagagccatgatgaatgtcttttgagtaacttcactgattttatcagtgactgacttctttttcagtactatgacagcacaaagtaacgtaatagctcctttctgaattcgtatctacttgagggttgtcaatggtttatgttaagggttaagacatggtttaagttttttgagaatattgtcctacttgatgaccttagtgtaacctagtaaacatagatggat

SEQ ID NO: 44260 - DNA, 601 bp, Human
tagtatgatagggattggagaaagagaaaagtaggtcctgggaatccggttaggaggttcctgtcctaggccaggcaaaagatactgttaaggaattgatgatggagatgaaggaagtgtctggatttgagaaatacctaagatccaaaattcctcagattcatctgggaaagaattcagtttgtcaagttgggagatgctaaggtacctccctcaggtttatactttccaaatttgatggatggtaggtgacattcatcaaagcaaagaacactagaattctaaaaagacttgaaactayaaacaaatatatgggaccaaataaaaggaagtgggagaattacactatgtggaccactaaactaagcgccagtaatcctgaatgctgtgatctcaaacctttcttttttgcctctgtaacttctaataaggttaacaagaacaacggtctattccaagaccgtatttccctcaaaaatagatttggaatgtacagtagtggattaagattttataccttgaaattttgcttaaatctgttattagctggacttaataaagaatatgggctttagataagatcactttccccttgctgtat

SEQ ID NO: 44261 - DNA, 601 bp, Human
agcttgtttaaggatttgggtttttactctaaaagaagcaggaagctattgaagagtattaagcaaggaggatggctggatgaaactatgattatttgcatttttagatgacatccttggctatagtatgatagggattggagaaagagaaaagtaggtcctgggaatccggttaggaggttcctgtcctaggccaggcaaaagatactgttaaggaattgatgatggagatgaaggaagtgtctggatttgagaaatacctaagatccaaaattcctcagattcatctgggaaagaattmagtttgtcaagttgggagatgctaaggtacctccctcaggtttatactttccaaatttgatggatggtaggtgacattcatcaaagcaaagaacactagaattctaaaaagacttgaaactataaacaaatatatgggaccaaataaaaggaagtgggagaattacactatgtggaccactaaactaagcgccagtaatcctgaatgctgtgatctcaaacctttcttttttgcctctgtaacttctaataaggttaacaagaacaacggtctattccaagaccgtatttccctcaaaaa

SEQ ID NO: 44262 - DNA, 601 bp, Human
ataatataagattaagcctattttaatagtctatctgaaatttcattttcttctaagaaaggtatatttaatttttcattgtccactagactgagcgtccctaaccacagatacatcctgttgctaaatataagtttttaaccctccaccctctgaatgtcacagacagccaggactacatagtctgagacagatgcaaaaggaaagatattcctagacagataataatgcaactttgttaaaaaaaaaaaagcaccagaatgtggcattttatctttccctataattttaatctttagttccgtattttaaagctgctgaaaataaaattaagctcacagctgatagaaataaaataaaaagtaacagagggagttaagaaactggtgtgtgattttgatgtgactttaacttttgtaattatgactctattcctgtgaaatgaataacagttgtaactcaattttagcaacttgtgtcataagattttgtatatttgaaacctctagatgtgtttctgaaataagatgtggcttagctatcataaataatatttttatgctaacaaagttgggagagtagctgttatattattctttat

SEQ ID NO: 44263 - DNA, 601 bp, Human
tttttttaaaaagccaacaactgcattctaagatccataaacattaaagataatataagattaagcctattttaatagtctatctgaaatttcattttcttctaagaaaggtatatttaatttttcattgtccactagactgagcgtccctaaccacagatacatcctgttgctaaatataagtttttaaccctccaccctctgaatgtcacagacagccaggactacatagtctgagacagatgcaaaaggaaagatattcctagacagataataatgcaactttgttaaaaaaaaaaaagcaccagaatgtggcattttatctttccctataattttaatctttagttccgtattttaaagctgctgaaaataaaattaagctcacagctgatagaaataaaataaaaagtaacagagggagttaagaaactggtgtgtgattttgatgtgactttaacttttgtaattatgactctattcctgtgaaatgaataacagttgtaactcaattttagcaacttgtgtcataagattttgtatatttgaaacctctagatgtgtttctgaaataagatgtggcttagctatcataaataat

SEQ ID NO: 44264 - DNA, 601 bp, Human; identical to SEQ ID NO: 37782

SEQ ID NO: 44265 - DNA, 601 bp, Human; identical to SEQ ID NO: 37783

SEQ ID NO: 44266 - DNA, 601 bp, Human; identical to SEQ ID NO: 37784

SEQ ID NO: 44267 - DNA, 601 bp, Human; identical to SEQ ID NO: 37785

SEQ ID NO: 44268 - DNA, 601 bp, Human; identical to SEQ ID NO: 37786

SEQ ID NO: 44269 - DNA, 601 bp, Human; identical to SEQ ID NO: 37787

SEQ ID NO: 44270 - DNA, 601 bp, Human; identical to SEQ ID NO: 37788

SEQ ID NO: 44271 - DNA, 601 bp, Human; identical to SEQ ID NO: 37789

SEQ ID NO: 44272 - DNA, 601 bp, Human; identical to SEQ ID NO: 37790

SEQ ID NO: 44273 - DNA, 601 bp, Human; identical to SEQ ID NO: 37791

SEQ ID NO: 44274 - DNA, 601 bp, Human; identical to SEQ ID NO: 37792

SEQ ID NO: 44275 - DNA, 601 bp, Human; identical to SEQ ID NO: 37793

SEQ ID NO: 44276 - DNA, 601 bp, Human; identical to SEQ ID NO: 37794

SEQ ID NO: 44277 - DNA, 601 bp, Human
cactcagtcatttatttaactatttagccctaaatcagtgggtgactaggagattctgaattctgtgatttcgttaaaatcaatcagtttttaattattatacaagctttttactttaaagttgtagctgtctaaataaaattgtgaaagcacaatttccaaacctaaatcgaaggcacattgatgctgtccatcagaaggtattgataatttaaaaaaatattacaaactatcttttatctttttataaaggacctaatgtcatttgagcttaaccataatcctttgaagaaagtaaaakttaactttaaataacattgacatacagagcagttaggtgatttgtctgagaccatatggtatgtatgtcccccgtcttgataaaattaacactaaatatgtaacatttgaaaatttgtaaaatatgtaaaagttgaagtttttaaaagtttggatttaagttcttcctttcagaatatgagcatgtcactttatttgcaaactaaacatggcataacattatggcttgtgaacactaattgtcttagctgctggggtgaatgcagaattaagcagcaattagtatgagtgaataaattgc

SEQ ID NO: 44278 - DNA, 601 bp, Human
aggcaagctctcttgattctgaatttcattagaaatgtttgtctaagtctttctcatatggtcagaatgagagagggtgcccttctagtaatatgtcattatgtcaaataattcatcaaccaattttgtttattctctcgaactgccactttggcggcaggggtactctgtctaaatgagatgtctataaagataaattaaacatgattcaggcccccaggtagagttcagttcagtagggtagaacagcaactcagtccagctaccatcagtaatatgtttgtagtaagactaatctgakagtaaggcagaaaaacatctcatggaattttaggaatagccaagaagatgggtcccctggagacttgcacatagcatgttgcatgaaggattcagtgacttgcaagatgggcttgtcttgtcaccttttcaggagacatagctgttcaatcccttgccattgtgtaactaagtgactcttacttgctgctggaatcacttcatgcttttcatgctttaacaatcagtggttctgttttactttgaaaaatgagtcattctatgacagtattcctcctagaccctagcatttcatagcttc

SEQ ID NO: 44279 - DNA, 601 bp, Human
ctcatatggtcagaatgagagagggtgcccttctagtaatatgtcattatgtcaaataattcatcaaccaattttgtttattctctcgaactgccactttggcggcaggggtactctgtctaaatgagatgtctataaagataaattaaacatgattcaggcccccaggtagagttcagttcagtagggtagaacagcaactcagtccagctaccatcagtaatatgtttgtagtaagactaatctgatagtaaggcagaaaaacatctcatggaattttaggaatagccaagaagatggrtcccctggagacttgcacatagcatgttgcatgaaggattcagtgacttgcaagatgggcttgtcttgtcaccttttcaggagacatagctgttcaatcccttgccattgtgtaactaagtgactcttacttgctgctggaatcacttcatgcttttcatgctttaacaatcagtggttctgttttactttgaaaaatgagtcattctatgacagtattcctcctagaccctagcatttcatagcttctatctatgattattttaaattctagctcctgtatctaactgaatgaataagc

SEQ ID NO: 44280 - DNA, 601 bp, Human
tatagcaaataattcacagatctttgatgaaactacattgtctttagtgggtaagtgtccaacagaggtctaataaactatgaccaggcaattgataatgccaagcggtagagacacagtgatctctcttcaaaatgcagtttccttcatcagaaagctatgtgtggggagccatttagaatcaagtttcaggcatagcaaatgtttttgatctttcctatccatacatatgtccaaataaatatagtacctggcagaatgtattattatcgtaagtaaagtacataagtgtgctcttaaktgttattggtgttcagaggaagacaggctacttttgcctgagacatcctaacaggcctcttgaaaaaagcattggagcattaggtctttgaaggttggctagaatccaaacaagttgaaggggagcaaaacattttaggcaaaggaaatggcatgagaaaaatcacagaaatagaaaatttcatgtggaggacaaataatacttatggtcagatattgaaagcaccatccatcaatgttgaaatcctacacttttgtacagaaccatggattgaagcagttaggagtcacaactgatatc

SEQ ID NO: 44281 - DNA, 601 bp, Human
agtctgaattgagaaatattaaacatatcttgtgatccaatattcccctaagttatacactcaaatatccaatgaccagcttgacatttctacctgcatgttcaatacttatttgaaacttaatatatcctaaatataatttttttttaaacagtcatgctctgttgcccaggatggagtgcagtggcacaattagctcactgcaacctcagactgctggtctcctaccccatcctcctcggtagctaggaccacaggtgcatgccagtgccagcacacctggcttttcttttcttttttytttttttttttttttttttgtagagatgacatcttgctacgttgtccagactggtctcaaactcctggcttcaagcaatcccctgcctcggcctcccagtgctggggtaacaggtgtgaaccaccacaaccagcctgctaaactgaattccaatttccctcctcaaaatttttcttccccaggtatttttatttcatcatatttcacatatttgcccatatcccaaagctagaagaaagctcctttcctgtcctcactagaaataatctatccaccagtcctatctactttttctccaaa

SEQ ID NO: 44282 - DNA, 601 bp, Human
atgctctgttgcccaggatggagtgcagtggcacaattagctcactgcaacctcagactgctggtctcctaccccatcctcctcggtagctaggaccacaggtgcatgccagtgccagcacacctggcttttcttttcttttttctttttttttttttttttttgtagagatgacatcttgctacgttgtccagactggtctcaaactcctggcttcaagcaatcccctgcctcggcctcccagtgctggggtaacaggtgtgaaccaccacaaccagcctgctaaactgaattccaattkccctcctcaaaatttttcttccccaggtatttttatttcatcatatttcacatatttgcccatatcccaaagctagaagaaagctcctttcctgtcctcactagaaataatctatccaccagtcctatctactttttctccaaactacatcataaatccacactcttctctctacctttgccctcatcaccaaatttaattcaccaccgtttctctcctgaactactgtgttatccttaatcggtctcccttttcaactttttttttttaattatactttaagttctagggtacatgtgc

SEQ ID NO: 44283 - DNA, 601 bp, Human
cttaagtctgaaactacattgtttttctattcttcatttacaaataaattgtacaagggttggcacttatgcactctctcatacactgctgtcctgccattactgggagtcacataataggtaccaaataaatacttgttgaaagagtaaataaatgtataaattaaatgaaatcagcaaaactatatgtaaatctaactagcccaaagaaattttatttcctgtaatatcattttgttcaaaaaaccaaacttaggagaggagaaatataaacaaacaagcttgggtgaagtttaaaacrtatgtgattaaatctccattgtcatttatccttttccaaaaagtgggaaatgttgcatgatgattaaacagaatacaatgtggtttcaagaaacatcacacaatcctgtttgttctaagataataaatatggtgttgaaaggaagaaatttataattactaacagcagcaggtggatgaatctctttggtattcatatgaacaaaatactaacattttaagtaaagttaccttttccatgaatatggttttcactcacaaaaaaggattttgttcaggttcaatatgtccatagttttaa

SEQ ID NO: 44284 - DNA, 601 bp, Human
tcaaaaaccaaagaatagaattaccacatgatccagcaatctcacttcaggatatattgccaaaagaattaaaagcaagatccccaaaagatattagtacactcatgttcatcatagcattattcataatagccaaaaggtggaattaacccatcatcaatagatatgatggaaccttattaagttttaaaaagaaccatgctctacatggttcacatgaatgaactatgagaacatcatgccaagtgaaataatccagacgcaaaaagaaaaatactgtgtaattccaattataccaagyatctagattggtcaaattcataaaaaccaagtagaatggtagttgtcaggaacttggagagggagaaatgaggagttattgtttaatgggtataaaatttcaattttgcaaggtagaaaaattctggagattggttgcacaataatgtgaatgtacttaactgaattgtacacttaaaattgttaacagaataaattttaggtgcattttagcacagcattttaaatatttatcaaaaataaaaacgttttccccttagagaaaagcagcattgtacatataatcacttctgttatactt

SEQ ID NO: 44285 - DNA, 601 bp, Human
gccaagtgaaataatccagacgcaaaaagaaaaatactgtgtaattccaattataccaagcatctagattggtcaaattcataaaaaccaagtagaatggtagttgtcaggaacttggagagggagaaatgaggagttattgtttaatgggtataaaatttcaattttgcaaggtagaaaaattctggagattggttgcacaataatgtgaatgtacttaactgaattgtacacttaaaattgttaacagaataaattttaggtgcattttagcacagcattttaaatatttatcaaaaayaaaaacgttttccccttagagaaaagcagcattgtacatataatcacttctgttatacttaaaagttgacttagtatcctaattataggtataatattgattttgattagttatccaatagaaagtaactgaaggattacaaccttggataagtcattgctgattcttaaagataagagatagaaattggtttaataaagaatttaaatagtttgcttgtttaaaaaatatagttttgctggacacggtggctcacatctgtaatcccagcacttagggaggcggaggctggaggatcac

SEQ ID NO: 44286 - DNA, 601 bp, Human
tttttaatcttgaagaaagtctacaggcatagcctgtacttttttgatgtttttctattatatattatgttttctctgggtttctaatataaattttattaaaataagtactttcattttctattcttagatggtgcctgagatgttatcagagaaaggggtcaaaaatatttttaatcagcttttgtacttatgttcaacattgtcctaaagagcacagctgaaaaataaacaagcaaaagaaaggaggaagagagagagagaaggaaagaaaagaaagaagggaggaaaaaaggaagakataagaaagaaataaaaagaaaagcaagagaaatgcaaggcatacatgtggaaagatatctttctaaaatttttaaaataataaatattcctgtttgaaacatcctcatacctaaatttctgaaagcatactggatagccccataagatatatggcttttgcacagacacaggacaaagacaatctttttcagagtgtcaaactgccatcccagaaacaagttgtgcaaatttacatttcctccaacagtaaagacaattgcctcactaactttggggatcagtaggattgtttttgttt

SEQ ID NO: 44287 - DNA, 601 bp, Human
aagaagggaggaaaaaaggaagagataagaaagaaataaaaagaaaagcaagagaaatgcaaggcatacatgtggaaagatatctttctaaaatttttaaaataataaatattcctgtttgaaacatcctcatacctaaatttctgaaagcatactggatagccccataagatatatggcttttgcacagacacaggacaaagacaatctttttcagagtgtcaaactgccatcccagaaacaagttgtgcaaatttacatttcctccaacagtaaagacaattgcctcactaactttggrgatcagtaggattgtttttgtttctgttttttggagacagggtcttgctctgtcacccaggctggagtgcagtggcgtgatctcagctcactgcatccttgacctcccaagctgaagtaatcctcctaccttagctcctggggtagctggaactacaggtgcgtgccaccatgcccagctaatttttgtattttttgtcaaggcagagttctgccatgttgctcaggctggtctcaaactcctggactcaagtagtcctcccgcctcagcctaccaatgtgctgggattacaggtgtaag

SEQ ID NO: 44288 - DNA, 601 bp, Human
aataaacctgatttagtagtaggagaggcataccatgagccataatttctgttttaggtgaatagtggtgatattcactgatacaattaacttgttttggaaactattcattgaaagaggaactagttttttatttgtttgtttatctcttgttgccctgtcacctgtggccttgacctccgagtccaagtggcagctgttacaagcagtgagaatcaggcagtgacaaagaagaaaagacaaataatgtgtgtgcactctcccttgagaaaggtttcagtttgcctcatgagttttaacrcatatatagacctaagcccctgggccagtgtttggtcatggccctgcctatctgcaaagaagactgagtctaaaacacaatttttgttcttggtggccacatgcaaagctaacaattctatttctgtaaaggaaaaatgaaatgcatgtagggtacaactagcagttgagtttagttagaaggtagaaatttgacagtcatcagcatttaggtaatagttgaaactgtgggtacggatgatattatcttggcatcatacctaagtgagaagaaggtggtagaaacaaaattctaggcatt

SEQ ID NO: 44289 - DNA, 601 bp, Human
tcctcaaggaattttatccacaaaggcgtggaaaatctcttttgaaatcctcgaaatacgaagtgtctctccctcagatgccataccactcatcaatctagacctcagagagaactaatgggttcaaaattaggcaagagtatctaaggagtgtgtgcaagtagactgtagtgatcctacatttttctccatcttcttcctgaaattataggaattatattcaaagtccaagaagcttgttgggagcatagccttgtatggggcatccctattggaaaaaggacatgaatatttcctcagygcaccaccaggaaatttaatattatgaggtacatagcaacacaaaaaaatcttcactcactaccttctgaataatagtaaaaagaatatacttttttatttagtaaaatgcagaaatcatacatctctacaaattttacaacatgagcacctctgtgtaacaagatcctagatcaagaaacataacattgccagcacttgggaaaactgcctcgtaccccctttcaggaactccttctttagggttaaccagtttttctgtagccagtatgcgagtatcaacttgtggcatgtgaatgcc

SEQ ID NO: 44290 - DNA, 601 bp, Human
cagcctgggcaacatagtgacaccctgtcactacacacctttttctgttcatacttctatttaacaagtgatgctggaccatgatgttcccagcattttattttttaatttcatcctaagatctgctcttatcccccattaagaaggattggtagaatgttctctttcctaatgacagaagtatgaaataacttgttcatcaggagagtttattattgatattgttaatatttaaatacacattccataaattggaatattttgttgtacagtctgagatttaacacatgtatagaattayattaacacaccttctctcagtatatagaacaatttcataacccccaaaagactcctttatgctagccctttgtaaccaatctctccactatacctctaatccctgataaccactaatctattttatatccccattgtcttttccagaataacatatgaagaaattatatactgtatttagtctttggagactggtttcctttacttaaggaaatgcctttgagattaagcaaagttatgtcaatgaagtgtttcattttattgctgaatagtattctaccccaagaatggactacagtag

SEQ ID NO: 44291 - DNA, 601 bp, Human
tttttctgttcatacttctatttaacaagtgatgctggaccatgatgttcccagcattttattttttaatttcatcctaagatctgctcttatcccccattaagaaggattggtagaatgttctctttcctaatgacagaagtatgaaataacttgttcatcaggagagtttattattgatattgttaatatttaaatacacattccataaattggaatattttgttgtacagtctgagatttaacacatgtatagaattatattaacacaccttctctcagtatatagaacaatttcatracccccaaaagactcctttatgctagccctttgtaaccaatctctccactatacctctaatccctgataaccactaatctattttatatccccattgtcttttccagaataacatatgaagaaattatatactgtatttagtctttggagactggtttcctttacttaaggaaatgcctttgagattaagcaaagttatgtcaatgaagtgtttcattttattgctgaatagtattctaccccaagaatggactacagtagtttattcatttgtccactaaaggccatttgagctgtgtc

SEQ ID NO: 44292 - DNA, 601 bp, Human
ctactgcatctttccaggtctcatatattctttctcttctttttttcctttgtcttctcctagtttttcttctcccatttataaatgtaaaaacattcttagctttcaggccatacaaaaacaggtcatgggcttgatttggaactcaaaccacagtttgtcaagtcgttttagaatgctataagttgattgctggatcatattataggtatatttttaactttataagaaactggcaaacttttccagagtggctgtaccattttgcattttgcattgccaccagtaatgtgtgggaatrtctgttgttccccatattcacccccagttggtattaccagttttttgttgttttgttttttagtcacatatgtttgtataagtatcttattttggtatttatatgcatgttcctaatggctaatgaacttaagcattaaacatttcataagcttatgtaccatccatgctctagagaaatgtctgctcaaatattttgactacttttttttaattggattttttgttttttaattgttgagttttgttttttggggattatggagctttttgtttttttgttttttgtttttttaaagag

SEQ ID NO: 44293 - DNA, 601 bp, Human
cattttgcattttgcattgccaccagtaatgtgtgggaatatctgttgttccccatattcacccccagttggtattaccagttttttgttgttttgttttttagtcacatatgtttgtataagtatcttattttggtatttatatgcatgttcctaatggctaatgaacttaagcattaaacatttcataagcttatgtaccatccatgctctagagaaatgtctgctcaaatattttgactacttttttttaattggattttttgttttttaattgttgagttttgttttttggggattwtggagctttttgtttttttgttttttgtttttttaaagagacaaagtcttgtttcattagccaggctggagtgaagtggtacaatcatagctcactgcatccttgaccttcttgggctcaagcaaatctcctgctaattttaacagacagggtctcgctttgttgcccagactggtcttgaactcctgactttaagatatcctcccactttgacctcccaaggtgctaagataacaggcgtgagtcatgttttcagttttaagagttctttatgcatttcagcgtacaagttgtttgttg

SEQ ID NO: 44294 - DNA, 601 bp, Human
ttaatttccaagtatttgaacatttcccagttttctttttattactgatttgtagtttaattgtattgtggttagaaaacatttgttaaggtttgtttttgacccaggacaatggtctgtcttaatgactctccatgtgcatttaaaataatatttattctgcagctgtttgctggagtgttctttaaaagccagttacattcatttggttcctggcgtttttcagttctggggattatttgtctgctaataaaatgtagacctagttcctcagaggaccctggtcacagatttatggacwtaatcataaatcccacttaagcactgttccaaattgctgaaactcaattcaatattaccagcaactgtaacaacacaacaaataaatcacattagtaccacaattattaagattgggaaagttttataattagacagttgtcacccaacaaattcatattagatgcttatatttttcttggtaataccagagatccaaataatcaaagcacaaatgaaacaaacacagctgaaatctttatgctttctattactacttataatacaatcagcaacaatttcaggttcaccaatctgcaga

SEQ ID NO: 44295 - DNA, 601 bp, Human
taatgactctccatgtgcatttaaaataatatttattctgcagctgtttgctggagtgttctttaaaagccagttacattcatttggttcctggcgtttttcagttctggggattatttgtctgctaataaaatgtagacctagttcctcagaggaccctggtcacagatttatggacataatcataaatcccacttaagcactgttccaaattgctgaaactcaattcaatattaccagcaactgtaacaacacaacaaataaatcacattagtaccacaattattaagattgggaaagwtttataattagacagttgtcacccaacaaattcatattagatgcttatatttttcttggtaataccagagatccaaataatcaaagcacaaatgaaacaaacacagctgaaatctttatgctttctattactacttataatacaatcagcaacaatttcaggttcaccaatctgcagaaacattgtatatctttagggatgtgcttttcttctttttccttaaatttttggttaaaaaaaaataagcaacacttaagtttctcaaatgaacagtcataatatgttaacattttaacctac

SEQ ID NO: 44296 - DNA, 601 bp, Human
gtcaatggtgggtctgagatggtggcaaacagcagtggtggacccgggtgggagtcaatggcaggtctgtaacagcggcaaacagcggtggtggacagtgagcaaaagctcagctcaagccgtaacaaacacagaccagaagagcgtgcagttgcaagatttaatagagtgaaaacagagctcccatacgatgggaggggacccaaagggggttgccactccctgcttgaatgcctgagtttatatcccgatcattgtccccttgttgtgctctcaggcgatatatgatttgactgtttcyttacctcctgcttttagcctaatttgtgtttcagtgagccctctttactacccgattggtcaggtgtgagctgagttaccagccctgtgtttaaaggtgggtgcggtcaccttccccagctaggcttaggaattcttagtcagcctagaaaatccagctagtcctgtctctcagtcccccatctcaacagaaaaacccaagtgctgttggggaagttggccgaacaacgctcttaactgcttcctgctgaattggggcatagtaggggtcgtgcagttgagatttcctcaggaggagtgc

SEQ ID NO: 44297 - DNA, 601 bp, Human
aaagatacagggattgaaatgtaggcctgaagtgcaggggaatatttctttggcacacgtcacaggccctgactatctgcttgatagttttgaaaaggcctggtccagtaaataatgattcggccatctgatgggtgctatcaatgcctaagtgaaagtgttactggggggttctagctcccagagctcccaagatggtggcaggccccttccaagatagcggcaagcctcttgttctctgacctggggttcttggcctcaaaggttccaaagaatggaatcttgggccatgcagtgagtkttatagctctattagaagccatgggtcacggaagagaaccgtggaacccagtgactagtgttcagctccattaggatgaacctgggcacttagccgtgcaggaacaatggcaagcctttagcccgatcaggagtggcagcgggcgcctcgctggatcaggagcacagtgaacacactgctggatccagagaggtggaagtcagtggtgggtctgcaacggtggcaaacagcagtggtggatagcaagcgaaagctcaggtcaagccgtaacaaacacggaccaaaagagtgtgcagttgc

SEQ ID NO: 44298 - DNA, 601 bp, Human
ggcctggtccagtaaataatgattcggccatctgatgggtgctatcaatgcctaagtgaaagtgttactggggggttctagctcccagagctcccaagatggtggcaggccccttccaagatagcggcaagcctcttgttctctgacctggggttcttggcctcaaaggttccaaagaatggaatcttgggccatgcagtgagtgttatagctctattagaagccatgggtcacggaagagaaccgtggaacccagtgactagtgttcagctccattaggatgaacctgggcacttagccrtgcaggaacaatggcaagcctttagcccgatcaggagtggcagcgggcgcctcgctggatcaggagcacagtgaacacactgctggatccagagaggtggaagtcagtggtgggtctgcaacggtggcaaacagcagtggtggatagcaagcgaaagctcaggtcaagccgtaacaaacacggaccaaaagagtgtgcagttgcaagatttaatagagtgaaaacagagctcccatacaaagggaggggacccaaagagggtagccattgccagctcaaatgcctgggtttatatcctga

SEQ ID NO: 44299 - DNA, 601 bp, Human
acggaagagaaccgtggaacccagtgactagtgttcagctccattaggatgaacctgggcacttagccgtgcaggaacaatggcaagcctttagcccgatcaggagtggcagcgggcgcctcgctggatcaggagcacagtgaacacactgctggatccagagaggtggaagtcagtggtgggtctgcaacggtggcaaacagcagtggtggatagcaagcgaaagctcaggtcaagccgtaacaaacacggaccaaaagagtgtgcagttgcaagatttaatagagtgaaaacagagctyccatacaaagggaggggacccaaagagggtagccattgccagctcaaatgcctgggtttatatcctgatcattatccctccccctgtgctctcaggcaatagatgattggctatttctttacctcctgtttttgcctagttagcattttagtgaactctctttactacctgattggtcagatatgagttaagttgcaagccccatgtttaaagatggatgcggtcaccttcccagctaggcttaggaattcttagtcggcctaggaaatccagtcagtcctgtctctcagtctcccttct

SEQ ID NO: 44300 - DNA, 601 bp, Human
agggtagccattgccagctcaaatgcctgggtttatatcctgatcattatccctccccctgtgctctcaggcaatagatgattggctatttctttacctcctgtttttgcctagttagcattttagtgaactctctttactacctgattggtcagatatgagttaagttgcaagccccatgtttaaagatggatgcggtcaccttcccagctaggcttaggaattcttagtcggcctaggaaatccagtcagtcctgtctctcagtctcccttctcaacaggaaaacccaagtgctgttgrgagattggccgatgattgctctaactgcttcctgctgaattggggtgtagtatgggctgttcagttgagatttcctctggagaggtgcctttgatgttattaacttggagcatgggctagcaggctggtccgggtctgcagtagattttagtcatggactgcatctggggctccatttgaagaacaatttgtagttttatagctttgattctggaagagacaaacttaacaaggatgttaaagatacagggattgcagcaggtggagcttgcagtgagccgagattgcaccactgcagtc

SEQ ID NO: 44301 - DNA, 601 bp, Human
cgatgattgctctaactgcttcctgctgaattggggtgtagtatgggctgttcagttgagatttcctctggagaggtgcctttgatgttattaacttggagcatgggctagcaggctggtccgggtctgcagtagattttagtcatggactgcatctggggctccatttgaagaacaatttgtagttttatagctttgattctggaagagacaaacttaacaaggatgttaaagatacagggattgcagcaggtggagcttgcagtgagccgagattgcaccactgcagtctggccttggygaaagagcgagactccatctcaaaaaaaaaaaaaaaaaagatacagggattgaaatgtatggcctgcagtgcagggggttatttttttgacacacttcacaggccctgactatctgcttgttagttttgaaaaagcgtggtccagtaaataatgatttggccatctgatgggtgctattaatgcctaagtgaaaggtttggtgaagggttttaagtaatttctattgtttagttgcaggcaaaagtatttttcctttttcggtggctagccattctgaggggaggaaactacgtccttgt

SEQ ID NO: 44302 - DNA, 601 bp, Human
gggggttatttttttgacacacttcacaggccctgactatctgcttgttagttttgaaaaagcgtggtccagtaaataatgatttggccatctgatgggtgctattaatgcctaagtgaaaggtttggtgaagggttttaagtaatttctattgtttagttgcaggcaaaagtatttttcctttttcggtggctagccattctgaggggaggaaactacgtccttgtgaggttccccgttctatttctcctgctgagtagcagcttgggttcccagaggggattaccccatactaggggtmcttctataagcatttttaatggagagttctgccttgtggctcttttagctttaatacccgcttggcagtttccttctatttttctttccttttctttctgatgaccccggcagtgtaagactgccacctctttaggtttctgtacagccaataataatctcctaatggcttcctgatgtttgataggtgttccctcagaagttaggaattccctttttttccatattgctgtgtgggcgtagaggactaggtaagaatactttgagtctgtatgtatatttacccttttcccttttttta

SEQ ID NO: 44303 - DNA, 601 bp, Human
ctttgccactacattaattttcttacttaggtatgccatggtttgcaagctggtcccttgaacctgtgtaaggactcctggagctatttctgttttttgtgacatatgaagaaaagtcttgccccgttggtaagcttaacactgagtcttgggttaaggcctttttttagggcctggaaagctgcttttgctttaggagtccattttactaaatgggtattggctttctgagcttccttaattagtgtatataatggcctggctattttgccgtacctgggaatccatatttggcagaagsctgttatgccaaggaaccttttatttgctttagggttttgggatgaggataagccagtataggctggatacatttcttactgagggccctggtgcctttggataattttagccctaagtatttaacctgctgtaagcagagctgagcctttggtttggaaaccttgtagccacaagtggtgaggaagtttaaaagcgcttgggtggcttgatggcacaaggttttttcaacaggcagctagaagtagattatccatgtaccaaaggacaagactgttcaggtatgagaactgtctcaagt

SEQ ID NO: 44304 - DNA, 601 bp, Human
ttttgccttggggggaatgttttgccagcacccctagtcattttctgatgagcttagttctacagtgttctctatggtcctttccacggtgtgtaaccacccatggacctctgcttatcggattagttgtgctcaccaatgtagcagtcctgcaccccttttcccgcctttcttgaccacaaagaaagggatccgggctgctggattctagtggtcctttaccagcgtgcccaacattgcctttgtgctcaggggtgagtcctagagctgggctgagttcctgagtctttcataacaaccyggctgcccatcaagatgcattcccataaacaacagttcttatgcaaatccgtttcagagagggtgaaggtaaccttttgagtcaggagtgagatggagttctttgcccactagggtctttgtccttctttacttttgtaggaatatgccctaaatattgatattaagctttttgttgccccagattaagtccttttgggtacgaaatatgagagagggatcctgtttatcttatgtgcctttttcctacgaggagagcaaggagaaaaagatgggcttgctggttttgtaggtactttaa

SEQ ID NO: 44305 - DNA, 601 bp, Human
gagcttagttctacagtgttctctatggtcctttccacggtgtgtaaccacccatggacctctgcttatcggattagttgtgctcaccaatgtagcagtcctgcaccccttttcccgcctttcttgaccacaaagaaagggatccgggctgctggattctagtggtcctttaccagcgtgcccaacattgcctttgtgctcaggggtgagtcctagagctgggctgagttcctgagtctttcataacaacccggctgcccatcaagatgcattcccataaacaacagttcttatgcaaatycgtttcagagagggtgaaggtaaccttttgagtcaggagtgagatggagttctttgcccactagggtctttgtccttctttacttttgtaggaatatgccctaaatattgatattaagctttttgttgccccagattaagtccttttgggtacgaaatatgagagagggatcctgtttatcttatgtgcctttttcctacgaggagagcaaggagaaaaagatgggcttgctggttttgtaggtactttaaggcttggctgagtgcaaacagctcacacgtttgacagaccaacgattag

SEQ ID NO: 44306 - DNA, 601 bp, Human
ttaaagtactaggtcatcagttctaaggccctggccaaggagccaaggcttgaagattgtattgaagattgcattgtggggtggtgggtcgggggatgctgggtagaaattaggggaggagagcatcttacacaatgagagaggaatcctagccatttacaaactcagggcctggcaagagtggtggagaacgggtcccacataactgcccatgtcaaaagttatatacctaaattgggaggggcaccagggacaagattccctggtttcatagcctagatgcctaaggatgcagcatagygcttccttagatccctttggagatacaacctactctaatacttgggagagaaagtgaaagtctgaagcattagtatctaggaggcagggattggaggaagtagattcagaggtaaggagaattttggggctacactttcaagaaagtcatggttaggacccaagaggtatgggtcagaaggacaggtaggggcgcacacatgggcgactgttgagtagagacttctagcctgcaccatgatctcgaccggccaatgccaggggttcaggacgacagctttctgcctctagttgacccttg

SEQ ID NO: 44307 - DNA, 601 bp, Human
ggccctggccaaggagccaaggcttgaagattgtattgaagattgcattgtggggtggtgggtcgggggatgctgggtagaaattaggggaggagagcatcttacacaatgagagaggaatcctagccatttacaaactcagggcctggcaagagtggtggagaacgggtcccacataactgcccatgtcaaaagttatatacctaaattgggaggggcaccagggacaagattccctggtttcatagcctagatgcctaaggatgcagcatagcgcttccttagatccctttggagatayaacctactctaatacttgggagagaaagtgaaagtctgaagcattagtatctaggaggcagggattggaggaagtagattcagaggtaaggagaattttggggctacactttcaagaaagtcatggttaggacccaagaggtatgggtcagaaggacaggtaggggcgcacacatgggcgactgttgagtagagacttctagcctgcaccatgatctcgaccggccaatgccaggggttcaggacgacagctttctgcctctagttgacccttggcatccctaggaaaattgtgaaagtg

SEQ ID NO: 44308 - DNA, 601 bp, Human
caggacgacagctttctgcctctagttgacccttggcatccctaggaaaattgtgaaagtggaagctggttccaggcagaccaactctcccaacccagaagttgttagaaagccttttcccaggaagcctcacacctgagtctttagtccggtggccatgctaatcgtttttaaccagctgacaggtgcccggtattttcctccaattctaaggtagaggacagaatagcaagcaaaagtggtctgatattactcactgctttggagaatccccatacgaggccaccaaatgttaccagcrgatctttgttcttagagctcccaagatgatggtgggctgctcccaagatggggcaggccactcccaagatggcagcaagccttttgttctctgacctgggcttcttggcctcacagattccaaggaatggaaacttgggccatgtggtgagtgttatagctctatcagaagccgtgggacatggaagagaaccatggaaaccactgactagtgttcagcttgattaggatgaacctcggcacttggttgtgcaggaacaaaggtgagactttagcccgatcaggagtggaaatgggtgcc

SEQ ID NO: 44309 - DNA, 601 bp, Human
ttggcatccctaggaaaattgtgaaagtggaagctggttccaggcagaccaactctcccaacccagaagttgttagaaagccttttcccaggaagcctcacacctgagtctttagtccggtggccatgctaatcgtttttaaccagctgacaggtgcccggtattttcctccaattctaaggtagaggacagaatagcaagcaaaagtggtctgatattactcactgctttggagaatccccatacgaggccaccaaatgttaccagcggatctttgttcttagagctcccaagatgatgrtgggctgctcccaagatggggcaggccactcccaagatggcagcaagccttttgttctctgacctgggcttcttggcctcacagattccaaggaatggaaacttgggccatgtggtgagtgttatagctctatcagaagccgtgggacatggaagagaaccatggaaaccactgactagtgttcagcttgattaggatgaacctcggcacttggttgtgcaggaacaaaggtgagactttagcccgatcaggagtggaaatgggtgccttgctggatcaggagcacaacctgccagatcc

SEQ ID NO: 44310 - DNA, 601 bp, Human
gtgcaggaacaaaggtgagactttagcccgatcaggagtggaaatgggtgccttgctggatcaggagcacaacctgccagatccagaggggtgggagtcaatggcgggtctgcaatggtggcaaatagcagttgtggatggtgagcgaaagctcagctcaagccgtaacaaatacggacaagaagagtgtgcagttgcaagatttaatagactgaaaacagagctcccatacaatgggaggggacccaaagggggttgccactccctgctcaaatgcctaggtttatatcctgatcattgwccccccgttgtgctctcaggtgatatatgatttgactatttctttacctccttcttttagcctaatttgtattttagtgagccttctttactacctgattggtcaggtgtgagctgagttaccagcgttgtgtttaaaggtgggtgtggtcaccttccccagctaggcttaggaattcttagtcaacctaggaaatccagctagtcctgtctctcaatacttcaaatattctttacacagacaagccatttaaaaaaaattagagcttacctttgcttttccatcaaaacatattgttac

SEQ ID NO: 44311 - DNA, 601 bp, Human
ttagcctaatttgtattttagtgagccttctttactacctgattggtcaggtgtgagctgagttaccagcgttgtgtttaaaggtgggtgtggtcaccttccccagctaggcttaggaattcttagtcaacctaggaaatccagctagtcctgtctctcaatacttcaaatattctttacacagacaagccatttaaaaaaaattagagcttacctttgcttttccatcaaaacatattgttacttctaggtttcctcttcaatttgcaaaaggaaaaggaaaatataggtaatttctcarttaaacttacacctgattttcaatatgagtttgtttattgagtgtttgtatatgtgtgtgtttggcagttagaagtatgctgagatttttattcttttagcctttgggggaactggactggcccttcacctctgtcctaatgtagctttttaattttattacaaatgggaaacaatgtaattttctgtatgtttcatctgtgaaaagtattggaaagttttgagttcatatgtattttattattgaattttaaaatatttaaaatgaacttaattaaatcttaaattacagtaaccttat

SEQ ID NO: 44312 - DNA, 601 bp, Human
ttattacaaatgggaaacaatgtaattttctgtatgtttcatctgtgaaaagtattggaaagttttgagttcatatgtattttattattgaattttaaaatatttaaaatgaacttaattaaatcttaaattacagtaaccttatgctgtagtaagttgaaggtaagctaccttctgtgaccttgaataatttaattaaattgagaagtctgttttttttttattatttgttttgtttttaatgggtaaattaaatgccaggcctctgaagtgagttcatataaggaactggttgtgggattttttttaaaaaaaatatgcctatattagagtcctacaccaaaaaaatttagagtttttgactcaaacccaggcactggtatttgttcaagctcctgatgtgatagaccagtatctaagtcctaataaaatatgaaatgatcaattttttttttttgagatggagtcttgctctgttgcccaggcttgagtgcagtggcacgatcttggctcactgcaagctctgcctcctaggttcacaccattctcctgcctcagtctcctgagtagctgggaacacatgcgcccaccaccacgcctg

SEQ ID NO: 44313 - DNA, 601 bp, Human
gctgtagtaagttgaaggtaagctaccttctgtgaccttgaataatttaattaaattgagaagtctgttttttttttattatttgttttgtttttaatgggtaaattaaatgccaggcctctgaagtgagttcatataaggaactggttgtgggattttttttaaaaaaaatatgcctatattagagtcctacaccaaaaaaatttagagtttttgactcaaacccaggcactggtatttgttcaagctcctgatgtgatagaccagtatctaagtcctaataaaatatgaaatgatcaattttttttttttgagatggagtcttgctctgttgcccaggcttgagtgcagtggcacgatcttggctcactgcaagctctgcctcctaggttcacaccattctcctgcctcagtctcctgagtagctgggaacacatgcgcccaccaccacgcctggctaattttttgtatttttagtagagacagggtttcactgtgttagccaggatggtcttgatctcctgacctcgtgatccacccacctcagcctcccaaagtgctgggattacaggtgtgagacaccgtgcccagccaaaatgat

SEQ ID NO: 44314 - DNA, 601 bp, Human
acaggcataactcattttactgcactttgctgtttgtattttttttttaatttcaacttatattttaggttcatgggatatatgtgcaagtttgttatatgggtaaactgtgtgatgccaaggttttgagtacaaatgaccctgttacccaagtagtgaacattgtacccaataggtagtatagttcctccctttatagctatatgtaccaaatgttagctcccatttaaaaatgagaacatatagtatgcagttctctgatcatgcattaattcatttaagataatggcctctggctgcwtccatgttgttgaaaatgacatgattgcattctttctatggctatgtagtatttcttggtgtatttgtaccacatgttctttatccaatccaccattgaaaggcatctagaataatttcatacctttgcttttatgaatagttctgcaatgaatctacaaatgcttgtgttttcctagtagaacaatgtatttttctttaggtatatacttggtaatggggttgctgggtcaaatagtagttctattttaaattctttgagaaatctccacactgctttccacagtggctgaactaattt

SEQ ID NO: 44315 - DNA, 601 bp, Human
tgctgattttgtttatccttttaaagaaacagcttttggtttcattgatcctttttatgaatatttaggagttgatttcgttttctcctttgatttcagttatttattctactagcattggggttagtttgttcttgcttttctagttcctcttggtgtgttactaaattgggaattgcagatcattctaacttactgatgtaggtgcttagcactataagttttcctcataatactgtgtttgctgcatctcagagattttggcatgttggttgtgtctctgttttcatttatttcaaawttttttttgatatctgccttaattttattgtttaccccaaagtcattcaggagtaagttgcttaatttctatgtaatagtgtacttctgagagatcttcttggtattgatttctacttttattccactgtggtctgaaagtatggctggtatgatttcaattttttgaatttattgagacttgctttatctccaagcatatggtcaatcatagagtatgttctgttcacagacgagaagaatgtataatctgtggttgatgggtggaatgttttgtagatgtctattaggtcccattggc

SEQ ID NO: 44316 - DNA, 601 bp, Human
ataacaaaaaagaggaattgcagcagagactgtatggcttggaaagcctgaaatatttactttctggctttttacagaaaaagtttgccttgccttgcttaaaacaagggtactggttacagatcctgcctgctgggtattaacagaacaaatgcagcaaatgatgctgatctgaacatgaacccacaggatccccagatcatgacacctctcagtgtttactcagagtagatctggacagtatggattaagaggaagaaattgagacaccttaccccccttttcctccctctaataagawcaggctaaattcaatgcaggaagactttccagggaataagaagcaaaggcactaaaagaaagagttggaaaacaatacctacaagaagagtgaactgcggtcttgaagcattgtgacttaaccaaaattttgggatttactaacaggacatgtgttaatcaagcagttcactttgaaaaggaaagttctagtaagctccacggcctttgtgaaaaggccattgaagtgagagagaaaaccaagaggaccattgagaaactgcaaaaaatgtatgccctaattggcaatacctactttaaa

SEQ ID NO: 44317 - DNA, 601 bp, Human
aaaaggtaaatacaataaatgcttcagaaaggggaccctctcccacttcataagcattaaatactaaacaagatgtgcaacagaatccacacgacattgagttgtgcaagagtcagcagttggcactgaaggactgggaactatggatgaacccagagctcccatattctcaagggttgtgtagagaaagcacaggagccatgaaaactgtggatataatcccaaaggcactaaacttggactcaagctataaggagattatcagtaatgtccaaaccattgatgtgataaccttttattaaaaaaaaaaaaattaaatagagatggagtctcactatgttgcccatgcttgtcttgaactcctgggctcaagtgatcctcccaattttgcctccaaaagtgccgggattacaggcatgggccactgtgcctggctgacatgataaccttgaggatgggaaatggggaggcatatctaatcctagatccaggaaataatggataccttaaccaagaggaatcttctggcacacatgtgtaaacaatatatacatatattttattggtcaggcttaaaagatgccaatgaaaaacaatatct

SEQ ID NO: 44318 - DNA, 601 bp, Human
ctgaagtaaagaccaacatagtacttaatgattccagtgaaatataaacaagaagcttagtctttttttccctaagatataagagaaaactcagtagtttacaaatgtgattgtaaacttgtgactttctggactacgtcttaagcacatggattggtttgtttgcagtgggttaactgtaggataaaaatcatcaaagtttgatttatatgaataagaagtagatgtagaaaacaatctttgcctatacatgtgttagtactatgtgtacgtgtgtatggatatagaatgaaaaaaaccrcataaatccagtacatctacttaagttatgtaaataattatttgcattttttaaaaaaattgccatgtctacaacacaaattagtaccgtgttagtacttgactaaattctggtaatcttcttatacaattagataggctgatgtatttcctaattaaaaacatttgtttttaactcttttctaatgctttggcaattcatgattggaagtagttgctaatttagatttcctcatggagcacagtaaatatgagagatcctcataatagcctctataggtttaaattatattttaaatgt

SEQ ID NO: 44319 - DNA, 601 bp, Human
ataagaagtagatgtagaaaacaatctttgcctatacatgtgttagtactatgtgtacgtgtgtatggatatagaatgaaaaaaaccgcataaatccagtacatctacttaagttatgtaaataattatttgcattttttaaaaaaattgccatgtctacaacacaaattagtaccgtgttagtacttgactaaattctggtaatcttcttatacaattagataggctgatgtatttcctaattaaaaacatttgtttttaactcttttctaatgctttggcaattcatgattggaagtasttgctaatttagatttcctcatggagcacagtaaatatgagagatcctcataatagcctctataggtttaaattatattttaaatgtaaatgcaaaagttaattattttttagaggacctgatgtcatccttgggagtaatttttaattactttttatccttcttagagttgattgtattaattatttgtactggcttaacaataccatactgaaaaagcttttattttttttttttttttgacatttcttctgtttcagttgatttatcattagtgaataaagatgaaaatgccatcta

SEQ ID NO: 44320 - DNA, 601 bp, Human
ctgatgtatttcctaattaaaaacatttgtttttaactcttttctaatgctttggcaattcatgattggaagtagttgctaatttagatttcctcatggagcacagtaaatatgagagatcctcataatagcctctataggtttaaattatattttaaatgtaaatgcaaaagttaattattttttagaggacctgatgtcatccttgggagtaatttttaattactttttatccttcttagagttgattgtattaattatttgtactggcttaacaataccatactgaaaaagcttttattttttttttttttttgacatttcttctgtttcagttgatttatcattagtgaataaagatgaaaatgccatctatttcttgggaaattctcttggccttcaaccaaaaatggttaaaacatatcttgaagaagaactagataagtgggccaaaatgtaagtattattttaaaagctactactctacatctcatacaaaaatttacaaaatcacattaggttgtctaatatttggaaagatgtgtaatagaatcctagtacagtcatcccttggcatctgtggaggattagttccagggcc

SEQ ID NO: 44321 - DNA, 601 bp, Human
atatgcagccatccatttttttccccaaatatttttgatccgcagttggttgaatccatagagagggaatccatggatacagagaaactttagctgctcagtagtctcatttgattgatgaaataactgaggatcagaataaggtgacatagcaagctagtggcagaatcaggactaaaaacttttacaatatttaaacgtttaagttcctctcatgtgttgacatctctaaaccacatgtaatcattttattttatttctttagtaactaacagaggagttaatattctgaagcttaatwtcttcatgattaggctaaattatcaacacttacttttatgataaccagaaatattttctaattatttgaaactgaaaaatcaatatgaagatgagccaaacttgacagttaggaaaacgtttcagaaagatgaaaccaaaccaaatagaatttcagaggaaaaacatttggctgtcatagaaactcagaatacattctttacctttcttcattcttcatgctactggttttcaaattgggaacaatatccattctttaaagtttagtaggccagtcacaatggctcatgcctgtaattgc

SEQ ID NO: 44322 - DNA, 601 bp, Human
aggaaaacgtttcagaaagatgaaaccaaaccaaatagaatttcagaggaaaaacatttggctgtcatagaaactcagaatacattctttacctttcttcattcttcatgctactggttttcaaattgggaacaatatccattctttaaagtttagtaggccagtcacaatggctcatgcctgtaattgcagcactttgggaggcagaggtgggcagatcacttgaggccaagagtttgagaccagcctggccaacgtggcgaaacctcacctctactaaaaaaatacaaaaattaggccrggaatggtggctcacgcctgtaatcccagcactttgggaagctgacatggatggatctcctaagctcaggagttcgagaccagtctgaccaacatggtgaaacctcgtctctactaaaaatataaaaattagcctggcatggtggcaagtgcctgtaatctcagctattcaggaggctaaggcaagagaattgcttgaacccgggaggcagaggttgcagtgagtggagatcaccactgtactccatcctgggcgactctgcttcaataaaataaataaataaataatgtttagcttaca

SEQ ID NO: 44323 - DNA, 601 bp, Human
ttaatattcatttttggccttaatgtaagagagggcagataattagattgaatgaatttgaactttatagagtgtccttgcctcttggatattcattcagcaaggttgtgaatttttatcccctaagcatttaaaatatattctgccctgctattctattcatatccttatggtcatccacttaagtaagaaaccggttgattattttcaagactttaaagttgcatttcaggaaagcacctcatgctcttctattgttttgtcttttatatttcaccttgtgatgatggaaaatttcatmattttaattaaaccttcttactgagttttcattagacagatgattcagaaaggctgtatattttaatgcttcaggcaatgtacagtgaattaaagaagacttctaagcaaatggacatctattccatcctcgctttgtttattttagtcttcttgttttaagctgtagtgactcagtcaacatcatggacccgcccataaatgtctgtggtgtttgggatgcctgatcacctgcctctttttcctacctcacccatcgtttttgatcccaaaagtgtttgctcattattattttttacct

SEQ ID NO: 44324 - DNA, 601 bp, Human
tttaaaatatattctgccctgctattctattcatatccttatggtcatccacttaagtaagaaaccggttgattattttcaagactttaaagttgcatttcaggaaagcacctcatgctcttctattgttttgtcttttatatttcaccttgtgatgatggaaaatttcatcattttaattaaaccttcttactgagttttcattagacagatgattcagaaaggctgtatattttaatgcttcaggcaatgtacagtgaattaaagaagacttctaagcaaatggacatctattccatcytcgctttgtttattttagtcttcttgttttaagctgtagtgactcagtcaacatcatggacccgcccataaatgtctgtggtgtttgggatgcctgatcacctgcctctttttcctacctcacccatcgtttttgatcccaaaagtgtttgctcattattattttttacctcccaaatatttagcttaaaatcccacttctgatgttttccagctgaagttctgttgggaggaaactttttctctaccaaatgagtacttaggtcaaagtgattgagggcctgccaattaattgacaaca

SEQ ID NO: 44325 - DNA, 601 bp, Human
tttgtcttttatatttcaccttgtgatgatggaaaatttcatcattttaattaaaccttcttactgagttttcattagacagatgattcagaaaggctgtatattttaatgcttcaggcaatgtacagtgaattaaagaagacttctaagcaaatggacatctattccatcctcgctttgtttattttagtcttcttgttttaagctgtagtgactcagtcaacatcatggacccgcccataaatgtctgtggtgtttgggatgcctgatcacctgcctctttttcctacctcacccatcrtttttgatcccaaaagtgtttgctcattattattttttacctcccaaatatttagcttaaaatcccacttctgatgttttccagctgaagttctgttgggaggaaactttttctctaccaaatgagtacttaggtcaaagtgattgagggcctgccaattaattgacaacagacaggttaacaggagaaaagtttatttcacactcagatacaagaattctacaaggggtagtttgatgaacagccatgggtaagggtttatataccagcttgactaaagggaagagttttagagcttca

SEQ ID NO: 44326 - DNA, 601 bp, Human
agtattgaataaatgattttttgtcataatgcagcctgattttgtaattcataaggctaccatctttgatttcttatactaaggaaaagccaagaatagaggtacaactagaaatattttaggatctgtcttggtttgttcccgctgctatacaaaatacctgagtctggataatttatagagaagagaaatgaatattcttacaattctggaggctgggaagtccaagatcaaggtgctggctgacttagtgtctggtaaggtctgctctctgcttccaagatggtgcttcttgctgtawcctcatgtggcagaagaggcaaacacctgcctcccacctgttttacaagggtactaatcccattcatgagggctctgcccttatgactgaatcacctcctaaagactctacctcttaatactgtcacattggcagatcaaattttaacataagaatttgaaggggacacattcagatgatagtagaaccaaatgatttctaaaacttacacttatttaaggaaaactgtgaaaatagttttcttagaatcttttacctctgtgttagttttaaaattctattaccattaatttgcatttt

SEQ ID NO: 44327 - DNA, 601 bp, Human
ttttactacctaaatgtaataagatgtattgtgctatcagcaaaggccatggagctctatgtgatgaaaataaaaaaggatccaagtatcttcctttaactaccatttaatgataatgatttttgtctttagcatttatattagaaatcaagaaagaggcaagctgcaggctatctaataataatacaaataataataactaacaattgcccctctcttccatccttagttcttagcagcctatgtttattctcaaagaaagtcctcttccttcatcttagtttatatggtaatagaaatkttagtttaaaaattgtgttctacaccacatgctgatgaaggtagttttagcattagatttacattaggaaagaagactcagaaacagggtactatgtaaccgtctctttcacatgttatctcatttatttctcatgggaatcctttaaggtccatattgttacccatttacttgtacaaatgtggaaaatgaagccctatagcttccaataaatgtggtctcatgaccagtactgacctggagctggcttataccagatgtcaaaagccaattattaaatactcagaatttctgttggta

SEQ ID NO: 44328 - DNA, 601 bp, Human
aggacaagacaaaggttttatagtctcctgtaaacaggaagtgttctagtctgacataactgctgcgttgtacctggatggcctctttctcgatcttcagggttacgtgtcttccggccagggtagctgtctttcggtcggctctcttcctgcttctgatatcttgctggcgcacgccgctgacgtaagtagccttgcgccttcgtactgggcctgagaaggaaggagttattcatctccttaagctttcaggcctcagggagaatcgtacattcccgtctatttggttgtagataaaagrgataaggggcctctttctcaataactacttcacgtgtgatatagggggtggtgtgggcaccttggaaaaacaaaaccttaattttttgggtattcttgagagacgggttggtatccacattgtccttgtagtaggagcatcatctgtattgtctggaaacgcgtctgtgcctgcaagacagttatgttgagaggacaaggaggtgtcaacagggagaggtatagcctcatttgctgcttcacgaatgaaagactgtgtctggattaaggaggggaggtaatttctgagtgggttagagtt

SEQ ID NO: 44329 - DNA, 601 bp, Human
ggtgtgtggggaacctacttcatatttagagatgtagagacaccttgaataatttggctgatgaaggccggcctgttattgggctggatggatgttcagagtacgaaatggggaattatatgcatgatgagagtttgtgtgacgacatttgcaccttctgaagttgttgggaacatttttacttacctggagaaagtatggacaaagactagaagatagcagagcggcatgtgagtgaggtttacttgccattcttgccttggtacctggccccaggcttggtcggtaggaaaaggtagcrgccagagggagccttggggtgacactgagtggcagatagagccagactgggtaatttctcagacatggctggaaaggtgaggacaagtgagaatagggtggaaaagttgcaagagaggtttgtaaccgacatggaaagagttgtggagtctttggaggtgaggaagattttgagagtgaggaagaacaaagcacctttccttgacataccatggtccttgcttttgaaggttttgggctcagaagtcctgcttttcttctgaggagtaaagaggagagaacaaggacagggagagaaact

SEQ ID NO: 44330 - DNA, 601 bp, Human
tatttagagatgtagagacaccttgaataatttggctgatgaaggccggcctgttattgggctggatggatgttcagagtacgaaatggggaattatatgcatgatgagagtttgtgtgacgacatttgcaccttctgaagttgttgggaacatttttacttacctggagaaagtatggacaaagactagaagatagcagagcggcatgtgagtgaggtttacttgccattcttgccttggtacctggccccaggcttggtcggtaggaaaaggtagcggccagagggagccttggggtgrcactgagtggcagatagagccagactgggtaatttctcagacatggctggaaaggtgaggacaagtgagaatagggtggaaaagttgcaagagaggtttgtaaccgacatggaaagagttgtggagtctttggaggtgaggaagattttgagagtgaggaagaacaaagcacctttccttgacataccatggtccttgcttttgaaggttttgggctcagaagtcctgcttttcttctgaggagtaaagaggagagaacaaggacagggagagaaactggccttgcacggatcatagggc

SEQ ID NO: 44331 - DNA, 601 bp, Human
acatcccactaatcctagaaaagagagagaattttttgcttagtttgcagaggcaggagggattggaggagagatatgcagtcagctgtgagcccttgggttcacggggtaagagctagccctagataggtgactaagggggtgcataattgtgctttcttagaggagacctaataccctcgttttgtcaagaagtttaaaagagagagatagtgtgggtgttgcagtgtttttgagaggggctacacaggagcagattattaacacattgaaggagagtggatggttttagggatagggwactgaggtcaagagcaagggcctgtccaaaaagatgggggctgtctctgaaaccttgaggtagtatgcaccaggtgagctgatgtgaaagtttggagttggggttttcccatgtaaaggcaaagaggttttgggaatcaaggtgtaaaggaattgtggggaaaaaaaagcatcttttaggtttagaacagaaaaatgggtggtattagacagaattacggaaagtaaagtatatgggttaggaactactagacatactgggagtacagcttggttaatgagcctgaggtcctggattaag

SEQ ID NO: 44332 - DNA, 601 bp, Human
gctgcctttttcgttcccggaatgggatcagttggcttagaggtgtcccctaagaacagatgatcagcaactgcctggcacacaccagagccttcttggaccaacgctggatttttggaccggagaaaccaagagaggccatgtagatttttccctgttgacagagctcccaggaaacttactggtaggtgagatcagtgactaatgtgcatgcagaggggtgactggaggctgaggagtttcctttgtctggctgctgtggcctactctctggggtggaggggtaggcccaaggaggacrcagacttgagcccctcccaggttttggcaccagaacgtaaaatttttgtattggtttgaaacccaagagcgcaacagacaagatgaggtggtgtggagcaacatgctgttttaatgagcgcctgggtgcaggtgggctgaggctgaaaatggcatcagcaccaagtgaggacgggataaaggttttatagtctcctgtaaacaggaagtgttctagtctgtcgtaactgctatgttgtacctggatggcctctttctcgatcttcaggagtatgtgtcttccaaccagggtagctatctt

SEQ ID NO: 44333 - DNA, 601 bp, Human
gaaaccagaaagtagtattttgggggcagctcacgtggagtcaggctcagtgtaggacttgagtgaaagactttcccaagaagccccagggctaatctgggcagccctggatgcttaggtctggaacccagggccagaatctttgacagccagatccagtaaaggccaaaaccaagaatctcctcccacaccagtggattctcaaaacacagtgcacttgatcaggctgtcagaattacctagagcagtgcatattctgatggagagaattctctgaacaatcctgaattgcatttaaaartgtgcgaaatatttgtgtaataaatccttcgtttgtgttcatttgttagaagccaattctaaacattcaaatattctaatatgtaaacaaaaaaactggaaaaagaatttgcatttaatttgaccggagaatatgtgcttctcttagctgtgaattttttttcactttattcagtttgctttcagaacataaactgcattctaatcctgttattttgttcttaatatttatcatcctctaaagagaagttagaatgtttatatagaagccagggaagtggtaaagtgatattattcagtg

SEQ ID NO: 44334 - DNA, 601 bp, Human
aattattattttagagagacagttaacaactgcctgaccatcacctgacattcctggtgatgggaaggagatgcctgccctgctcatgtctgcctgactacctactgtaacaccaggttgtctaaatgtgccatgagcaaacagacaagttgtatattttgggtcgtgattgagtcttccaggttcttaaaaccacagcctttaatttaccataaaaaattttaaaaagaagttaccaggaggataataaaaattattatgtgtacaaattgatagtgtggatagagaagagaaagaaataataaccatatttattcatagaagtagaaaaaattcaatttcagatgagaagaaaaactgttaatgaaacattttatagagagccaataattcttcaaaacatggaataactttcccttataattaatgtcatattatcaagatggtagaaataaaattgctgaagaatattattaatattattattaagcttacttctccctggatagataaaaatcacacagcgttagctacatgcattcaaggttataaaaatggtgtaatgtgaacataaatttgctttatgaaatccgtggctgac

SEQ ID NO: 44335 - DNA, 601 bp, Human
tacaaattgatagtgtggatagagaagagaaagaaataataaccatatttattcatagaagtagaaaaaattcaatttcagatgagaagaaaaactgttaatgaaacattttatagagagccaataattcttcaaaacatggaataactttcccttataattaatgtcatattatcaagatggtagaaataaaattgctgaagaatattattaatattattattaagcttacttctccctggatagataaaaatcacacagcgttagctacatgcattcaaggttataaaaatggtgtaaygtgaacataaatttgctttatgaaatccgtggctgaccctcagagaagcaataatccctggaagctatccccccacagctgcagaccctcagtcatgtaccagccacctctaaaggctgctgaaatttgttacttgaaaaatggaatgtaaagttcttggacttagcctaattacaaaccttacagccaaatccacaataacatttgcatctgcttaataaaatatacagaacattgtatggcagttatgagacccgtaatgaaccctcttatccaatggtaaacagcttggggccttgt

SEQ ID NO: 44336 - DNA, 601 bp, Human
accttattgagttgctatgcatgctgaaataatacaagtcacataattagaagtgctgaaatacttaatggatccataaacattagcttgccagtctttgagaccagaatgcagttgcttgcatttaactaagttttatcttctggtaaagcaaaaatatgatgttcaataaataaataaacaaggaataaataagcagagaagcactctttggattagagcactggctcacactcatctcagaagtgatttaaatcttgacatttattgcagtgagtcatagatgatctgataaagtaamgatcctttcaaaacctgctaagctctccagaagcattttaaaaattttgccccaacataactggagctcttgatgtttccacattaattcaaaataattaggaaaaagtaaaggaatgaagaaaaacaacttgaataaactttggttaacttttaaaaaaaaaagattgttagtgaaatgatgatattgaaacatcttaggacaatattggtttcagaaatctaatttgaaccaaaaaagataggccaattaggtaaataatcttttgaaaatacagacatacctcaaagatattgtggc

SEQ ID NO: 44337 - DNA, 601 bp, Human
aaatatgatgttcaataaataaataaacaaggaataaataagcagagaagcactctttggattagagcactggctcacactcatctcagaagtgatttaaatcttgacatttattgcagtgagtcatagatgatctgataaagtaaagatcctttcaaaacctgctaagctctccagaagcattttaaaaattttgccccaacataactggagctcttgatgtttccacattaattcaaaataattaggaaaaagtaaaggaatgaagaaaaacaacttgaataaactttggttaactttwaaaaaaaaaagattgttagtgaaatgatgatattgaaacatcttaggacaatattggtttcagaaatctaatttgaaccaaaaaagataggccaattaggtaaataatcttttgaaaatacagacatacctcaaagatattgtggcttggttccaggttgctgcagtaatgcaaatattgtaatcaagtgaatcacacacatttttggttaaacagtacatacaaaagttatgtttacactatactgtagtctattaagtatgcaatagcattgcatctaaaaagcaatgtggatacctt

SEQ ID NO: 44338 - DNA, 601 bp, Human
gaaacatcttaggacaatattggtttcagaaatctaatttgaaccaaaaaagataggccaattaggtaaataatcttttgaaaatacagacatacctcaaagatattgtggcttggttccaggttgctgcagtaatgcaaatattgtaatcaagtgaatcacacacatttttggttaaacagtacatacaaaagttatgtttacactatactgtagtctattaagtatgcaatagcattgcatctaaaaagcaatgtggataccttaattaaaaaaatactttattgctaaataatgctarcaatcatctgaaccttcagtgagctgtaatctttttgctgatgtgggttgtcttgcctctatattaatggctgctgaccaattgggatggtgttacctgaatgctggagtggctgtggcaatttcttaaaataagatagcaatcacgtttgccatgttaattgagtcttcctttcatggaagaaatctctgtagcttgtgatgctatttgatagtattttactcacagtagaactttcaaaatttgaagcaatcctctgaaatcctgccactgctttatcaattaagttaatgaaacatt

SEQ ID NO: 44339 - DNA, 601 bp, Human
tacatacaaaagttatgtttacactatactgtagtctattaagtatgcaatagcattgcatctaaaaagcaatgtggataccttaattaaaaaaatactttattgctaaataatgctaacaatcatctgaaccttcagtgagctgtaatctttttgctgatgtgggttgtcttgcctctatattaatggctgctgaccaattgggatggtgttacctgaatgctggagtggctgtggcaatttcttaaaataagatagcaatcacgtttgccatgttaattgagtcttcctttcatggaakaaatctctgtagcttgtgatgctatttgatagtattttactcacagtagaactttcaaaatttgaagcaatcctctgaaatcctgccactgctttatcaattaagttaatgaaacattttaatcctttgttgtcatttcaacaatgttcacagcatcttcaccatcttcaaaatcttaaccatttttctttgcactttcgtaagaggcaacccctcatctgttgaagttttattatgagattgcaacaattcagtcacatcttcaggctccacttctaattctagttctcttgctattcc

SEQ ID NO: 44340 - DNA, 601 bp, Human
ctcatctgttgaagttttattatgagattgcaacaattcagtcacatcttcaggctccacttctaattctagttctcttgctattccactacatctgcaattatttcctccacctgaagccttgagcctatcagtcatccatgagggttggaataaacttccccagttcctgttcatgttgatattttgacctcctcccaataatcatgaatgttcttagtggcatctagaatggtagatcctttccagaaggttttcaactgactttgcacagatccatcagagggatcactatctgtgkcaacaatatcctcacaaaatgctttttttaattgtatttaattttttttttttttggaaaagcagtctctatcgctcaggctggagtgccgtggcacaatctcggctcactgcaacctctgcctcccaggttcaagtgattctcctgactcaaactcccaagtagctgggattacaggcatgcaccaccatccctggctaatttttataattttagtagaggtggggtttcaccatgttgaccaggctggtcccgaactcctgaccttgggtgatccacccactttggcctcccaaagtg

SEQ ID NO: 44341 - DNA, 601 bp, Human
catctgttgaagttttattatgagattgcaacaattcagtcacatcttcaggctccacttctaattctagttctcttgctattccactacatctgcaattatttcctccacctgaagccttgagcctatcagtcatccatgagggttggaataaacttccccagttcctgttcatgttgatattttgacctcctcccaataatcatgaatgttcttagtggcatctagaatggtagatcctttccagaaggttttcaactgactttgcacagatccatcagagggatcactatctgtggcracaatatcctcacaaaatgctttttttaattgtatttaattttttttttttttggaaaagcagtctctatcgctcaggctggagtgccgtggcacaatctcggctcactgcaacctctgcctcccaggttcaagtgattctcctgactcaaactcccaagtagctgggattacaggcatgcaccaccatccctggctaatttttataattttagtagaggtggggtttcaccatgttgaccaggctggtcccgaactcctgaccttgggtgatccacccactttggcctcccaaagtgct

SEQ ID NO: 44342 - DNA, 601 bp, Human
tctcttgctattccactacatctgcaattatttcctccacctgaagccttgagcctatcagtcatccatgagggttggaataaacttccccagttcctgttcatgttgatattttgacctcctcccaataatcatgaatgttcttagtggcatctagaatggtagatcctttccagaaggttttcaactgactttgcacagatccatcagagggatcactatctgtggcaacaatatcctcacaaaatgctttttttaattgtatttaattttttttttttttggaaaagcagtctctatygctcaggctggagtgccgtggcacaatctcggctcactgcaacctctgcctcccaggttcaagtgattctcctgactcaaactcccaagtagctgggattacaggcatgcaccaccatccctggctaatttttataattttagtagaggtggggtttcaccatgttgaccaggctggtcccgaactcctgaccttgggtgatccacccactttggcctcccaaagtgctaggattacaggcataagccaccccacacctggccttttttccaaatttttaactttaatttttgtattttg

SEQ ID NO: 44343 - DNA, 601 bp, Human
ctttttgtatcattggtaaaaatggggtttcaccattttgctcaggctggtctcaaactcctgagctcatccaatccacctgcctaggcctcccaaagtgctgggattaccctgcccggctgccaaattttattcttaaagaatactacttgaaagtcaaaattactccatgatccatggactgcagaatggatattgtgttagcaaacttgaaaagtttaatatccttgtacatctccatcagagctcttgggcgactatgtgcattgtcaataagcactaaatgttttgaaaatatttytttttctgagcattaggtctcaacagtgagcttaacatagtcagcaaaccatgctgtaaataggtgggctgttgtccaggctttgtcgtttcacttataaagcacaggaagagtagattaagcataattcttaagagccctattattttttgaatggtaaataaatattggcctaaacttaaagtcattagctacgttaatcctgaataagattctgcctgtcccttgaaggtttgtagctgagacctcctttctagccataaagtcctagatagcatcttcttccaatagaggactcat

SEQ ID NO: 44344 - DNA, 601 bp, Human
aacacaatcaacctggaaatgacctcagtatgtgtaatcttaagtcatcttgctaacgcagacacctctgaggttcccaagaaaacttcagtggagttctctaaactgaaaccttgagagaggaagattttcaagtaggaaccagacaaattcacttaaaactcaccactacacacctgtgtcatagaagcattccattttttctattgcagatgggatttcctcttcaagcttactgtactgtgtctttttaaaaaatagttgaagacatcggaataaaagctaatgtcccaaacagcgyttccctggatattgctgtttctttaaaagcctttttcccagctcttctgagatggtccatgacattgcctttcttgctcattaccttgatcccttgaatgggcccaaaactttggaatgcaaaaacattcattccattgacttggttgagaaagatgataggtcaggttttttttcatctaaagattatcctgggcatacttcatttgggcccaaatgagggattattccaaagaagattgaagaagcaattactccttcccctagtaatatactctttggcaatgattacagtttgcat

SEQ ID NO: 44345 - DNA, 601 bp, Human
ttcttgtatcattgggtcctccaagtcaggcctgggtgcctctttatttacaaagagtagttgcctctattttctcaattgaaatgaccagatttttaagatctaataattgtgtccaccgaagaaatcatcaataaaaggatctgcatttcatgatacacaagtgcacctggaccctatgcagggagtggcactgctgcaccctggtcactgcctggctcctatgctatgtactcctcttcctgggacctatgtccaccttgaacttctaagtttctttccttaaaccttatgagccaayctgtgctagtttcacacttttcttttacatcttcctcacctctgtcaggcttcaaagaattgaagagaattggggccttgctctggtttaggctttggcttaatggaatgttggggctggtttgatcatctgaccagatcactcaaactttctccatatcagcaataaagcttgtattagtctgtttttagccactgatgaagacatacccaagactgggcaatttacaaaggaaagaagtttaatggagaactcatagttgcacatagctggggaagcctcatgacagtggcagaaggt

SEQ ID NO: 44346 - DNA, 601 bp, Human
taaagcttgtattagtctgtttttagccactgatgaagacatacccaagactgggcaatttacaaaggaaagaagtttaatggagaactcatagttgcacatagctggggaagcctcatgacagtggcagaaggtaaggaggagagagtcacatcttatgtggatggcgacaggcaaagagatagcttgtgtagggaaactccccttttttaaaccatcagatctcatgagacttatttactatcaggaggacagcacaggaaagacctgccctcttgattcaattacttcccaccaggtycctcccacaacatgtgggaattcaagatgagattcgggtggggacacaaccaaaccatatcattccacctttggcccctcccaaatctcatgtcctcacatttcaaaaccagtcatgcctttccaacagtcccccaaagtcttaactcattccagcattaactcaaaagtccacagtccaaagtctcatctgagacaaggaaggtcccttctgcctatgatcctgtaagataaatggcaagttaattattccttaaatacaatggaggtacaggcactgggtaaatacagctgttcaaaa

SEQ ID NO: 44347 - DNA, 601 bp, Human
ttcccaacaagttcctcatctccatctgagactacctcagcctggatttcattgtccatatcattatcagcattttggtcaaagccatttgacaagtttctaggaagttccaaactttcccacattttcctgtcttgttgtgaaccctccaaaccattccaacctctgcatgttacccagttccaaagttgcttccacatttttggatatcttttcagcaatgtcccattctgctggtactaatttactgtattagtctgttttcatgctgctgataaagacatacctgagactgggcaawttacaaatgaaagaggtttaccagagaactcacagttccacctggctggggaagcctcacaatcatggcagaaggcaaggaggagcaaatcacatcttacatggatggcaggaggcaaggagagagcttgtgtagggaaactcccatttttaaaaccatcagatctcatgagacttattcactatcaggaggacagcacaggaaaaacctgcccccatgattacgtcccgccaggtccctcccacaatacatgggaattcaagatgagatttgagtggggacacagccaaaccatatgaa

SEQ ID NO: 44348 - DNA, 601 bp, Human
attatcagcattttggtcaaagccatttgacaagtttctaggaagttccaaactttcccacattttcctgtcttgttgtgaaccctccaaaccattccaacctctgcatgttacccagttccaaagttgcttccacatttttggatatcttttcagcaatgtcccattctgctggtactaatttactgtattagtctgttttcatgctgctgataaagacatacctgagactgggcaaattacaaatgaaagaggtttaccagagaactcacagttccacctggctggggaagcctcacartcatggcagaaggcaaggaggagcaaatcacatcttacatggatggcaggaggcaaggagagagcttgtgtagggaaactcccatttttaaaaccatcagatctcatgagacttattcactatcaggaggacagcacaggaaaaacctgcccccatgattacgtcccgccaggtccctcccacaatacatgggaattcaagatgagatttgagtggggacacagccaaaccatatgaaggctgttggtctttcttattgttgtgttcactgaagtagcaattttaacttctttcaagaac

SEQ ID NO: 44349 - DNA, 601 bp, Human
gggttgccacagacctacagtttgtttaacaaacaaacaaacaaacaaaaggccaggtgtggtggcctatgcctgtaatcccttcagcactttgggaggccaaggcaggaagatagcctaagctcaggagtttgagaccagcctggacatggtaaaaccctgtctctaccaaaaatacaaaaaattagctggatgtcatgtaacagaggtagaaggattgtttgaccttgggaggcagagtttgcagtgagctgtgatcatgcctctgtactccaacctgagtgacaaaataagacaaaaracaatgaagtgaagagcaatgaaacaaagtatgcctgtacactaaaaatcagtctgttgtagctatttgatgttaagaacactaaattctttagtgcctttaggtcatatttgtagtaaacacttctgttaatgttttgaaactttactatttgcaccacccccagttataagtgtacacattcttgcatgttggactaaccctgtccttggacaaaggtcagtagcagatgaagattgcattttgtgatgtgctcagttaagtttaatttaaagtggtccattgtacaataatgtttgt

SEQ ID NO: 44350 - DNA, 601 bp, Human
cagaaagaaacatttaatagggagtgagaaacagaagtcatgatgtcctggcaattgacaacaacaagattagatagtgaatccccccgtaccattacccaccgcgtatgacttatatgtaaaacatagggaaggattatgtggaacaattgaagtcaacctctcagggaacggcaagaatgctatgtgaatctgcctaagggcaggatttatggtagcagcagttaaaatagaaatcttaaaggcattcccagaataagggttacccagaagtcaacatggcagattaacacccaatatrgagttgctttagcctccacaataatgtagggaaataaatataatgaagatggcagtattttttaaaccatatttcaaagaaatcttctctttgaaacatggagaagaaggcatatgtcactatatgcaacataagcttatattcatatctatttagtatatccaggacaaattttatttagttctaggaatatacagtgagatttttcttactgccccttgacgttagatattattcaccttacagtgatcagagatacgtcttttagcatccaccacttgttcatcaaccttgtctgtc

SEQ ID NO: 44351 - DNA, 601 bp, Human
tatgtggcaaatgcaacaagaagttttccttgacccaataaagatacaggtccttccttaaatggctatgttgaaatataaattcttaaattatatacttatttacatggcttctcccctctagtgaacttatcctggaatctgtcaattagatttattctatgtactgtctattcttttaaaatgggactctctcagaaatatccctctggataaggtacacatctcatttttctcagtgacagtaaaggggcgtaatttctattacacaggtctaattgccttgaagaaacatcataaggactcaaaacatggaaggtattattattgttgtgattatgctttgaattcttaagtaaccaatgtattctctgtctctggatctgtttctagtgtcaaaacccttgttagcaggaattagatcagattatattaataattatgtagtggatatcttacttttgcatattttctcatcagacaatacacgtctatattatcttttatctcagtgtgtatgaataaatgtcagagctatttgggtcataatttgctatgcggctgttttgtcttgttatatatttcactgtaataacagtga

SEQ ID NO: 44352 - DNA, 601 bp, Human
gattatattaataattatgtagtggatatcttacttttgcatattttctcatcagacaatacacgtctatattatcttttatctcagtgtgtatgaataaatgtcagagctatttgggtcataatttgctatgcggctgttttgtcttgttatatatttcactgtaataacagtgagttatgattcacaaagtttgcctccttttataaaaggtgtattttaatttgatgttagaaacaacgaactttaaaaatgtaattggccttaatatctttttagattcctttgaagatatacttascacaaaaatatgctccttgggaatttgacaattgagctgataataggatatatcatttttagtttacaggcaaaagcaaatgcttcattattttgttgttatttactacatcataaaagaaatttaattttagctagctgtgtgcatctaagtccagatatcatttgataaaatgagtcaagtgggaaaacttccatttctttgtgatgacacatcaaatatgcccttatctctaaagacattaagaatgattgagtgaagtcttcctactttgttttttcagtatctttagacatagta

SEQ ID NO: 44353 - DNA, 601 bp, Human
ggggtttacttatttaaaaataaattgtgaggttattttcatttttactaggaaatgctggaccatgatataatagcttcttcctaatcatggaagagttgactcttgagaagagctttagaataatgaacagttcttgtctgggaaaataaagaataagagccataatgggtaaataggcaaactacatgcaagcctacaaaacagtgatgtacaatgctagcaaagcactgacctttttggaaagacaattttctaatggcttcagcagagtgagttagtggatcagtatacttttgtrtattaatataggttaaaaaagacttggagtattaaatttttaaaaagaggtctagtaccttaaatgagttaatgtgtttaaagtacttcttacatcttactcaataaacagttttaccttaaagtgtcaaatctattatctattagggatattgtgttaatggtgactgcccaatgctttaaagaatcttgacttcattttttcaagtatgttttggaaacatgtctacaagttcagatatccctggatttgactcccagctaaattacataatgcttatttgaggttgaaaaaggcttt

SEQ ID NO: 44354 - DNA, 601 bp, Human
aattaccatgaaatgctttgggaagataatttgtcaattaacagctttttttgttgttaatcatcagactttaagtttcatcaattaatatataagtaaagtttgaggattcgttatcacattcacattttcccccgagtttgctgtttcattgataagcaaattgagccaatatcttctttctctttgagattcactggaaacatggctaattgaaaaggtagtcctgacaaacacttaagatgttgagttaattaatgtctttaaaatactggagattataaaatgaaagtgtgacataaaatgaacaaatgtataaattgtgtattaatgctttctcaataaatccattttattgcagttatcattttttaagcctacgccaaaacgatataaaattcttctagaagccaaagccttcccttctgatcatgtaaggacttcttcaaattgtatttatgttctttctactcttcctagagcagtgtatcatttgcctgacttgaatgtttactcactaggcttttccaagcaatcttacaataaaaagatctgtcaaatgcttttgattaaattttttaatagattatagctttatttc

SEQ ID NO: 44355 - DNA, 601 bp, Human
ttaccatgaaatgctttgggaagataatttgtcaattaacagctttttttgttgttaatcatcagactttaagtttcatcaattaatatataagtaaagtttgaggattcgttatcacattcacattttcccccgagtttgctgtttcattgataagcaaattgagccaatatcttctttctctttgagattcactggaaacatggctaattgaaaaggtagtcctgacaaacacttaagatgttgagttaattaatgtctttaaaatactggagattataaaatgaaagtgtgacataawatgaacaaatgtataaattgtgtattaatgctttctcaataaatccattttattgcagttatcattttttaagcctacgccaaaacgatataaaattcttctagaagccaaagccttcccttctgatcatgtaaggacttcttcaaattgtatttatgttctttctactcttcctagagcagtgtatcatttgcctgacttgaatgtttactcactaggcttttccaagcaatcttacaataaaaagatctgtcaaatgcttttgattaaattttttaatagattatagctttatttctt

SEQ ID NO: 44356 - DNA, 601 bp, Human
attgatttattagtctttttaaagacattgagcaaaccactgctctaaatcaagtgcagttataaatgttttattaattcttattgctcttttattttatgaaatcaaatcaatacaaaccccagtgcttaaccctttagctaaatagaataggaatataaacttttatttgtccagtgtgttttcatagcatgctagcataaatgttggcccattattatcaaaatattatttattagagattaaaaatatttcttgtgatttactaaaaaaagtcacattactttacttgatgatgagwtgtttattcttacttgataagaaatgtaatggtttcagacacaaacacaaataaaagtacaatgtaagtctgggcacagtggctcactcctgctatctcaacacttcaggaaaccaaggcaggaggaacacttgagcccaggagtctgagaacagcctgggcaatatagtgagacctcgtctctataaagtaaataataaataaataaattaattaattttaaaagtacattttatattttagttttggtgttagagaaactttatttctctatattattgctgtcttttactctagccc

SEQ ID NO: 44357 - DNA, 601 bp, Human
catgctagcataaatgttggcccattattatcaaaatattatttattagagattaaaaatatttcttgtgatttactaaaaaaagtcacattactttacttgatgatgagttgtttattcttacttgataagaaatgtaatggtttcagacacaaacacaaataaaagtacaatgtaagtctgggcacagtggctcactcctgctatctcaacacttcaggaaaccaaggcaggaggaacacttgagcccaggagtctgagaacagcctgggcaatatagtgagacctcgtctctataaartaaataataaataaataaattaattaattttaaaagtacattttatattttagttttggtgttagagaaactttatttctctatattattgctgtcttttactctagcccttgtaattttagggcaagtaattatgtcaaatggaataaaaccctaatatcttactaaaatggatcaaaatcctaatatctacaaaagattccaggtcggtgtgggggcttatccacatgcatatctggtactcttaatgaagtaaacttcttaatgccttttttttagctaacttactcttcctagggt

SEQ ID NO: 44358 - DNA, 601 bp, Human
tggcccattattatcaaaatattatttattagagattaaaaatatttcttgtgatttactaaaaaaagtcacattactttacttgatgatgagttgtttattcttacttgataagaaatgtaatggtttcagacacaaacacaaataaaagtacaatgtaagtctgggcacagtggctcactcctgctatctcaacacttcaggaaaccaaggcaggaggaacacttgagcccaggagtctgagaacagcctgggcaatatagtgagacctcgtctctataaagtaaataataaataaatwaattaattaattttaaaagtacattttatattttagttttggtgttagagaaactttatttctctatattattgctgtcttttactctagcccttgtaattttagggcaagtaattatgtcaaatggaataaaaccctaatatcttactaaaatggatcaaaatcctaatatctacaaaagattccaggtcggtgtgggggcttatccacatgcatatctggtactcttaatgaagtaaacttcttaatgccttttttttagctaacttactcttcctagggtaagccatttctatatcc

SEQ ID NO: 44359 - DNA, 601 bp, Human
atgatgagttgtttattcttacttgataagaaatgtaatggtttcagacacaaacacaaataaaagtacaatgtaagtctgggcacagtggctcactcctgctatctcaacacttcaggaaaccaaggcaggaggaacacttgagcccaggagtctgagaacagcctgggcaatatagtgagacctcgtctctataaagtaaataataaataaataaattaattaattttaaaagtacattttatattttagttttggtgttagagaaactttatttctctatattattgctgtcttttaytctagcccttgtaattttagggcaagtaattatgtcaaatggaataaaaccctaatatcttactaaaatggatcaaaatcctaatatctacaaaagattccaggtcggtgtgggggcttatccacatgcatatctggtactcttaatgaagtaaacttcttaatgccttttttttagctaacttactcttcctagggtaagccatttctatatcctatgttcaaggatgacaagtccctactattcattttgcttattttgcaaattctggttttgacttagattagatgatttaatttc

SEQ ID NO: 44360 - DNA, 601 bp, Human
accaatattgtggagtttcatgagttactcataatcttgggaccactgttgagcattacctagaacaagtcaacatgagagagggccgtatcctgtcgttgaaaaatgtatttcttatgtgcttaatactgattttttaagatataaattaagtattagtatctataatattttccttaccactttattggaaattatggtgggtaaaccttattagattgttttaagaataaagagttttggattgccaagttatcaattttacttacaattaatgacattcttttctttatataaagtrtacttcacttaataattcagatattttaataacaatcccattaatattgggatgccaatttttattgatgcccattttgtaaacaaattcctggtttcttctagtagagagtttatttcacacccacacacatacacactcacacacacacacacgtactctcttaacatggagcagagtaattggcaaataccaagataattaaaaattaaaagtaaactataggataatatcttaatgagcttcccccaaatattaacgtaattaatgatgcattgacctcaaaatcatgtcagacag

SEQ ID NO: 44361 - DNA, 601 bp, Human
gatatgacctaacttgtgcctaacttgatttagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaaggtatgcacgccatttacttcttcccaccttactccaaacatcactctacttaagagtgttctaattgcatgacttgtgaagtactttagcttgtgtctgagtaaaactatttcaaaagttaaaaaaaaaaaaaaagagtaaaccttgggccaggcacggtggctcacgcctgtaatcccagcacttgggaggctggagcagggggatcacgaggtcaggagtttgagaccagcctgacaaaaatggcgaaaccccatctctactgaaaatacaaaaattagctgggcatggtggtgggcacctgtaatcccagctattcgggaggctgaggcagaagagtcacttgaactcgggcggtggagattgcagtgagccaagatcgtgcccctgcactccagcctgggcaacagagcaagactcc

SEQ ID NO: 44362 - DNA, 601 bp, Human
tacactggacagcactttaatattcctgccatcacaaaagctggacaagcgaaggtatgcacgccatttacttcttcccaccttactccaaacatcactctacttaagagtgttctaattgcatgacttgtgaagtactttagcttgtgtctgagtaaaactatttcaaaagttaaaaaaaaaaaaaaagagtaaaccttgggccaggcacggtggctcacgcctgtaatcccagcacttgggaggctggagcagggggatcacgaggtcaggagtttgagaccagcctgacaaaaatggygaaaccccatctctactgaaaatacaaaaattagctgggcatggtggtgggcacctgtaatcccagctattcgggaggctgaggcagaagagtcacttgaactcgggcggtggagattgcagtgagccaagatcgtgcccctgcactccagcctgggcaacagagcaagactccatctcaaaaaaaaaaaagcgagtaaatcttacatttttaaaagaaaatctgtaatcttttttgcttcaggcatctctatttaaactgcttttttttttttttttttttttttgccacttctgtggt

SEQ ID NO: 44363 - DNA, 601 bp, Human
agatctagttaatatattcagttattgaagctaatgaatggaactaattaaaatatatttagcactgttatcagcagtctctaggaatttctaacaacgacttccaactgctttgacggataactctgaaagtggtgcattacaaaagatataaagataatgtcttcttaatttagatgttaaatgttaagcaccaaaataaagggaggccaataaaaaatcatattttaaaatgttatgcaagtaatcagcagtccctgcttccttagtatacacgtatgtctcattaaccttcctagayatgagacagcaagatacagaagaaagaccatgggtttccatcacacaatctgaggttcaaatcttggctaggtcatttaattgttacacaatcttgagcaagttacttgacatctcgctttaaaagtgctaatttaacataacagcacccaccttacaggttcagtgtgagaatgatgaatataaaacaccaaatggattggcacacattctgctattaaatgatggtttccttacctttctactcttctcaattaatatgatattataaagtggttgagagacactttcttttgtttcc

SEQ ID NO: 44364 - DNA, 601 bp, Human
gaatacaaaatgatggtgggatggagcaatgagagtcaatcaggaggttctgaggtaaaatcttcatagtcatgtgataaggaagaagaaacagaaattgtgaaaaatattttaatttaagaaatgtatgtataccaaaaacagcatgaatcataagcaaatagcttcatgagttattttgaggccttataaccatcaccccatcaagaaaaaaaaagtatttccaatactcagaatcctcaatcgtgtcttcttccaaatactacctgttaccttctgtctctgtccacttgggctgctrtaacaaaataccttaaactgggtaatttaaaaacaacataaatatattgctcacagttctggaggctgggaagtgcaagatcaagatgccagcagacttggtgtctgcttagggctgctgtttgtttcacagatgacgccttgttgctttgcccttcctcacatggcagaagggctaagggagctttctagagcctctaatacaaagggacaaattccattcatgaggaatcacttaatcatgacttaatcatttccaaagccctgacctcctaatactgtcacattgggtataaggttg

SEQ ID NO: 44365 - DNA, 601 bp, Human
ggcagaagggctaagggagctttctagagcctctaatacaaagggacaaattccattcatgaggaatcacttaatcatgacttaatcatttccaaagccctgacctcctaatactgtcacattgggtataaggttgtgacatataaaattggggtctggggagaccaacatttagaccatagcatccccctttcaaatttataattcccctaacttctaaccacatagtcagctttgtccattttgaactttatataaatgcattattttgtctagttttgaactttatatgaaggtatayacaggttgaatattccttacctgaaatacttgggaccagaagtattttggatatttttggattttggaatatttgcattatacttactgcttgaacacaccaaatctggaaatctcaagtgctccaatgaaatttttattctttgagcattctgtcagtgttcaaaaagttttggattttggagcctttcagatttctgaatttgggattttagatgctcatcttttataaagtttttttttgtgtttggcttatttgctacttttatatgtgtgagattcattcatgcagtacctagca

SEQ ID NO: 44366 - DNA, 601 bp, Human
actgtcacattgggtataaggttgtgacatataaaattggggtctggggagaccaacatttagaccatagcatccccctttcaaatttataattcccctaacttctaaccacatagtcagctttgtccattttgaactttatataaatgcattattttgtctagttttgaactttatatgaaggtatacacaggttgaatattccttacctgaaatacttgggaccagaagtattttggatatttttggattttggaatatttgcattatacttactgcttgaacacaccaaatctggaamtctcaagtgctccaatgaaatttttattctttgagcattctgtcagtgttcaaaaagttttggattttggagcctttcagatttctgaatttgggattttagatgctcatcttttataaagtttttttttgtgtttggcttatttgctacttttatatgtgtgagattcattcatgcagtacctagcagtacttttgtttgttttttttttctatttcagtgtatttttacatagtatgaaatagatcacaggttttttccgttttatttagggtagatatttggattttattttcattt

SEQ ID NO: 44367 - DNA, 601 bp, Human
tcaagtgctccaatgaaatttttattctttgagcattctgtcagtgttcaaaaagttttggattttggagcctttcagatttctgaatttgggattttagatgctcatcttttataaagtttttttttgtgtttggcttatttgctacttttatatgtgtgagattcattcatgcagtacctagcagtacttttgtttgttttttttttctatttcagtgtatttttacatagtatgaaatagatcacaggttttttccgttttatttagggtagatatttggattttattttcatttgaraactactaatataataatacatgctactctaaatattcacataaattttggggggtatacattcatatacatttctgttaagtatatacctagaattagaattcctgaaccataaggtatttgtatatttatttctaatcaataatgccaatcctccaaaaaagttgttcttctaccagcatatattagactttctgtttctctacagcttcaccaatagttactgttttcagtctttataattttagctgttctaagtagtttgcagtggtaatgcgtggcagttttattttgcagttc

SEQ ID NO: 44368 - DNA, 601 bp, Human
tatttttcatattctgttacttgtttctactaggaacttctttcctacacccactaattgtagatgtttctgattgtcccctgcattgtatctctagtgatttttaaccactgccataattcagctaccactgtcaagtgcagactccaggctactcatacaataggaaatagcctgcatcttcccactacatccggatgtcctatatgtaccttgggatcaatatgctccaaagagatttgtgtcatccacaagatgtctctactgtatcatcatgtcaccatctttctggaccagtacrctcagcttttctgttcttgacctttttaacctatctcttattaatttcatcctttcagggtctgtctttcttttaatatttctgaatcaaagatgaatgttttcagctacaagaaacaaatgttaaccttgggtgaaaaatgcagatttctttttctcaccacgaaagacttgaggcaaggggctgctggggtccactcagcaactcaattatgtctgagtgccatctcccaagtttccttagagttttctcagactttttccatcacagtcacaagatatttgtctcaaatccagaaat

SEQ ID NO: 44369 - DNA, 601 bp, Human
tcaatcaggatctctgcttctgcagccacccttatcaaagccatgagggatatctatttctcctgaattagcctcattcattggcataacagctaaacctagggcctcccgaaggaagtgttacacttaagttttttgtagatgatagatgtttcataaaatacttaagttgcctaaagcccagagtatattcttgaatattccatttttcatgcctcttgactaaccaaggaaggcagatttaagtctttgttaaactgaaaaatgaaagtgttccaatgtgaaatgtacacatcagttmtaatttattctaccctccataaaagtggaaaaggaaggctatgtctcatggcaataaaaatggaattccaaaagatctttgggcagaaaaaaaattcccaataaaatatgagagatttcttccacaccattctctgaaattcacttctttcatcagttaaattatttatacaaacaagattagggatgtcaacatgaaaggttagtcgatttgaagagaaaatattttcgcagcagataatctatcttatggaggagggtggtgagcaaagaagataatcatcatattgtctataaaacc

SEQ ID NO: 44370 - DNA, 601 bp, Human
tgctttgtgtaggccctcattgtattagcaaacatggtgtatttttaaaatgtagtcatatgccaacaataggaaatcatgagatttcatataaagactcctggtttcaaatatcttccaaaaaattagaagtttgacaacaatggaccttcattcctataggtggcaacactgggtagcagctctgtcccttagatggggcttaagctcttcgacacaacatccatgtttacccactgagcccaccattgaagccaagtcatcgctggtgaatatatctatatgaataccacaacattaggtgtgtgtgtgtgtgtgtgtgtgtattcatgcttatgatattcttacaatgaagtgtaaaataaagtatttcttgcaggcccaactcgtacattgcttgactgactcttgtagaaacctgcaaatgaaatccttgacttttattggcaacattttctcacttttctgtatcaggatatatctgtcttcctgctatacttccacaccatgatgaaaaatgtatcattggccaccgtttgcactgtcttataattacttctatgcctattttaactctcaaatttaggaagctatgtcagta

SEQ ID NO: 44371 - DNA, 601 bp, Human
atgtatatataaactaatcatataatggcaaattggtgtcagcatttagaaacatcaaagaaaaaatatataatctttttcttggtcctttattttcttggtaatctgagacctctgtctctgtagtctacgtaattgtctctcttgagaatattgaaaacccacaagttttactttgctcctaaatgtcaagaaggcatagcctaaatgtcaataagcatcaaaagtctttctgaatgagatagtgccagcattcatcactgttccttctcagaacctcaagcctactctttccaattamcctcatatagggaagccccaatacactggcccctccataccccttttatctccttctggcaggtctcttaggcagttgctccattggcaacagctcccagcaatgatggctgcattactactcccatcctcataccttcagtgacctttggggtgtttgcagcagctttccctctaattaagagcttgcaagcctccgtgtgcttgggaaacacagctgcaaaccactggagagaattccagcaggaagtactcatccctcgctcccattgtctaataccagctgaggtgtacattacac

SEQ ID NO: 44372 - DNA, 601 bp, Human
cacagctgcaaaccactggagagaattccagcaggaagtactcatccctcgctcccattgtctaataccagctgaggtgtacattacactcaagaaattttattctttcagatgtataatgacctctcattttacgtcaggctctgggtttaaaaagagacagacagaaaatagagaataaaagaaaaaaatcccaccatctctgtctttaaagagatcagaatcagatgtgacatagaaatatgtaaagagaatattgctttagactgtgttaagtgcttgacaacgggagacaatagawtcactaaggtgtcttagaaaaaacaccctcgacatgttctaacaccacccaaagtatacttatgtatgctccaattcgtttagctttaaagttgcccaaaaccacaaactgaataacctcaaggagagcattcagatagttcagagcattcattcccatagtcaaccaaaaagtatctgagacaagtctcactcagtttagaagtctattattccaaggataagtacatgcccagaagaaataaaaacggaatcacagaaactgtggtctgtgcctttctacaaagataattttgagggc

SEQ ID NO: 44373 - DNA, 601 bp, Human
agaaaatagagaataaaagaaaaaaatcccaccatctctgtctttaaagagatcagaatcagatgtgacatagaaatatgtaaagagaatattgctttagactgtgttaagtgcttgacaacgggagacaatagattcactaaggtgtcttagaaaaaacaccctcgacatgttctaacaccacccaaagtatacttatgtatgctccaattcgtttagctttaaagttgcccaaaaccacaaactgaataacctcaaggagagcattcagatagttcagagcattcattcccatagtcawccaaaaagtatctgagacaagtctcactcagtttagaagtctattattccaaggataagtacatgcccagaagaaataaaaacggaatcacagaaactgtggtctgtgcctttctacaaagataattttgagggcctcagtaaagggaaaagtgggctggaggggaaagaggaagggtatggtaacccacatggtgcaagagagaaggagcaggtaagggaataatcaattatgtattcctctcatgctcagtaaatcagcactttacataaaataaggtgaacgtagagtaggatttaa

SEQ ID NO: 44374 - DNA, 601 bp, Human
ataaatgaatatatcttgatgaattcatttcactgtttagcttatccttggatccataccagagtttttaaatcactacgtaaacatgtttactctaatttcattctgattccaagttaaagatactcatttttaattcaatgagttccttgattgttgtgcacacttttctcatgatacccattttttgattcagaacactcccttattggatttcttatcttcaaaattaatgtcacaggtgcgactagctggggctcgtcatgggtggtaaaggaatttaccacgacagtcataggtraagaaaggcagatttattagagaaggtatgaagataccttgcaagaaagcaatgggcattacaacagagaagaggctgtctgcagagaggcaaggggtggagggaagttttatggggttgtgctggagggggccacatgctgaccgaagccatgctgctggggctatgtgtggaaggaggtcactgtgtccacaggttacttgtgattaacatttctcagaacaattattcattattcttccccacctggggccctttctttgttgttgcttacttatcaaggctccacatttaaccttt

SEQ ID NO: 44375 - DNA, 601 bp, Human
attttaaaatatttggtaaaagatatatttgaaatctatcattaggtaaattaccttaattttaggtaatttatcagaaggttgtgaactcaaaagtatctgagacaggtcccagtcaatttagaaagtttatcttgccaaggttaagaacatacccatgacacagcctcaggagctcctgatgacatgtgcccaaggtggtcagggtacagcttgcttttatacattttagggagacataatacatcagtaaatacataccagatttacattggtttaatctggaagggaaagacaactsgaagctgaaagcctggggaggagagggctgggcttccaggtcataggtagatttgaaaatatttttggtaactggttgaaagagttattatcaatagaaaggaatggctgggttccagtaaggggctgtggacaccaaggttttatcacgcagatgaagcctccaagtagcaggcttcagagggaatagaatgtaaatatttcttatcagacttatggtctgtgttgatgttaatgttggaaagcataatgaagtatgtccatcccctcttccatcatggcttgaactagcttctcaggt

SEQ ID NO: 44376 - DNA, 601 bp, Human
tcagtaaatacataccagatttacattggtttaatctggaagggaaagacaactcgaagctgaaagcctggggaggagagggctgggcttccaggtcataggtagatttgaaaatatttttggtaactggttgaaagagttattatcaatagaaaggaatggctgggttccagtaaggggctgtggacaccaaggttttatcacgcagatgaagcctccaagtagcaggcttcagagggaatagaatgtaaatatttcttatcagacttatggtctgtgttgatgttaatgttggaaagcrtaatgaagtatgtccatcccctcttccatcatggcttgaactagcttctcaggttaactctggaatgcccttggccaagaggaggggtccattcagatggggccttagaattttagctgtggtttacaaaattgaggctcaaatattttctaccatctgaatttttctcgtttctgttcctgtttggtgctcaactaaaatgtgagcatttagaattgattttcaggtggctagcttcctggatggaattttgtgtggatatatatatatatgaataatcatattcattttttgatatct

SEQ ID NO: 44377 - DNA, 601 bp, Human
atttaatgaaaattgatcatttttacagttttcacaaggatattttcacatgaaactttcccatgcccccaggtgaaaggctggaaccaatgtaatgactactagtacagttcggtaccgctgccttggctcctgctaaggtggcagctgttttacccatcactgcttttgcattatcaatgcaagtgtcaattcagcaaaaaaggcaaagaatgtcttagcatgatgacaattgctttgatctggtgggccttctgaaagggtcctgggaattatggatcatactttgtgaaccattgcrtcaaagagcaaaccataatttatggtacagaagtttgtcaaatgttttcttaaaaatatttgtacttattatttctaatcatgaagcaaacttaaagcttattattgtgttcttccctagggttgttatgttggctttgatctagcacatgcagttggaaatgttgaactctacttacatgactggggagttgattttgcctgctggtgttcctacaaggtacaaacgagttaatacatttacatccctttatttcacattgactttaatctgaaggagaaactgggtctgtgggccaat

SEQ ID NO: 44378 - DNA, 601 bp, Human
atatagagaaattaattcttcaattccttggctgctatgaaaaagtcaggaggttctgtagaaaaagccctacacttaattcaaattgatcatctttttagtttttttattgataagttgtgaaatttctgcatatataaagataatatttagagaatcaacttagaattcatatttgaaaacagttgacagggagcatgaaaataaaaccaattacaatttacttgctttaaaaatatatttttattattattacaatattttaggacaaaataatttaaatgtatgaatttcaaagccrgatctcattaaaactgctttctaccagctggagcaaaattgccccgtaaaagtaatagccatttattctcaacctaataatactattttttatttgtttttctttgaggaaggtgacctaagcttctgttttatcataaatacacaaataatcacacattttgaactgatcaaatgttgtggtttcaattaaaaaattcaaatgactacattgtttagttttgtcatatatttaagtaaacccacataatttaatttattttcaatctagtatttaaatgcaggagcaggaggaattgct

SEQ ID NO: 44379 - DNA, 601 bp, Human
ctggccatgaaagatgttcctgcctcccccttcaccctctgccatggttgtaagtttcctgaggccttcccagtcatgcttcctgcacagcctgcaaaaccatgaacaaattaaacctcttttctttataaattacccagtctcaggcagttgtttgtagcagtgagagaatggactaatacagcattatatgtgatcaataggtatggggttatatgaaaaaaaaaatccaaaatttacaatatacaggaaaaagatgggtgacattctgtaacaccctagcccaagtattgtttggtarttatttagtactgacccctaagtacttcgttgactcactgagaatgtgcatagtaacatgtagactttgcccagtggagatcatttctcttaagcagaaaatataacctcaaagtttatggtttgtgactttgtaggacattagtttgtaactatcaccaagtttattttagcagacctttgatgagctgactgtagaatataatctccattccttggagatataatctctcttatatgctataagaaagaattctggccttcctaccatcttactgattccgccactatttagtgggtt

SEQ ID NO: 44380 - DNA, 601 bp, Human
agtgtgttttacttttttattcacctgaaaatcaaataccacctgtgagaagagtgataaacaaagaaaagacccaaaagcctacaatatcacgctgctcaaataagtgtaattgttcagatgttacgacaatgttccatacataaaatattgtgaagatggggagaggaagttttcttgtgaataatatttatagttccacggtcaaatccaatttaaactttgagtaaactttagagtctgtatgactactgactctatttgccaattaataattatatttcagttgttagcattccamgattagctggtttaactatgtttaataagccttctgtcatcttacttttctgttctcttagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataacatttcttctcatggtccactcattcactctttaacaagtatt

SEQ ID NO: 44381 - DNA, 601 bp, Human
tcatgaaggctggtctaagaaaggaattataagcatgggtgacccacctggtgtagagagtgtatccccagatatataacattgcattttagaagtctaatatttggtatataatttttgaaatagtcctttatgtgatgtttccattagcaaacagcaaattgcatctgtaccaagagatttcacttccttttttgtttaaatatgcattttggacattgttcaaaacctatgacctaaggcttttccaagagccctttgcccataaagagaatgaataaattagaggccagagtcaacscacggcattaagcatcataactcaagctgttattctcacctagaatttaaccttttcctagttcattattaacttagctcattgcaatgtcatattctaaactctgtctgtacaataaattaggactggtcatgacttcttggatgtttttgccccacttcaaggtagactttaattcagtctacacagttaattattgctctgaaatatgaagggaactactcttaattgtacaaatttgacaatatgaaatgtttcactaaaaacatgcttaaataacattgtaaattttgaatgttt

SEQ ID NO: 44382 - DNA, 601 bp, Human
agttgaaaaggctggctgacttcagtgcatggttaagaaataagagttgttactatttggcaacaacattagaaaaacaatatgcatcaaacaattcccaggaaagtcccagaaagaataaaaataaacatccagaaatttcagcaaaaagacttaaaaaattataactttataccatgcttgtcccaactgtacagttaacattgtatgaagagatcgtcttttgcacatttgttcaggggaacactgacttatatatttcacttccatatgcttttccaggcaacagttgagaatgccrtagcccaaaacttatctataatttaaatcctgttttagttttctaatgatgccttctgaattactacttatcaagtccctatctagtaccagaataaggccttcttgtgcaaagtttgagacaacaggaagcataggtcgcagtagcaagatgtgtgacttcacaacacttctgatgctttcaaatgagatagaccagtaccaatagatttctcagtgagtttttatagaatccccagttgaaatatgacctcggccttctgaggcacctgttctgcttgtttagcctgtatttagccag

SEQ ID NO: 44383 - DNA, 601 bp, Human
aggcaacagttgagaatgccatagcccaaaacttatctataatttaaatcctgttttagttttctaatgatgccttctgaattactacttatcaagtccctatctagtaccagaataaggccttcttgtgcaaagtttgagacaacaggaagcataggtcgcagtagcaagatgtgtgacttcacaacacttctgatgctttcaaatgagatagaccagtaccaatagatttctcagtgagtttttatagaatccccagttgaaatatgacctcggccttctgaggcacctgttctgcttrtttagcctgtatttagccagtgttaatatggatgactttccagctacaacttcttggcttctcagccatatataattggctatctcctttgtctttaatatttgcctcccacatctctaaacttctgtggtaccgttttcttttgcttctgctccaatggatgtgagaactcttctgtattttaaaatgtttactttttcaccttttcattgattctctcaaaacctcagtccttaatcctcttgcccaaaagtatctcatccacagttatttcaacaatatacaactggtgtagaagaa

SEQ ID NO: 44384 - DNA, 601 bp, Human
aattcatttggagatatatcttttaaccagttaaataagtgatttaagtcacaggcaacccaagcttagaatatgtgccataaggcagcctctgattaattactgggtgaattctcagactgcttttgccgtaggggcagcggaggtatagcagactgactcagagctgcttgggaagagcttgagcaaggaggtggggaaactcacagatacgaatcttctgtaaaatggaatgcaatactaactaagtgaataaatttactttgttacattgaaaactaaaattgttgcctgtgagagrgattcatttcagaagttccataaatttaaggggatataaaaaagaagaaagaattacttaaatggcatttcttaaaggaatatgccaagtgatcttttcctttttattctcctcattagaatttttatggaattggagttattgacttaacattttaaagcctgcctcattatcataaaattgttctttatctttcaacaatattttagccattataaacagtggtaaaatcgtgattgctttaagctctcccttcgctctgggaacacactcttgaagtgggttacacctgtcatcagt

SEQ ID NO: 44385 - DNA, 601 bp, Human
gccgtaggggcagcggaggtatagcagactgactcagagctgcttgggaagagcttgagcaaggaggtggggaaactcacagatacgaatcttctgtaaaatggaatgcaatactaactaagtgaataaatttactttgttacattgaaaactaaaattgttgcctgtgagagagattcatttcagaagttccataaatttaaggggatataaaaaagaagaaagaattacttaaatggcatttcttaaaggaatatgccaagtgatcttttcctttttattctcctcattagaatttttrtggaattggagttattgacttaacattttaaagcctgcctcattatcataaaattgttctttatctttcaacaatattttagccattataaacagtggtaaaatcgtgattgctttaagctctcccttcgctctgggaacacactcttgaagtgggttacacctgtcatcagtcttagtcctcaaatggtgactgtaagggacccaaaagtagacacaccacttgaagaaaactcatctgtggaatcatgacatacaacctaaacctattttcatttagaaaccattttagatcaataat

SEQ ID NO: 44386 - DNA, 601 bp, Human
aaagaagaaagaattacttaaatggcatttcttaaaggaatatgccaagtgatcttttcctttttattctcctcattagaatttttatggaattggagttattgacttaacattttaaagcctgcctcattatcataaaattgttctttatctttcaacaatattttagccattataaacagtggtaaaatcgtgattgctttaagctctcccttcgctctgggaacacactcttgaagtgggttacacctgtcatcagtcttagtcctcaaatggtgactgtaagggacccaaaagtagrcacaccacttgaagaaaactcatctgtggaatcatgacatacaacctaaacctattttcatttagaaaccattttagatcaataatttttaaaggatttttttaaaaaatcttcctggcttgacaatttttactgtgtgaaattctccagataattttcttgtgtagggaatttaagctgtgatcataaaaataacttacatgcattgaggcacgagcacagttaaaaataaattcagtaaataatctgtatttttttaactccagagatgaagtaatcctagatcttaaagaaagccaa

SEQ ID NO: 44387 - DNA, 601 bp, Human
aaggcttttttgttactaatagtctcatgccaaaaaacatattgacttagctcttataagaacaacatattctgaaactttagaaaacaatttttattaactaaaatttatcatttctggaagtgcttttttatgactatgcttatcatactgttagcttactggacatattagaacaagcctcttacagagtaagatttgaagaggtaattgaatatgtaacagaaccaagtgaagcactaatatttacagatgggtgggcaaatgagaagaaaaaaatgaaactgaattttatgatacwtcctaaaactactttctaaaatagcattaagtcagctaacttcgaacaaagcagaacaattgtgattagatgaatattttattaaactaggaattgatagagatctttttaaactaagagtatgttagcaatattgtacctgtttaatggcatggcatgccatgccaagccttctaatgggcatgcttggggaccagttgctggcatcaaggggtgaatgtacagtttatgagctgaagcaatctactttctcagttttcaacactttttctttgtcattagtacctttgaatctgcttt

SEQ ID NO: 44388 - DNA, 601 bp, Human
tgttttgatgcatatctactgttttgtctgattgtcattttataggcactagttcggtgttctctatatgtgcctgaactactcttatttctgaactcaaatatctgcttgcactgtaccaaacgtgtctctgtttcctaagcctttcttctcactacacatggtagtctagcaacattaatgccctaccgtgggaatatggctgaagatcttgactaggggacttatgaacccatgcagccgtgcccaaatcctaccaaactgaccttactttcttgaagacagaattgtagtatggtcragctcatgctttttgtagtaggccatccaaattcgattgactggctaaaaaagattgttagtggaggctggaagaaacattttggctgatgatagatgaatagagcttggaacaatcaaaaggaaaagcagaaagtctatacctattcataagaaaaagttagtatgtttaccgaacattatgaaagaattatgacattttcaaagttttaaaattttattttgtagggacggggtctcattgtgttgcccacgctggtctgtttcttgaggatttactatagactgggctgtattcaaa

SEQ ID NO: 44389 - DNA, 601 bp, Human
gaacccatgcagccgtgcccaaatcctaccaaactgaccttactttcttgaagacagaattgtagtatggtcgagctcatgctttttgtagtaggccatccaaattcgattgactggctaaaaaagattgttagtggaggctggaagaaacattttggctgatgatagatgaatagagcttggaacaatcaaaaggaaaagcagaaagtctatacctattcataagaaaaagttagtatgtttaccgaacattatgaaagaattatgacattttcaaagttttaaaattttattttgtagrgacggggtctcattgtgttgcccacgctggtctgtttcttgaggatttactatagactgggctgtattcaaagcattggggatacaggcatgaatgagcccccattgtcctgaacttaccattcagtctgggcagtgaaagaagagggatgttgggagaaccttacaaagatgaaatgtaagctaactggagaaatcccctaactttcagtcagactgaaagggaacaggcagtaactgtgggtagccctcttgggcagggtgattttccacatgtgccagtcaggggccagaacattaa

SEQ ID NO: 44390 - DNA, 601 bp, Human
ttaccgaacattatgaaagaattatgacattttcaaagttttaaaattttattttgtagggacggggtctcattgtgttgcccacgctggtctgtttcttgaggatttactatagactgggctgtattcaaagcattggggatacaggcatgaatgagcccccattgtcctgaacttaccattcagtctgggcagtgaaagaagagggatgttgggagaaccttacaaagatgaaatgtaagctaactggagaaatcccctaactttcagtcagactgaaagggaacaggcagtaactgtgggtagccctcttgggcagggtgattttccacatgtgccagtcaggggccagaacattaagatccttatgttccaactaaggaattttgattttattttaaagacaaaggggagccactgactgttcatgaggaacaagattacaaattcaggtctcttcacctctcattaagtcttggtttgcctgtggaaaaaataaatagaccccagtgatctctggaagattctcttccagctttcgaatgctgtcattctcaagtgataaaaatgaagcatcacaattgagtgaactgctggtagt

SEQ ID NO: 44391 - DNA, 601 bp, Human
gtctgtttcttgaggatttactatagactgggctgtattcaaagcattggggatacaggcatgaatgagcccccattgtcctgaacttaccattcagtctgggcagtgaaagaagagggatgttgggagaaccttacaaagatgaaatgtaagctaactggagaaatcccctaactttcagtcagactgaaagggaacaggcagtaactgtgggtagccctcttgggcagggtgattttccacatgtgccagtcaggggccagaacattaagatccttatgttccaactaaggaattttgrttttattttaaagacaaaggggagccactgactgttcatgaggaacaagattacaaattcaggtctcttcacctctcattaagtcttggtttgcctgtggaaaaaataaatagaccccagtgatctctggaagattctcttccagctttcgaatgctgtcattctcaagtgataaaaatgaagcatcacaattgagtgaactgctggtagtgatagctcagaaactaaaaccagcttgatggaaatctgagcatcaccggctatatcaataacttcagtgaccctcctttccactccttt

SEQ ID NO: 44392 - DNA, 601 bp, Human
tagattctgtgcaatgtatttcgtgtttaaatgttgttttgaaataatcatttctttatttgctttttaaaaggttttaaacagcgcttatttctgtttgtaaagacttgaacttgtaacagatgagtgatatgcttactcaagttcactaaatcaagtgtctaggatcatgcattttgaagaaaggcaactccttatagagattctaaaagaatagagaaggtcaaaagaacatttgtttgagggagtggacattgtatatactaaaaagaatagcttctgtgaccaggcgcagaggctyatacctgtaatctgacactttgggaggttgaggagggcagatcacaaggtcaggagattgagaccatcctggccaacacagtgaaatcccaactctactaaaaatacaaaaaagttagctgggtgtagtggtgcatgcctataatcccagctactcgggaggctgaggcacaagaatcacttgaacctgggaggctgaggttgcagtgagcagagatcacgtcactgcactccagcctggcaacagactgagactccgtctcaaaaaaaaaaaaaaaaaaaaaaaggaatagcagctctg

SEQ ID NO: 44393 - DNA, 601 bp, Human
aataatcatttctttatttgctttttaaaaggttttaaacagcgcttatttctgtttgtaaagacttgaacttgtaacagatgagtgatatgcttactcaagttcactaaatcaagtgtctaggatcatgcattttgaagaaaggcaactccttatagagattctaaaagaatagagaaggtcaaaagaacatttgtttgagggagtggacattgtatatactaaaaagaatagcttctgtgaccaggcgcagaggctcatacctgtaatctgacactttgggaggttgaggagggcagawcacaaggtcaggagattgagaccatcctggccaacacagtgaaatcccaactctactaaaaatacaaaaaagttagctgggtgtagtggtgcatgcctataatcccagctactcgggaggctgaggcacaagaatcacttgaacctgggaggctgaggttgcagtgagcagagatcacgtcactgcactccagcctggcaacagactgagactccgtctcaaaaaaaaaaaaaaaaaaaaaaaggaatagcagctctgccatcttagcctattctagtctatcctagcctagcattctgc

SEQ ID NO: 44394 - DNA, 601 bp, Human
aggtcaaaagaacatttgtttgagggagtggacattgtatatactaaaaagaatagcttctgtgaccaggcgcagaggctcatacctgtaatctgacactttgggaggttgaggagggcagatcacaaggtcaggagattgagaccatcctggccaacacagtgaaatcccaactctactaaaaatacaaaaaagttagctgggtgtagtggtgcatgcctataatcccagctactcgggaggctgaggcacaagaatcacttgaacctgggaggctgaggttgcagtgagcagagatcamgtcactgcactccagcctggcaacagactgagactccgtctcaaaaaaaaaaaaaaaaaaaaaaaggaatagcagctctgccatcttagcctattctagtctatcctagcctagcattctgccagccccaaacccggaagtagtctggagaacattgcttttattaaatcactggttcatttttaaaaacctgctcccgatggttttgcattttctttgaatatcctgggtcatgatggtctatatctacatttggactttaacaataaataactgtggaatcttagactatttatcaag

SEQ ID NO: 44395 - DNA, 601 bp, Human
gaagaaaaacatcatatgaaaaattagtgacagtccgaaataattagctaccaatggccccaggactttatagcacatataatacgaaatattccctcccctacttttctgttgctacatggcagaaaactatgtgagtctgtatttatgactggttgaattgttttgatgaatattttatttaagtaattgctatgaccactgaattcaatgatatcactgttacatcgagatattaatctttatgccatgttttacagaaaattgtattattttccacatccagagtactctgactccmtttactactcattgttagagaattataatataaataaactctataaagagcaactattttctttattctattgatcttactcttattgaggtcaaaatagaatacagagacaaatctctaaatttaacattttatttgtgaatcacagaattgcaatttggggcacacatacagatcaggcagtcatcagcatgtctaaagaacaaagaaaatgttggggtatttattttaaagaaatgttacatatccttttgaaagaaatctctctggcactagaaaagcttttggaagctggcatat

SEQ ID NO: 44396 - DNA, 601 bp, Human
ccctttactactcattgttagagaattataatataaataaactctataaagagcaactattttctttattctattgatcttactcttattgaggtcaaaatagaatacagagacaaatctctaaatttaacattttatttgtgaatcacagaattgcaatttggggcacacatacagatcaggcagtcatcagcatgtctaaagaacaaagaaaatgttggggtatttattttaaagaaatgttacatatccttttgaaagaaatctctctggcactagaaaagcttttggaagctggcakatctctaactggtgagtgacagtggtaggtaaaactagtcttagttatagcaggtatttcagcagatactaagtgaaactgggcttcgggttacagcaggtagtttcagcagctgggcttgtggagaagtcaattcttggagcagtgctatgtgccctgggtgctttttttcctctggcctttagactttgatttaggtgagtatgacaagaatgacccaatttgtataatcagcattcaccctcttctccccttgtaattgcttcaatattcatgtcgataaaactgaaacatcttatc

SEQ ID NO: 44397 - DNA, 601 bp, Human
agatatagagcccttagtaacaagtatcaactgtagagttgttaaaccattttgctttactcagccctacttttcacctctgctcttccattcagtttccagggaccgagcatctcagcttctgctttcctgctggcttgttaagatactcagttttactccctccttcaactttgttctggttatgctatcttgatcacagcttcttgcttgtggtcagtgttcctgattatttattgagcaggacattggcttaactagctgtgcccctttggatgagtcactcaaccactttaagccrtacttttctcaaatctaaaatggtagaaagaatatctacctcaaagtggtgttgtaaaaatttaagtgagaatacaggaaatgactatgcccatttcccagcaaacatgtcttagtttctatccatttttccttagcagctagatgtgcagaagctttgctaaactattccttttgaacaggatttcttattggcacaggagccaataatttgattcgccaggccattcttaaatgttctatgggattttatagcttccatacaggggtaatagatccacaggtaatggggatggggaaa

SEQ ID NO: 44398 - DNA, 601 bp, Human
tctgctttcctgctggcttgttaagatactcagttttactccctccttcaactttgttctggttatgctatcttgatcacagcttcttgcttgtggtcagtgttcctgattatttattgagcaggacattggcttaactagctgtgcccctttggatgagtcactcaaccactttaagccatacttttctcaaatctaaaatggtagaaagaatatctacctcaaagtggtgttgtaaaaatttaagtgagaatacaggaaatgactatgcccatttcccagcaaacatgtcttagtttcyatccatttttccttagcagctagatgtgcagaagctttgctaaactattccttttgaacaggatttcttattggcacaggagccaataatttgattcgccaggccattcttaaatgttctatgggattttatagcttccatacaggggtaatagatccacaggtaatggggatggggaaagacaatggatggcaaacaattagaatcttcggtggagctggttcaaggtccagatgctctctttgtgtcctttgtacaaagctggcggaaatatataatttcttaagtgaataaatgcaa

SEQ ID NO: 44399 - DNA, 601 bp, Human
aaaaaagagatattagcatgaaataatgagataggcaacttggaaattctttctttgtaaacaatcatattgtacttatactttttcagatataaagcacttttgtaacttcagtaaataaaacattaataaaaccccaatgtcttgaccacagttacggaatcagttctgagttcttttttcctaagaacacattttactcttcgtgtagtcccttgtttctttcatatttgggttatgaaaatgtcatcactattttcaagcacaagttattatttcctcctgtgatactgtttgaacrctaggtctttgatgtttctgtcagatatacccagcaatcatcatcataactcatactcttgaatttttaatatcactccacacacagaagtgtcaagtacccagttctttagtgaatgcacaaaaaatgaaagaaaagtttgttaaataagaagaaagattgaaatactgaaatattcctcctgatttttgttttgatcccattgaaaataaatgggaaatacatgttgctatttttttcattgctctgtctcacagccactgtttgcatcagatttttaaaaaagaaaatgccaagcag

SEQ ID NO: 44400 - DNA, 601 bp, Human
aactccttccttatttcctcctttttatgcaaacattatcttaccagccttaatgggggagtcacaataagttcccctcagtactcagcacagggccatccatgcttgcggaaagaatgggctttgaatatacatcatgataaacattagtacattaaataagcaattactttctaagatgattttgtttttctacacaatttaactcattaatatagctcagttatctgttcaaattaacttaagatagctgtccaatcctgattctgatatttaatacaaaaacacttctttacagctggggggggtggctcacacctataatcccagcactttgggagaccaaggcaggggaatcacctgaggtcaggagtttaaggccagcctggccaagatggtgaaaccccgtctctactaacaatacaaaaaatcataataataaaataaaatagccaggtgtggtggcgggcacctataatccccgctattcaggaggctgaggcagataattgcttgaacccaggaggcagagatttcagtgagctgagatcacgccactgcactccagcctgggtggcagagtgagactctgtctgaaaac

SEQ ID NO: 44401 - DNA, 601 bp, Human
ttccttatttcctcctttttatgcaaacattatcttaccagccttaatgggggagtcacaataagttcccctcagtactcagcacagggccatccatgcttgcggaaagaatgggctttgaatatacatcatgataaacattagtacattaaataagcaattactttctaagatgattttgtttttctacacaatttaactcattaatatagctcagttatctgttcaaattaacttaagatagctgtccaatcctgattctgatatttaatacaaaaacacttctttacagctggggggkgtggctcacacctataatcccagcactttgggagaccaaggcaggggaatcacctgaggtcaggagtttaaggccagcctggccaagatggtgaaaccccgtctctactaacaatacaaaaaatcataataataaaataaaatagccaggtgtggtggcgggcacctataatccccgctattcaggaggctgaggcagataattgcttgaacccaggaggcagagatttcagtgagctgagatcacgccactgcactccagcctgggtggcagagtgagactctgtctgaaaacaaacaa

SEQ ID NO: 44402 - DNA, 601 bp, Human
atgatagattattggtttacaaagaccagtctgaatagaaaaggatggaaagcaaggtaaagtttgctgcagtctaaagctacaagtacacattgcttcagttcatgctgtgttccgacaatccatggaagtcctcagaacccaaatcactgaagctgtaagtagagtctagaatactaatggctctgggaggaaatatccaaagtcactgctgattcagctagagaaaatacactggagggaggagccaagatggccgaataggaacagctccggtctacagctcccagcatgagcaacrcagaagacgggtgatttctgcatttccatctgaggtaccgggttcatctcactagggagtgccagacagtgggcgcaggccagtgggtgcacgcaccgtgcgcgagccgaaacagggcgaggcattgcctcacctgggaagcgcaaggggtcagggagttccctttccgagtcaaagaaaggggtgacggacgcacctggaaaatcgggtcactcccacccgaatactgcgcttttctgattgacttaaaaaacggcgcaccacgagattatatcccacacctggctcggagggtcctac

SEQ ID NO: 44403 - DNA, 601 bp, Human
aaagctacaagtacacattgcttcagttcatgctgtgttccgacaatccatggaagtcctcagaacccaaatcactgaagctgtaagtagagtctagaatactaatggctctgggaggaaatatccaaagtcactgctgattcagctagagaaaatacactggagggaggagccaagatggccgaataggaacagctccggtctacagctcccagcatgagcaacgcagaagacgggtgatttctgcatttccatctgaggtaccgggttcatctcactagggagtgccagacagtgggcrcaggccagtgggtgcacgcaccgtgcgcgagccgaaacagggcgaggcattgcctcacctgggaagcgcaaggggtcagggagttccctttccgagtcaaagaaaggggtgacggacgcacctggaaaatcgggtcactcccacccgaatactgcgcttttctgattgacttaaaaaacggcgcaccacgagattatatcccacacctggctcggagggtcctacgcccatggaatctcgctgattgctagcacagcagtctgagatcaaactgcaaggtggcagcgaggctgggggagg

SEQ ID NO: 44404 - DNA, 601 bp, Human
ctagaatactaatggctctgggaggaaatatccaaagtcactgctgattcagctagagaaaatacactggagggaggagccaagatggccgaataggaacagctccggtctacagctcccagcatgagcaacgcagaagacgggtgatttctgcatttccatctgaggtaccgggttcatctcactagggagtgccagacagtgggcgcaggccagtgggtgcacgcaccgtgcgcgagccgaaacagggcgaggcattgcctcacctgggaagcgcaaggggtcagggagttccctttcygagtcaaagaaaggggtgacggacgcacctggaaaatcgggtcactcccacccgaatactgcgcttttctgattgacttaaaaaacggcgcaccacgagattatatcccacacctggctcggagggtcctacgcccatggaatctcgctgattgctagcacagcagtctgagatcaaactgcaaggtggcagcgaggctgggggagggcgcccgccattgcccaggcttgattaggtaaacaaagcagccaggaagctcaaactggtggagcccaccacagctcaaggagcctgcctgcc

SEQ ID NO: 44405 - DNA, 601 bp, Human
tacagaacactcaggcataggtaagggagaggcttcggacccacagccatctcctggagtacattgagatgtgcttgtacccttttggtcaactgctctcattaccattacattctccaagatgtgtatgaaactgaaatggcctcatgccttttatcccaaccatcccaaagctccattggagacttggggtctgtcagtcacttctatacctatccctgggggagcaggaatttcaaaatagtctcttgcgtctttagaggatatagtatgaacctgggttttaaatggaggtgctatsacacacaggtccattctcctaacattcctacacaaagattatggcaccaatttggggcatgaagaaattctttacaaacctttggactgccccttagggctgagggaacatggctcaggccatttccatcatcagatcttctcaaacatatgtggagttcccactgacctctcaaccctcccagcctcatcccttggattttatctagtggtatggagtacaacctggctaagtattgggaacctgaatcaggtatgaatctcatccttttctgaggcttctccttccccagcaggagca

SEQ ID NO: 44406 - DNA, 601 bp, Human
tatagaagtgctactgatttttttacattgattttgtggcctgaaactttattgaaattgtttatcagtttcagggcccttttgaaagattatttagggtgttctggatatagaagtgtatcatcagttaagagagataatttaacttcttcttttcctgtctgaatgatttttatttatttctcttgcctgattgctctgtctaggactttcagtaatatgttcaacagcagtggttaaagtgggcatccttgtattgttcctaccttagaaaaaaggctttcaatttttcgctgttcartttgatgtaagctgtgggtttgtcatctatggcctttatgttattggggtgtatttcttctataaccaatttgttgagaatatttattatgaaggtatgttgaattttattaagtgccttttcagcacgtattgaaattatcataaggtttttgtcctagattgtgttcatgtgattatgacatttactgatttgtgtatgttgatggctcaagcatgttggatgcaacatcctttcatccctgggataaatgctacttgatcatggtgaataatctttttaatgtgttgtttgaattga

SEQ ID NO: 44407 - DNA, 601 bp, Human
tttttgatgtaggcatttattgccataaactttcctcttgcactgattttgctgtatcccataggttcaggtgtgctatgttttaattttcatttgattcaagaaatttttaaatttccttcttacattcttcattgactcactggttgttcaggagcatgttgcttaatttccatgtatttgtacagtttccaaagttccttttgtaactcatttctagttttattcccttatgatcagaaaagatacttgatatgactgcaacattttaaaagttgttgagaattgtttgtggcctaasatatggtctatcctggcaaatgttctaagtgctgatgagaaatatgtgtatgctaaagtagttgaatgaaatattctgtaagtgtctgttaggtccatttggtagactatagtttaactttgatatttctttgttgattttctgtgtagacaatttataggttcctttcgatcttggactgttactaaaaagatgcactgagtataattatacataatttacttcatacttattcaaatacttttggagattaaatttccagaaatgaatttcgtaggtcaatggtgtttatctttataa

SEQ ID NO: 44408 - DNA, 601 bp, Human
atcagaaaagatacttgatatgactgcaacattttaaaagttgttgagaattgtttgtggcctaacatatggtctatcctggcaaatgttctaagtgctgatgagaaatatgtgtatgctaaagtagttgaatgaaatattctgtaagtgtctgttaggtccatttggtagactatagtttaactttgatatttctttgttgattttctgtgtagacaatttataggttcctttcgatcttggactgttactaaaaagatgcactgagtataattatacataatttacttcatacttattyaaatacttttggagattaaatttccagaaatgaatttcgtaggtcaatggtgtttatctttataactttggtagctattgctcatttattttcacagaggtgcatcacattatactctcaaagtaatacatgggagttagcccttacccacagtcacaccaatagagtacataatcagacttttgtatttttgtcaatctgagaggtgaacaatggtatcgcaatgtagttttaatttgtatttatattattagtaactggagagattttctttttaacttttaagaactacttgttttt

SEQ ID NO: 44409 - DNA, 601 bp, Human
ggtccaatcaacttccaccaggccccaccttcgacattgggaattacatttcaatatgagatttgggcagggacacaatccacattatatcaactgagatcatattaaatttgtgcatcaatttaaggataattgacattttcttaatattgaatattgttcaagtatttttattgttcaggaatgcaggtcttgaacacttttttggtaatatatctgtttgttgcaatttagatttcagatatttatttcttatattaattttccaccagactaccatactaaagtatctgaatatttrtatcaaataaaaaaattatgtaacttgaaagtacagtagtaataatttacatcttctttcctatttttatatctgccaaatcttggtattaacgaaaattacttcggtgttgctaaatcagagtttgactttcaggctgaggttgctgtatttcattacattaagtatctttctactattgttttctttagattttttaaaacttaagaataagaatgtcgtaaatgtctttacagggtttaaggagataatcttatttttcctttagctttattaataaaatgaattgtatattcataa

SEQ ID NO: 44410 - DNA, 601 bp, Human
gcaatcctaacctagtttaatattaatattataatagcatcacaaaaaatgataatatctcccatacctcttttttgatttggtttttgttttctatgcactgagctagtttaaatagcattggaattatctactaaaaagtattgatagaatttccccatgagattaccttcttttgtgagttttagatgtttaagtcttttctctatttctcctattaaaatctattagtttccattttgttccttgctgggattaggatgaataagtaatattctcccaaaaaattattcaattaatytagatttgtcaatttaagcaatgtctcttttatgatgtgcttatttttccctattttgtgaatatccttctgcatatgtttttcttttcatagctttaccttcttatgttttcttgatcaattggtattcctctccctcaccacaacaaacttgacttatgtatcagtgtaactgtcattttatgttttctaactattaatttcagcttttttctttgttaattgcataccgctgctttattttagatttgtttcatgtacttttataacactttttagtcttattattgatttatttgt

SEQ ID NO: 44411 - DNA, 601 bp, Human
aagaaaaatttaaaaccttaaatatcaaaataagtactaaataaaaaatgagtaaattactcaaaaaaaaagcaaatcatctcatgttgaaagactttttaaaaaagctttagaaatagaaaatatgacattaaatgacattgaattaagaccagacatatgtgtcaaagtaataaatatcaataggtttaattcacatattgaaagataaagtcatcagattgtactacgaagcaaagacactcaattaaaataaataactcagaaaaaaattgaataaaaggatgagcaaaagtataartagaaaatgtaaaataaagcaagatgcaatctttatatatgacaaaatggaattcagaccaaaaaaaaatgatgagggatacttttgtcaataattttaactttcttgatattcactttgtattcttagatttgattatacttgttttacctgatctatcatgtttaaattatggatagtgagtaaaactatgttaactcctctatttgtttagttgtttatttttacactttcacatatcatttcctatttactgttaccttaatctccacatttgttcagtctcagtcctataattaa

SEQ ID NO: 44412 - DNA, 601 bp, Human
atagaaaatatgacattaaatgacattgaattaagaccagacatatgtgtcaaagtaataaatatcaataggtttaattcacatattgaaagataaagtcatcagattgtactacgaagcaaagacactcaattaaaataaataactcagaaaaaaattgaataaaaggatgagcaaaagtataaatagaaaatgtaaaataaagcaagatgcaatctttatatatgacaaaatggaattcagaccaaaaaaaaatgatgagggatacttttgtcaataattttaactttcttgatattcmctttgtattcttagatttgattatacttgttttacctgatctatcatgtttaaattatggatagtgagtaaaactatgttaactcctctatttgtttagttgtttatttttacactttcacatatcatttcctatttactgttaccttaatctccacatttgttcagtctcagtcctataattaaatatattcgatagtcacaatatgtcattttgttatagtttcaccagtcatctcttggctgacttaagttctttttccagtaatgaagaattcatgggaaaaatattagctgaaca

SEQ ID NO: 44413 - DNA, 601 bp, Human
ttcacatattgaaagataaagtcatcagattgtactacgaagcaaagacactcaattaaaataaataactcagaaaaaaattgaataaaaggatgagcaaaagtataaatagaaaatgtaaaataaagcaagatgcaatctttatatatgacaaaatggaattcagaccaaaaaaaaatgatgagggatacttttgtcaataattttaactttcttgatattcactttgtattcttagatttgattatacttgttttacctgatctatcatgtttaaattatggatagtgagtaaaactaygttaactcctctatttgtttagttgtttatttttacactttcacatatcatttcctatttactgttaccttaatctccacatttgttcagtctcagtcctataattaaatatattcgatagtcacaatatgtcattttgttatagtttcaccagtcatctcttggctgacttaagttctttttccagtaatgaagaattcatgggaaaaatattagctgaacacttgcttgatcaataccagtaaaacttatacaatttgacttggtcaaacatagcattcatgtatcatgttttttttt

SEQ ID NO: 44414 - DNA, 601 bp, Human
tatacccagttcttttttcattgttcgtcactgaatgtgttgaattttcctagattagcaatttgggggaggtacctaagcaggaggctaggggagaaaggatacagtagcccttcagatttttcatttgctcactacttccatcccttaggggtcctgttgattctttctatggatgtgcctcctttttctgcaggatacataatgtaaccactgctctgaaaatggccctgctctcttgtattctatacccttaattgtatcaagggtgtagcttttggaattcaaattgggcaccttrtttttactttagataattttttttttaaactggaacttcagtagatattccatcgcttgagcttttaccattctgctctgacttttttcagttcctcctatgcagattccacccaatatcatcaatataggcagaagaaccattggggacaaaaagagaggattattaagtttctcataatgaattacttgaaacgagagaatatatattagaaataaggtttcaaaggtatgcctgggttggtacactatgaattttaataagttagaactgtatgatatttttaagtgatggatttta

SEQ ID NO: 44415 - DNA, 601 bp, Human
cacgctttagaaccggcaggattgaactccatgcaggccccacagcagactccaaccgggggtgcctgcgactctcagagccccagagggcacgttacagtgctcttttagctctgctgtccgcagtcccagtccttagtccgcattagtgttaatagctcagtggggcctctgacttttcacatgaggcggctgccttccaccagccagggtgaagagccagtgtgacagccagactcttctcgaagttacgaagttacgccaccaagctgtccctctgaagtcaagccacttctctcckatgcccagctgtatcctgtctactggctgagtctgggattaatataggcacaggatggggcggggtggggccatgagtggtttaggaaaaagcaacatttgagcgggaaaacagggatagaagttctcactttgggctgtggtttcaggcttttcagcttgagggtaggaattcctggggacctactcttttctgcctagattttctgtgcctgctgttccctatcactaatacacaaatcttggtgtacttcaaatagtgtaatccaaatagtgtaatccaatttagataaattggaag

SEQ ID NO: 44416 - DNA, 601 bp, Human
ctcactgatgtttctttactagaattagtctcatttatgtactgcattttataatatgcaatattatcatataaagcatataagatactattacaagataatatagcatattcctcactatacttttctattctatataaattttaaaacattttgtcatctcccaaaaaatagtgtcttggaatttttatttggacatcactaaaactaaaatatttagggataattgatcagaagcaacatgatatttctctttctaaattttttatatttttctctaaattgttttatagtctttttyatgtaatatatacacacacgtatgtgattttccctatatattttgtattttatgtctggcttattttacattcttttttttttttttttttttgagatggagtctcactctgtcacccaggttggagtgcagtggctccatctcggctcactgcaacctccccctctgggttcaagcgattctcctgcctcagcctcctggtagctgggactacaggtgtatgccaccacgcccgtctaatttttgtatttttagtagagacggtgtttcacccagttggtcaggctggtctcaaactcc

SEQ ID NO: 44417 - DNA, 601 bp, Human
tcaaaatatcatgtccagtcacagtggctcatacctgtaatcccagcagtttgggaagccaaggctgatgaatcacttgagctcaggaactcaagaccagcctggccaacatggtgaaaccctatctctactaaaaagacaaaaactagccgggcatggtggtgcatgcttgtagtctcagctacttgagaggctaaggcacaagaatcgcttgaacccaagaggcagaggtggcagtgagctgagatcacgccactgcactccagcctaggcagcagagcaagactccatccaaaaaaamccccaaaaacctaatgtttttatttatattttagattagtgggatggtttggccatgaactcagcaccagatttaagatggataacagtaagtgtatttattttacctaatgtcatttttattttaactttatttcaatgttcatctgtctttgtattatgtgtaatgtatatgccccagggagagtgcacttcaaaaatgtcactgagaattctcaaataagaaatgacatttccagagtgtaagactaagagtttatagattttagcatgattttgagtctatcccttagcagggaga

SEQ ID NO: 44418 - DNA, 601 bp, Human
ccttagcagggagataaaagaaaatgaagtccaaggtaagggtcatgtggcttggtcaggtgccatcaacatagagtgcctgaaacactgggcatggaggacaggaggaaatttggggcttggagtcagatccagaaagacctgggtgttaatcacactttgctgcttaatagttttttgatcctgcacaagttatatcatcttgtgtcattgttttttctttcccacttatctaatgtgaataataaaatctatttaaagatttggttttagggttagtcaagctcaaaacaataagccmagtaggacacagcagtaccttaataaatactcattttcactcctcttttttcctattttccttttgtggcttttgccatgtaccaaagagtgtagcaattcctgtgagcagttaaccccagcagatagaagtgaaactctaccatgcagagcttccttttcctgcatgacctcatttctcaatcacatgggatgcagaaagatcatacgtgctttgagagttcaacataaacttgatccttcagattgctttaaaccctgagatactgttttaaatttgttttcattttttattgacttt

SEQ ID NO: 44419 - DNA, 601 bp, Human
atttctcaatcacatgggatgcagaaagatcatacgtgctttgagagttcaacataaacttgatccttcagattgctttaaaccctgagatactgttttaaatttgttttcattttttattgactttatttttttgtttttgaaacaaggtcttgttctgtcacctaggccggagtacagtggtgcgatcaggctcagttcagccttgatattcctggctcaagcaatcttctcgccttagcttcctaagtagctgggactagaggtgtgcaccaccatgactggatgatgatgatgatgmtgattattattattattatttagtggagatgaggtcttgctatgttgtccaagctggcctgagataatattttatatatataggtgctctttgacttacaatggggttatttcctgataagcccatcataagctgaaaatatcataagtaaaaaatgcatttaatacacctaatctatagaacatcatagcttagcctagcctaccttaaaacacattcaaaacacttacatagcctagagttgggcaaaaccatctaacacaaatcctattttataataaagcattgaatatattatat

SEQ ID NO: 44420 - DNA, 601 bp, Human
ttctcaatcacatgggatgcagaaagatcatacgtgctttgagagttcaacataaacttgatccttcagattgctttaaaccctgagatactgttttaaatttgttttcattttttattgactttatttttttgtttttgaaacaaggtcttgttctgtcacctaggccggagtacagtggtgcgatcaggctcagttcagccttgatattcctggctcaagcaatcttctcgccttagcttcctaagtagctgggactagaggtgtgcaccaccatgactggatgatgatgatgatgctkattattattattattatttagtggagatgaggtcttgctatgttgtccaagctggcctgagataatattttatatatataggtgctctttgacttacaatggggttatttcctgataagcccatcataagctgaaaatatcataagtaaaaaatgcatttaatacacctaatctatagaacatcatagcttagcctagcctaccttaaaacacattcaaaacacttacatagcctagagttgggcaaaaccatctaacacaaatcctattttataataaagcattgaatatattatatga

SEQ ID NO: 44421 - DNA, 601 bp, Human
tgaaacaaggtcttgttctgtcacctaggccggagtacagtggtgcgatcaggctcagttcagccttgatattcctggctcaagcaatcttctcgccttagcttcctaagtagctgggactagaggtgtgcaccaccatgactggatgatgatgatgatgctgattattattattattatttagtggagatgaggtcttgctatgttgtccaagctggcctgagataatattttatatatataggtgctctttgacttacaatggggttatttcctgataagcccatcataagctgaaaatatcataagtaaaaaatgcatttaatacacctaatctatagaacatcatagcttagcctagcctaccttaaaacacattcaaaacacttacatagcctagagttgggcaaaaccatctaacacaaatcctattttataataaagcattgaatatattatatgatttattgaatactatactaaaagtggaaaacacaatgggcgtatgggtagtcgaagtatggcttctacttaagatgtactgcttttgtatcactgtaaaattgaacaattttaagtcaaaccattgttaagtcaggga

SEQ ID NO: 44422 - DNA, 601 bp, Human
aacaaggtcttgttctgtcacctaggccggagtacagtggtgcgatcaggctcagttcagccttgatattcctggctcaagcaatcttctcgccttagcttcctaagtagctgggactagaggtgtgcaccaccatgactggatgatgatgatgatgctgattattattattattatttagtggagatgaggtcttgctatgttgtccaagctggcctgagataatattttatatatataggtgctctttgacttacaatggggttatttcctgataagcccatcataagctgaaaatatcataagtaaaaaatgcatttaatacacctaatctatagaacatcatagcttagcctagcctaccttaaaacacattcaaaacacttacatagcctagagttgggcaaaaccatctaacacaaatcctattttataataaagcattgaatatattatatgatttattgaatactatactaaaagtggaaaacacaatgggcgtatgggtagtcgaagtatggcttctacttaagatgtactgcttttgtatcactgtaaaattgaacaattttaagtcaaaccattgttaagtcagggacca

SEQ ID NO: 44423 - DNA, 601 bp, Human
aaaattgaacaattttaagtcaaaccattgttaagtcagggaccattggtatgcagatttgtagcaaccaaattgcaaaatgggatattccagtcaagtcaggatacctgtattttaccttggctgctaaaataattagatctgttattataccagttatttaaattctttgagatgggttttcttatttggaaataaaggaattgaatttgatcaggggtagcaaactttttctgtgaaaggccagataggaaatattttaagctttctaggctatacagtctctgtggcaaatactcarttccgtcattgtggtggtaaagcagccataggtgatacataagtgaaagattgtggctatgttttcataaaactgtattttaaaaagcagggcctggcacgaagactcacgcctgtaatcccagcactttgggaggcaaggcagatggatcaattgatcacaggagtttgagaccagcctgggtgacatagtgagaccttgtctctataaaaactacagaaattagccaggagtggtggtatgcatctgtagtcccagctacttgggagcctgaggcgggaagatcacctgagcccgggg

SEQ ID NO: 44424 - DNA, 601 bp, Human
attttaattgactcacagtttcacatggctggggaagtctcaggaaacttacaatcatgtcagaaggcaaagggaaagcaaggcacatatgaggtgatgggaggtgagagagagagagaaagagagagagtgcataaaaactgctgtttttggccgggcgtggtggctcacgcctgtaatcccagcactttgggaggccaaggcgggcggatcacgaggtcaggagatcgagaccaccctggctaacactgtgaaaccccatctctactaaaaatacaaaaaaattagctgggcgtggtgrcaggcacccgtagtcccagctactcggaaagctgaggcaggagaatggcgtgaacccgtgaggcggaggtttcagtgagccaagattgcgccactgcattccagcctgggcaacagagcgagactccatctcaaaaacaaaaacaaaaaacaaaaacaaaaaaaaaaaaaactgctgtttttaaaaccatcagatcttgtgagaactccttcactatcatgagaacggcatgcaggaaactgcccccatgatccattcacctcccatcaggtcccaccctcgacatatggggattacaat

SEQ ID NO: 44425 - DNA, 601 bp, Human
tttggccgggcgtggtggctcacgcctgtaatcccagcactttgggaggccaaggcgggcggatcacgaggtcaggagatcgagaccaccctggctaacactgtgaaaccccatctctactaaaaatacaaaaaaattagctgggcgtggtgacaggcacccgtagtcccagctactcggaaagctgaggcaggagaatggcgtgaacccgtgaggcggaggtttcagtgagccaagattgcgccactgcattccagcctgggcaacagagcgagactccatctcaaaaacaaaaacaaamaacaaaaacaaaaaaaaaaaaaactgctgtttttaaaaccatcagatcttgtgagaactccttcactatcatgagaacggcatgcaggaaactgcccccatgatccattcacctcccatcaggtcccaccctcgacatatggggattacaattcaagatgagatttgggtggggactcagagccaaaccatatcaccatagtttgcttaatcctggatttgataactataaaaaagtcatcaagttttaacattcttttagtcagtcatagtgttaacttatctctgactagctatctta

SEQ ID NO: 44426 - DNA, 601 bp, Human
ggccgggcgtggtggctcacgcctgtaatcccagcactttgggaggccaaggcgggcggatcacgaggtcaggagatcgagaccaccctggctaacactgtgaaaccccatctctactaaaaatacaaaaaaattagctgggcgtggtgacaggcacccgtagtcccagctactcggaaagctgaggcaggagaatggcgtgaacccgtgaggcggaggtttcagtgagccaagattgcgccactgcattccagcctgggcaacagagcgagactccatctcaaaaacaaaaacaaaaaamaaaaacaaaaaaaaaaaaaactgctgtttttaaaaccatcagatcttgtgagaactccttcactatcatgagaacggcatgcaggaaactgcccccatgatccattcacctcccatcaggtcccaccctcgacatatggggattacaattcaagatgagatttgggtggggactcagagccaaaccatatcaccatagtttgcttaatcctggatttgataactataaaaaagtcatcaagttttaacattcttttagtcagtcatagtgttaacttatctctgactagctatcttaacc

SEQ ID NO: 44427 - DNA, 601 bp, Human
gcgtggtggctcacgcctgtaatcccagcactttgggaggccaaggcgggcggatcacgaggtcaggagatcgagaccaccctggctaacactgtgaaaccccatctctactaaaaatacaaaaaaattagctgggcgtggtgacaggcacccgtagtcccagctactcggaaagctgaggcaggagaatggcgtgaacccgtgaggcggaggtttcagtgagccaagattgcgccactgcattccagcctgggcaacagagcgagactccatctcaaaaacaaaaacaaaaaacaaaaacaaaaaaaaaaaaaactgctgtttttaaaaccatcagatcttgtgagaactccttcactatcatgagaacggcatgcaggaaactgcccccatgatccattcacctcccatcaggtcccaccctcgacatatggggattacaattcaagatgagatttgggtggggactcagagccaaaccatatcaccatagtttgcttaatcctggatttgataactataaaaaagtcatcaagttttaacattcttttagtcagtcatagtgttaacttatctctgactagctatcttaaccctattg

SEQ ID NO: 44428 - DNA, 601 bp, Human
tggctcacgcctgtaatcccagcactttgggaggccaaggcgggcggatcacgaggtcaggagatcgagaccaccctggctaacactgtgaaaccccatctctactaaaaatacaaaaaaattagctgggcgtggtgacaggcacccgtagtcccagctactcggaaagctgaggcaggagaatggcgtgaacccgtgaggcggaggtttcagtgagccaagattgcgccactgcattccagcctgggcaacagagcgagactccatctcaaaaacaaaaacaaaaaacaaaaacaaaaamaaaaaaaactgctgtttttaaaaccatcagatcttgtgagaactccttcactatcatgagaacggcatgcaggaaactgcccccatgatccattcacctcccatcaggtcccaccctcgacatatggggattacaattcaagatgagatttgggtggggactcagagccaaaccatatcaccatagtttgcttaatcctggatttgataactataaaaaagtcatcaagttttaacattcttttagtcagtcatagtgttaacttatctctgactagctatcttaaccctattgaattta

SEQ ID NO: 44429 - DNA, 601 bp, Human
attatcaccagaccaactcaaaattacaaagttttacaggtgtaagtgtgcattcatctgaagacataagtgattaacttcttttaatctacaactaaggtctgagtcctgaagaccttcctctggagcctcagtaaatttacttaatctaaatgggtccaggtgctggagtgattacccttatcttgtcttctgctaaatcactgaagtttgaggagttcctttagaccttcaataaacttgtttgtagaggcctggagagtttcttcacaaccacagtaaaacttgtttaatcctgaatgggtcctgttaagaattccttcattattctgtcatgctttaaggcccagggaaagcctaggcaaaactcttgataggcttttgttcatcccagcctttgtataagggcactgacttttttagtttttaatatttaatgtaaccactcggtcagtactgaaacagttgtgatggaggcctgcattagtgaaacctggcctgccacaggtacatgatattaacttacattttcttcctttgcaagttttatttaagtgacatttgtacaatttttctgtcatggaaattttaccttcagtat

SEQ ID NO: 44430 - DNA, 601 bp, Human; identical to SEQ ID NO: 35382

SEQ ID NO: 44431 - DNA, 601 bp, Human
aatgcattaatatataaaatatgtagatatattatttatatatttatctttagttattttcttttgtctgagtgatagttcagtaatggttacaactcgatatcaagtggacactattgtcacttgtaacttaatgccaagtggtaatcccttgaacctcttaagtataagtgttctagtgccccatgaatgagttgaactgtggctcatattaacacaaagataactaagagctctctaatgaaatgagatcactgattttttgtttttgttttttgtttgttttttgagatggagtctygctctgttgcccaggctagagtacagtggcatgatcttggctcactgcaacctctgcctcctgggttcaagcaattctccctgcctcagtctcccgagtagctgggattacaggaaactgccaccacacccgtctaatttttgtattttttagtagagaagggtttcaccatgttggccaggctagtctcgaactccttacctcaggtgatttgtctgcctcggcctcccaaagtgctgagattacaggcatgagccaccatgcccgacagagatcactaatttttaatgtcattatttg

SEQ ID NO: 44432 - DNA, 601 bp, Human
taatcattaaaatcattttactttattatcatctttcaccaagaaaatagaaaccaacaaagacagacaatgaagggaattgtcatgaacaataccatagagggtatttaagctaaaatactttattattggttatactttaagtccccaaaattataatagttatgaattgtctaaagaatgtcttattaattcatttaaccaagacagttatttcctgtgtgttttggatatgagtttcaggcaaccaacaggcaatgagactatcatttgatagtgtcacttgtgcttggacaagaaragaaggcctacaagaaaaagtaattaaaaacaatctctatcatggccaagttaattgaccttttaatataaagttaattgaatttctaatgcaaatttatccagatgcttataagctatctagagaaaggaacgtttggcctgcacagtgagtccttacataaaggtgcacatggaagctaatacagagaacttaacaaaataaagggaacaactcttggagttcttctgactgagccctaataatgtattaataacaaactccaccttggggagaatgtgggtgccctttaaggtcact

SEQ ID NO: 44433 - DNA, 601 bp, Human
cttgtcaggaatcttctgtctttcatattgcagttcacaatcagattgttctttctctggctgcaaacccacacctgaaattatttttcatctccaagcacggagttatatgagcaatcgctcttcctagaaaccattttttttctgcctgatattctagtagagggaacaaaaatgataataatcttaatgcaacatgtaatagaattaaatttttcctgctgataatatatattttgatatgagaaaagaagcagggataggctgaaatcgaatggcaggagatatggccacagtcttyaatcccctattttcttgacctgcagattgtctcattcggggaagctccagggttctcaagcggaattcgtgtttcattttgtgtagcacccgtcagaaagacaagccaggcatgaggatccatgatgagcgctcttctgagttgccatttggagctgcccgtttagaaagcaaatctgcatttccctcattcctagtttccttcatcctcttttaagtgtcatcttttccatgaagcctactagatcacacagttgaaaattgcaaagtcttcacaccgcagcttcccctttctttgttg

SEQ ID NO: 44434 - DNA, 601 bp, Human
ccaaggggtatatcctccacatcctccacaaagtatttcctgctcttcttcttggactcagcctcccctgtcctcactacagtcactaactctgcttttgtattttcactgtttgccctgaagaattccattataccattgttgtaatttattgcacttaatgtgttttatgtttccgattaccaatctgtacatttttattctcctattgtatatttttatacaatatacatatagtgtatacaatatatattgtagggaacaaaaaaaaattccccctcaaccctcatgaattcttagytgggatgggtccctataacaaaagatagattaataagagggaaacaaacacgtttattaacgtgcagtgctcatcatacaggatacactccaaggaaaagtaactcgaagtagtggtttggaactctggctcatagagcatcttcaacaaaaaacaataaatttgtggggaaatgacaggacaaaggaaaattattttaggcttccaagggagggaaactgtgggaaggtaaatatatgggtggaaaatatgagtaagtttgtttgcagattcctctggtgctgtctctgggacggtaag

SEQ ID NO: 44435 - DNA, 601 bp, Human
catcctccacaaagtatttcctgctcttcttcttggactcagcctcccctgtcctcactacagtcactaactctgcttttgtattttcactgtttgccctgaagaattccattataccattgttgtaatttattgcacttaatgtgttttatgtttccgattaccaatctgtacatttttattctcctattgtatatttttatacaatatacatatagtgtatacaatatatattgtagggaacaaaaaaaaattccccctcaaccctcatgaattcttagctgggatgggtccctataasaaaagatagattaataagagggaaacaaacacgtttattaacgtgcagtgctcatcatacaggatacactccaaggaaaagtaactcgaagtagtggtttggaactctggctcatagagcatcttcaacaaaaaacaataaatttgtggggaaatgacaggacaaaggaaaattattttaggcttccaagggagggaaactgtgggaaggtaaatatatgggtggaaaatatgagtaagtttgtttgcagattcctctggtgctgtctctgggacggtaagagtttagagttgtctccag

SEQ ID NO: 44436 - DNA, 601 bp, Human
gcttgaccttcatccattttatagtcactagaagattttaagcagggaagtgataggtttgcttagcagggtttaaaatggttatcatggtaagtgctttgaggaatacaagaccagaggtaggctgaccttttaggatattattgcagtattccaaatgtgaataatcttgacctgaataagagcacagctagtagggacagaattgagaaagtaaacttcttgatggccaggaaaggaagataaaggaagaagaaactttgagtgatgatggatagcaaacagcatgggtgaatgtttmaagaaaagataatactttaaaactaaatgttaaatggttaaacaagactataatatgacagatctgaactattgacccccctttttttaaacaggcaagaggattatatacatctttttgttggccggacgtggttactcacgcctgtaatcccagcactttgggaggccaaggtaggcagatcacttgaggtcaagagttcgagaccagcctggccaatatggtgaaaccccgtctctactaaaaatatgaaaattagcctggcatggtggtacgtgtctgtaatcccagctacttggg

SEQ ID NO: 44437 - DNA, 601 bp, Human
acccctctttgggtttgattaatttactaaagtggttcacagaactcagggaaactggcttaatttgctggtttatgataaaggatgttacaaaggctacagatgaagagatgcatagggtaaggtatgagagaaggtacacagagctttcatgctctgcctggatatgccacctgccaggatcctacacatgttcactatctggaagctcttcaaatcctgttctcttgggccttttatgaaaacttcattggataggcatgactgaagcatggacaaccatgtagtaatgtgattggaygaaaaggttataatctaatgctgataggctgagtgggaaaacccagtgaggcctatctgttcagattcttcttgatctctctgtgcagcattaattcctctaggatatgggacaggacctcctctgaaatgaggtcttatgaccctcaatcacaaaggtggaaacatgttatagtcctgccttgtataggtgaaaggttttctgaggtctgctcctgaggccaaaagcaccataaaattataataaaagactattaacaagggctatgggaatcataagccaggagccatagataaaaac

SEQ ID NO: 44438 - DNA, 601 bp, Human
tttcaaggatataagagaggatgcaatcaaatggaaaaacattccatcctcatggataagaagaatcaatattatgaaaatgaccatactgcccaaattgatttatagattcaatgctattcccatcaaactaccatcgacattcttcacagaattagaaaaagttattttaaatttcatatgtaatcaaagaagaccacatatagccaagacaatcctaagcaaaaggaacaaagctggaggcatcatgccacctgacttcaaactatactaaaagtctacagtaaccaaaacagcatgrtactggtaccaaaacagatatatagaccaatggaacagaacagagacctcagaaataacaccacacacctacaaccatctgatcttcaacaaacctgacaaaaacaagcaacggggaaaggatctcctattcagtaaatggtgctgggaaaactggctagccatatgcagaaaactgaaactcgaccccttccttacaccttataacaaaaattaacccaagatggattaaagacttaaatgtaaaacccaaaaccataaaaaccctagaagacaacctaggcaataccattcaggacat

SEQ ID NO: 44439 - DNA, 601 bp, Human
gaataaacattgtagatttagacaaatgtgacttaaacttcaggtatatcaatatcccttgaatgtcaacatactcaaatcacctaatccagttgggaatattaataatatcatggaacttgctgtcaggattaatgagatgttccaggtaaaaagcctagcacagtgtttggcaaatagtaggtggccaataataaatggcagctatagtcatcagtgaagaaatacatgatttcaagtaggtagggctggctgtgaagaaaattgtcacataagtgacttcatactctatttcagcttycttcccactctccctccttccctccacacacaccatgtacgccatctcctattgtcagtacttgggactctcatatgcacctggaccactgtcttttcccagtctagcatcttctgttcctggtttatcttcctcatctctttccttccagacctcccagtcttatgacctctgcttttgcttcctgctatgtgcagccttggaaagtttctgctaatgtcatttatgccaaatgttaaagactaacatcattttcctatgctaatcttgccaggaggtatttccattttagtgaaggtc

SEQ ID NO: 44440 - DNA, 601 bp, Human
ttgtcccctgtacctgcaatccctcacttccccacagtttctgggctaactcccacttaccctgggagtgacagagttcatgagtgatcttcccccatgaagcatcatcactctggcatcatctctcgtcctctccccatatgttctcttccctcttcctaccttgattcaactgagccagggctatttctgtgtctgtgaacaggtaatagtgtttatgagggcagatatctgacatgtttttcttctttattttacctgacatatgcttgtaccctttatttaatctgacattttttttgtactcttctggcctagcctactctgccagttctgaggtgcatttttttttcgtattttaatacctctgatattgttatgctctccagttgataaaatcttaaaattataattgacagtggcttttttctaacttggtgaaacaaaaataagggttaatttccttctacaatcaacagcatctttgatttgatgaaatatagtgatagatgttaaagatcatgtaaacgaatggatggcactcacagccctccttgagtcacattactatgcctacttagaacctagctgccctgcatca

SEQ ID NO: 44441 - DNA, 601 bp, Human
cactctggcatcatctctcgtcctctccccatatgttctcttccctcttcctaccttgattcaactgagccagggctatttctgtgtctgtgaacaggtaatagtgtttatgagggcagatatctgacatgtttttcttctttattttacctgacatatgcttgtaccctttatttaatctgacattttttttgtactcttctggcctagcctactctgccagttctgaggtgcatttttttttcgtattttaatacctctgatattgttatgctctccagttgataaaatcttaaaattwtaattgacagtggcttttttctaacttggtgaaacaaaaataagggttaatttccttctacaatcaacagcatctttgatttgatgaaatatagtgatagatgttaaagatcatgtaaacgaatggatggcactcacagccctccttgagtcacattactatgcctacttagaacctagctgccctgcatcatggcagggcagcagttgaacattattctttatttatgttaggctttcctagtaaaggtagggcagataataaatcagctaaaattgtttttaatcatttcttgctgga

SEQ ID NO: 44442 - DNA, 601 bp, Human; identical to SEQ ID NO: 35383

SEQ ID NO: 44443 - DNA, 601 bp, Human; identical to SEQ ID NO: 35384

SEQ ID NO: 44444 - DNA, 601 bp, Human; identical to SEQ ID NO: 35385

SEQ ID NO: 44445 - DNA, 601 bp, Human; identical to SEQ ID NO: 35386

SEQ ID NO: 44446 - DNA, 601 bp, Human; identical to SEQ ID NO: 35387

SEQ ID NO: 44447 - DNA, 601 bp, Human; identical to SEQ ID NO: 35388

SEQ ID NO: 44448 - DNA, 601 bp, Human; identical to SEQ ID NO: 35389

SEQ ID NO: 44449 - DNA, 601 bp, Human; identical to SEQ ID NO: 35390

SEQ ID NO: 44450 - DNA, 601 bp, Human; identical to SEQ ID NO: 35391

SEQ ID NO: 44451 - DNA, 601 bp, Human; identical to SEQ ID NO: 35392

SEQ ID NO: 44452 - DNA, 601 bp, Human; identical to SEQ ID NO: 35393

SEQ ID NO: 44453 - DNA, 601 bp, Human; identical to SEQ ID NO: 35394

SEQ ID NO: 44454 - DNA, 601 bp, Human; identical to SEQ ID NO: 35395

SEQ ID NO: 44455 - DNA, 601 bp, Human; identical to SEQ ID NO: 35396

SEQ ID NO: 44456 - DNA, 601 bp, Human; identical to SEQ ID NO: 35397

SEQ ID NO: 44457 - DNA, 601 bp, Human; identical to SEQ ID NO: 35398

SEQ ID NO: 44458 - DNA, 601 bp, Human; identical to SEQ ID NO: 35399

SEQ ID NO: 44459 - DNA, 601 bp, Human; identical to SEQ ID NO: 35400

SEQ ID NO: 44460 - DNA, 601 bp, Human; identical to SEQ ID NO: 35401

SEQ ID NO: 44461 - DNA, 601 bp, Human; identical to SEQ ID NO: 35402

SEQ ID NO: 44462 - DNA, 601 bp, Human; identical to SEQ ID NO: 35403

SEQ ID NO: 44463 - DNA, 601 bp, Human; identical to SEQ ID NO: 35404

SEQ ID NO: 44464 - DNA, 601 bp, Human; identical to SEQ ID NO: 35405

SEQ ID NO: 44465 - DNA, 601 bp, Human; identical to SEQ ID NO: 35406

SEQ ID NO: 44466 - DNA, 601 bp, Human; identical to SEQ ID NO: 35407

SEQ ID NO: 44467 - DNA, 601 bp, Human; identical to SEQ ID NO: 35408

SEQ ID NO: 44468 - DNA, 601 bp, Human; identical to SEQ ID NO: 35409

SEQ ID NO: 44469 - DNA, 601 bp, Human; identical to SEQ ID NO: 35410

SEQ ID NO: 44470 - DNA, 601 bp, Human; identical to SEQ ID NO: 35411

SEQ ID NO: 44471 - DNA, 601 bp, Human; identical to SEQ ID NO: 35412

SEQ ID NO: 44472 - DNA, 601 bp, Human; identical to SEQ ID NO: 20699

SEQ ID NO: 44473 - DNA, 601 bp, Human; identical to SEQ ID NO: 20700

SEQ ID NO: 44474 - DNA, 601 bp, Human; identical to SEQ ID NO: 20701

SEQ ID NO: 44475 - DNA, 601 bp, Human; identical to SEQ ID NO: 20702

SEQ ID NO: 44476 - DNA, 601 bp, Human; identical to SEQ ID NO: 20703

SEQ ID NO: 44477 - DNA, 601 bp, Human; identical to SEQ ID NO: 20704

SEQ ID NO: 44478 - DNA, 601 bp, Human
agctttttgtagagaatgggtctcgctttattgcttaggctggtcttgaactcttggcttcaagcaatcttcctgcctctgccttccaaagtcctaggattacaggcataagtcactgtcccaggcctgagcagcctctttgtaagcccagataagcagcctctgcccagactgacctgccctaagtcactatcctgacttctgaagatcatgtgtctccaaccatttccacctaaaccactggctactcccaaatccccagccctttgtcccaggcagcagtgacgggacatcaaccagragccattcctgcttccccaccctctgtcccctagagcccagtgatctacctgcgcatagttcatggtccccaccccccaccctccagagcccagtgatctacctgggcatagttcatggtctccatggtgctgtcataggcagagcggagagaggcaaagttgatgagcacatctacctccgggtgcttcctcatggcatcagccatgttcttgaagacagggatcaggatctctttgtgcccccagtaaaacttctgcttgtggtccccactgtgagaaagtaaaagaagaattaggat

SEQ ID NO: 44479 - DNA, 601 bp, Human
ttaattttttaaagacagggtcttgctctgccacccacgctggagtgccatggaatgatcatagctaactgcagccttgaactcctgggtgatcaattgatcctcctgcctcagcttcctgagtagctgggactacaggtgtgagtcaccatgcctggcttgactaatttttaagctttttgtagagaatgggtctcgctttattgcttaggctggtcttgaactcttggcttcaagcaatcttcctgcctctgccttccaaagtcctaggattacaggcataagtcactgtcccaggccygagcagcctctttgtaagcccagataagcagcctctgcccagactgacctgccctaagtcactatcctgacttctgaagatcatgtgtctccaaccatttccacctaaaccactggctactcccaaatccccagccctttgtcccaggcagcagtgacgggacatcaaccaggagccattcctgcttccccaccctctgtcccctagagcccagtgatctacctgcgcatagttcatggtccccaccccccaccctccagagcccagtgatctacctgggcatagttcatggtctccatg

SEQ ID NO: 44480 - DNA, 601 bp, Human
gtgagccgagattgcaccattgcactccagcctgggcaaaaagagtgaaactctgtctcaaaaaaaaaaaattttttttaattaaaataggccaggtgcagtggctcactcctgtaatcccagcactttgggaggccaaggtgagtggatcacttaaggccaggagttcgagaccagtctggccaacatggtgaaaccccatctgtacaaaaaaaaaaaaaaaaaaaaaaagccaggtgtggtggcatgtgcttgtaatcccagctactcagaaggctgaggcacgagaatcacttgagcytgggaagtggaggctgtgtgacagagtgaggccctgtctcaaaaaaaaaaaataaataaatacaaacatacataaaataaagtgctttaatcctgatttgtttttttgtttgtttttgagacaggatctgggacttactctgctgcccaggctggagtgcaatggcatgataacagcacactgcaacctcaacctcctgagcttaagcgatcctcctaccttagcctccctactagctgggactagtgagtgccatcatgcctggctaatccttttttaagtacagacaaggtcttgctg

SEQ ID NO: 44481 - DNA, 601 bp, Human
gaccctccgagtcttgtcaccatccccacaggacagggtcagcgtttaagagaaatgagctgcttctacactcagcccagaggcggggtgggaggggcatgggacagatccaggaatcacttctctttggctctaaaccagggccagcaaacttctgtaaagggtcaagatagtattgtaggggccaggtagagtggctcatgcctgtaatcccagcactttgggagtctaaggcaggtggatcccttgagcccaagagttcaaggccagcctgggcaacacagggagacccggtaggagratcaattgaacccaggaggttgaggctacagtgagttgcatgattgcatcactgcactccagcctgggctacagagcagtatgtgtgtctctttaaaaccaaacaaaaacccctggctgtgcgcggtggctcacatctataatcccagcaatctgcaaggccaaggtgggcagatcatttgagattgggagtttgagaccagcctgaccaacatggagaaaacccatctctcctaaaaatacaaaattagccaggcatagtgatgcatgcctgtaatcccagctacttgggaggctgagg

SEQ ID NO: 44482 - DNA, 601 bp, Human
tatggtggtgcgcgcctataatcccagctactagggaggctgaggcaggagaactgcttgagcccgggaggtggaggttgcagtgagctgagacggcaccactgcactccagcctgggtgacagagcgagactccatctcaaaaacaaaaacaaaacaaaacgaaaaaacaaaaccaatatgcatctcattcttcccacaggcctctgctcgtaatcactctaaccatctcctgaaaacacaagtggtggatagccgaaactgatctccactagctaacaccacagtgatccacccaagaraggcaggtatttcggaagccctgctacagtcatagcagctacgttcactctcacccaaaagctcacaccctcctgttgtctacctgttcctgtgcctgctcataaagcagctatctaaggcttttcttcatgggaccctccgagtcttgtcaccatccccacaggacagggtcagcgtttaagagaaatgagctgcttctacactcagcccagaggcggggtgggaggggcatgggacagatccaggaatcacttctctttggctctaaaccagggccagcaaacttctgtaaagggtca

SEQ ID NO: 44483 - DNA, 601 bp, Human; identical to SEQ ID NO: 20705

SEQ ID NO: 44484 - DNA, 601 bp, Human; identical to SEQ ID NO: 20706

SEQ ID NO: 44485 - DNA, 601 bp, Human; identical to SEQ ID NO: 20707

SEQ ID NO: 44486 - DNA, 601 bp, Human
tagctcagaagcttagcagacagcagaagcccaaggagtgtttatattcaacaccatcaggtgcgccagacactttcaagtacattttatcattttaacacatcaagaacaaacctttccttctaccacctctccccacacaaaacatctcaccaagccccgcccagctgagcccaggctgtgtccttctccctccttggcctccctttcatcagcaaagcccttctcatcccctaaactacagttcaaacatcaccttctcagggatgccatctcaacttctccagacagctggttgctrcctacgccaagtagggactcagagcctgactgtagctttaatctgcttataaattggtctcctccaactggatataagctcccagagagcagggccctggctggactttgtagtaaccaagcaagtaacaaacgtttcttgaaggaactagctgcgaattaataagatgattacctggttcgcctcaaatgccccctcttgcaatccccactcccagcccagaagtgacccatctcagccatacctcagaggagaacatggtggcacacgtcccgatgcaccagcagacgatgggcttag

SEQ ID NO: 44487 - DNA, 601 bp, Human
tgggggagagcactcaagaagaaagagaatcggctgggtgcggtaactcacggctgtaatcccagcactttgggaggccgaggcaggtggatcacctgaggtcaggacttcgagactagcctggccaacatggtgaaaccctgtctttactaaaaatacaaaaattagccgggcgtggtggctgttatcccagctacttgggagactgaagtaggagaattgcttaaaccagggaggcagaggctgcggtgagctgagatcgcaccactgcactccagcctaggcgagagactccgtctcaaaaaaaaaaaaaaaaaaaaaaaaggagaatcaggaacagcttcatggaataagcggactgacaaggcatgggaaaaaaaagaagtttctaagacctatgcacgccagacctttacaattacttcctcatttaagtcatacaacaaccttgcggcatggcatcctcattttacagctcaggaaacagttaccaagaggctaaatgacttgcccaggtctaccaagatctgattttaaagatctgatctcagctcactgcatcctccgcctcccaggttcaagcaattctcctgcctcagcc

SEQ ID NO: 44488 - DNA, 601 bp, Human
gagaggccgagatgggtggatcatgaggtcaggagactgagaccatcctagctaacggtgaaaccccatctctactaaaagaatacaaaaaaaattagccgagtgtggtggtgggcgtctgtaatcccaactacttgggaggctgaaacagcagaatggcgtgaaccccggaggtggagcttgcagtgagccgagactgcaccactgcactccagcctgggcgacagagcgagactccgtctcaaaaaaaaaaaaacacaaaaacctaaaataattcaaggacccaccccacccatggggygatgagtgccaccagatactgaaatgcgaggtgctcaccctcttagaagtgtcctgatcatggtggggatggggaggtggggtggaaagggggaggggctggtaatgcaaagcaagccaggagaaacaatggaggagggtgactggtttttggctgttgggcgagtacagagttggggggagagcaatggagttgggggagagcactcaagaagaaagagaatcggctgggtgcggtaactcacggctgtaatcccagcactttgggaggccgaggcaggtggatcacctgaggtcagga

SEQ ID NO: 44489 - DNA, 601 bp, Human
aggtccacttactggatgatctctccaagctcatcaaagctccggggcacaaacactcctgcttccttcaaagcctggttcttggctactgcagtttcagaagcctggttggcacaagctccagcatggccaaactggacctggaaagcaaaggaaagtagctttactgctaatcccccaagagtgaacatagaatcccatgtaaagtgtgctaaacactttacatgaatcacttcatttaagcctcaagcaagctcactgaataggtacaatagatgatttccattttacagacaaggawaccaaagcacagagaagttcaggagcttcctcagggtcacgcagctaaggtgcatggaagtcaggatacaaagactggcagcccaactccagaatcaccttcctctgcctcctgggttccagcgattctcctgcctcagccacccgagtagctaggattacaggtgcctgccaccacgcccagctaatttttgtatttttagtagagatggggtttcactatgttggccaggctggtctcgaactcctaacctcaggtgatccaccagcctcggccttgcaaagtgctgggattacaggt

SEQ ID NO: 44490 - DNA, 601 bp, Human; identical to SEQ ID NO: 20708

SEQ ID NO: 44491 - DNA, 601 bp, Human; identical to SEQ ID NO: 20709

SEQ ID NO: 44492 - DNA, 601 bp, Human; identical to SEQ ID NO: 20710

SEQ ID NO: 44493 - DNA, 601 bp, Human; identical to SEQ ID NO: 20711

SEQ ID NO: 44494 - DNA, 601 bp, Human; identical to SEQ ID NO: 20712

SEQ ID NO: 44495 - DNA, 601 bp, Human; identical to SEQ ID NO: 20713

SEQ ID NO: 44496 - DNA, 601 bp, Human; identical to SEQ ID NO: 20714

SEQ ID NO: 44497 - DNA, 601 bp, Human; identical to SEQ ID NO: 20715

SEQ ID NO: 44498 - DNA, 601 bp, Human; identical to SEQ ID NO: 20716

SEQ ID NO: 44499 - DNA, 601 bp, Human; identical to SEQ ID NO: 20717

SEQ ID NO: 44500 - DNA, 601 bp, Human; identical to SEQ ID NO: 20718

SEQ ID NO: 44501 - DNA, 601 bp, Human; identical to SEQ ID NO: 20719

SEQ ID NO: 44502 - DNA, 601 bp, Human; identical to SEQ ID NO: 20720

SEQ ID NO: 44503 - DNA, 601 bp, Human; identical to SEQ ID NO: 20721

SEQ ID NO: 44504 - DNA, 601 bp, Human; identical to SEQ ID NO: 20722

SEQ ID NO: 44505 - DNA, 601 bp, Human; identical to SEQ ID NO: 20723

SEQ ID NO: 44506 - DNA, 601 bp, Human; identical to SEQ ID NO: 20724

SEQ ID NO: 44507 - DNA, 601 bp, Human; identical to SEQ ID NO: 20725

SEQ ID NO: 44508 - DNA, 601 bp, Human; identical to SEQ ID NO: 20726

SEQ ID NO: 44509 - DNA, 601 bp, Human; identical to SEQ ID NO: 20727

SEQ ID NO: 44510 - DNA, 601 bp, Human
aggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcwgcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacct

SEQ ID NO: 44511 - DNA, 601 bp, Human
cgaatccatacatgtctggtgtggtttgatagctgggcttgaaaaagtgcttccagttgaaattagcattagaaatcggttagaacaccaacatttcagggtgagggaggactgctacaaaggaaaagaacatgtctacaaatgcactgaaagaactagccagaatatgaattccattagtatctaagacacacaaaatgtcatttacaaataagtcacggcaagtgtcacaacctgaaatctcaactcagacagatggtagagatgttaacagttgcctgaaacttcgatgtgctttcaygcccacaggaaaggtaaaactgacatttgtgtttctcttcaacaatttcatgatcaataaagaattgcagttggagactaaagcaaattctagaaactccttaactccaagttgccctatggtttttatgattgcatgttatcagaatgaggcgctctgttccacactttattcaaaagccttttacgctcccacaaggccttctggaattccagaatcagccctgcacacaggcagaaaaacagcttcatcttacaggttgtgtgagaacacccaataaactagggacttttttgggaa

SEQ ID NO: 44512 - DNA, 601 bp, Human
ttattgggcaacccgaatccatacatgtctggtgtggtttgatagctgggcttgaaaaagtgcttccagttgaaattagcattagaaatcggttagaacaccaacatttcagggtgagggaggactgctacaaaggaaaagaacatgtctacaaatgcactgaaagaactagccagaatatgaattccattagtatctaagacacacaaaatgtcatttacaaataagtcacggcaagtgtcacaacctgaaatctcaactcagacagatggtagagatgttaacagttgcctgaaacttygatgtgctttcacgcccacaggaaaggtaaaactgacatttgtgtttctcttcaacaatttcatgatcaataaagaattgcagttggagactaaagcaaattctagaaactccttaactccaagttgccctatggtttttatgattgcatgttatcagaatgaggcgctctgttccacactttattcaaaagccttttacgctcccacaaggccttctggaattccagaatcagccctgcacacaggcagaaaaacagcttcatcttacaggttgtgtgagaacacccaataaactaggg

SEQ ID NO: 44513 - DNA, 601 bp, Human
tctgcacagtttaagtacattttttttttctgtaccttgaagtaagcagaatagttcaagctttcaaaactggtgatgctgtatgcgtgagggatgcttacataatagcaacgctttattgggcaacccgaatccatacatgtctggtgtggtttgatagctgggcttgaaaaagtgcttccagttgaaattagcattagaaatcggttagaacaccaacatttcagggtgagggaggactgctacaaaggaaaagaacatgtctacaaatgcactgaaagaactagccagaatatgaatwccattagtatctaagacacacaaaatgtcatttacaaataagtcacggcaagtgtcacaacctgaaatctcaactcagacagatggtagagatgttaacagttgcctgaaacttcgatgtgctttcacgcccacaggaaaggtaaaactgacatttgtgtttctcttcaacaatttcatgatcaataaagaattgcagttggagactaaagcaaattctagaaactccttaactccaagttgccctatggtttttatgattgcatgttatcagaatgaggcgctctgttccacactttat

SEQ ID NO: 44514 - DNA, 601 bp, Human
ttcccatgatttacaaatgtatcgcttatacagaggaagttgcaaaatcactgccagtacagacacatccagtctaattaactatcgtctattcatacaacagcaacaactgcagctcctgagaccacagaaggacacagtgagcagctggtgactgagccagggtagcctccgatcaataactgatcagagtaatgagacttcgagaggaatgcctataagaaatctcaaaaggtatttgtttgggtgcagaaacaaatgcaccctccacatttggattttctctagaagaatctgtggycaaatctcttatccaatggaggtactgagtggctggatcagttaccatgcaagctcacgatgaatgagattgaatttggttctgtgtgcacactgggctctggggagggaggacacccctgtgtgttgctgctgccttccgtgctgtctactgtatccttcatgtgtctccaaatggtacacgccccatgggattacagaacacagctacagaattaggatctcatggtaacaatgaggaattaggttactgtagaactaaaatatgtttaatgaaattaaaatgcaatggaaaaaaaat

SEQ ID NO: 44515 - DNA, 601 bp, Human
agaacaccgaactgtcaggggagagaagacagtaaaatgtctctgtgtagtaaaagcagatgagtgagcaactgtgaccttcccacacagaagcacaggtcaggtgagagaagacagtaaaatgtctctgtgtagtaaaagcagatgagtgagcaactgtgaccttcccacacagaagggcaggagctcgggtgctcacacttacctgccagctgtgtcaccaggccacaaaaatgccggcaacacagcacactgacgtggtgggggcaaccaaaccaaaaacgacaaattaaagaagttygcatgcaattagtacactgtccttggtctgttaaactgtttaatgaatgcataaaaaggcagaaaaatatataaagccaaaagctcataataaaattaaatcatgatacaaccaccacaggcaattaccatcaaatacattcccatgatttacaaatgtatcgcttatacagaggaagttgcaaaatcactgccagtacagacacatccagtctaattaactatcgtctattcatacaacagcaacaactgcagctcctgagaccacagaaggacacagtgagcagctggtgactgagcc

SEQ ID NO: 44516 - DNA, 601 bp, Human
tttttatcaaaggaaaatcaacgatgagagaaatgaatgctttaaaatgcaaatgagtttaaagggaggagatgagttaagacgagggtctgatgggacatgaaaggcaggaccgcatccaagccaatcacttatctttactcttgtttctaatttctcaaagaccccaagtttcagcttcatctcatacactcattatcatctttcagagagccagcaccatcccctcatttcagtgtctcgaggttcccatgacccccgttgtgtgtgagctcccggggggccctgtgggcactggcayccatgtgcacgttcattcaggagatgctggtggggcgggctgtgtccatgacagcacctgccagtgggatctgctcagcgtccaccctccctaacatttgcgggatgatgctttgagagaaacacaagaaacttcaggcagaatcagaatagtcaccatagaaagaccagaacaccgaactgtcaggggagagaagacagtaaaatgtctctgtgtagtaaaagcagatgagtgagcaactgtgaccttcccacacagaagcacaggtcaggtgagagaagacagtaaaatgtctctgtg

SEQ ID NO: 44517 - DNA, 601 bp, Human
aattcatgatattaaaggtaagtaaattgagtattcactttagaggaggtctccgtggataagcctgcgggagttgctgtgctgatgagacttggctgtcctcataagcagtgactcccatcagctggtgtccatgagcgtgagcaagtgtacgctatgtacagggccaacaagcgaagaactttccattaattttccctccatctcctacaatggctcttcttcacaaagaagatcatcactgtgaggcatgttctcgtggctctggtgggctggcgtgaagcccctctactgactcccygtctactcatggggaaggcaggtggctggggtagccataagacatcccactgatggttttcaggaaatgcaacctgtaaccccggctgcctgccactcccagagccaggaagagggaggacaaatgcaagggccagagaagacgaaaggcaagaatagcctcttaggagaaattgtgtgtgctaagcccgcttgtatggggctccctcaagagagttcagtgttctttagctgtttcttcttttttactacgtttttatgaagtaggatgatttcagagcattaagagtgtgctgatagc

SEQ ID NO: 44518 - DNA, 601 bp, Human
tgacattattccttggtactggtgaaggttaggaatttaacataagcaggaagttaatcttcctcagcaggagcaggagctacgcattcacctgagctctgcggctacaaatcttcctaagtagcattagctcctaacttaatgtattatctttgtcagttacacgagagtatctgctatatcaatgaactttgagggctgcagttgaaagactattattataggaccaaggtaagtgccctgcaagaaatgtctatttcttgactatcagctacagcaaaatgaagacagagagagaagrgaaagaggagacttatagtggtcaagagatgaaatcagcgtaataggtttcaggagatgtattggctgcagatgaaatggattcttttaaccaggttagcagctgagtatgcatgagaatagagtagttccgacactgaagaatgtgggagcattctagaagtattatggaaagtgaacacaccggggttttcagaggcaaatctgtggtgagtgtgtgcttagctgtacgtctcctgatggattctccctgcatgagagaggctatttctaggttagcaggaatttctggtgactttaa

SEQ ID NO: 44519 - DNA, 601 bp, Human
gcagagcatgaggaaataatttttaggagcaatagtgttcaaaatcactttagccaattacttaaagttgattttcttgctgacattattccttggtactggtgaaggttaggaatttaacataagcaggaagttaatcttcctcagcaggagcaggagctacgcattcacctgagctctgcggctacaaatcttcctaagtagcattagctcctaacttaatgtattatctttgtcagttacacgagagtatctgctatatcaatgaactttgagggctgcagttgaaagactattattrtaggaccaaggtaagtgccctgcaagaaatgtctatttcttgactatcagctacagcaaaatgaagacagagagagaagagaaagaggagacttatagtggtcaagagatgaaatcagcgtaataggtttcaggagatgtattggctgcagatgaaatggattcttttaaccaggttagcagctgagtatgcatgagaatagagtagttccgacactgaagaatgtgggagcattctagaagtattatggaaagtgaacacaccggggttttcagaggcaaatctgtggtgagtgtgtgc

SEQ ID NO: 44520 - DNA, 601 bp, Human
cagaaggcctttcccagtctggagcaaagtgcactaaaagggttttttgacgtctaccatggaatggataaattttacattccactttacttgcagagttgtattttttcttttatagcaagtgtgttatcttctgcattggatttacaggttgaaactttttctgctctgtgaaggttcagtgaaccgaggacggaccttttccgattttctgcagagcatgaggaaataatttttaggagcaatagtgttcaaaatcactttagccaattacttaaagttgattttcttgctgacattmttccttggtactggtgaaggttaggaatttaacataagcaggaagttaatcttcctcagcaggagcaggagctacgcattcacctgagctctgcggctacaaatcttcctaagtagcattagctcctaacttaatgtattatctttgtcagttacacgagagtatctgctatatcaatgaactttgagggctgcagttgaaagactattattataggaccaaggtaagtgccctgcaagaaatgtctatttcttgactatcagctacagcaaaatgaagacagagagagaagagaaagag

SEQ ID NO: 44521 - DNA, 601 bp, Human
ctatgtgctttgagaagccgtggcagccacacaaggagaagaggacaggccacagcgatagcccacttcctatgcagagcccagctgagctcaggtgaggacagagcccagagagaccagacgtcccaaggacactcatcgtttagagctcaattcaacccatgtttagtgagtactaaatgtctgctaggcactagttttcaaagcaaactcgggtatgcacgtggccatagaccaggccagccctcaataccagagccactcccgggcccctccacgcacttcaggcctcggcaaagtraggcagactctcaccaaggctgcccatcatcctgagctgacagccataccctttgcagaggattccctccaaggattcaaaggcaggtcctccatgcccctcttgggcatttgtctcttcctgcagctgcttttccctgggggaggcctgcctccctgctttcacggcctcacagatgccccggaggctgggggtgggcccctggcagtgacactacctgccccgagggacagtggctgagagctcaggaaacggcaggtcacccctggccccgatgggtgaggacccgccggcgtctta

SEQ ID NO: 44522 - DNA, 601 bp, Human
ctccttgctgagtgtaaatggtccccccttgccggcctctgaagaggggtaccccagctctccctcaaacttggtgcgccattgagcatagctgtgaaatgttctcgctatttaggtacttgagcagctgtttccaatcttttgcacattcccatgcttaaaaagccaggtgccacggtgcagacggtggtggcctgggtctggaggggggcctggtggatgcaggtttgtggtgaccgctcctagtgtgcaaacggcagccctgctcacggtgacggcagtgccagctctgggcttgtcyccttccccttctcctcctggctgtcctcttctttgtgagtgctcctggcacctatgtgctttgagaagccgtggcagccacacaaggagaagaggacaggccacagcgatagcccacttcctatgcagagcccagctgagctcaggtgaggacagagcccagagagaccagacgtcccaaggacactcatcgtttagagctcaattcaacccatgtttagtgagtactaaatgtctgctaggcactagttttcaaagcaaactcgggtatgcacgtggccatagaccaggccagccctca

SEQ ID NO: 44523 - DNA, 601 bp, Human
ctgcactttcagccactgcctggactggccatcccggggccagcaggcacatcctcattcctcataaacctactcctggcccgcggcggtgcagccctggacagccaggcactagcatgatgtctgacatgcagccgcacctggcggacgcttccccttcagggcctccaagttttggcatccgcaggcgtcctgtcccccgtgctcctgtgctccttgctgagtgtaaatggtccccccttgccggcctctgaagaggggtaccccagctctccctcaaacttggtgcgccattgagcayagctgtgaaatgttctcgctatttaggtacttgagcagctgtttccaatcttttgcacattcccatgcttaaaaagccaggtgccacggtgcagacggtggtggcctgggtctggaggggggcctggtggatgcaggtttgtggtgaccgctcctagtgtgcaaacggcagccctgctcacggtgacggcagtgccagctctgggcttgtccccttccccttctcctcctggctgtcctcttctttgtgagtgctcctggcacctatgtgctttgagaagccgtggcagccacacaagga

SEQ ID NO: 44524 - DNA, 601 bp, Human
gtgcatggttgcctccacccctgtggcttcaggaagaaatccttctccccagccgcagccgccagtcactccaagtcccacgaccaccttggggctctcacctggcccttgtctggccccggctcccccagggcccttctgcccccaagccctggcttcctctgctgcactttcagccactgcctggactggccatcccggggccagcaggcacatcctcattcctcataaacctactcctggcccgcggcggtgcagccctggacagccaggcactagcatgatgtctgacatgcagccrcacctggcggacgcttccccttcagggcctccaagttttggcatccgcaggcgtcctgtcccccgtgctcctgtgctccttgctgagtgtaaatggtccccccttgccggcctctgaagaggggtaccccagctctccctcaaacttggtgcgccattgagcatagctgtgaaatgttctcgctatttaggtacttgagcagctgtttccaatcttttgcacattcccatgcttaaaaagccaggtgccacggtgcagacggtggtggcctgggtctggaggggggcctggtggatgcag

SEQ ID NO: 44525 - DNA, 601 bp, Human
acacacacccccacacaaacacacacgcacacacacccctactgcttttcctatctggaccagaatggggtgtccacaagtgcacaagtgctgagcacaaggagctgagtcctggaagcctgcagacttttaaccacctttccgcgtgtgtcctggagtgtgagcctcaggcagccacgtggacaaagcgttgtgtagaggatttacttatctttggccaggattttaaaggtatatgcaaaacctgtctaggatgaaactgtggagaacagaagggctgcttttccctgctaaataattytttttagaagaggaatgaagcattctgttgagtttcttactatgatctggataccaaagcctgggactctcatcctctccactctgcttggctacacggggtttctggcagaggctccatctctctgtggccagggtccactgaggacagcgtgcctctcgtggagcagggaacggggtaggggccaagccgctacctgccagcgcgtcacacactgggtgctgtgccacccttagctcacccctcccacacatcagatattcctgcacacacagtgaaaatcctccttctcgccagcac

SEQ ID NO: 44526 - DNA, 601 bp, Human
gggattgccaccgtcttcgggcaggggcacccctgggggctctcagaccagcccgcctgcaccctctgtgtgcacctcctgcagagatggcctctgtgagccaggcatcgccggcccctgctcagggggctggagggagaagttgaggcctctagcacgcatccctgggagggttctctgtccattaagagcaacgctgggagcccacacagcctgcccaggctttagtttcaacttacgcttatcttcattttcccttcattccatagacatgtaaataccacacacacccccacacaamcacacacgcacacacacccctactgcttttcctatctggaccagaatggggtgtccacaagtgcacaagtgctgagcacaaggagctgagtcctggaagcctgcagacttttaaccacctttccgcgtgtgtcctggagtgtgagcctcaggcagccacgtggacaaagcgttgtgtagaggatttacttatctttggccaggattttaaaggtatatgcaaaacctgtctaggatgaaactgtggagaacagaagggctgcttttccctgctaaataattttttttagaagaggaatga

SEQ ID NO: 44527 - DNA, 601 bp, Human
agccccgagagcaccggtgtctctgggagtcagggagctcggagcagggtcccgtgctggagggggcaccgcagcacgggagccaggctgttctttgccttgttgcctatttcatagctggggtgtctcccttaccctcctggtgtgtttgcacagagagagagagggaagaggaagagagagacacgaagagggagggagagagggggaagtagacagacagagagacagggagggagaggacacagggtgaggtggacccaggcggaggccctctgttcagctcgcgtttctcagccgyagggcagggagttcttggttccgactctgctggttcctggcactgctcagcctgagccttccacccagctgcttctgtctccgttgggagctgacttcaagggtcctttgtcatggaatccctgcattttaaaatccctctgtattttaaaaccatttagtgcctccggccttgcaattccttcttccgtggctggtgccctcacagccactttcttgcaataataaagcatcccaaagtaccggaggaaggcattctaactcaaaagctccttctcagggacgagagagggaagctcct

SEQ ID NO: 44528 - DNA, 601 bp, Human
tcctcttcctcatggcaagagggactcctctcccacgggggaggctcagagacgtctgtttcccaaacgcagatgactcggagctgatggccagagagtgaagttctagtccagctgccccaaccatggggcttttgaggcttgattaccatttccttctgagaatggtgggagcagggattgatatgaggttcaccgctctgattttcattttacagtttcggaaactaaggccccagcacagaaacacagaggacccaaagctacagccttgaggggcagaggggccagggccagcagrgcttttagagccagcactgccctccccagcagctctgagggtggccaggcctcttccagaatagcacgagtgtggagtggcactggggcagggttatgatgacaccaatgttttcagaggacgaggctcctgtggggcctttgcattgcttttcttgcttgatcagcacaacgttccaaagcatctgcaggacaggtgacgcttttgccaccattgctgttttacaggagagggaaggaagctcagagaagacagacacctgccccaggtccacggctatgacgcagtgccatgagacct

SEQ ID NO: 44529 - DNA, 601 bp, Human
tgttgccatggcgtctccatgcaggagcacacccttcatgaccacagctccgggaagcagggtctctgttccttgtcccgagagacccacggaaaaaattcctcttcctcatggcaagagggactcctctcccacgggggaggctcagagacgtctgtttcccaaacgcagatgactcggagctgatggccagagagtgaagttctagtccagctgccccaaccatggggcttttgaggcttgattaccatttccttctgagaatggtgggagcagggattgatatgaggttcaccgctckgattttcattttacagtttcggaaactaaggccccagcacagaaacacagaggacccaaagctacagccttgaggggcagaggggccagggccagcagagcttttagagccagcactgccctccccagcagctctgagggtggccaggcctcttccagaatagcacgagtgtggagtggcactggggcagggttatgatgacaccaatgttttcagaggacgaggctcctgtggggcctttgcattgcttttcttgcttgatcagcacaacgttccaaagcatctgcaggacaggtgacg

SEQ ID NO: 44530 - DNA, 601 bp, Human
agcaacggaggtggacaaacggcacctgtcagaggcgaaagctgctgtcagattggcgaggaagtccttaaaatggttgtgtgctttccgccgggtggctgtgccatggcctctctggttggcaccttgatggcagcccgcccccaggtaccatgttgccatggcgtctccatgcaggagcacacccttcatgaccacagctccgggaagcagggtctctgttccttgtcccgagagacccacggaaaaaattcctcttcctcatggcaagagggactcctctcccacgggggaggctcasagacgtctgtttcccaaacgcagatgactcggagctgatggccagagagtgaagttctagtccagctgccccaaccatggggcttttgaggcttgattaccatttccttctgagaatggtgggagcagggattgatatgaggttcaccgctctgattttcattttacagtttcggaaactaaggccccagcacagaaacacagaggacccaaagctacagccttgaggggcagaggggccagggccagcagagcttttagagccagcactgccctccccagcagctctgagggtggccag

SEQ ID NO: 44531 - DNA, 601 bp, Human
ctgaatgacagatgcagtttttcctgtgtttttgccctttgccgggttgaagattatgtttattcctgaatcatcggctcgcacgagttaatgaaagtcacgggcatttactttctttacagaaagctgtgcaccatccagaatagcgggcttttctctatgtctgaaaaaattcacagacaagcctttcgttctgatgcagatttcaggtaacctgaggctgttacctcagctccttgcagaggatgcagctccttgcagatactgggaatgagagcgctgcagggtggcggccgctggygcccgtggcttgtgtgtgtggtttcccttctggtgccctactcgggaggttgttgctttgccccatgacaggaaggatcagcgtttctcctcttagcaaactgtgaggctggatgcagagattcagatactgcttttgtagatgtggtcggggcatatctggttgtgttttctctcccatgtttcatggggaagtgaagctcccgtggcctcctttgggggcctttgcctctgtccgctggtgatacaggggtcggtatcagagacctcttggcacgaaaccttgtgggacccacattgg

SEQ ID NO: 44532 - DNA, 601 bp, Human
atgctcaaaggagacagtcacctacgcagcatcttcctttctctccagggatcttctgtttcaatgcgtgcgtattttctacctaaaaaccggtgggagtgggaaacagcagaccccctgcaaactatctgaagcttagggtcatggtatctgtttcccatggaaactggcccagcagctaaaacaggcaccagtgaaatcagtattattggacagaacatgtgtgtcaaagtctgcaaggctggagatgagacgacacatccgactgtaaatggtgggccatgctgtctccccttttctyactctccatccccctgacttcataatgctctggcaattccgagaaatcacagaacactgtggttctcttttcaatactagttaaatactagttacaatactagttaaataatagcttcctctgaaaaaaagcacatatatatatatgtgtccccccccactccccgccgcaaggaagctattattcgatttctggtcaaacagctcctaccatgcctcaggagagtatgttagatttttttttaaaagcaagatcagggcattttagattttgcagtttggagagaattcttttctgtct

SEQ ID NO: 44533 - DNA, 601 bp, Human
gtatattttttgaattaggaatcgtaaaatgtagttctagatgaaatagatgcaccttttctgccattttccctacatcacacttcttttgtggctcacagagatccttgacatccccagaaaccttgtttaagtgattaaatgatcctccttaaagatgctcaaaggagacagtcacctacgcagcatcttcctttctctccagggatcttctgtttcaatgcgtgcgtattttctacctaaaaaccggtgggagtgggaaacagcagaccccctgcaaactatctgaagcttagggtcrtggtatctgtttcccatggaaactggcccagcagctaaaacaggcaccagtgaaatcagtattattggacagaacatgtgtgtcaaagtctgcaaggctggagatgagacgacacatccgactgtaaatggtgggccatgctgtctccccttttcttactctccatccccctgacttcataatgctctggcaattccgagaaatcacagaacactgtggttctcttttcaatactagttaaatactagttacaatactagttaaataatagcttcctctgaaaaaaagcacatatatata

SEQ ID NO: 44534 - DNA, 601 bp, Human
tgaagggcgaatgaatttgctttttactctttttacctcccagagtaatatttgattcttctggcactctcaggaagtgcagataccagagagctcagaagttaatctgaaaaaactcagagacagagagctcagggatgaatctgtgtggcctgttcagaaccacagaagatagtggtgtcactgtttttctgagctgccatgataagaaagaacagaggtatatttgatataatttttttcttgtgaaagtgataatatgcttcttcagtatattttttgaattaggaatcgtaaaatktagttctagatgaaatagatgcaccttttctgccattttccctacatcacacttcttttgtggctcacagagatccttgacatccccagaaaccttgtttaagtgattaaatgatcctccttaaagatgctcaaaggagacagtcacctacgcagcatcttcctttctctccagggatcttctgtttcaatgcgtgcgtattttctacctaaaaaccggtgggagtgggaaacagcagaccccctgcaaactatctgaagcttagggtcatggtatctgtttcccatggaaactggccca

SEQ ID NO: 44535 - DNA, 601 bp, Human
gtattgattatgtgccagttttggggaagtgggtcaaataactgagtgttgataacatctgccccattttcccacctgatgggatggagcacaggaagttggctccatgtggagttgccgcctggagacctctggcctctcgtaaacctggaatggtgcgttctcatggaggcaaccacggcagggtcccatgcacctggctctctccacctgggcctcccattagggcctttgctacagagatgcacccatcagcactcggctgtggagccttagcaagcacctgttcttccctttgtcrtgtggtccatgatgtcattgcagaatgacacgttagaaaaatgtctctttgttaatgtatctcaatatgcccagagagcagcatctaccatccagtggctaaatgcagtagggatttccttatgggcattgtcttaatcaagtaagtggtccaagttctaggaatgtacatgttttccctgtgtccccaaaaggattcaatgcaaagccagaatagagaaagcaaggcgtcttggttttaaaacacgaggtgtgatcgtaaaccaaaaatatcattcagcactgctcccacgtcaccact

SEQ ID NO: 44536 - DNA, 601 bp, Human
tttttttttttgagacagtctcactctgttgtccaggctgaaatgcagtagcgtgatcttggctcactgcaacctcgctcctgggttcaagcgattctcatacctcagcctcccaagtagctgggattacaggcatgcaccaccatacctggctaatttttgttcagtggagacgagtttcaccatgttgcccaggctggtcttgaactcctggcctcaagcaatccacccaccttggcctcccaaagtgctgggattacaggtgtgagccaccgtgagccaccacacatggcctgcttastttttaggacacacatttagtaattccctgatatacttttagttgtactcactaaggtttaaaaaaagccaaaactgtgaacatttttggttattcattgagatttgtgtcttctgggccatccccaacctgtttcaagtactgcactttctttgtgggtgattaaaagcgaggaagagctaggatgtcagttgcactataaaagaagaaatggacacagggccgcaccttgtgatgtagactcagatgctggggggcatcctgcaacctgtgttttgccagctagagatgaggccagga

SEQ ID NO: 44537 - DNA, 601 bp, Human
ggaggaggtgaggggaagacgcaagctgggtggggcacttagggggtgaaggtgaactcaagtcacttcacagaccagccatgggggacgctgaagcgggtggcgcaccctcaagccttcccggaggagaccgctgagggcctgggccagcctcgcaacctccgcttcccccgtcaaccccatcagaagctctgagctgcggccccaggaacacttgtgacgtataaggtcatcctgaaagtgaactgagagctgaacttcagctctctaggacagaaagggttcctgctgtttagtttargtattttttttttttttgagacagtctcactctgttgtccaggctgaaatgcagtagcgtgatcttggctcactgcaacctcgctcctgggttcaagcgattctcatacctcagcctcccaagtagctgggattacaggcatgcaccaccatacctggctaatttttgttcagtggagacgagtttcaccatgttgcccaggctggtcttgaactcctggcctcaagcaatccacccaccttggcctcccaaagtgctgggattacaggtgtgagccaccgtgagccaccacacatggcc

SEQ ID NO: 44538 - DNA, 601 bp, Human
atcattctgtcacaccttatgataaacaggttacctgttcctaggtgggaggagctgggagaagatgctaggccttaaagaaacaacgggaggaggtgaggggaagacgcaagctgggtggggcacttagggggtgaaggtgaactcaagtcacttcacagaccagccatgggggacgctgaagcgggtggcgcaccctcaagccttcccggaggagaccgctgagggcctgggccagcctcgcaacctccgcttcccccgtcaaccccatcagaagctctgagctgcggccccaggaacrcttgtgacgtataaggtcatcctgaaagtgaactgagagctgaacttcagctctctaggacagaaagggttcctgctgtttagtttaggtattttttttttttttgagacagtctcactctgttgtccaggctgaaatgcagtagcgtgatcttggctcactgcaacctcgctcctgggttcaagcgattctcatacctcagcctcccaagtagctgggattacaggcatgcaccaccatacctggctaatttttgttcagtggagacgagtttcaccatgttgcccaggctggtcttga

SEQ ID NO: 44539 - DNA, 601 bp, Human
ttaagagcagtgttttggggggtttttcaatttatggggagtgggcacttatcattctgtcacaccttatgataaacaggttacctgttcctaggtgggaggagctgggagaagatgctaggccttaaagaaacaacgggaggaggtgaggggaagacgcaagctgggtggggcacttagggggtgaaggtgaactcaagtcacttcacagaccagccatgggggacgctgaagcgggtggcgcaccctcaagccttcccggaggagaccgctgagggcctgggccagcctcgcaacctcygcttcccccgtcaaccccatcagaagctctgagctgcggccccaggaacacttgtgacgtataaggtcatcctgaaagtgaactgagagctgaacttcagctctctaggacagaaagggttcctgctgtttagtttaggtattttttttttttttgagacagtctcactctgttgtccaggctgaaatgcagtagcgtgatcttggctcactgcaacctcgctcctgggttcaagcgattctcatacctcagcctcccaagtagctgggattacaggcatgcaccaccatacctggctaa

SEQ ID NO: 44540 - DNA, 601 bp, Human
ctcatctggcattggattgtcctttttagctttctgcaagcatcttccctctccagctagattttaatctttcagaggaaaaaagaaaaacttctgtgggatccccaaagctcccggcatttgactcacaaggtggagctcagcaaatagaaagtgaccagaggaacaaaagccttccatggcagccttgtgaaaagagcttgctgcagggagctgggaagctccagcccgggcctgacgccacctgtgtggccttcagcgagtcccctggggccctggggcttctggttcctcgcgggtkaaatgatgggactgaaacagagagtctccaagtcttcggttctagaattttactgagaagccaccttggaaaagcggcaaagcgtgtgagatcagcctctggtgagcttttatattggttgtttccggagactccagacctgggttttggtttatgttcctaaagagcttttgtgctgagcacgggaagaaaagcccaggagcacgcctcggtgtcaggctggtgacgacctcgggcaggggactgcgtggcccgcgtggacggatgctgcatctgagccactttttttttttttgagac

SEQ ID NO: 44541 - DNA, 601 bp, Human
cctttgcctagagcgtcctccccctccaaatgtctctgttttgggaaaatatagcctcttttggctgcaaccctcatctggcattggattgtcctttttagctttctgcaagcatcttccctctccagctagattttaatctttcagaggaaaaaagaaaaacttctgtgggatccccaaagctcccggcatttgactcacaaggtggagctcagcaaatagaaagtgaccagaggaacaaaagccttccatggcagccttgtgaaaagagcttgctgcagggagctgggaagctccagcycgggcctgacgccacctgtgtggccttcagcgagtcccctggggccctggggcttctggttcctcgcgggtgaaatgatgggactgaaacagagagtctccaagtcttcggttctagaattttactgagaagccaccttggaaaagcggcaaagcgtgtgagatcagcctctggtgagcttttatattggttgtttccggagactccagacctgggttttggtttatgttcctaaagagcttttgtgctgagcacgggaagaaaagcccaggagcacgcctcggtgtcaggctggtgacg

SEQ ID NO: 44542 - DNA, 601 bp, Human
aacatcatctataaaaggaaaaaatggataaattggacctcatcaaagtttcaaaacttttgttttacaaaagacaccatcaagagaagaaaaagacaagctacagacagggagaaaatatttgcaaattacgtatctgacaaaggacttgaaagcagaatctgtaaagggctctcaagactcaaccagaagaaaacaaacaatttggtttaaaaatggactaaacccttgaataaacacttcagcaaagaggacgtagggagggtgaataagcagatgaaaagatgttcagcatcatcaytagcatcaggaaaacacaaatcaaaaccgcgaggggataccgcaccgttagaatggctgaaataaaaaatgccaacattcccaagtgctgggaacgcaaactgtcactccttgaaacaatttggtagtttcttagaaagttaaccctatacttaccatatgaccctgtaattccatttcctgctttaaatactaaaggataaattacatgcttttggaaatggcttctataatgaatatattggccaccaatcttttgagggaaaagtaatttaaattttaataaaaacttatgtttata

SEQ ID NO: 44543 - DNA, 601 bp, Human
ggcatctcccatgcatagggcctactcagcactgcgagctctgttttctgcaccccttgctcgtggcctcccctgtgacagagttgcaggcacagcagggcgtaaccatgagctgcttgtccttctctgcactgggcctcattacttcccaactaaatgccaggggccaggcatggtccacgttctgaaaataccacaaaagtgaagcagacaaaattcctgcctgagaggttttgaatgcatgaggaatgaaagagggatcccattttggctgggtgtggtggctcgtgcctgtaatccyagcactttgggaggccgaggcgggcagattgcctgaggtcaggagttcgagaccaccctgggcaatatggtgaaaccccgtctctactaaaatacaaaaaattagccaggcttggcgtcgtgtgcctatagtcccagcttcagggggctgaggcaggagaattgcttgaacctctgaggcggaggttgcagtgagctgagattgcaccactgcacttcagcctgggcgacagagcgagactttgtctccaaaaaaaaaaaaaaaaaacaaaagatcccattttatcccttggatttctta

SEQ ID NO: 44544 - DNA, 601 bp, Human
tgtctgaaacctccgcagggcccagggcaaaggcatctcccatgcatagggcctactcagcactgcgagctctgttttctgcaccccttgctcgtggcctcccctgtgacagagttgcaggcacagcagggcgtaaccatgagctgcttgtccttctctgcactgggcctcattacttcccaactaaatgccaggggccaggcatggtccacgttctgaaaataccacaaaagtgaagcagacaaaattcctgcctgagaggttttgaatgcatgaggaatgaaagagggatcccattttrgctgggtgtggtggctcgtgcctgtaatcctagcactttgggaggccgaggcgggcagattgcctgaggtcaggagttcgagaccaccctgggcaatatggtgaaaccccgtctctactaaaatacaaaaaattagccaggcttggcgtcgtgtgcctatagtcccagcttcagggggctgaggcaggagaattgcttgaacctctgaggcggaggttgcagtgagctgagattgcaccactgcacttcagcctgggcgacagagcgagactttgtctccaaaaaaaaaaaaaaaaaaca

SEQ ID NO: 44545 - DNA, 601 bp, Human
acaggaggcagagctcaggagataatctcactcgcccgctgctcacctcctgctgtgcacctcggtttctaacaggccacagagcggtaccggtccagggcctgggggctggggaccccttctttaaacgtttcttgccctcacccccagactactaacagctcccctgctgcctgtgaggctccctgccctgcccacccttcagggtgaagccaaagctctttgtcccctgggccctaacgtggtgaggcttcctgtccaccttcccagcattcagcacccagagcagagcaagcttcgkgaaacagaagcaacatggatgtccctctccttccagtgtcctgtggccgcccttgcctgcagcaggagccctgttattctgggtgcttctgagggcccttccctctggctgcagccctgccaggagccagagccccagccccagctctcctcccacttgccctggctgctgagcatccatcccctgccctgggctgtgcccctatgccctggccccgaccatcttccatgtggatgggctgtgcatcctctgccctgggccttgtgcagggtcctttctgtccacaaggcccttccttct

SEQ ID NO: 44546 - DNA, 601 bp, Human
gcaccgacattgttcacctctgtgtctgagcccagacgggggtctccacacggcacacatcaggtctgaagttttgctggcactggactctttcctctgccctccttccctactcgatcctcttcaaagcagcggttcccaacctttttggcaccagggatgggttttgtggaagacagtttttccatggatgggggtgggtaggggaacgtttttgggatgaaactgttccacctcagatcatcaggcattagattcccataaggagtgcacaacctcgatccctcgaacatgccattcmcagtagggtttgctctcctataggaatctggtgccgctggcctgacaggaggcagagctcaggagataatctcactcgcccgctgctcacctcctgctgtgcacctcggtttctaacaggccacagagcggtaccggtccagggcctgggggctggggaccccttctttaaacgtttcttgccctcacccccagactactaacagctcccctgctgcctgtgaggctccctgccctgcccacccttcagggtgaagccaaagctctttgtcccctgggccctaacgtggtgaggcttcct

SEQ ID NO: 44547 - DNA, 601 bp, Human
ctttgacgcggctgcataacatgagctggtctctgcttctcaaagtaagtgtctcacgccacactgacaccgggctgatttgggaatatcacttccacattttgagtaagaggaagcggagagggaagaatggctgggcatgagtgcccagggccagctggtaatcaacagaaccagaacactccaggtcactggagatcgcacagaagatacagagtggtaagcactgcgagaggttagctcacagtggagggaagggaaaagccatgagcgcccgggggcaggggaacacaggggacaygggggcaggtgacacaggggacataggcgacgcaggggatgctgcggcttttgcagacttcatgcattgtctgctcggctctcagctcaactgcaaaggcccaacagcggtgaatgcgcaccaggcaagagggctgattgtgagttctcagaaaagcaaaggaaagggactcgggggagcttgcgagattgattttgtcagttttcccctcgctttctcactgctgctcccagatgctacttgttcagaaatagcctgcatgtaaagagcccacacctcaggcaggaatgaatttctgga

SEQ ID NO: 44548 - DNA, 601 bp, Human
gagagaaaaatattacttatccccaggcttctgggctgaatacaggaaaatgctcgggaaatacacacagaaaaacacacaacagcatgaggcaggcagctcatgggctttgacgcggctgcataacatgagctggtctctgcttctcaaagtaagtgtctcacgccacactgacaccgggctgatttgggaatatcacttccacattttgagtaagaggaagcggagagggaagaatggctgggcatgagtgcccagggccagctggtaatcaacagaaccagaacactccaggtcactrgagatcgcacagaagatacagagtggtaagcactgcgagaggttagctcacagtggagggaagggaaaagccatgagcgcccgggggcaggggaacacaggggacacgggggcaggtgacacaggggacataggcgacgcaggggatgctgcggcttttgcagacttcatgcattgtctgctcggctctcagctcaactgcaaaggcccaacagcggtgaatgcgcaccaggcaagagggctgattgtgagttctcagaaaagcaaaggaaagggactcgggggagcttgcgagattgat

SEQ ID NO: 44549 - DNA, 601 bp, Human
acaagcaaatagaggggaagtgacggtaattcaagggggattccatctgagatagggtcaggttgggcaaagcactgagagaaaaatattacttatccccaggcttctgggctgaatacaggaaaatgctcgggaaatacacacagaaaaacacacaacagcatgaggcaggcagctcatgggctttgacgcggctgcataacatgagctggtctctgcttctcaaagtaagtgtctcacgccacactgacaccgggctgatttgggaatatcacttccacattttgagtaagaggaagcrgagagggaagaatggctgggcatgagtgcccagggccagctggtaatcaacagaaccagaacactccaggtcactggagatcgcacagaagatacagagtggtaagcactgcgagaggttagctcacagtggagggaagggaaaagccatgagcgcccgggggcaggggaacacaggggacacgggggcaggtgacacaggggacataggcgacgcaggggatgctgcggcttttgcagacttcatgcattgtctgctcggctctcagctcaactgcaaaggcccaacagcggtgaatgc

SEQ ID NO: 44550 - DNA, 601 bp, Human
ttttaatcgtcttcgttttgcatggcacttttcggtttacagaaaaactgtgcagaaattagtttccacataccccgaacagtttcccttattagcaacactgccttagggctctctcggtgctgtgcacgctgtgggtttggacaagtgcgtggtcttcagtcaccatggcagcctcgacagagcggtttcgctgcccgaaaaatgccctaaaaatgccctgtgctctctctgctgccccctccgctcccagcccatggcaagcactctccataggttgcaaagcctgtgtttttaggcyaagcgttacatgggagcctaatctcaagagaagtgagctctctggagaacgcacggagcgcacggtgcaatccgtggcagatacagtcgggaagcgcttgcctggaactcgcgatcaggtgcgaggggggagttccccggccggcctcaccctgatgatgaccccggtgccacccccgagcgtacgaacgtcctgtgtggatgacagcagtggccagcacccctcctccccctcacagttgctacctcttcccatcgatcgtcacttacaatgttcttgaagaagtggactacggggttt

SEQ ID NO: 44551 - DNA, 601 bp, Human
tccatttcctaacgggctcctgcctgctgagggtggctagcatccatcagctgccagaagcacccgggtgcccagcctccccacttctgtcctagttggtgaagaagtatagacctgagattgaaaatattctagatgatgcagatctcccagagcactcaggaagtgtttcagaggatggaaaacacctcccagaggctccgtagctggggaatgggcccatcttgggacactgagggaggcggcggactttgcttcaccgtgagccctttccggggctaggagtagcgggccctctgayattcagagcttccaaggggatgtccccaggtctgcagctcctaagtgcacttatcgaatacgagcataaaatgtctgctgcactgagatcttggaattagaagcctgtggttttgttcttgtttttaatcgtcttcgttttgcatggcacttttcggtttacagaaaaactgtgcagaaattagtttccacataccccgaacagtttcccttattagcaacactgccttagggctctctcggtgctgtgcacgctgtgggtttggacaagtgcgtggtcttcagtcaccatggcagcctc

SEQ ID NO: 44552 - DNA, 601 bp, Human
ggctgcactgggagccctgtgccgccgtccatttcctaacgggctcctgcctgctgagggtggctagcatccatcagctgccagaagcacccgggtgcccagcctccccacttctgtcctagttggtgaagaagtatagacctgagattgaaaatattctagatgatgcagatctcccagagcactcaggaagtgtttcagaggatggaaaacacctcccagaggctccgtagctggggaatgggcccatcttgggacactgagggaggcggcggactttgcttcaccgtgagccctttcyggggctaggagtagcgggccctctgacattcagagcttccaaggggatgtccccaggtctgcagctcctaagtgcacttatcgaatacgagcataaaatgtctgctgcactgagatcttggaattagaagcctgtggttttgttcttgtttttaatcgtcttcgttttgcatggcacttttcggtttacagaaaaactgtgcagaaattagtttccacataccccgaacagtttcccttattagcaacactgccttagggctctctcggtgctgtgcacgctgtgggtttggacaagtgc

SEQ ID NO: 44553 - DNA, 601 bp, Human
aataagatttctgggtcaaaaatgaatttcattcttctatcatctttgtctcctgctggcatagaaaataaaaaattaattgtgagtactagtccatgtacatttgctacatgattgtcatcgttttgcaaattcattaggtcagaaaaagcaagtcaaatatgcattaatggaaaacgtttcggtaaatatcttagttcataattcagtgtaatcatgtgtgggactgatctgggatcctcatggtctctcaagtaccctgccccttcctccctctcttccttcctcttccccaccttckgttttctttccctgttctttcttcctgttctttctccttgttgtttttcttttaaaatgtattcattcatttatatgatgcttattaattgagcagaaagtgtaggtaggctctgttctagcgtatgagagcattgcagtttcggagacagacacaacctatctacaatacgttggtggttattcctccattttattctaaaattataacttttatacagtaagaatcatatctggtatttgctagtaactaaagtctgtaagtttggttagaatataatgattggcattttaatttggc

SEQ ID NO: 44554 - DNA, 601 bp, Human
cagtagctaaaataagatttctgggtcaaaaatgaatttcattcttctatcatctttgtctcctgctggcatagaaaataaaaaattaattgtgagtactagtccatgtacatttgctacatgattgtcatcgttttgcaaattcattaggtcagaaaaagcaagtcaaatatgcattaatggaaaacgtttcggtaaatatcttagttcataattcagtgtaatcatgtgtgggactgatctgggatcctcatggtctctcaagtaccctgccccttcctccctctcttccttcctcttycccaccttctgttttctttccctgttctttcttcctgttctttctccttgttgtttttcttttaaaatgtattcattcatttatatgatgcttattaattgagcagaaagtgtaggtaggctctgttctagcgtatgagagcattgcagtttcggagacagacacaacctatctacaatacgttggtggttattcctccattttattctaaaattataacttttatacagtaagaatcatatctggtatttgctagtaactaaagtctgtaagtttggttagaatataatgattggcatt

SEQ ID NO: 44555 - DNA, 601 bp, Human
agtccactcctagaaaattaagagcagataaagcagtagctaaaataagatttctgggtcaaaaatgaatttcattcttctatcatctttgtctcctgctggcatagaaaataaaaaattaattgtgagtactagtccatgtacatttgctacatgattgtcatcgttttgcaaattcattaggtcagaaaaagcaagtcaaatatgcattaatggaaaacgtttcggtaaatatcttagttcataattcagtgtaatcatgtgtgggactgatctgggatcctcatggtctctcaagtaycctgccccttcctccctctcttccttcctcttccccaccttctgttttctttccctgttctttcttcctgttctttctccttgttgtttttcttttaaaatgtattcattcatttatatgatgcttattaattgagcagaaagtgtaggtaggctctgttctagcgtatgagagcattgcagtttcggagacagacacaacctatctacaatacgttggtggttattcctccattttattctaaaattataacttttatacagtaagaatcatatctggtatttgctagtaactaaagtc

SEQ ID NO: 44556 - DNA, 601 bp, Human
gtttatctttggggaacctagaatgtaccaggaaacacacaacacagcttagaaagagaaagtgggggctctctggaactccagacaaggagagagtcctgcggctctgggaaacagacaagcagacaaaatgcagagaaggattttgctttggaaaaaagagaaattcaacagacattagtaggacccaaaagggagagatgcagggaggaatgcaagggtctttcttgttagctgctggggcagaacggcctgtgtgcaaccccccatcgctccacattcagggaggatccggcacgayggccccaaagtccactcctagaaaattaagagcagataaagcagtagctaaaataagatttctgggtcaaaaatgaatttcattcttctatcatctttgtctcctgctggcatagaaaataaaaaattaattgtgagtactagtccatgtacatttgctacatgattgtcatcgttttgcaaattcattaggtcagaaaaagcaagtcaaatatgcattaatggaaaacgtttcggtaaatatcttagttcataattcagtgtaatcatgtgtgggactgatctgggatcctcatggtct

SEQ ID NO: 44557 - DNA, 601 bp, Human
caccagaggcctcaaggcttccagagcacctggctgcaccctcagcctctgctgggggcttcccaccatacaagctacttgcacagttttcttttcattcagcctgtgcttgggagtgagcatggccactcagaaccaggcagctgctttcgtgtgaacagttgattcgggggctatccagtgaggtgagggacgggatgtgtggcaagaaggtctaagcactgcacacgaggggacagccagcctcgctcttgcgtcctagaggtttccaggttcatgctcactccctgatggcagaggrcaggttgccagcctggctctacatggcagaaagccacttccctgcaagcgttaagtccttctgtcttactctattgcttttctccaaaaataaagcatttttgagagctaaatccggggattgactttcagattaacaatctgcgcggcctttcctcctttccaatccttagtcatgtttatctttggggaacctagaatgtaccaggaaacacacaacacagcttagaaagagaaagtgggggctctctggaactccagacaaggagagagtcctgcggctctgggaaacagacaagca

SEQ ID NO: 44558 - DNA, 601 bp, Human
atcctggcagcagcgggacagcgtctcagctcccccacctcccagtcccctagcacctttctagctcatccggctgtgtggccttgggcaagggcaggaacctctctgagcttcagtttcctcatctacgcaatggggctgtgcgagaacacaagccgttcatggagatgccactcctcaggtggaggctgccagctctgggctttggtgccagctgtcatttatggaagagcaggccgccctgccctggcctcatcagccccagcagcccctctggcttcctcatgggccgtgtgaccgyaggggcttcctgacacacatgggtgcgagtgtcccaggaccagcctctacttgctactgtgctgtcttctcgagtgggaactccactgcaaacatggggaggaagggaaggagctcgctgtgggagtctgggcgcggtggacgttaacaatggggggcgaagtgtcctcccacggtgggtgcactgtctgtgggaaggctgaccacgctgttagcttttcagggatcttggttggcctcctgagtctctactcaatggacagggtccagactgcactttacattttgccaacaagaaatg

SEQ ID NO: 44559 - DNA, 601 bp, Human
gattggattctggtcacatgtgccctgtggttctaggatctgtctgggagatcaagagtcctcggccttagtaaaatgtcgagcctcgtatcttttataaggttttgagacaaaatcctgagctctctcccagggtgagcaggaatcagtctcccttggccatagctcggactgggagcaacaggaggccggggctgctgagccggacagagggaggaggcaggcctggctggcacggggggcggccgcatcctggcagcagcgggacagcgtctcagctcccccacctcccagtcccctrgcacctttctagctcatccggctgtgtggccttgggcaagggcaggaacctctctgagcttcagtttcctcatctacgcaatggggctgtgcgagaacacaagccgttcatggagatgccactcctcaggtggaggctgccagctctgggctttggtgccagctgtcatttatggaagagcaggccgccctgccctggcctcatcagccccagcagcccctctggcttcctcatgggccgtgtgaccgcaggggcttcctgacacacatgggtgcgagtgtcccaggaccagcctctact

SEQ ID NO: 44560 - DNA, 601 bp, Human
gcccaaccacacatattttaaggatctaagtcgtttagggaacagttgcttaccttcacgctgtggggtgttcaagagaagattagcaaacatcaagcaaatcaaggtaaggaggctcctgcctacacgggtttggaggactcggaccctggggggctgtgcgctgtgtaggtgccggtccccggaggccccggcctgcgcctttgctgggggctccttttgctgattgatttgcacagattggattctggtcacatgtgccctgtggttctaggatctgtctgggagatcaagagtcctyggccttagtaaaatgtcgagcctcgtatcttttataaggttttgagacaaaatcctgagctctctcccagggtgagcaggaatcagtctcccttggccatagctcggactgggagcaacaggaggccggggctgctgagccggacagagggaggaggcaggcctggctggcacggggggcggccgcatcctggcagcagcgggacagcgtctcagctcccccacctcccagtcccctagcacctttctagctcatccggctgtgtggccttgggcaagggcaggaacctctctgagcttc

SEQ ID NO: 44561 - DNA, 601 bp, Human
tcagagacagagcttataaacagcgggcctggcattcgtcctgggtctggttccaggtcctcatgagccgacgggacactccccactccctggaggtctcctgggcatcccctcccgtggctccagggatctccccccgacacccacgtctgcttgactcctgctttagctccctgagggccccaacccctgggcatgagcaagttggactccagctgggccctgccccagagtcaaggtcagtcgcctgctccagggcccctgaaccagcccaggcgcagcccttcctcaagcacctccrgcttcacatgcatctcggaggaaatccacgcgtaaatgcgggtgggcaatgccacctgagcccctgcacgcctgctgggacagagcacgtccagggtacagtgcggctgagccagaggcggcagccacccttgtactcagcttagttggggattctgggagcccttagtccccgctcagtggagctgagcagagggtaccttaccagcttaaaaattttggaaagcgtgccctgggcatcgactcccttgaatcccttgtgagccgatttatagtcggacgctctgcctccgtagccaaa

SEQ ID NO: 44562 - DNA, 601 bp, Human
gccagccgcgttttgtgtttgtcactaccttttactttcacagcgattttgtgagctgagtgggcgggttacctccattttacagatgagaaaaccaagtctcagagacagagcttataaacagcgggcctggcattcgtcctgggtctggttccaggtcctcatgagccgacgggacactccccactccctggaggtctcctgggcatcccctcccgtggctccagggatctccccccgacacccacgtctgcttgactcctgctttagctccctgagggccccaacccctgggcatgarcaagttggactccagctgggccctgccccagagtcaaggtcagtcgcctgctccagggcccctgaaccagcccaggcgcagcccttcctcaagcacctccggcttcacatgcatctcggaggaaatccacgcgtaaatgcgggtgggcaatgccacctgagcccctgcacgcctgctgggacagagcacgtccagggtacagtgcggctgagccagaggcggcagccacccttgtactcagcttagttggggattctgggagcccttagtccccgctcagtggagctgagcagagggtac

SEQ ID NO: 44563 - DNA, 601 bp, Human
tcatgtgcctccccttttgcttaatgagagccgctgtctaagagttaagggttttctgggtgacgtttaacaataataaaggtgactgcttatctaaggaatccgagccgcgcacctgccagccgcgttttgtgtttgtcactaccttttactttcacagcgattttgtgagctgagtgggcgggttacctccattttacagatgagaaaaccaagtctcagagacagagcttataaacagcgggcctggcattcgtcctgggtctggttccaggtcctcatgagccgacgggacactccycactccctggaggtctcctgggcatcccctcccgtggctccagggatctccccccgacacccacgtctgcttgactcctgctttagctccctgagggccccaacccctgggcatgagcaagttggactccagctgggccctgccccagagtcaaggtcagtcgcctgctccagggcccctgaaccagcccaggcgcagcccttcctcaagcacctccggcttcacatgcatctcggaggaaatccacgcgtaaatgcgggtgggcaatgccacctgagcccctgcacgcctgctgggaca

SEQ ID NO: 44564 - DNA, 601 bp, Human
ctcccagagcctttggcttcacggttccctcccggccctgcctggagcttcatgtgcctccccttttgcttaatgagagccgctgtctaagagttaagggttttctgggtgacgtttaacaataataaaggtgactgcttatctaaggaatccgagccgcgcacctgccagccgcgttttgtgtttgtcactaccttttactttcacagcgattttgtgagctgagtgggcgggttacctccattttacagatgagaaaaccaagtctcagagacagagcttataaacagcgggcctggcrttcgtcctgggtctggttccaggtcctcatgagccgacgggacactccccactccctggaggtctcctgggcatcccctcccgtggctccagggatctccccccgacacccacgtctgcttgactcctgctttagctccctgagggccccaacccctgggcatgagcaagttggactccagctgggccctgccccagagtcaaggtcagtcgcctgctccagggcccctgaaccagcccaggcgcagcccttcctcaagcacctccggcttcacatgcatctcggaggaaatccacgcgt

SEQ ID NO: 44565 - DNA, 601 bp, Human
cagcctttggacttcctggaaagtggtagaaccactgtcctatgaaacaaagtgcttctgtgctgaaatggagtaagttccctgcagcctctggcaaggtaacctaccgaggtacaatcttaactttcttgatgcccccttttgacattgaaaatggtgggtgtattggttttactttttatcattgaaactacaatttgttgagcactgaccatgcaggaaacccgtttttccccgttttctcttttgtgctcacagcacctcctggagtaggtgttcctatcatcctctctttatagcycaggagccaaagctcagccagcccgaaggagccaggattagagcctgcatggatgcaacagtcacgcttctctctattacgtgtcttgcaacttggagtcacatgatctcagcatctgatccaccctgggctcaggtcagtataaggctgaactcacaaggtgagggttagactgacctcctctctcaggacaggaaaagaacagagcctactgcaaaaggcagatactcttgcctccactttgacatctcacaactccacagcaacactacaggtgggaaaacattcacatgtatgttc

SEQ ID NO: 44566 - DNA, 601 bp, Human
gtgtggaggtagccaggcgtggccatccctctagaaagaggaatgcgttggtcactcagaatgtcacttagatcgacgaagcagaactgcactttttttgcattcaaatttttattcaaagtttagtctctctccttgggtttcccctcttttatgaaatgatcaattttggcgaagagcccccagaaagcaagatagaaaagaaatatgctctttaccgtggccgatcagcaacgaaccaacactgtcctcatctaattctacgtcttccacactgcccagtaacacaaataaccagagygcagacgccaagaatccttccaagtaacgcagctaacagaccaaggtgacagttctgacttcttggggggttttccaagtacatacgtagcattataaacaagcctctatgttgtgcttacacaactcactcaagggatttttgttttcacaagtgaaaacgtttatgaaatgctagcctgcgaagccgcttcaggaaccatctagtgagatttccctcccaagacaggcagctttctcacataccgtggaggcctcctgccggcctggggactgacaggtgcagggccctgcccctcga

SEQ ID NO: 44567 - DNA, 601 bp, Human
cacggcgaaaagaaagtccaagggtggaggggtgaacgtggagggacgtctgtgcacctggccccctgaagacccacgtgcgtctgggggcacattgcgggggaaggaacgtgatcttcacacagaaagggacagttttaaccgttttctgttttcatgttctcatttaactgttggccggaaattgccggtaggctgccgtggcctgaccctactacgtgcacaactccgcaggcattaggggaggggtcatctgctctaattaggtaacaggggcaagtgggattaaagttttaaggcrgttatattaagaagctgaggacaggattccggaaccaggtgggttttcagcgtctagccatgggtgatccagagcgactatctcttcctccctgaaaaggaagagagaggagttaggacgagagtgccgcagggtcctcccacaccagcatcccctcttctgtggtcccgggtggatgctgagccattgggtgtctctctcatctgctaatagaaatggcaccccggagagctggtcttttcattccatttctcccgacctccctcagcaaatgctaattgaatttccagttctgtgaga

SEQ ID NO: 44568 - DNA, 601 bp, Human
cctcgatcaccaggtgaatgaacccacacactgcaaaccagcacagggacagtcgccgccaagtccccaatgggacaaccgcagcacgacctgacaacagccatgtggtcacgactaagacccctgtgacagagaagaggccagccagtatatgccaggtggggcggtcattaggtacaaagttgtccagtcttaggtgctgaggccagtatgggtgcaaggggcccgcgttggtagtcatgtctttgtgggctgatggctgcgtgtgtataggcaggaagttaaaaaaaaaaaaaaaaaaggaacagaaaaacctggacaaatagaaagtacagaatgagataataaaatcaaattcaaatagtttattatcatgagaaatgtaaatggaccgaatttaccagttaacagacaggattgtaacacttctaattacattccgtttttttttttttttttcagacggagtcttgctctgtcacccaggctggagtggagtggtgcgacctcggctcactgcaacctctgccttccgggttcaaacgattctcctgcctcagcctcccgagtagctgggactacaggtgcctgccaccacgcc

SEQ ID NO: 44569 - DNA, 601 bp, Human
aaatcaggactcacagagttgagataagaaggcttggtctccaagcaggtcttcgtagtagagaacgaaccagccctcgatcaccaggtgaatgaacccacacactgcaaaccagcacagggacagtcgccgccaagtccccaatgggacaaccgcagcacgacctgacaacagccatgtggtcacgactaagacccctgtgacagagaagaggccagccagtatatgccaggtggggcggtcattaggtacaaagttgtccagtcttaggtgctgaggccagtatgggtgcaaggggccmgcgttggtagtcatgtctttgtgggctgatggctgcgtgtgtataggcaggaagttaaaaaaaaaaaaaaaaaaggaacagaaaaacctggacaaatagaaagtacagaatgagataataaaatcaaattcaaatagtttattatcatgagaaatgtaaatggaccgaatttaccagttaacagacaggattgtaacacttctaattacattccgtttttttttttttttttcagacggagtcttgctctgtcacccaggctggagtggagtggtgcgacctcggctcactgcaacctct

SEQ ID NO: 44570 - DNA, 601 bp, Human
gaaagctctttatgaaatcatgaggagtgacctcattaaaaaaagcagctgggtgcggtggctcatgcttgtaatcctagcactttgggaggctgaggtgggcagatcacttgaagccaggagttggagaacagcctgggcaacaaagcaagacgccatctcttaaaaaaaaaagttgttaaaaaaaaaataacttggtggggtggcacatgcctataatcccagctactagggaggctgaggcaggaggattgcttgattgcccaggagttcaaggttgcagtgagctataatcatgccwctgcactctagcctgggtgacagagcgagaccccgtctcaaaaaagaaaatggcttctttggttttcttgtaaggaaagaaagaaaaagagaaaagattagaagtatatatagcatattaccatttgtgtaaaaagggaaaagtgcaaataatgataataatagtgaacagttacatggcaaccactgtttgccaaacactgttctaagtatcttacatatagttggttattactattatcctccttttacaattgagcaaattgagacttacgtgtgtaaataaactgaaaagaaacat

SEQ ID NO: 44571 - DNA, 601 bp, Human
tttctgggggggaaaaaaaacacacaaaagttttctggtactgcattatatataccactgtaattatatgcgtcacattttacagtatgggtcataacataaaccttatgtatcaaaaacaggatatgttaagcatatgagtatcacagtaaacagttttatggcatacgatttatacgcagtatattaaatcatattacatgttaaagcaatatagttatataacccacacagcacaacatatatagtatactttaccatgtcgcaactatatgactacacaattaacttaaaatgctawatttcatactcattttaggtacacattagtaacagcaaggtgtggtatgcatgaacacccaggcgctgagttcttaaggagagggaagcaataggagaacatcccagccctttggctacccacctgccattatagtctctggaacgtccatatccatatccataccctccaggtcgactgtcataatacctgccactcccatagccctggtccccaccacctagagcagaaaaatatttaaatggcagttgtccacacataggcaactctccctctcaccccatgatcaaaacgatcact

SEQ ID NO: 44572 - DNA, 601 bp, Human
tcctggtgcagtatgtggacacgctcaagctcgcagtgccctctctcatctacaccttgcagaataacctccagtatgttgccatctctaacctaccagctgccactttccaggtgagccccaagcccagcatggccccagaggaactaactgggttggggactggagtatgggaatagcgtggtgggggggtgttgcagaggacaggggctatgtcaccttcagaatgtccttggaactccttcaacctcccttttctcgtctgtgaaaattgggggtggaaatagtaatgcctgttcaytgagatgctaggatacttaaaagaaataatacctgtgaagagcccttgattggtgacagataagctttaggctatttgtgggcagctttgtgaaatggttaaagagcctggattctggggccaggctgtctgggttcaaatctcagctctgctaccttccagctgtgtgattttggggcacgtcacctaacctctctgtgccttagttttctcacctttaaattggggcttacagtggtgctcacttcagaatggtgttgtgagaattaaatgaatgaattcacgtgcagtgcctagaac

SEQ ID NO: 44573 - DNA, 601 bp, Human
aaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctrccagcctagcccagctttgtgtttttctttcctccccattcccaccacaggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctga

SEQ ID NO: 44574 - DNA, 601 bp, Human
tccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcaggtgcggggccgcctggggctgggagtgccgactggggctcccaggggcctgatctcgggggcagygggggccccggactgggattggaggccctcggcctagccttggaggacgtcggggcgcccgtcttgggggggcacctaaggaatccggcagtggcctgcttggattgtggctttattaaaggagtcgtgggagtgcattaagcggggtctgggtcaggtttggggagcccttgactgcgtctagcggggcctattctggagtatccagaaactggtctgagatagctgaacttggtagacagggtctctgattagaggctgaattcggggattttcagtcggacatgaggggaatgaatt

SEQ ID NO: 44575 - DNA, 601 bp, Human
gttcgtgctgttggaggagcgcaggccggccgactcggctcagctgctcaggtgcggggccgcctggggctgggagtgccgactggggctcccaggggcctgatctcgggggcagcgggggccccggactgggattggaggccctcggcctagccttggaggacgtcggggcgcccgtcttgggggggcacctaaggaatccggcagtggcctgcttggattgtggctttattaaaggagtcgtgggagtgcattaagcggggtctgggtcaggtttggggagcccttgactgcgtctagmggggcctattctggagtatccagaaactggtctgagatagctgaacttggtagacagggtctctgattagaggctgaattcggggattttcagtcggacatgaggggaatgaatttgaggggacactgtcaggtgaggcactggttttaagggaatcctagaatcttttttccctcagtgtgggagaaggggtcctgagggacagaagtgctgtcttgggagcttggtgcctctcagtgactggttgctgtgtttggggataacatgaatctggagggatttggaggtatctcagatatg

SEQ ID NO: 44576 - DNA, 601 bp, Human
tggctggggctgggagaaactcatttgtgaaatggtagatctttacgtcaagtgaattatttccagttctctttgtgatgcattcagtttgtgttacaagggactgttatgctgagggatgcccctacttgctctgtgtgtgtgtgtgtgtacacacatatacctgggctcacattcagctgtaaagaaaatagcagggggttggccgggcgcagtggctcacacctgtaatcccagcactttgggaggccgaggcaagcggatcttgaggtcaggagatcgagaccatcctggctaatayggtgaaaccccgtctctactaaaaatacaaaaattagccggacgtggtggcgtgtgcctgtaatcccagctactcgggaggctgaggcgtgagaatcacttgaacccaggaggcagagcttgcagtgagctgagatcgcaccactgtactccagcctggtgacagagcgatactctgtctcaaaaaaaaaaaaaaagtagggggtatgggggctgggagaactctgaataggaagtcaggaatccttctataaagtgaattgttattcctaaattctgttttcctcaaacccaggttgtt

SEQ ID NO: 44577 - DNA, 601 bp, Human
tgttttattttatttttaccttttttttcttttaagacagagtctcactctgtcaccctggctggagtgcagcggtgcgatcttggctcactgcagcctctgggttcaagcgattttcgtgcctcagcctctcacgtagctgggattacaggtgtacgccactacgcttggctaatttttgtatttttagtagagaccgggtttcaccctgtgagccaggctggtcttgaactcctgacttcaagtgatccacctgccttggcctcccaaagtgctggaattacaggtgtgagccaccacrcctggccttgaagcataacaaaagttttcaaacttgctgtgggttataacaagtagttggatctcgtagtgattggaatataccaagtgaactgtgccaggaggcagagtccttctagtcagtagataaaactttctagagcaagggatataccattgtaacattctggttttgaacactccaagagtctcataacttgctttattatatttatttatttattttttgagacaaagtcttgctctgtcacccaggctggagcgcaatggtgctatctcggctcactggaacctccgccta

SEQ ID NO: 44578 - DNA, 601 bp, Human
cgtctcaaaaaaaaaaaaaaaaaaaaaaagagattaaaactcatgaagaagtgggatttggatatactttattttatttgtatttatttatttatttatttatttatttatttattttgagatagagtcttgctctgttgcccaggctggagtgcagtggtgtgatcttggctcactgcaacctctacctcctgggttcaagcaactctcctgtttcagcctctcaagtagctgggactacaagtgcaggccaccatgctcggctaattttttttgttgttttgtatttttagtagagacrgagtttcaccatgttggccaggctggtcacgaactcctgacctcaagtgatccgcccgcctcggcctcccaaagtgctgggattacaggcgtgagccactgcacctggccctgggtatacttaagattgacgtgctcctctggagtatatccaggaaagtgtgaaggagaggaaaaaaaaaaaaactaggctgacataaagcagtgctaattgaatagttggataagaatctcctgagagaacagaatgtgcaggaagatactggagtcaggaccttggtccacagcagcaggagaccct

SEQ ID NO: 44579 - DNA, 601 bp, Human
gtcttggccccatggccctacactttaccccaggtgagccctgtgcctaccaggtctagagatgggcctgattctgaggggaatggtttggacatatggaaatggaggctgtttgtcccctttccccctatggcttgtggtcttgctttcaccccacttcagttcctctcgtcttggatttaacaaccagcctatcaccatggcttaaaatagtaaaaagaaggcactttttaaaaaaggcatttcccctgcttttggctaccaaaccctaccttagtatctgcatgtgtttcttgccttmctgtgctcagaggccctgatcactccactcttttccagagaccgaggcaaaggcccttttgaaggaacggcagaagaaagacaatcacaacctaagtaagccagagagcgtgtgcattgcccgggtgctgtgcaggcctgcctcaccccgagtcctggccccccatggggaactccttccctgcaacagcctcccaactccctactttctgtctcttccatttttggctaattgacaactctttctcccactctttcttcctctcctcccctctccaaagttgagcgtcgcaggcgattc

SEQ ID NO: 44580 - DNA, 601 bp, Human
accgcgcccagcctctaattttgtatttttagtagagacggggtttctccatgttggtcaggctggtctcgaactcccgacctcaggtgatctgcccgtctcggcctcccaaagtgctgggattacaggcgtgagccactgcgcagggccacatttaggctttttattggctggttctaggtgcttggtgatgctgacaaaacacatgataacactaagtccttttgtgctaggtcctttgtaataaatcactcagctgtttaacaaattaggtatattgaccacctactatatgacagayataattctagacactcagcaaagtattacataagtattgagagctcattttgtgctaggtccttttttactaattgttttcacctgtttaacaaatatttattcagccctactctgttagcagccactgttctagtgcttcatatacgtccgtgaacaaaacaaaccattacacaataagtgtttattgagtgctaactgcttgtcagagcccatgctattaagtgctgtcatctgtttaacatttattgatcacctgtgtaaggtactattctaatctgggatatgtcagggaacaaaa

SEQ ID NO: 44581 - DNA, 601 bp, Human
gcagggccaagaaaatccccacctgccaggcctcagagattggaggctctccccgacctcccaatccctgtctcaggagaggaggaggccgtattgtagtcccatgagcatagctatgtgtccccatccccatgtgacaagagaagaggactggggccaagtaggtgaggtgacagggctgaggccagctctgcaacttattagctgtttgatctttaaaaagttactcgatctccatgagcctcagtttccatacgtgtaaaagggggatgatcatagcatctaccatgtgggcttgcartgcagagtatttgaattagacacagaacagtgaggatcaggatggcctctcacccacctgcctttctgcccagctgcccacactgcccctagtcatggtggcaccctccggggcacggctgggccccttgccccacttacaggcactcctccaggacaggccacatttcatgcaccaggtatggacggtgaatgggcagggaggagggagcaggtgggagaactgtggggaggggccccgagtcaggctgaaccacagcccacatgtgccccccagctctcaacggtggatgcccacgcc

SEQ ID NO: 44582 - DNA, 601 bp, Human
tcgtatgtataataagaaacgtttgtgctgttatttacccccattttacagacaaggagactgaggccaaagaggttaagtgtcttgatcaaaatctcccagttcctgagtgacagagctgggatttgaacccatgtagccaggctctagaatctgcactcctgctttgccctgctactcctcatgccaacatgccagccttattccactgttcccaaagttctagctcctctagatggctgctgctgcctcccctcagtccccccatatgtctctctctctctctctctctctctctctytctctctctctcacacacacacacacacaaatacacaccacactacacacaacccttagcagcaaccccacatgtcctgtcctccttgcagccaggcctttgcacaggccgtccctccacccagaatgctttgcccactctcacctccctggcccattctcaactcaccacacttccaacattatctccagcactctggccaggctcaagtggtgagttcaggcctgacatgcagtaggtgctgaggggcatgtgttaagggaacgaggggtgtgagagggagactgaggtagagagggg

SEQ ID NO: 44583 - DNA, 601 bp, Human
acaaaccctctgaccccggctgggcgtggtggctcacgcctgtaatcccagcactttgggaggccgaggcgggtggatcacgaggtcaggagttcaagaccagcctcgccaagatggtgaaaccctgtgtctactaaaagtacaaaaaattagccaggcgtggtggcaggtgtctgtagtcccaactacttgggaggctgaggcagagaattgcttgaacctgggaggcggagtttgcagtgagctgagatcataccactgcactccagcctaggcgacagatcaagactccgtctcaagaaaaaaaaaaaaaaaaaaccctctgactctaagatccccaaacactgtgatcctgagttgttaaagcaaatgcaaatagccagacttgccagatgcaggctgtgtgccagcaggaccagctatgtaacctgcagggccccttgttcagatttcaagatggcgaccacagagcattaaacaaagcacagggtgccacataaccacataggtcacacgcccatgaagccagccctggaggccaggcactgtttctgagcgctttgctggtggtaatttatttctcatgatgcgaatgtacaga

SEQ ID NO: 44584 - DNA, 601 bp, Human
ctggcttcctgctccacggctggaggtaagtggcgcccctaaagggcctcgcctttgtcagagctccgccttcggggggaaatccaggagccttacgccacgcccctacgcttgagctccgcctacagagggatctcagttgggaaaagagcctcaggctcagattcagagccccgccccctgactcattccccaaagtcctttcccaggagagctccacccactacgcagccccgcccccagaagtgttctcccgtagccgcggagtcgcatccctagggagattcttcgtctctaactytgagcgccgccctctggcctccagcacccctcttagactcagacctactctcccaggcccagcgtcctatcctcctgctggagccctgcacccaataaacagagcctacagcccccagactcaggccctacccacaggctcagagcccacaagttcagagcctcaccacaggttagatgcctgtgtctagtgaaagttcccccacaaagcatcccactccccacgacctgtcctctggctcacagcccagccacaccctggctcataggcccacctcctgcagccccgcccccaggccca

SEQ ID NO: 44585 - DNA, 601 bp, Human
aacacaaaataacatatctgcccacgggcacggtggctcacgcctgtaatcccagcacttcgggaggctgaggcgggcggattacttgaggtcaggagtttgagaccaacctggccaacatggcaaaaccccgtctctactaaaagtacaaaaattagccaggtgtggtggtgcacacctgtaatcctagctactcaggaggctgaggcaggagaattgtttgaacccaggaagcggaggttgcagtgagctgagatcgtgccactgcactccagcctgggcaacagagtgatacttctcaaaaaaaaaaaaaaaaaatctgcccaggcagagggtagattctggaaaggaggaacacccaataagcaaacctgtaaatatatgtcagatggtgtaagggctatggaattaaaaagcaaggaaggtggggtgaagaaagagagagggaaggagagagatgctagaattgtaaatagggtgcccagaataagcctctgtgagaatttaatggttgagctgcccgaaaggaggtgagaagtgagccatgcagacatctaaggttacagcgattcacacaggcaaagggcatggctaatgccaa

SEQ ID NO: 44586 - DNA, 601 bp, Human
aatctgcccaggcagagggtagattctggaaaggaggaacacccaataagcaaacctgtaaatatatgtcagatggtgtaagggctatggaattaaaaagcaaggaaggtggggtgaagaaagagagagggaaggagagagatgctagaattgtaaatagggtgcccagaataagcctctgtgagaatttaatggttgagctgcccgaaaggaggtgagaagtgagccatgcagacatctaaggttacagcgattcacacaggcaaagggcatggctaatgccaaggccctgaggcaggcrtgtgcttggcatatgtaagggatggcaaggccagtgctgctggcgcagagtgagcaagggggagaccagctggagatgaggtcagagatgtggcaggggctatggagaggactttggctttgcctgtgaatgaagggaagtcgcaagagggttgtcagcagaagacagcctggaggaataagggtggaatcaggagaccagtgaggaacctgatgatgatggcactggcagtgcaaggagttatatatatatggagagagagacagacagacagacagaaaggccggcatggtggctcac

SEQ ID NO: 44587 - DNA, 601 bp, Human
atcacttgaggtcaggagtttgagaccagcctggccaacatagtgaaaccccatctctactaaaaatacaaaaattagtctggcatggtggcaaatgtctgtaatcccagctactcgggaggctgagccacaagaattccttgaacccaggaggcagaggttgcagtgagctgagattgcaccactgcactccagcctgggcgacagagcaagaccctgtctcaaaaaaaaaaaaaataggctgggtgcagtggttcacgcctgtaatcccaccactttgggaagcctaggcaggcagatygcctgaggtcgggagtttgagaccagcctgaccaacatggagaaaccccgtctctattaaaaatacaaaaaaattagccaggcgtggtggcacatgcctgtaatcccagctacttggaaggctgaagcaggagaagcgcttgaacccgggaggcggaggtttcggtgagcccagatcatgccattgcactgcagcctgggcaacaagagcaaaattccgtttaataaataattatttaatatatatatatatgtgtgtgtatatatatatacacgtatatatatacgtatatatatacac

SEQ ID NO: 44588 - DNA, 601 bp, Human
ctgtaatcccaccactttgggaagcctaggcaggcagatcgcctgaggtcgggagtttgagaccagcctgaccaacatggagaaaccccgtctctattaaaaatacaaaaaaattagccaggcgtggtggcacatgcctgtaatcccagctacttggaaggctgaagcaggagaagcgcttgaacccgggaggcggaggtttcggtgagcccagatcatgccattgcactgcagcctgggcaacaagagcaaaattccgtttaataaataattatttaatatatatatatatgtgtgtgtrtatatatatacacgtatatatatacgtatatatatacacgcgtatatatatacgtatatatatacacgcgtatatatacgtatatatatacgcgtatatatatacgtatatatatacacgtacatatacgtatatatatatacgtatatatatacacgtacatatacgtgtatatatatacacatatacgtatatatatacacatatatacgtatatatacacatatatatacacatatgtatacatctatatacatatatataaaataattattttacgtatataatttacgtaaataa

SEQ ID NO: 44589 - DNA, 601 bp, Human
aagggaaaaagaaaagtggatcagtagactgggcgcggtggctcacacctgtaatcccagcactttgggagaccaaggcaggcggatcacttgaggtcaggagttcgagaccagcctggccaacatggtgaaaccctgtctctactaaaaataaaaaattagctgggcatagtggtatgcctgtaatcccagctactcaggaggctgaggcaggagaatcgcttgaacccaggaggcggaggttgcagtgagcctagatcgcgccactccagcttgggcaacagagaaagattccgtctcaaaaaaaaaaaaaaaaaaaaaaaggtgatcagcagctggaggaggaagtgaggtcaatacatgcaggaaccctcagcgtgtttgggagctgggagctgagggaaatgatccgcctttaggaaggagagatgagggagtcagaaggtccctcctaatgcctttcattttctgagaaatggggacccgccatctcactgcatcccaactcacctctcatttcagttgttttctcccactcctatgtcctcccaggtatatcaatttttcagctgcctcccagaggacaaggtcccctacgtca

SEQ ID NO: 44590 - DNA, 601 bp, Human
tagaaagacctagaagtaaacttgcggggcatggatgaagtctggaagaggggcagggacaggcatcaagggaggagcctgggagatgccttctcctcccaggcacagtactgcacagcactggaagaggaggaaaagaaagagctccgagcctttagccagcagcggaagcgggagaatctggggcgtggcatcgtgcgcatcttcccggtgaccatcactggggccatctgtgaggaggtgagccgtggagggcctcagcgagtgagcagtgcctctgctccaagccctggggagcagracacatcttccaagcactgggaagatgaggcctgccacttaagccccagtgaggtgtctctagggtcccctcttgtgggcggggtctgttcctcacatctcactgttgggcagggactgtctctaaggcaacccctggtggacagggacctgtcccatcaatcccactgtcgtgtggggtttgtctgtaaggaggccttagtgtgtttttctccccgtctgtgcagtggacatggggcatgggctatctctttggtcctcctgtggtcagaacttgtcctcaagagctgacccacagtgg

SEQ ID NO: 44591 - DNA, 601 bp, Human
ctcaaaaatcacccccaagcacaagcctttcctgattactcaatctaaagtcatattccttccttcacccatttaaaataaaattccttagtaagagaatgtattagtaggcaccaatttgtttactcatttattgtcaattcctcaaccaaatgtagtccacaagaactgtttcatcctgtatggtctctagtcccttccaccattagtttacttctgattacgagaggctagaaacaaatattttccttttatctaaaacaggtgaatccaccatgttaaaacacacacacacacacgcacacacacacacacacaagtttggtttttttaaaaaaaacttttagatatggggtatcactttgtgacccaggctggagtgcagtggcagaatcacagctcactgaatcctaaactcttgggttcaagtgctcctctcgccctcagcctcccaaatagcttggattacaggcacatgcctggctaattttttaatttttttcagagatagggtcttgctgtgttgcccaggctagtcttgaactcctgggctaaagtgatcctcctgcctcagtctcctgagtagctgggattacaggtg

SEQ ID NO: 44592 - DNA, 601 bp, Human
cttttaatcttccagtctcaaaaatcacccccaagcacaagcctttcctgattactcaatctaaagtcatattccttccttcacccatttaaaataaaattccttagtaagagaatgtattagtaggcaccaatttgtttactcatttattgtcaattcctcaaccaaatgtagtccacaagaactgtttcatcctgtatggtctctagtcccttccaccattagtttacttctgattacgagaggctagaaacaaatattttccttttatctaaaacaggtgaatccaccatgttaaaaaacacacacacacacgcacacacacacacacacaagtttggtttttttaaaaaaaacttttagatatggggtatcactttgtgacccaggctggagtgcagtggcagaatcacagctcactgaatcctaaactcttgggttcaagtgctcctctcgccctcagcctcccaaatagcttggattacaggcacatgcctggctaattttttaatttttttcagagatagggtcttgctgtgttgcccaggctagtcttgaactcctgggctaaagtgatcctcctgcctcagtctcctgagta

SEQ ID NO: 44593 - DNA, 601 bp, Human
agtctccttattcctgaatcttcaaatagctggttacttttaatcttccagtctcaaaaatcacccccaagcacaagcctttcctgattactcaatctaaagtcatattccttccttcacccatttaaaataaaattccttagtaagagaatgtattagtaggcaccaatttgtttactcatttattgtcaattcctcaaccaaatgtagtccacaagaactgtttcatcctgtatggtctctagtcccttccaccattagtttacttctgattacgagaggctagaaacaaatattttcyttttatctaaaacaggtgaatccaccatgttaaaacacacacacacacacgcacacacacacacacacaagtttggtttttttaaaaaaaacttttagatatggggtatcactttgtgacccaggctggagtgcagtggcagaatcacagctcactgaatcctaaactcttgggttcaagtgctcctctcgccctcagcctcccaaatagcttggattacaggcacatgcctggctaattttttaatttttttcagagatagggtcttgctgtgttgcccaggctagtcttgaactcctg

SEQ ID NO: 44594 - DNA, 601 bp, Human
tcggagggtggttttagaaaacagacatggcctaagacaataagacctagatatcactcacaattaagtattctctatataatatacaactatttctagaagtcatgagatggtcacacttaacagatctggttccatggatttggtagctaaacgcaagtctcaaactggccttttaaagttatcctttatttcaacctagttgtttaaatggaatcatcataaaccaacctaatttcatagataaagtctgagtgaaagtaatttgtccaaagtgacacagctaggtccttatctcccrtctactaatgaaaatataaatttcagaaggccgtattttctcttcatataattacgaatattcccttggtcactcaaatctcaactccatccctccttgctccaaacacatagactactctcagacttcaaacgcctcattgacaagctaatccctccatctgaaatgcatttctctattgccctgtgaactcctttcattcaatcatgtcctaagggaagttgccctgaaccctcaagattaagttgaatacctattcactgatgcctgtgatgtcctgcacttcctctttgtctaaga

SEQ ID NO: 44595 - DNA, 601 bp, Human
tcagtttttccctcactggtcatttagtactacacaaaaaaatcctccctacagctaaaggtattacataaacttttgtaaagcactctaaggatacctgagagttcacatgttttaaaataagggatttctgtctacttgtcccaatattcttataacatgaaatttacaataaatgatacaggcttttaaagtgaaacacaacacatttagcttatgttttataattaagctttcctaaattataaggataaaaactgccaggaagtagtgatataatcagtggaaaaacaaaaaaagactcagttttctgaatgagaaagactattgtgaatatcacaactaacagataaaggtgttactatttactttgaaaagaaatttgaatgaccttagacttattactatttaaactccaaaacactgtaaattaacaaaaaattgttaaaaattatactgctgcagctctgtataaattaattactaatgaattccaaaataattaggataactactaacaggcatctgaaatgaatgaagcatttcattacctttaattcccacggacggggctcctccagctacagcagccaaagcatat

SEQ ID NO: 44596 - DNA, 601 bp, Human
tttttaatgaatatgtacaagataacatccgacttctcttattacaattaagagttcttgcagctgtttatgtcattatggagaagaaaaatatattggcttatttgtctgacttttcccttaaagcagaatgtctttgttgctattgttttttgctttggttgtaaagagggaatacatgataaagtaactggtttaatttctttcattgtacactggttctgaacatctaattatttttagttgtctaaataaaatgcctctgaaacaaaaaataaaacaaatcataacatatcatgtmataacaatgtgaaatctttggaagactcattaatatataaaagaaaaatgaaaaagtgctttaagagcctaagattaagtttaccatttaaatccaggcctaagatttttaataaccttaacgttacgtgaaaaatgtactgtgaaggctcatctgttaaacggagttacgaagttttttattattattcagccataaaaaaatgaaatcctgtcatttgcagcaacatggatggaactcgaggtcattatgttaagcaaaataagccaggcacagaaagataaatattgcatgttgtca

SEQ ID NO: 44597 - DNA, 601 bp, Human
ccatctattcttcaactcctcaagttaaggcctgaacatcaagcatgtgccacagacagcatacaactggactagaacgagcaagcagagaaaagcatcagccttccagagttactctctgcttaaggcaaaaacagcaataaataatgaggaatatgaattagctccattgctggaacaactaacatggtgttacccataagtgaaatctcaagagtatcagatgaagggaggttgagttatcctcttgtagtacaatggcctgtcatctttttaatgaatatgtacaagataacatccracttctcttattacaattaagagttcttgcagctgtttatgtcattatggagaagaaaaatatattggcttatttgtctgacttttcccttaaagcagaatgtctttgttgctattgttttttgctttggttgtaaagagggaatacatgataaagtaactggtttaatttctttcattgtacactggttctgaacatctaattatttttagttgtctaaataaaatgcctctgaaacaaaaaataaaacaaatcataacatatcatgtcataacaatgtgaaatctttggaagactcat

SEQ ID NO: 44598 - DNA, 601 bp, Human
gtttctgttatatgtagaaaaatatcaaacctgaatttctaccttcaggacttcagttggctttggttttgtttgtttaaatgtattttattttcagtagtcaatgtcagaatagaaatttcaaaatcttttgctgtcactagtagaaataaatgctttcctacgttttgtaagctaatggcttacaaaaacctgtatttactctccagaaactttatcaatttttttctaattttaacataccactttgtttctttttttatagtgtttctcgagattttaaaattatttttcttaaaaattcttactctctttttattaaaaagatgaagagattggacatagtcattgctcatatgatataatatatgttgtaaaccaaattttgtcttctgtaggtggccatttcctagcctcttgataagcattttagttttgccagtttgaaaatctttctacttattcttcacctttatattattctttggtagcctatactggtagtttttagtcatattgctcccaatttaggatgaatgttttataaaatctctgttaatatcctgtaaggaaaatatttcctagaaaaataacctaccta

SEQ ID NO: 44599 - DNA, 601 bp, Human
tatgtatttcagtaagtaatacttcagcagaattataccactaaaggcagtgtaagagggtcacatgccccatgattcacatacatggaatcatcaagaatgcaataggtacaatgccaactagtataggtatatagtcagactgcctttgtgtaggtgtctcagataccagaagcagatagtgatatagatgatttattcaaactgatgagtgattgattagatagtattttgaataaaacaaggtacagtctactcttgatttatgtggtacttgattcatagaaaatttagggtatartaagcatgcttaaaaacactttgtgtttatatataaagaatagttaaaaatctagactcaaataattattaataggatttttacttatacaaatttatgataggccactataaagttctgcaggatgtgaaacagttcttcattttgcaggagtatccagcatactgcaggacatctgacattcttggcttctgcccaataaatgccagtactaacaatcaaaaataatcctacagattttcaaaatcctacctacaaagcagtaccaaccccactgagaaccattatttttctcttata

SEQ ID NO: 44600 - DNA, 601 bp, Human
cttatctctgttctttggattcaaaggtaaataaggttttattttgattttacttttttggggccagaaaagctaattgtaaacttaaagaatatgaatcctctttgcaggttacaattaactcagtagctaaaataatcatgtgttaataagagttacattttcagcaaataaataaaaatataattattaaaacataatcagaataaaatattcttatctgcttaaatagttactgtggataaccctaaaatcctaatatatcttcagagaaatctaagaaatggagaaattaattatrtacttactagtgtatataagtgaggaggaaaatatttaatgagtgaaattgcattctgctctagttcattctgtcatttgggtactggttgtggtgttctttctaaataaagtatttatcaccttccaaagagccatagtaaaagtttttagaggattctctattatcctgtttcggggaaaggcaaactttttctgcctaaagcctttgtcacaactactcaactctgccctggtgcaaaagtatccatagatgatatgtaaatgaatgaatatggttgtcttccagtaaaactttatt

SEQ ID NO: 44601 - DNA, 601 bp, Human
acattttcagcaaataaataaaaatataattattaaaacataatcagaataaaatattcttatctgcttaaatagttactgtggataaccctaaaatcctaatatatcttcagagaaatctaagaaatggagaaattaattatatacttactagtgtatataagtgaggaggaaaatatttaatgagtgaaattgcattctgctctagttcattctgtcatttgggtactggttgtggtgttctttctaaataaagtatttatcaccttccaaagagccatagtaaaagtttttagaggaktctctattatcctgtttcggggaaaggcaaactttttctgcctaaagcctttgtcacaactactcaactctgccctggtgcaaaagtatccatagatgatatgtaaatgaatgaatatggttgtcttccagtaaaactttatttatgaaaacaggcaacaggctggatttgtcccatgagccatagtttgccaacctcacacaatgtcttcaaatagaaatacaacagagaaatagctaaaataggattcaagattttatgacttggataatttttttctttgttattatttaagtgaag

SEQ ID NO: 44602 - DNA, 601 bp, Human
atatactcatttatctcactctgaggctgattatctttaatccctatactgttcagctttactgtttaccattcaaggtggagttagtcatgaaacttctaactacaggtgctatgtagtttttagagccatgcatatgaccaaggtcataaattacaaactgctgggccaaggaaagaatgcaatcccaaaaagtttcagtttatctttcatagtatttcataaaatacttacacatggaattttacatgaaaatcctgatgtcttgtttcttaaaaattcagaactaagccccaccccyacccttcccaaccccctgctattttcttaaggcagaaattggttaacacttagtaatggatagcccctttaggtggaagttagactctttaacacagtttcaaccattccatagttgaggtggaaggtcacttgtgattatttggtatttatctttacttttctgctagtgttatatttacggaaggttaagaagagactcgagtatctttttttaccatgtctcaaaaaaacaagggtgttacttgttttttctgtctaggattccttactcatttcctttacttatttggtagacagt

SEQ ID NO: 44603 - DNA, 601 bp, Human
catttgatacttagcatattaggtgtagcttaatgtagtctggatatgattaggcttaatctgtgtacatctttacttaccagtttatatttcacacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggtaggtatttattagtaattacttaatagtttyggaatcagttctcaaagtgatgtttgtaatgcttaaaggttaaaatcagtcctgtgtaagaatcatgagtcttacattaatgaccattattaactattattgagtttttcaagattggctcaagatgacacattgagtaaaccttgtaatcattctcctccccatgaatgtacatgttgtataaaacacctgatatggtttgactatgtccccaccaaaatctcatcttgaattgtagttcccataatccctacatgtcatgggagggacccggtgggaggtaactgaatcctgggggca

SEQ ID NO: 44604 - DNA, 601 bp, Human
tgttgtataaaacacctgatatggtttgactatgtccccaccaaaatctcatcttgaattgtagttcccataatccctacatgtcatgggagggacccggtgggaggtaactgaatcctgggggcaggttttacctgtgctgttctcatgatagtgaataagtctcatgagatctcatggttttataaaagggcagttcccctacgcatgctctcttgtctgctactatataagacatgcctttgctcctcctttgtcttctgccatgatcgtgaggcctctgcagccatgtggaactgtkggtcaattaaacctctttcttttataaattacccagcctcgagtatatctttattagcagcgtgagaatagactaatacagtaaattgatactgggtagtagggacactgctgtaaagatatccgaaagtgtggaagcgactttggaactgggtaacaggcagagattggaacagtttggagggttcagaaaaagataggaaaatgtggaacagtttgggacttcctggatactttcagggctcaggagataggaaaatgtgggaaagtttggaactttctagagacttgttgaatggct

SEQ ID NO: 44605 - DNA, 601 bp, Human
aactgtgagtcaattaaacctctttcctttagaaattacccaaccttggatgtatctttattagcagcatgagaacagactaacagaacaccacagagagattttgtcctaactaaagcaataatattaataccagcgtagcagaaaagtatgacgtggatagagaacagattaatgtgctgcaaaatctcttatgctgtagattgtctcatgctgcagcacagaaagacagagatgaaaagtttagatttataattataaattccatctaataatatacttgcatatgtttttactcaamttcaggatatagagaaaatatctaagttaaaatgtaatgattttaataatctaaaaggaagtttcattttgtattgcctgttttctctaataaaaatactcctgagacagatgaagcttcataatgtgtgagaaagtttcttcaaataggtctttgaagcagaagagaaaagattcttggcagatatagaataagtatttatctcatataagaggaaggacctgataaaaagaaaaacagttagaaattaagactgcatttaaaggatatttatttgactagagtaattgggaaaggcag

SEQ ID NO: 44606 - DNA, 601 bp, Human
tttcttcaaataggtctttgaagcagaagagaaaagattcttggcagatatagaataagtatttatctcatataagaggaaggacctgataaaaagaaaaacagttagaaattaagactgcatttaaaggatatttatttgactagagtaattgggaaaggcagatataaatgaagataaatagaattaggtaaaagaacaatttggagacatatttgtagaaatgactgaggatttgtgtgtgtgtgtgagcgaattattttgtaatggtgcaataaaattaaactaaggttttttgggkttttttttttccaacttgtattttaggctcaagggatacagatttcttatattggcaaattgtatgtccttgaagtttagtataggaatgatcccatcacccaggtagtgagcatagtacctaataggtaattttagaaccctcaccccactcccgacctccctcctagtagtactcagtgcattttgtttccatcttcatgtctgtgtatacgcaatgtttaggtttagctctcacttataagtgaagacatactgtatttgatttcctgttcctgtgttgggttacttaggacaatgg

SEQ ID NO: 44607 - DNA, 601 bp, Human
ttgagaaggatatttcctagaatttttgccaagggtgatattgagaaagatatttcttagattttcttctaggatttttaagttttaggtcttatatttaattctttaatccatcttgagttaacttttgtatatggtgaaatgtaagggtcctatttcattcttctgcatatggctagccagttattccagcaccatttattgaatagagagtttttttcccattgcttgttttgttgacttgctgaaaatcagatggttgtaggcatgcagctttatttctatgtcctttatcttgttscatttgtctgtgtgtctatttttgtaccagtacccttctgttttggttactgtagccttgtagtatagtttgaagttgggtagtgtgatgcctccagttatgttctttttgcttagaattattttggctatttgcactctttcctcattccacgcaaattttagaaaatttttttctaattctgttataaatgatgttgtatgtagtttgatagtaatagtattaactctgtagattactttgggcagtaaggcaattttaacaatactgatttttccaatccatgagtgtacaatgttt

SEQ ID NO: 44608 - DNA, 601 bp, Human
ggctatgggtttgccatagatagctcttattattttgaggtgtgttcctttgatgcctagtctattgagggttttatcataaagggaggtagattttatttaaagctttttctgtatctgttgagatgattatataatttttggtcttaattctatttatgtggtgaaccacatttattgatttgcatatgttgaaccagccttgcatcccagaaataaagcctacttgattgtggtatattgctttttgatgtgctgctgtatttgatttgccagtattttgttgatgacttttgtgttwgtgttcatcagagatattggcctaaagttttcttttttccttgtggtctctgacagtttttggtgtcaggctgatgctggcttcacaaggaaggagctcctcttgctcagttttttggaatagtctcagtaggattggtaccagttctttgtacatctggtagaattcagctgcgaatctatccgatccagggctttttttttttttttttgagacggggtctggttctgtaacccaggttggagtgcagtggcgttatcttggcccactgcaatctctgccttttaggctcgagccaac

SEQ ID NO: 44609 - DNA, 601 bp, Human
tataatttttggtcttaattctatttatgtggtgaaccacatttattgatttgcatatgttgaaccagccttgcatcccagaaataaagcctacttgattgtggtatattgctttttgatgtgctgctgtatttgatttgccagtattttgttgatgacttttgtgttagtgttcatcagagatattggcctaaagttttcttttttccttgtggtctctgacagtttttggtgtcaggctgatgctggcttcacaaggaaggagctcctcttgctcagttttttggaatagtctcagtakgattggtaccagttctttgtacatctggtagaattcagctgcgaatctatccgatccagggctttttttttttttttttgagacggggtctggttctgtaacccaggttggagtgcagtggcgttatcttggcccactgcaatctctgccttttaggctcgagccaacctcccacctcagcctcctaagtagctaggactatgggcatgcgccaccacaccaggactttttttaattggtaggtttttattactggttcagtttgagaactcgttattggtctgttcatgtttttactgt

SEQ ID NO: 44610 - DNA, 601 bp, Human
atagataattatgaagcataggtttaacttaaaagtccatttattaaaaatccaaattgtctatacttgattcctcctcttgaaaacccattttaatcaggtttctttccccactgtgttttgccagaactgctttgggtaagatcaccagtcactccctgtagctatatgtctagttctcagtcttattattaattaacttggcttctggcaccacactctcctggtggtcctccttcttcactggctgcccctgtcatttcctttgatgattcttccttacctccttagattcttactsttatagggcctcagaccttggatttggacctcttttttttccatgcttattcctttggcaattttacccagtcacttagataagctagatagctgccaaatgaactctttgatgtacatgttccaagggggaaggacacatatcccattcttccccctagactttcatttttccatggtatttttcatcttatttgataggatttccatcctcctagttgcttaactgcttttctcaatctgtacatcttctcctcagaaaatcctagtggctctaccttctgaacataccgaaaataat

SEQ ID NO: 44611 - DNA, 601 bp, Human
taagcaatttaagacaagttcagtgcttaattacatttgatcagagcacaggccatttgtacatgtgtattttccgagagtatctactttgcctgtcatttcttttgtttgttttaaattaaaaaaacaaaaaatcccttagactgcaggttaatatttgaagttaacttgtttcatgtgtttgcttattacacacttctgacttggttttgattgctaatttatcttcactggatacttaggccaataaagaagcttataggattaaatgagccttgagtgggggacaggttgtttttttgctttataaagaggaaaacaagaaaggaagaaagctggtagctgtgtgcatttctccagtattgaatcctttctaggctttgcttcatacattgggttttttcatatgaggagcccagagagaatgcatagctttcattagattacttgtgaggagccagtgggctccctgggaacggggcacttcagatgtcccccttgagacactttacatgctctccgggtgcaaccttctttttagtgcactactcttctttgaggaagtgagaaagtttgcatcttaaagggggttggggatagg

SEQ ID NO: 44612 - DNA, 601 bp, Human
gtcagaggcagagctggggttagaacttgagttctcttctgttctgctgcctgtaaatccccaagcctgaattcagttctgcctgcacctctggcaagtgctgtattgtggggagaagtgtggcatccatggcaggggatcctctgtggctctctggaatcagtacatcccaggttgacgtctccttggctctggactcaaagttagtctacctgctggtcgtctacatcagggtgctgtgctgccatccttctgcccatggtagactcaaactcacctgccaagatctaattcattattwcccctccagctttttccagagagcttgcccctcctgttgctgcagttgttcttccagccacatgtactctgaagatgggatcacaatcagtgtctccataccagaaaaggctctgtaactttttggtcatgggagagctctttcctctgccctctcctttgcagttcctagaccaggtgtgttaacctgaattgtcatgggagcctcttaattggtcctttcagcaaaaactaaaagaaaaaacccactcatcatggcaaacattgtcatattagtcttcctggagaggcatttggattt

SEQ ID NO: 44613 - DNA, 601 bp, Human
aagtgctgtattgtggggagaagtgtggcatccatggcaggggatcctctgtggctctctggaatcagtacatcccaggttgacgtctccttggctctggactcaaagttagtctacctgctggtcgtctacatcagggtgctgtgctgccatccttctgcccatggtagactcaaactcacctgccaagatctaattcattatttcccctccagctttttccagagagcttgcccctcctgttgctgcagttgttcttccagccacatgtactctgaagatgggatcacaatcagtgtckccataccagaaaaggctctgtaactttttggtcatgggagagctctttcctctgccctctcctttgcagttcctagaccaggtgtgttaacctgaattgtcatgggagcctcttaattggtcctttcagcaaaaactaaaagaaaaaacccactcatcatggcaaacattgtcatattagtcttcctggagaggcatttggatttataactctcctctacccggaaagtgtccatcatagcaacatcttccagggattcttaaatataacgatgctgttgacatgtctggttatcccttt

SEQ ID NO: 44614 - DNA, 601 bp, Human
aaatgtgctagtcacttagcctatttttacaactctgaagcagccgtgtctaaaaatatttcctctctggctgagcctgccttccaccaggcctagaaaagtcatggagctgaggacatagccttcaaatatttttttttccattgcagactgcttgtcctcaaggtcttaccagcatgtaggtcactgtaatataaaacatgagttctcaatggattgatttaaattgtggtcactcaaactgccaggaagagtcctcctcatttgttgtaaaaataacagatgtctatgaaaggagaaraagaaggcctttctttttttgcagttcatttctccactgccttctccatcccagaaagttggcggtaacttgggtgttactgaattactcaggagaatgaattgtacttgtttctctgtagttattttctaaataagaggttacgttatcaggagaggccatcagctacagcagtggaaagagccaccaggtctcatcttgactttaccaacaaatgtctttattcagtcaacattccctgagggccagccacagccaggcagggtctaggttctcagtgtacaaagatgaatgacattt

SEQ ID NO: 44615 - DNA, 601 bp, Human
atgtttgttttgttttgtttcttattgtagccatcttaggtgtgaagtagtatctcattgtggtgtttttgttttttgtttttttgttttggaaatgaggtcttgctctgctacccaggctggagagcagtggcatgatcatagttcactatagccttgaactcctaggctcaagccattctctcacctcagcctcccgagtagctaggactatagatgtgagccaccacacccagctaattaaaaaaaaaatttttttttagagacagagttgtactgtgttgcccaggctgctctcaarctcctggcctcaagtgatcctcccaccttggccactcaaagtgctgggattacaagcataagccaccgagtcctgctatcattgtggttttgatatgcattttttccccaatgtctaggtggcctttagatgatggtggagataattttaccttctctaggatgaaattcaaataataaatatcacaggcagattaatgttagaaatgcttgttctttggtgctgtaaagaaatagcacttgaaataaatttaatttcctcagcaagaccatttttactttctgcagaaagggtacactc

SEQ ID NO: 44616 - DNA, 601 bp, Human
ggcctcaagtgatcctcccaccttggccactcaaagtgctgggattacaagcataagccaccgagtcctgctatcattgtggttttgatatgcattttttccccaatgtctaggtggcctttagatgatggtggagataattttaccttctctaggatgaaattcaaataataaatatcacaggcagattaatgttagaaatgcttgttctttggtgctgtaaagaaatagcacttgaaataaatttaatttcctcagcaagaccatttttactttctgcagaaagggtacactcgccagsatttttgccacaagagtacaccgaacaaaggagacagggtcatttataacctgacacgtccatcttactgctgtgtccggtttctattggctgggacgggacttcacattcaaatgtatttgtcttgattggctagcaacttagaactttttgaaagaggcaaaggcagatgagaacaaaggaaggaggaagtaacttgtggaatgctgagaaaggtaaaaacacctctaaataaggaagaggaacaggctatgacctaatgcccacttggaccagtataagcatgccagggcaaatatt

SEQ ID NO: 44617 - DNA, 601 bp, Human
ccgcaaggtggcgctgcaggaaagcctggaagtcaacctgtttaaagcttttcctctcatgcttttggcacgccactttactgtggccttaaagaactaaatttggtttaagtcagtatggattttttttaatgaataagttaatgtcttatatatgcatatgcctatatcctcttttccccatatctacccatgtaaccttaaaatttttttgaaccatgttggtgttcttgttttcattttaattcccattcaattgaaaaataaagcttttcacttcagggaaaatatcttaattcaygtttattatcatatgtttctgattgaggatttatgtgttcatttagaattttgttgcttttaggtgtctttctttcattattttttgatcactgagtttcgtttgtgactggggttggttaagtagcttgatcaattagccacctcttgttatctcacataccttggaagttaactaatacaagtaggtaggggaaattttgttctggaaaatcaaggaaggattggtgaaggttaaatacctcttcggaacaggaaattccaattttatttcaaatttaaaaatttttaaaaagctgaa

SEQ ID NO: 44618 - DNA, 601 bp, Human
tatatatgtgtgtgtgtgtgtgtgtgtgtgtatgtgtgtgtgtgtgtgtgtgtgtgtgtgtatagttgaatgaatgcgtgaataaacacgcatctctcctgtttaaaaatatatatatatacttcatctggttctttccatttaccattacacatgagttctctaactgcttactgagggctgactgtgccgggcatcgtgcttggtgccgtcccctacagatgccagtagggcagcccttgtgcccttgcctgtacctcacagaggtcaggagggctgctggagcaggtggcaggccccrcttgctgtaaatgaaagccttccccagaaggatgagtctgttctgaagccaaggggccactggcctctagagcatctgtgtggcagagggtggagtcatgggagaaatactcaggaatccaggagaactgtcacttgggcaaattactcactttcctggggctcctcctcctctataatagaagatcaggtcccatgtagaagactttaagggcaaccatcatatacttccagacttctaataattaaataatggaagtcagcatttattgagcatttgtgcttaggctttgtgctttac

SEQ ID NO: 44619 - DNA, 601 bp, Human
agcatttattgagcatttgtgcttaggctttgtgctttactcccaatgtaatttcattctcacctcaacttcctgaggtgaacagagtgatttcagtgtcatttcagtttcaagaaacatactcagggtcacacagccagtaagtggtgcaactgaacccaggcttgtctcaacaacaaagcctgtaaaactgtcctatacacacacgtacacacatatacttgtattttaagccgtgattttgtacattctacagtacactgttgtcttttttttttttttttgagacggtgtcttgctytgtcacccaggctggagtgcagtggcatgatctcggctcactgcaacctccacctcccaggttcaagcaattcttctgcctgggcctcccaagtagctgggactacaggcacatgccaccatgcccaactaatttttgtatttttagtagagatagggtttcaccatgttagccaggatggtctcgatctcttgacttcatgatctgcccgcttcagcctcccaaagtgctgggattacaggcatgagccaccacatttggcctctgttttaaaatagtcattttgggaaatacattgtt

SEQ ID NO: 44620 - DNA, 601 bp, Human
gaactctctctgtgtggtattctaagggctttcagagggtctttctgggtcagttattgaagctctttatgaggcatctggacaatatatggcaactacataggacaagggtcagcaaacttctgtaaaggaccagatagtgaatattttcagccatacagtctctgttgcaagtagtcagttctattgttgtagcatgaaaacagccatagacagtatatgcaatatgagtgtggctgtgctccagtaaaacttgacttacaaaaacaggctgtgggctacagtattgtactttaccaayacttgacatagaagaggggcattaatgtgcctggaatgtgccttcctagtgagacttcatgaggggattgtggtatataggttaagggtatgaactagcccaactgggtttaaatcctggtgccggcacttattagctgtgtaaccttaggcaagctacttaacctcgctgtgcctcagtgtcctcatgcttcacataaggataattatagtacctctgtcacagggttattatgaggaatgaataaattaatatttttaaagtatttagaacagtacctggcacacagtaagtacagta

SEQ ID NO: 44621 - DNA, 601 bp, Human
agtgtaattgttttcaattacttcattcataaatgctcactcctgagagtgtcattttttaaacaaaacatttacaccagctcttccagagagatgaaagcacatttgcttcctcaaaatctgctttaaatattaaaacttttctctatggtttatggaagcaattgcctcacttttgctccaagatcaaaccaacagttctggtttatctatcaacaaatatgcctaattacacctcaaagaaagcacagagcattttaccctaccttgaaaggcagttgtatgtcttttttttttttttaacaaaatgtaatgttttagaatgtagcatgtgagagatccaccttttaatggtgttttcctcactgtccatttgatgcattctccaatgcaccaagtatcagatggtaagttgaaagccctcttcttgtctgtggtccctttctgcataggtgcatgccctttagccctcaccatccctggccgcctgtgggctgaagctggaagagcaggacctggcctcaggacatgctcttagcttgctctgggcatgggcttcaacagcctatcattggctggtccctctgcttctttttccacc

SEQ ID NO: 44622 - DNA, 601 bp, Human
acctggggttccaggcacatggtttggccaatgctgccttgagtggtgcaggctctctggaaggatgtgtgtgctgttgtaggtcaggcctcctggatgaccgggcctctgccactaacacttcttgccagtccccatgggatctcgtggaggctcacgcccttttgctctgctgtttgtccactcattttggcttccatgttgggccttctttcccagtatcccagctccgtcctcactcttcctattgctcttgttcgttcacactgtgactgaggcctgatgcatgccccagtcactstcactcctgtgagtcagagggacagaggctggataggctgtgtctgacagtggactgctgcccttgccaggcacccactcctaatggccagtgtgggcaggatggtggggccaaatggtcagctcttctcaggagggctctgctggcaacaggcctgggagcaccatgagcctgccccccagtcaccatgtgacatcttgctcacattgtcgcccctgctcaagacaggctcagtggttctctggtttcctgccatctacaagctctgccagagagccttccttctggccaacctctgcc

SEQ ID NO: 44623 - DNA, 601 bp, Human
tactttaataaatgattccagagttggaaaatcccaatgtatttgaaagtagctgaagtttcaggcatggagacttctgtctccatgaacagggtatcagtactccaaaattcacctcagtggtgcgtagctttgaaaatcttgggccacacactgtggcttacacctgtaatcttagcactttgggaagctgagacgggaggatcacttgaggttgggagtttgagcccagactggccaaatggtgaaaccctatctctactaaaaatataaatattagccttgtgtgggggcgcacacstgtagtctcagccactagggaggctgaggcaggagaatcacttgaacccaggaggcggaggttgcagcgagccaagatcgtgccattgcacttcagcttgggtgacagagcaagactctgtctcaaaaaaaacaaagtcttatgacctctttggcatgtactttagagaggaaatcttacccaagccagaaagtctcagtctaggcattttttttattgtgcaagcatataaaattctagtaattctggggctaatcctgtgatagggagaattcaaggaaaggtggtggtgacccagtg

SEQ ID NO: 44624 - DNA, 601 bp, Human; identical to SEQ ID NO: 37540

SEQ ID NO: 44625 - DNA, 601 bp, Human; identical to SEQ ID NO: 37541

SEQ ID NO: 44626 - DNA, 601 bp, Human; identical to SEQ ID NO: 37542

SEQ ID NO: 44627 - DNA, 601 bp, Human; identical to SEQ ID NO: 37543

SEQ ID NO: 44628 - DNA, 601 bp, Human; identical to SEQ ID NO: 37544

SEQ ID NO: 44629 - DNA, 601 bp, Human
ctttttcttctggatgtacttattttgtatagttgaaatcatattgtatatataatttggcattctgatttatttacattcatacatatgttccatgtaattaagacattttccgaacataattaattattgcataataatccttgggcggtaccataattttattcaacttctctcttattgctgttcatttggattgcccgatgtgtagtgtaaataatgccactataagactcttgtaatttagtttttgtgcacctctcagattatttccgtaggattcctagaagtagaattactkggttaaggagtataaacattttaaggttttgatgtatagtattcataaaagttgtctcattaagtgacatatcagataggatacaataaaaaaatagctttaagcagacatttataaaaagaagtatatatcttgctcagagataaaaccgaaagcagttttaagaggccgaaaaaggacttagttccctttcttatgggttaggtatgggttcatagatattgaatatattattttttaaaaagtcctctggagttggtgatctctctcaggttctttctggctgcaaagttctgtttt

SEQ ID NO: 44630 - DNA, 601 bp, Human
gtcccatctctccgtgtcatttgttttgtcggagacaaggatgccagagtaagtgagaaacaagtgtaaaaaggcagttaagaataatatcatttctggagtttagttacatattattgctgttaaaaacatctgagttgactactactaaataagacttaaggtgtatgtactctaagctagactctgttttaagtgctttgcatctattaatttaattctcacaacactcccatgaggtagatatatcacctattaataatagacaatccattattatgcttcatctacatttgcttttgttcattaacctaagcatttttgaattgtactttgagtgacttttcattaaaaacatcttattttattgacagtatatcttaccagtgactctcatttgtgctattttgaagccaacaatatataaatttgcattacttaaaattttatatttaagtttttgacttttgacttggtgtacacacacgcatatgcatgtacacaactggaacctcttctatatgtacagagagcctcgtgttttgtgtttatgcatagacgcagctttcagttttggtgtttgaatagaaaaatacatgtc

SEQ ID NO: 44631 - DNA, 601 bp, Human
atagacgcagctttcagttttggtgtttgaatagaaaaatacatgtctgtatatattctcaggtaatattagaaactgggcattttaggggggtgtttaaatcagccatttgtcagtctagtaggctacaatcattttaggactgtagaattaatctaaaaataatatattatgtaaaaatactaaaacagataatctgcttagaaagcttattattaaactttgtctttatttgcctccagagaacacagtttagagatgtattcagttttccatatttagataggttatctaaagataycctcaaaagaatggtagtgcaatgaattacataattttatccttatcattttgcttgaagaaaaattacttaaatttatttaaatttaacttacaaataatttaaatattgaaatactgagctcataagtttacaattacaggccagattcttccctatgcctaatatttccctaaagcaaattagtcacttagaactctttctggtcaccattgttatctaatgtaataccactccatataaactttgcatttctaaagtattgagcttttgctaaaattatttcttaaagattaaaag

SEQ ID NO: 44632 - DNA, 601 bp, Human
gtctttatttgcctccagagaacacagtttagagatgtattcagttttccatatttagataggttatctaaagatatcctcaaaagaatggtagtgcaatgaattacataattttatccttatcattttgcttgaagaaaaattacttaaatttatttaaatttaacttacaaataatttaaatattgaaatactgagctcataagtttacaattacaggccagattcttccctatgcctaatatttccctaaagcaaattagtcacttagaactctttctggtcaccattgttatctaaygtaataccactccatataaactttgcatttctaaagtattgagcttttgctaaaattatttcttaaagattaaaagcaaaagataaatatctaggtttgtgttttcataatgtctcggtatatttaatttatgactgccctatctctacttcctggggaggctgggattctggtggcttgaaaaatttctttgtttctttttccagaggcggggtctcgctctgtcgcccaggctggaatgcagtgatgtgatcatagctcactgcagccttgaactcctgggctcaagcgatcctctca

SEQ ID NO: 44633 - DNA, 601 bp, Human
ggtgcaactgagatctctgaaaaggcctttttttttctgtcctcctcttcagtccaggtgattctcttatacatagtagacaatcagtaaatatctgttgaatgagtctgcagtgtgtttagtgcatagttgtgaattatgaaataaagactttgcagggaacagttaattttgtttatgcactgtaactccagatttataaaacttttttttttttttttgagacggactctcactctgtcgcaaaggcttgagtgcagtggtgacatcttagctcactgcagcctccccgcctcctggrttcaagcgattctcctgcctcagcctcccaagtagctgggattacaggtgtgagccaccatgcccagctaatttttgtattttttagtagagatggggtttcaccatgttggccaggctgttcttgaactcctgacctcgtgatccatctgccttggcctcccaaagtgctgacattacaggcgtgagccaccatgcccagctagatttataatactaatcagcctcttcttaatatagattttgctgcttcccattaacttttgtggttttattttgactgataacatctggaattcag

SEQ ID NO: 44634 - DNA, 601 bp, Human
cacaaatttatgctaggacaccaaactaaatggaaagatttaagaactttggtgcttgatttttcccattattattattattactattttgagagggagtctcactctgtcccccaggctggagtacagtggcacaatctcagctctctgcaacctccgcctcccgggttaaagtgattctccttcctcagcctccccagtagctgggattacaggtgcccgtcaccacacctggctaattttttgtatttttagtagagacagggttttgccatgttggtcaggctggtctcgaactccygacctcaagtggtctgcccacctcagcctcccaaagtgctgggattacaggtgtgagccaccgtacctggccccattatgactgttaattgataataaaaagtagcaagtttggccataagttgctttgcacactttatcttgcttttgtttgttttattgtttggtaaaattaacattcttattagcattatgtctttgattttatattctacttttcaaactagatataatattgctacagtatggggaagcctaataaatgtcttttaaggaaaaagttgatggaattcttacacag

SEQ ID NO: 44635 - DNA, 601 bp, Human
cactaaaaattgtcttggtgatcaaaaactcgtggaaagacttcatgcagtaagtaatagcagacaagaacattcagtaattaaatagtatacacaaactgacccagaaaacaaaatgctatggaatctgtttgaacttgtgtttgcctcttggctcaatgtcactgtttctccctcctaacctttctgacagcctctttgttttttttttttttttttttttttttttttttattcctctatgtcctcagcctctctctagaacagcttttttcctttggctctcccctgtgaataatgkggtcctctccaatagagaggctgttcctgctcccacaccccacagttcctcaggatggtatcggtattctcctagttcacccactgccacttctaagctactgcttctccactgtcatgtataaagctcttcctttgaagcctaagctgtcttgcagttttatcctccacccattctgtttcctgttaatctgttcatcattgggtggctccttaacacattgtatgccaggctggagtgcagtggcatgatcttggcacactgcaaagtccgcctcccgagctcaagcaatcctcctgc

SEQ ID NO: 44636 - DNA, 601 bp, Human
tctttggccaggtgcagtggcttacatctgtaatcccagcactttgggaggccaaggcaggaggattgtttgagcctaggagttcaagactagcctgggcaacaaagtgagaccccatctctacaaaaaataaaaaataaaattagctgggcattgtggcacacacctgtgtttccagctacatgagaggctgaggcaggaggattactggagcccaggaagtcaaggctgcagtgagccatgtttgtgccactgcactccagggtaggcaacagagtgagaccgtgtctcaaaaaaaaaagcattcttgctttttccttcagtgaaaataattataaccatattactagtgttgatgaaaatgttggtgattgtggatattacaaaaatagaatctggaatggttagataaatgcacttaaagcaggaaattgacaagggaagtcacaaggaatcataagtgggaagtgttaataatgtaatagtgctgctaataggagcaaaatgttacgtatataaatacaattagatcatgtataaaatatatgatttctttactacataagccagtatagggtagagattaagagtatattctttg

SEQ ID NO: 44637 - DNA, 601 bp, Human
accatgccatccatttattttaaaaaagattgcccatactttgtgattatgcaagtaatatatgactgctgaaggaagttttgaaattaaatacaagtatttctggcctatctttttaggtatatgtaatatgtataagtaattggtatcagacttcctatactatatgtaaagtacagtatcctgatactatttacttaatattatattgtactttttaatgtccataaaaaataattgtaaaagtaattttaggataatatttcaccctatggatgtactataagtaattcatccccckattcttgatcgtttaggttgtttcaaaattttcactattataaataatgctatagtgaaagtccttatacataaatctttgtgcacatctctgattatttccttaggataaattcctagaagtggaatttctgggtcaaagggtatgaacatttttaaggctcttgatgcatattgccaaattgctttccagaaaggttgtaccaatttatactcccagcagcaatgtatgagagtgcccgtctcaccgccccctcatcaacattgagtattatcattttttttaaatcttcaaaaatgt

SEQ ID NO: 44638 - DNA, 601 bp, Human
atcttacattagaactctttctactaggatcgagcacatcgtattggtcagaagaaaccagtacgtgtattccgtctcatcactgacaacactgttgaagagaggattgtagaaagagctgagataaaactgagactcgattcaattgttatacaacaaggtatttatacatagaaacttaattaggtgttttttgtaaaacacatgtagttttcttcaaaggagattacttttaataaaagttgaccaaaatttgaaaacttagaggaaaaattgaaacatcactgtgtatcccatgagwctgtacaattgttatgtatcacctaaaaataaaaggaaaaaatttaaaaatgctaattgaggctgggtgaggtaggtcatgcctgtaatcccagcactttgggaggccgaggcgggtggatcacctgagatcaggagtttgagaccagcctggccaacatggtgaatccctgtctctactaaaaatacaaaaaattagccgggtgtggtggcgtgcaccagtagtcccagctactcaggaggctgaggcaggagaattgcttgaacctgggaggtggaggttgcagtgagccgagatcgc

SEQ ID NO: 44639 - DNA, 601 bp, Human
aaaaaatgggagagtcttctctaagaaattttagaatggacattgaacaaagtttatacaaatttgagggagaagattatagagaaaaacagaaggtaactttttactctcaaccattagaccctcaaatgagcatttctccccataacaattataaaataacactggcacttacctattataataccctgctctagagtgaaatttgatataggtctaaatatctcatgcaaggtatatctttcgtttattttattggtttatcgtcgtcgtcgtcatcatcatcatcatcatcatcataaatttttgctgttgctgctgctgctgctactactactactactgcttagtactacttttgttattgagaagcagtgtaggattgaggttgaattcctgaattctggagctgaaatctcaactcttgtcactaattaagtgactctgggtattctcaattttctcatttatcaaatggaggttataatagttacatcatagagggattctgatgatgaaatgagttaatactcataaagttattagaataatgcctgacacttaatgttaactgtatgaataataatattagtaacattta

SEQ ID NO: 44640 - DNA, 601 bp, Human
tcttaagacttgccttgatcctccttatgcatgcttagctgaggatttaggtgacaaataagaatacattctggatatttgttctttctggaccttgtctcttccattctttactaggaactatggacctgagctaaggtgggttctttaattgggtggttttttgtttgagttcagagaatagacagatcagcaggcatgttaatcatcttaaaaagctcccttttaaggatgatgtgatatataaccgttagacatatcttctcaaggcatagctagcattgctttatttcccccttgyaccttcagaaaactcatcagggccacaaagtaaatagagcactagtttatcctcaaatgaacaaaacaaaattgctttagtggagttacctggtattctgtgtacacagattctcaaaaagggactctttcccccttttctgcctaaaggattgttagccaaggggagataggtgatgcccatagctgggggcactgtggttcatggttacgttttatctatgttgagtctccaaaggcttattctgttgtgatttggagtggggctagtgaagggcccacaagttttgaagcagttggt

SEQ ID NO: 44641 - DNA, 601 bp, Human
tctctaatatggagaagatgaaaaaaatgtaatttagatttctacaggatcaccagctgtatcttagccaacttttatcaatggagagtctcaataggtacatttttagttatcataaaactcttttttactgattattaggtaattctaataaatatgggcatgtaacaaatagttaagaacatcagccccattttatctcagcttgactcactgcaggaaagcacaaatttgaagaaagccatttccccaagaactactcacttccttgagagccacgtgagagactaacttggatgasagtgacttgtcacaatttatttttgatggcactagtttaaaaaagtggtaaaatagtcttttcagaatgaatcatttctaaaaatccattattctccagtgattataccttataagtagaaacccatatatataaaaacatatatatttatatataaatataaatgtttatatatatataaatataaatgtttatatataaatataaatgtttatacatatatttatatataaatataaatgtttatatataaatataaatgtttatacatatatttatatataaatataaatgtttatt

SEQ ID NO: 44642 - DNA, 601 bp, Human
taaatagatgagcaagatgccaacattcatcctcttatttaatggactgtttagtgtcagataattttagtgtcacgtttgaattttgtggtgaaatagtcattccaacatatctcgtgaagatgtgacaggcccactatctcacacctatatgcaggttgaaaacattttcaattgacagtaactgtactttatctctgattgtgttctttacaatcaatgagattgaaaaagagatgcagacaaaagaagtgctgactaatactccatcattataatctctatcttgcattctgagttytctaaaagtccccatctgctatagttgaaaaggggaatgtcatgttttcctgccctgggtaaacagatggtgcatggttaagtgtcttgaactgcttactagataaattccagactaaaatatgattcacctctaatttccaacttataataccccagagggaagaaagtatggttttaaaagaaccagggaagagggtagttctatccataatttactcctaccacatatactaaagcaatcacaatgagcttgtgtagaataccaatcattttgtattggggggtagctttcagaaat

SEQ ID NO: 44643 - DNA, 601 bp, Human
ttatgttatcttctttcatcttcaccacaactcggtgattttcctgttttaaatatcaggaaacaactcacagaggttgagtaacgtataaatcacacagctagtaaatggtaaaggtatgattcaaagcccacattcatttcctgaaaaacatgatctagacataagtggtagccaaaatgtccccaaataaataaattaaaaataaatagcaaaagggaggaggaaagcccagtgatcagaatatattcatgataatggttagagctttttgattgaacttgaaaatgattaaaagctrcctgagagctctaagaataaaattgttacaactttacagtcagacattttgagattaacctaattgctttgctttcataacaccgtaatgccattttatttcattttccattttattagaaaaaatttaaacatttaagtattgcctaaaactgttagtgatttttcttttctaaatagatgagcaagatgccaacattcatcctcttatttaatggactgtttagtgtcagataattttagtgtcacgtttgaattttgtggtgaaatagtcattccaacatatctcgtgaagatgtga

SEQ ID NO: 44644 - DNA, 601 bp, Human
agtcaatatactagttttttacttaaaactgtaacattttaatctaattttggagacgtgaaataaaactgatgggaaactcttgaaatttttatcactggaataacctaattttgaaaacactgatggttagtttcttgaaatattaatattactacaagtcataagtaaaagcattctatcttaagtgagaaactataaagttggataattactatttgagtttgtggcttggtttgaataaacacttgcttgttttaagtaaaagttcagctgaagtgacaatcaacctttaatcttrtaaagcttctgtgttagatattttctatctctaacatgccaaacatgcatattaaactgagtttttttgcatgcaatttctgtacccttttcttgtgtctttttgtttgtttgttttgctttgtattgtttgtttgttggtttagatacagggtcttgccctgcagcccaggctggacctcctaggctccagtgacacccctacctcagcctccagagtagttagggctatggcatgcatcacaacacctggcaaatttttttaaagtgctttttgtagagatggggtcttgctatgttg

SEQ ID NO: 44645 - DNA, 601 bp, Human
aaaactggaaggcccaaggttgcactcaggcttactgagtcagtcactccaagtggaccccatccctaaaccttgagactcactgctcctcttttgatctgggagagaaacagaaaaaagaaggaaaaaaaatccccaatgtgagtatgctggaaagtaaatttgaatagctttttatattgggtacttactgtgggtaatttacaaactattggaaggaaccacaaattcaaacacagccaaatttaaggtctctttagcagaaatcaatcttacatcatggcagttctcccattctccrgtctttcacttgatagatcacttcctcattaggatgacctacagcaattctacatgaactgctctttacatttaaacagtgctttctgtcctaacatgtcaaaatgcttgacaagcaatcaaaaggtagctcactaattttttcaactcatggcagtaaatagcctgcatctaccatcactgctgtttactggtgatttcttggcagggaaactttaaatgccttagcaatgtctagaaagtcaatgactaaagaaaatattcattttggcttccatagggctgtatttgatgaactgct

SEQ ID NO: 44646 - DNA, 601 bp, Human
aattttaaatagtaataggacaaatttcagaagctaaaaatatacaggtcataccccaccagtcttgatagggttttgtttgtggtttttttggtcttgttttttaataacagaggaaataaattaccattattatttgaaacttagactgatgcagagggaggttaaaagattaaactgtgagcctgagcttgagcagaaaggtaagattgttcttcctgattccctcagcgagtcactgattcagaggaccatttacagtcatcacctggcagcgtgcacggggcgattggttccaggwcacccctgtatcaaaacccgcagataccaaaatccagggatgcatacctctcgggtactctaaatcctctctaaattacttgtaattcctaattcaaagtaaatgcgatgtaaatagttgttatactctattattttatttgtaatagttatcttttatttttttgtcttgaatattttcagtctgctggttgaatccatggatgcagaaccccagattcggagggctgaatgtactttcgataggttcctgagcagcagtgattatagtcacagcagactggacagtttggtgagcaag

SEQ ID NO: 44647 - DNA, 601 bp, Human
tagaaaaatgtattcttttaattttaaatagtaataggacaaatttcagaagctaaaaatatacaggtcataccccaccagtcttgatagggttttgtttgtggtttttttggtcttgttttttaataacagaggaaataaattaccattattatttgaaacttagactgatgcagagggaggttaaaagattaaactgtgagcctgagcttgagcagaaaggtaagattgttcttcctgattccctcagcgagtcactgattcagaggaccatttacagtcatcacctggcagcgtgcayggggcgattggttccaggtcacccctgtatcaaaacccgcagataccaaaatccagggatgcatacctctcgggtactctaaatcctctctaaattacttgtaattcctaattcaaagtaaatgcgatgtaaatagttgttatactctattattttatttgtaatagttatcttttatttttttgtcttgaatattttcagtctgctggttgaatccatggatgcagaaccccagattcggagggctgaatgtactttcgataggttcctgagcagcagtgattatagtcacagcagact

SEQ ID NO: 44648 - DNA, 601 bp, Human
ctgagaaacagaagtaaatggagtcagatcatttatgaataaatcagacaagtttttaatccacttgcttatacccctgagtctccctttttgttttatgcaactgccatttcctgaagatgatttcttccttacatcgagacagggttctcagcctcacctcagatttcctcatgtgacaaaagaattatcatgttcattttctcaatctcttatcacataccacttttatctttgatatagcccaaatgttactgttcagaaaattatttcttttgcccattaattggatctcatcaaycttttcctccaaatgttttatgccacatttaattaactcaaattactcacagctgatttccaggcctgccaatataccacttctgcctttcattactcaccttgtttctctgcacttttttggtctatcatttttgcctcaaatttctcatatttaaaaaagcctccttgtcatagcatgcataattcactcatagatgtggaagaaacagatgtaatacctttctgccaagacacccacactctctcacaatgcccagtcatttttccctgggttgtgtgtaggatgggtcattaatat

SEQ ID NO: 44649 - DNA, 601 bp, Human
attaaaaataaataaaatttgccaatttagtttggaattatccagaaatagcttagcaaaacatctggttaatgtgctattcaaaattaattttattttaatagattaaagttatataggcctcctttgggaagaaaactaatttttctcaaatgtaataattataaaatgtaataattatatgtaatacagatttttgtagatggaatcattgtaattagagtatacatatgtgtgacttttatgaacacatacagaatgtctaaaaaaaaaaaatttgcgaaaaaaggaaaaccagaargtaacaactgaaagaagtccctgccccaccccctctgtccctctacctgaaaaaggggaacggttcacaggaaaaagagcaggagttgcaactggtgacttctgactgctttatattctttgctgttaatttaatataattttaatccttttaggaagagcacaatctattcccagtatgtcacagcctctcccatctctcttggctttgaactgccccaatttgtttggccctgcagggatttgactaggagcagcatgcttgaagtgctttatacacacaatcataagaagctaaata

SEQ ID NO: 44650 - DNA, 601 bp, Human
aatcagtgcctagcatatgatagagatacagcaaattctggaaaaaaagcaaacatatgctgggactacaaattttagtattaacaatatattaatttgcagaacagatagtggttggccttttacatttctgacgtttacaatatcttaatttctgatcacctcacataagctcatttgatctcttattgttgcagtggagtttagaagtttgaattttgagatgtggatgacatatgaagttatgagatagatgaatataggtgctggagctaaagaaataatagaaagcttggtgaaytgtagttgactacaaatggacactggttctggggtgaataggaagtggcctgaacagagagagggccatagtacttcctaacattaagttcaaactagggcagtgcagtatggtagtagaagcaaaaacaaagtggcataaatacaaggagtggcatggctcttcttactgtattttttgagacagggtcttgctctgtagcctaggctgaagtgcagtggtgccatcatggctcactgcatcttctatctttcaggctcaagcaatcatcttgagtagacgggactacagatgcacacc

SEQ ID NO: 44651 - DNA, 601 bp, Human
gaaaacaaattaaaaaaaattgtcactatttaataggaagaaaaatgaaaccaaataatcagtgcctagcatatgatagagatacagcaaattctggaaaaaaagcaaacatatgctgggactacaaattttagtattaacaatatattaatttgcagaacagatagtggttggccttttacatttctgacgtttacaatatcttaatttctgatcacctcacataagctcatttgatctcttattgttgcagtggagtttagaagtttgaattttgagatgtggatgacatatgaagttrtgagatagatgaatataggtgctggagctaaagaaataatagaaagcttggtgaactgtagttgactacaaatggacactggttctggggtgaataggaagtggcctgaacagagagagggccatagtacttcctaacattaagttcaaactagggcagtgcagtatggtagtagaagcaaaaacaaagtggcataaatacaaggagtggcatggctcttcttactgtattttttgagacagggtcttgctctgtagcctaggctgaagtgcagtggtgccatcatggctcactgcatct

SEQ ID NO: 44652 - DNA, 601 bp, Human
caacactcttcatcttcagatggatacgagacaggaaggagataagacacttttgtaaaagttgaaataaaaaatagaatctaaactatggtggtatgactgggaatacaaaagagagtacaggtaggaggggcatcttggtatttggtacacaccacaacatctttttgtcaagctgtcattctgtctggaaaacaaattaaaaaaaattgtcactatttaataggaagaaaaatgaaaccaaataatcagtgcctagcatatgatagagatacagcaaattctggaaaaaaagcaaacrtatgctgggactacaaattttagtattaacaatatattaatttgcagaacagatagtggttggccttttacatttctgacgtttacaatatcttaatttctgatcacctcacataagctcatttgatctcttattgttgcagtggagtttagaagtttgaattttgagatgtggatgacatatgaagttatgagatagatgaatataggtgctggagctaaagaaataatagaaagcttggtgaactgtagttgactacaaatggacactggttctggggtgaataggaagtggcctgaa

SEQ ID NO: 44653 - DNA, 601 bp, Human
gttttaatatgcattgcatgtgagaacatcaaattcctggcatagttaatagcatgaaaagtgccacaaagatcagaaacttcccagtgcttgaaaggagacttgtggagttcgacagcagcacaggcctatgattagggaaattggaaataacggagctgcagccataggttggaacagtagaaatgcctgaagtgccaggatacggagtatactctggatatattcaatgggcagcaacacgacatcgtaattttagagaaaacaaagtaacaatgaaagaaaacaccaattctcttarttaaagcaaaattgaaactggcctgattttagcattggaaaacaatctccaggtaggtgacggaggaaaactgcatccatttaggaattctcgttttgattatcactggcaccaccataccagcctctaggcctccacgttaatgcctgggtttaggtgtgaacaaaggatgttgcattatttcacttcagtacatatgatatagttgaaacattaaagaattgatgggaaaataagagaataactagaaaaaacagagtatgagaaaaataaggtctgttttataaaagctagtttatt

SEQ ID NO: 44654 - DNA, 601 bp, Human
tttcccaaagtagattgtggcccattacagggagaaagggtggtgggcaggtgaagtatggaggaaaaagagaacttcaggcaaagagagtaccacatgcaatggcctagaaaatatagagcaaagcacattgaaatttcaagtactgtgagaacacagaatttaaagttaagtgttagaagacatgaggctgttgaagtaagttggagcaaaaacatgaaggcacttgtttgccacgaggtagaaggtagtatacatctacattgtataacagcatagcaatccttaagtgtcatttaayaatttttgtctgatttattagctatataagtatattatagtaaatgggttttaatatgcattgcatgtgagaacatcaaattcctggcatagttaatagcatgaaaagtgccacaaagatcagaaacttcccagtgcttgaaaggagacttgtggagttcgacagcagcacaggcctatgattagggaaattggaaataacggagctgcagccataggttggaacagtagaaatgcctgaagtgccaggatacggagtatactctggatatattcaatgggcagcaacacgacatcgtaa

SEQ ID NO: 44655 - DNA, 601 bp, Human
taggtgcagtgtaggcactggaaacagtgcaataagacaacaaacagggaatttcaaaatatagtgtgctggaatatgattcagaataggatgttaggtgaacccatgagaaggacagaaaccagcctttcccaaagtagattgtggcccattacagggagaaagggtggtgggcaggtgaagtatggaggaaaaagagaacttcaggcaaagagagtaccacatgcaatggcctagaaaatatagagcaaagcacattgaaatttcaagtactgtgagaacacagaatttaaagttaagygttagaagacatgaggctgttgaagtaagttggagcaaaaacatgaaggcacttgtttgccacgaggtagaaggtagtatacatctacattgtataacagcatagcaatccttaagtgtcatttaataatttttgtctgatttattagctatataagtatattatagtaaatgggttttaatatgcattgcatgtgagaacatcaaattcctggcatagttaatagcatgaaaagtgccacaaagatcagaaacttcccagtgcttgaaaggagacttgtggagttcgacagcagcacag

SEQ ID NO: 44656 - DNA, 601 bp, Human
cattgaaaatatctgtcacttaagatgacaattcagcttaataaatgaggcaaacggtactgatgaaacatgccctttccaaggaaggagtcacgatgatttctattgatgctatcagtatttccacaagcttctgtttccagtaggttatatatagtatcatagaggaacagtgaaaacacataattgagtcttcataaagaatcagaaaaatactttaaatctcccttgacaagaaaacccaagctcttttattgatgagaattattatcattatagaattataatgttactaaatatrtaatttttgtattcagggaagacagactggtatcatattagtattatgtcagtaaaagctaattagtatacaaaatatgctaagcttacactagggattctaagttctgatcttaaggttatgccactttatctcaattttccagcaaaactgtttatcggagttactgtatattatcccacactatatcagaactatttcaaaagcaatcttgttagtcatctccattaaaaaaaatccaagctatgccttttctatgaaatttttggtggttgccatgacaatggtatttctatctca

SEQ ID NO: 44657 - DNA, 601 bp, Human
ttgtgttctgctaaagagagaatctcacctccataatgaggctattaatatactacatgtttctggtagtaagttctcatcttttaagaaaatacatcaaaccttatatctgtgtagtttaatcccttttaagatatattttctaataatactgttattctaatattttttaaaacttatttcatactatttatcttaatatatttgtgagataattattgagacattttattaatattttatttagtcttagaatttcagagaaaagtgaacctagagaggtacttctcctggttcaaaytgtgaacatgaaaattctgaatttaagtaactggacaaagtaggtcatgtagattaagaaaactaagatgagcttcatctttcatcacattttagttgcatttggattaatctgggaaacttcacccagattcaaaaattagtaaacctcctaatttttgaaggtggagaatttctactctctggctgatttttaaaaggttgactagaaaagggttatataaatcaaattagtgcaaacaacatactgtctagtcctctctcagtcaccactttcctaattaaatttcaaagtcattaa

SEQ ID NO: 44658 - DNA, 601 bp, Human
tgctatgtctatgaagtatctctcctctcctccccatcccgtgttctgctgcctgtttaaacttaacatttataaacagtccactgggtttgttttgttgatgcactggctgttttccaagattttgttgttaatcttatctgactgtttaaggatgaccttttgtggtgttataaaactctgaagaaaaggaaaatagatttggtcatctaaccctcttccaaagactgcaaaaaaaaaaaaaaatccagttgttttaaaatagagtggcttgatacaaaaagctgcggcatattacatytgtctgcatctgcacgttttcagctttcagggaccaaaaattggcagtgcaacatataatcagacataaaggaaagccaaaaagaagccagtagggaattttttctgcctaatattctaacagtgttggtaaataggcctactacttctagtatttacataagagacagcagtcaaataaccaattcaataaaacaaacaattcttctatgagaaaaaaagaatgacaccacttaagagttgatggacatagaattattagatgtgaagggatcttagaagtcttattttatagatgagg

SEQ ID NO: 44659 - DNA, 601 bp, Human
tctttatgtattgcataatctaaaattcatatcaggtataactacaatctaattcttgtgtcaaccatgaaagcctttcttagaaagctggtgaaatcctttgttacaaatatcagtctctgcttgttattatgtctgtattagtatcatctgcaatcctcagcagcttacttttcatcctggtaaacttctaacaggccacatctgaatcatggataaaatacaatttgcagggaattctctatttctattcagaattttaaaaattttaactaaatgtgcaaggccttcaacaatttcgtagcttgccctttacctaagcctacttgctccttaggtcaatattaagttcctggatttaaatattggtggctttcctctcaggtgttctctgttaaaagctttctcttcctttagaatccttagtaaaggaagtggtatttgcaaggaagagaacagtgtcttccctactatttagctgtcaggactttagggctacatgctaggttgcatagtgaaaaccctggcctggcgtcaactggtggcattaaaaatcactttttcacttctttgcaattaaaatatttccaccaatttatct

SEQ ID NO: 44660 - DNA, 601 bp, Human
ttatttttaaactagtctctttaaaccacaaaatactgtaaagttattcattgaaaagaatgtaacatttactactgcaatatatgatgtgcaatttattgagaatgtctcctaaatgcatctttatgtattgcataatctaaaattcatatcaggtataactacaatctaattcttgtgtcaaccatgaaagcctttcttagaaagctggtgaaatcctttgttacaaatatcagtctctgcttgttattatgtctgtattagtatcatctgcaatcctcagcagcttacttttcatcckggtaaacttctaacaggccacatctgaatcatggataaaatacaatttgcagggaattctctatttctattcagaattttaaaaattttaactaaatgtgcaaggccttcaacaatttcttagcttgccctttacctaagcctacttgctccttaggtcaatattaagttcctggatttaaatattggtggctttcctctcaggtgttctctgttaaaagctttctcttcctttagaatccttagtaaaggaagtggtatttgcaaggaagagaacagtgtcttccctactatttagctg

SEQ ID NO: 44661 - DNA, 601 bp, Human
tttaaaacaatcttttatttttaaactagtctctttaaaccacaaaatactgtaaagttattcattgaaaagaatgtaacatttactactgcaatatatgatgtgcaatttattgagaatgtctcctaaatgcatctttatgtattgcataatctaaaattcatatcaggtataactacaatctaattcttgtgtcaaccatgaaagcctttcttagaaagctggtgaaatcctttgttacaaatatcagtctctgcttgttattatgtctgtattagtatcatctgcaatcctcagcagsttacttttcatcctggtaaacttctaacaggccacatctgaatcatggataaaatacaatttgcagggaattctctatttctattcagaattttaaaaattttaactaaatgtgcaaggccttcaacaatttcttagcttgccctttacctaagcctacttgctccttaggtcaatattaagttcctggatttaaatattggtggctttcctctcaggtgttctctgttaaaagctttctcttcctttagaatccttagtaaaggaagtggtatttgcaaggaagagaacagtgtcttcc

SEQ ID NO: 44662 - DNA, 601 bp, Human
tgctcatttctcaaatttaaaacaatcttttatttttaaactagtctctttaaaccacaaaatactgtaaagttattcattgaaaagaatgtaacatttactactgcaatatatgatgtgcaatttattgagaatgtctcctaaatgcatctttatgtattgcataatctaaaattcatatcaggtataactacaatctaattcttgtgtcaaccatgaaagcctttcttagaaagctggtgaaatcctttgttacaaatatcagtctctgcttgttattatgtctgtattagtatcatctgcaatcctcagcagcttacttttcatcctggtaaacttctaacaggccacatctgaatcatggataaaatacaatttgcagggaattctctatttctattcagaattttaaaaattttaactaaatgtgcaaggccttcaacaatttcttagcttgccctttacctaagcctacttgctccttaggtcaatattaagttcctggatttaaatattggtggctttcctctcaggtgttctctgttaaaagctttctcttcctttagaatccttagtaaaggaagtggtatttgcaaggaag

SEQ ID NO: 44663 - DNA, 601 bp, Human
tatagcatcataaatttcacagtaaaattatccatgagaaatgtaaaactcaaacaaagttcagtaatattttaaatctcaaaaattaaaaagaattgctgactgtgtcttggcacacttttctgtgtttgtgaaatatgttagagccagcctgtttttgatgaagagcaactgtactggagagaaagcctgtattcatattcatcgtcatcaggcaaatcgaggagctgacttgcttaggatcagtaagtgcttttttcctcacttcttaacaaagaacagaacattgtgtaaaaaaaaacaaaatcccatttttgttaaaaataatagtaaacaatggaatgttagataattgatttttttacttcccatataaaatgatcaataactactactaaatactaattcgtagttgtattaattggcatcacatttattcttgcttgcattttccctgatcgtaacaagaatgatctgactgtaaagttagtgaaacaagattacatgggcaagtagatactgactcatgtaaataacagtgagtcatgtttggctgcctgattctgttaaaagaaaaatgcatccatattcattcaaagca

SEQ ID NO: 44664 - DNA, 601 bp, Human
gagtaattagactcacaaataacagaaagcaaagagtggcaaatctatcgttcctgccagcttcttctgctagtcatcagaacaattatcttctagtttatgaaaggataaagatgtagtattcaaatttaaatgttaccaatataagatatggagatatgtgaaacctactatagtatcttcataaacatagttttatagcatcataaatttcacagtaaaattatccatgagaaatgtaaaactcaaacaaagttcagtaatattttaaatctcaaaaattaaaaagaattgctgactstgtcttggcacacttttctgtgtttgtgaaatatgttagagccagcctgtttttgatgaagagcaactgtactggagagaaagcctgtattcatattcatcgtcatcaggcaaatcgaggagctgacttgcttaggatcagtaagtgcttttttcctcacttcttaacaaagaacagaacattgtgtaaaaaaaaacaaaatcccatttttgttaaaaataatagtaaacaatggaatgttagataattgatttttttacttcccatataaaatgatcaataactactactaaatactaa

SEQ ID NO: 44665 - DNA, 601 bp, Human
cataaagggctgggcacggtggcttatgcctgtaatcctagcactttgggaggccgaggcgggtggatcacctgaggtcaggagtttgagaccaccctggccaacatggtgaaaccctgtctctactaaaaatacaaacattagccaggcgttgtggcgcatgcctgttattccagctactcgggaggctgaggcaggagaatcgctggaacccaggaggcggaggttgcagtgagccgagatggcgccattgcactgtagcctgggcaacagagcaaggctccgtctcaaaacaaacaarcaaacaaacaaacccataatgtattaaatgcacagtttctaacataatatgaatatccagtaactgctgactagcattattattataacatttacattaaaactaatctgcactggtttaagtatcgcttaatgattgattctgtttctttcacacacctgttcttttactccacctgatgtaaaggaaatacgtgaacatttgttgattattaatatggtttggctgtgtccccaccaaatctcaacttaaattgtatctcccagaattcccacatgtcacaggagggacccaggtgga

SEQ ID NO: 44666 - DNA, 601 bp, Human
tatcagtctattatttttaaactgcataaaggtataactcttcagttttcatcaaaaccacactttttaggttatcagggtccacagttcttaagcaagcaatgcatgcttagtgctatctccctgctataaatagcttctcagtcttcccaccactgcccatcccttctctccttaatgtcttggtcaaaaccatcccccaggaacccctttccacttaattgctgatcatgttgatgttttgatcaccttagctacttcctagagtcggtagtatatatgtgagatttaactttaaaamtacccataaagggctgggcacggtggcttatgcctgtaatcctagcactttgggaggccgaggcgggtggatcacctgaggtcaggagtttgagaccaccctggccaacatggtgaaaccctgtctctactaaaaatacaaacattagccaggcgttgtggcgcatgcctgttattccagctactcgggaggctgaggcaggagaatcgctggaacccaggaggcggaggttgcagtgagccgagatggcgccattgcactgtagcctgggcaacagagcaaggctccgtctcaaaacaa

SEQ ID NO: 44667 - DNA, 601 bp, Human
aaatgcagatttaaaaatgtctttttatgcaactgccagaaggaagcactgttttgtctgcaaattcccagattctgctctagttttaaaggctaacgactgtgaaatgcaaatataatcagggttccagatgtggcaatcaggaaatgatttgtgtaccagctatttttaacaaaaggcttgcaaacatgataaatgaatagtgaaagtcaaaatgatatcaaatatgcatgaaagtagcatatatataattataaattacctttaggaattaattataacattacttcagagagattcrtatgatttattcctatggagaatgtagagtcagatgatctaggttatcactttgggactaggatatcaccaaaaatctttatgttacaacatatgtgatagaaatgaacacaattttacaggaagaactaatcagatgaattcagatttcatttgtactttggtataaatagatcaaactgggttttctcaactagatgtataataactacagataaaaagaactatgctggtttgccagaatgtaaaacactggcgaaagtgagggggctgtatcaatgagctcgggaaagcagctcca

SEQ ID NO: 44668 - DNA, 601 bp, Human
tgtatttattatcctcttttcctgagaaaacagatgcttttcaaaacattaagtgatttatctaaggttacatagctagtcagagatggaagcagtatttggactcagaaagtttgacatcagtaccaaccactgtgctctactgactacaatggccctacttgagaagttcaaaatcatacatacgtgggtacaactgaccctaagactgcctggcacaaactttgtgggacaggctagatttatgtgagatgtacttgaagtggagaagattgtgacagagagtcactaaaatatgctkcctgtactaggagaaaaaaaaaaacaaaaaaacttggcctagcctagagcagtggggtaggctaattacatgatgttgaggaggaagaaggagcatttctgtcttttttcttgtcttataattgattaaattatatctgtgtcacgatatcagaaacaaattacagtataatggacagtttttgaacccatcttagcttgtatcctggtatatgtagagtgttagaccaacagtggcacctatatgtagttaaatacattttaatttatctttagcctgaaaggaaaatagtttcttata

SEQ ID NO: 44669 - DNA, 601 bp, Human
gacaaaaggcttccagaagttgagtccaaattttacacttatataaaatccttataacagaagaccaaattataattcaataactgaagagtttttaaaatagtggatgtgttcatatcagcatggcttcatcatgtggataagagacaagaaattggcagatgcaacctgcagattcattactgttcctgtgaagggcaggataatgaataaaaatgaaaataatgaaaaataatgactagaattttaggcagtttgcttaatctctattccaggaaaaatacagcaaaaaagaaaaaatatcttgaaattttttctaaaaacaattataagtgacatttcttatttttctgccaaataatgtggaagtataatcagtcaaataagtctgatcttttctggtaaaataattatttatttgaaaatgtaagacgtaataatcagagagtctttaaaaaggggccaaaaaaatctcctttaacattcttcttaaagaacaaaattataaaaaagaaccatactaaaaatattttaaaacaaaagtaaaaattcccattactgttgcagagcttttaaatttttatttttgtttgatttttaa

SEQ ID NO: 44670 - DNA, 601 bp, Human
ggctgggggatagataagtctccagtgcagaaaacttccaaatagcttctgtagctattcaaaccaaagaaggcggagtataactctctgcttcttattgttggctgagcgtagtgatttccttccagagtataatacagaaagagaaagaaagagtgaagaaacctgatgatgacgactatctcagccaggtgatcaaggttgacatcagcagtgataagtcatcttgacaaaatggccctttatctctgtggtcttcctcaaaagcacactcccaatcttgagaaaagcataagacacrttttagcagtggggcatcgtacaaaatacctgtccagtattatccaaaattgtcaaggtcttcaaaaataaggaaagtatgagaaattgtcacaactaaggggatcctaagaaaacatgacaactaaatgtaatacagtatcctgatggaatcttggaacacaaatgtgacatgataaggtaaaaatataggaaccatgatcaaagtatgaacttcagttaatgataatatattaatatttgttcactaattgaaacaaatgtaacatactaatataagttgttaataatagagaaaaat

SEQ ID NO: 44671 - DNA, 601 bp, Human
atacctgggagaaatgcagccactccatcttatcagaaccagaattgcggtggtctattaatgttaaaaagtgctgctggctataaattgaagtttgactatatacaccatgccctttaggaattattctgctagacaaatggcttcctaagggttcacaaggttattacgatttgattttcacacttgcagaagtcaagtgttctgttgaaggtgaaatttgtagataaggaaggctagactgattcatgaggtagtagattagggttggagacattaatataaactcatccttagcttsatgtacatatgcatagcaacatacataaaaaattatagatatgtgtatacacattgttagtatacatacacatatctcttcactcagtcagctaagacaacctagaaacaatgaaaccccagtaacaatgagcaaatatagcacccagatcttggtgctaataccactccccagtaaaggaactagagcttcctggagaaaggaccaattctagaaccagggcaagaaatataaaagatggaagtagaccatctggtagtgtgagaaattaaggaagtgatttttaaaaacccacaatta

SEQ ID NO: 44672 - DNA, 601 bp, Human
gtttagctccgcctttggccttgctgacaccttcccaaggagaatgggaccactcataccatgttgttgccttcaaatgggaatggaggctcagcactctaacagaccccctgaaccaaggcagagggaaatgaagtgtcaactctctttctttacactaccttaattctatcctattggtgttaggtgtgtgtagaggcttagttcctcactggtctcccctgaccccaggttttgaaggaaagtacagtgcctcctatacccaacttgcaacatcctgttgctgatggcaagtagaggygggggcttagctccccactggaccccatggctgtgtgcagggagtccatttgtaattagctctgtctggcatgatctccttaagtctccttcctgacgggtggggtggaggctcagctctccattgaaccacactgcaacaactctggtgggggaaccacagtgctgcctgcttgtgaagggcaagagtagggtggtatgcacgatcaactccttacctggtccctctgaaacaaaagtcatggatcatgtctgtaaccatgacctatggtttcattagggttttactggagaggtgtac

SEQ ID NO: 44673 - DNA, 601 bp, Human
acaaaggtttttattttggttgttgtatttgtcagctctatcattttcacttggtttttattttataacatctattttgttgcttatactttctattttttcatttattttaagaaatacataattgctttttgaaacatttatgtgatatcttatttaaaatccctgtcacataatttcaacaactgatttatctcagttttagtgtgtgctgactataattttttttcatttattttgtgattacctggttcttggtataattggtagttttcaattgtattgtgaacattatgagtaktatatgactctggatcttattttaacttattatttttagaaggaagctcccctatattggggtgtagcaagaaagctacaagggtgggaatgtacaggttccactgggccttgctgacaccatactggcaacagagggacgctgactcacatggccttactgcagacagatgaggtagaagtttagctccgcctttggccttgctgacaccttcccaaggagaatgggaccactcataccatgttgttgccttcaaatgggaatggaggctcagcactctaacagaccccctgaaccaag

SEQ ID NO: 44674 - DNA, 601 bp, Human
agccaaagaagaaactggatatgaagttcgtgcatggcagttgtttgctttcagtactcgaagaatgttatgccaatacttctgacatccatagtttcagatccgaaatctgctgtcatttgaattggtgtttctctgtaagtaatgcattgtttctctctatctgcttttcagacttttttcctttctctttatgtttcagaagttcaattatgatgtgcctcggcatgaatatctttgtgtctaccctatttgagttttgcttaggttcttaaatctgtacgtttatgtcttttgccaktttggggaactgctctgtcattatttcttcagataatttttccatctcactggctggctgttttcattctgggagtttgatgatatggatgttagctttttatttttcgttccacaggttcctgagttcctacccacttcttcactaagcctatgttttcctctctgtttttcaagtttgataaattctatttatctatttggtaaattctatttatctgttcttgaggtcactgatcctatgctttgtcatctccactctactcttgagcctgcccaacaaaggtttttattttggttg

SEQ ID NO: 44675 - DNA, 601 bp, Human
aagttgaccactcattcatcactcatttaacactcactgaacacctaatgtataccaaggattaagctagacttcagtgtaacctttattaaaatcattatcttagcatcaagaatttactttattggggcatccagatagtacaaattattacatagtgtaatggaagagagagcagtcttaattcattctgtggaccaataataagtgagaaatattagcaggtcttcctatagaaggcaatactggagatggatgtgtaatgtgaaggagaggtaaatttttgagtcaaagaggagayaaattcacagtagaaagaaaaagaatggttaaggaacagaacagaaagaaatgccatatacaactggtataaagagtgcttagaggggtgtaaaaaaagaagacaacagagagcatggtagcagccagataaagaatggtttgtgtatgtatgaaagagtgtggaatttaattgtaaggaagatggaaagccattgaatgatttttaacagaaaagttcaagttagaggaaaagaagatagaaaggtttatttgcataacatgatcagatatttgtttgttttagaaaggtcactttgga

SEQ ID NO: 44676 - DNA, 601 bp, Human
cagcatacttattttaaggtaattaaatgtttgagaattagtgttcctacctgattggaaaccttcttgtctttaattcattgactatactagatctcttttttcttggagatgaccttcagatttctatcagaaatcacttctttggggaaaccagggcttctcagaaagtcaggaaactgaaatgcagatagcaagagaaagggaaattatctgtacatataagtttcatttttaaaaattttaagcaaatgttcaagcatccgtcatttgaacagtatcataacttcaggaactttcrtggttatgagtatgaattctcacaacacaaacacgtgatgagagtataggttgaattttgggatttcaagtcaagcagtcttcaaaagaggcctggttagcctttgttaattaattgtgtgtgtgtgtgtgtgtgtgtgtgtgtgtgcgtgcagctttttttgtgatggggtggtggggaaagaaatctgttgactactagtcagtgatttagcgggcaaaaaaggcaagttttctgtcttttctttaatattcactttggttcttcagtcttcatctagatttctcttctatcttcact

SEQ ID NO: 44677 - DNA, 601 bp, Human
ctccaaggttttgtctgataaacatcacaacctccaaggggattgtgaacaggttccttgtagggtaggttagatacttattgtttcagacagtcacaccataaccagttctcagcatacttattttaaggtaattaaatgtttgagaattagtgttcctacctgattggaaaccttcttgtctttaattcattgactatactagatctcttttttcttggagatgaccttcagatttctatcagaaatcacttctttggggaaaccagggcttctcagaaagtcaggaaactgaaatgcagatagcaagagaaagggaaattatctgtacatataagtttcatttttaaaaattttaagcaaatgttcaagcatccgtcatttgaacagtatcataacttcaggaactttcgtggttatgagtatgaattctcacaacacaaacacgtgatgagagtataggttgaattttgggatttcaagtcaagcagtcttcaaaagaggcctggttagcctttgttaattaattgtgtgtgtgtgtgtgtgtgtgtgtgtgtgtgcgtgcagctttttttgtgatggggtggtggggaaagaaatc

SEQ ID NO: 44678 - DNA, 601 bp, Human
gccatcatgacccataattttcatgaccttcacagagggtcacggagacaacccacgaaaatgatttgttttaaaagaaaatactgaaagggttaatctgctgctccacaggcctaacctcctgggattaaaccacatgcatggagctcactaagtgtacttagtaacaacaagctaaaaatagaaaaaagcatcatgctgttattgtatgagtttccctccaaggttttgtctgataaacatcacaacctccaaggggattgtgaacaggttccttgtagggtaggttagatacttattktttcagacagtcacaccataaccagttctcagcatacttattttaaggtaattaaatgtttgagaattagtgttcctacctgattggaaaccttcttgtctttaattcattgactatactagatctcttttttcttggagatgaccttcagatttctatcagaaatcacttctttggggaaaccagggcttctcagaaagtcaggaaactgaaatgcagatagcaagagaaagggaaattatctgtacatataagtttcatttttaaaaattttaagcaaatgttcaagcatccgtcatt

SEQ ID NO: 44679 - DNA, 601 bp, Human
aagtttgcaagtaatatagttaagaaatttatctgatggattttctccccaagcactaatcattgaatagtacatctaatgaaggtactatgcctaaatgtaaaggataagatgtaaattattaaaaagcagtctcagaactagaaaaattgtcagctatatcagcagactcagattcaggctttcatgtcacagatacttctgtcacagaccttggcaaatatgtgttttgtgttggtcttataattgtccttagaatcatggggacttattcattaattcaaaaagatttatggcccayattttatgtgttagttatagtactgggttctgagactacagaagccaacacacaaagcaatccaaggacaaactttttctcttcattcatccattattcagtatgtgtcttcattttgagtactgactagggatcaagtgctgtgctaaatgtatatattaataagtatatattaatataactgcaaatgagaagatgagccacttattatgatgttactgctgtttttttcttttctttccataaaatgggatgtccttttgccccaagttttggacttaaattgcaaatgaaaagaaa

SEQ ID NO: 44680 - DNA, 601 bp, Human
agaatatagagaaatagctgctgcagctgtactacccatggaaaagtataaataacaattttagcagctagtgattctgaaattgcccttaactgtgtcattataaaaatgctttaacaaatatgttttacagtaaggtgactatagcaaaaagcaatgtattgtatatttcaacatagctagaagagaagattttgaatgttatccccacaaagaaataataaatgcttaaaatgatggatataccaattaccctgatttgatcattatacaatgtatatatgcattaaacatcacactmtaccccataaatatgtacaattactgttatcagttataaatctgaagaaaagaaaagtttgcaagtaatatagttaagaaatttatctgatggattttctccccaagcactaatcattgaatagtacatctaatgaaggtactatgcctaaatgtaaaggataagatgtaaattattaaaaagcagtctcagaactagaaaaattgtcagctatatcagcagactcagattcaggctttcatgtcacagatacttctgtcacagaccttggcaaatatgtgttttgtgttggtcttataa

SEQ ID NO: 44681 - DNA, 601 bp, Human
cgaaaaagccatgcgatgacatagcaggagggcagtagtcttcaagtaaaggagagaggcctcaggagaaactaaacctgccaacacctttctggacttctaacctccagaactgtgtaaaaataaaatctgttactgaagccatagactctgtgatattttgttatggcagccctagcaaactagcacaaagaccaattgaggttttatactaactagattggctgatataactggtgaggctgtagaatcataggactgcaacttgactgagttactttgagtttcaaagttgacttgmgtaactttgaaaaagattttggcattatcttttaaagctgaatattcaaattccccatgacccagcagttctaatcgtggttacacatgttaagataaatcttgcacgtgtataataggaggcattaaaatacatgctcataaaacattgttaagaatagatccaaaacaactcaaataacatcaacaggataatatacacattttttacatttgtacaacattgtattatacagtgataacaatgaataaacactagctgaaacaaaatagatatcttagaaacataataatgttgagt

SEQ ID NO: 44682 - DNA, 601 bp, Human
tccagaataggaaatatagtgactattaaacagatgaaaagattttcaacctattggtaattagggaaatgcaaactaaaactattagagactgaattatgtttcccagaaattcatatgttgaagcctgagtcctcagtgtgactgcatttggagataggccctttaaagaagtcatttaggttaaataaggtcttaaacatgaggctctaatccaatatgactggattccttataagaagaaaaagactccagggatgcgtgcaaacagcgaaaaagccatgcgatgacatagcaggarggcagtagtcttcaagtaaaggagagaggcctcaggagaaactaaacctgccaacacctttctggacttctaacctccagaactgtgtaaaaataaaatctgttactgaagccatagactctgtgatattttgttatggcagccctagcaaactagcacaaagaccaattgaggttttatactaactagattggctgatataactggtgaggctgtagaatcataggactgcaacttgactgagttactttgagtttcaaagttgacttgcgtaactttgaaaaagattttggcattatc

SEQ ID NO: 44683 - DNA, 601 bp, Human
ttttctccttttgaattagtttgcaaaggatgatggcctccaactccatccatgttcctacaaaagacattatctcattcttttttatggctacatactattccatggtgtatatgtaccacattttctttatccagtctatcattgatgggcatttaggttgattccatgtctttgctattgtgaatggtgctgcaaagaacatttgtatgcatgtgtctttataatagaatgatttatattcctctaggtatataaaaccagtaatgtgattgttgggtctaatggtagttaacttttstttttaatgccagaataactgttacataaaatatctcactatgccactgtcaaagacaaaatcctgggactgtagaggtccattgcctaaccacctaaagctgcacagttcactcattagccacatgtggattttgaaccctttaaatgcaggctagtttgacccaggtgctgaaattttaatttaattttattttattttatttacatctattttttcaaaaaaacacgtggctaatggatacaacgttagacagcactgagagcattcccattatcacagaaacttctatggaacaga

SEQ ID NO: 44684 - DNA, 601 bp, Human
ggagattttaggagagaaaacaatcaaaactttatttatacatgtttatattagcttaatgaaacaaagacagccatcatgggactagcagataattctgaatatgaatttttgaatatgaagactggtacagattaacatccaattacactaaagaccagataaggtcttcattctattacagcatatcaggaataaggatacctcttgatactttggtaagtgccgttttgggagaatgaaccttactacaaagtgaacatttatgtcaagaagtagtttagtatataaattgtagtcrtatatgaatacaacttagtaaatttaggtatgtcatgaaagttatgttaggttactttgaaaagtaagaaatgaccaggttaactaactttttttctttttttttcaaacttttattttaggttcagtggtacatgtgcaggttgttatataggtaaactcatatcaaagggatttgtttcatagattattttgccacccaggtactaagcctagtatccaacagttatcttttctgctcctccccctcctcccacgctctaccctcaaaaggccccagtgtctgttgttcccttctttg

SEQ ID NO: 44685 - DNA, 601 bp, Human
acagtaaggcagaaggaacattgactaaggccatgtaggtcaaagaaggcagtttaatttttattttaaaagtgatgggagccagggttttggacaggaatgttacctggtttaaatttctttggaagattattctggctattgtacttgttataaactagaaggaccgtggcaagaggggaaggaggaagatcctgtaagagactgcctgttgcactaggtgaggcaagcaatgatggcttgctgtagggtgaagacggtgagaggtagagggatccaggacagattttaaagttagagrtggaaagagtttcttatggactacatgtagaaattgttggaaagtgaaagtttagggatgaatcccaagcttttggcttgagcaaatggagatggaaacaactggagtgaaagtgatagaaaaaagtaaactatttcattgtatttgctaattctgaaatgtctatgatatataaagtagagatatttagtgggaaatgggaattatgaatctcaagcctgggagagtggtgaaggctagaggtatgaatatgggagtcatagtcatctgcctattgaagcaatgggactagaataaaac

SEQ ID NO: 44686 - DNA, 601 bp, Human
ctgttattggggaatagctgtcccaggcctttgcaatagactgagctacgggatttatgtgtatgtagacatacatacatacatacatgtgaaaacacgttcatctacagttatatagtcacacacatatataccttacatctatgtttaattctatatttgctaaatatattgaaaaccagcactttcattcccccattttcatccagcaccagagttcattctagcttttgcctatatcatacttcaacttcctcctcagacagtgacaaacactgattaccttcatctttaatattcrcacttattagatcaatctccctgtattttaacaaattattgttgctaccacttttctaccccattataacattctccccacctagcacagactataactatctgtattgagtggttgctgtggccacttccccatgtagatgtccttctccttccaataactttcaacagctcacactatgctcctcggtgcagacaccctccttctacttcttgggctttaatagcaaatgcccaacctctgcaataccctgtatacccaccctgcccatggtgacaaaggcttactaggcctcatcga

SEQ ID NO: 44687 - DNA, 601 bp, Human
gtttctattattatttattttgaagctcagattgttcgagatttgcccaggggaaatcctttcaatttggccaatatgtcctttgacatctctctgtcattctttgatatgtttcttgcttcttggaacaatatgttctagggtcatcttatgctttctctgatctgaatcagccatttctccagaaagctctggttccttcactaggagaattgtatctagacaccaagatctggacactaggtttgctcactgttattggggaatagctgtcccaggcctttgcaatagactgagctaygggatttatgtgtatgtagacatacatacatacatacatgtgaaaacacgttcatctacagttatatagtcacacacatatataccttacatctatgtttaattctatatttgctaaatatattgaaaaccagcactttcattcccccattttcatccagcaccagagttcattctagcttttgcctatatcatacttcaacttcctcctcagacagtgacaaacactgattaccttcatctttaatattcgcacttattagatcaatctccctgtattttaacaaattattgttgctac

SEQ ID NO: 44688 - DNA, 601 bp, Human
taaccaggtataggccagtagacaacagctttgctttaactaaataagtgcccaggtttctgagagttaaagagaagtttttcatttttctaagtgtggagttgagaaattgttgaaaacaggaatttttttgaacttgtttgctgaattgcccagttgttacatggcctgacatggatgatttaaaaggttgcatttctgtttggatatataattgtcaccctgctgctttatcatcgccctcttacagggtaaacatgttcaactgttttgagtttgcgagtgtgaaagttccttatgrtctgttttttcttatgaatttcatgcccatttattccaatttgagtgcaggtagaaatatataaagttcttgaagaacgtattttcattctcatgaatcttgttgattttattgtaatacagagaactttactaattttatagacatttgtacagtaagaacatcaaaagaaaacaaaaacattgatacagtttggctttgtgttcccacccaaatcacatcttgaattgtaattccataatcctcacgtgttgtgggagggacccagagggaggtaactgaatcgtggtgttggttccc

SEQ ID NO: 44689 - DNA, 601 bp, Human
tccctctaaggtatgacaactccagtccccaccttgctgtctccaactataatctcctctactaaaatgtgtttttagacttactgttatacagtaattcaactgtaaaagactgcaaatgcaagcagagtcatttaaagaagaaaggaaaatgctctcaccaatttttaacacagaaacagcatttcgagacttacaaaaaagtaaaattgaaaaatatttcttacagctaatacttgcaggtaatgctattatgcctctcacaaaagcaagagggatgaggcatagaaggaacgtggtkttgagggcaatgaaaacaagcagttactgcaatctgttacaagctgcattcaattgactagaagacaggggtttcagtgccataatttttacaatatttgcttgccatctgatgttgggaaaaatattaatttctctgcacttcagttttcatgcctccaaaatgtgggttctcaaactaaagacatatttcaaaacttttcaaggtctaaaaattgctgactttagtgtctgtgtgcccttcataaagggcaagttttcacaaagtatggtattcttctaaaaggcctttgaagtaaga

SEQ ID NO: 44690 - DNA, 601 bp, Human
gccagaggttgcaaatttcttttttgaaaaatcagattttggtgatgactttgagcagtgggatataaatgactcccacaaacttaccgttccgataatggaacactaggcataaatgggttaaggaaggttataatagattaggtcaagccaacattgtctctttcccacctccctctaaggtatgacaactccagtccccaccttgctgtctccaactataatctcctctactaaaatgtgtttttagacttactgttatacagtaattcaactgtaaaagactgcaaatgcaagcagagtcatttaaagaagaaaggaaaatgctctcaccaatttttaacacagaaacagcatttcgagacttacaaaaaagtaaaattgaaaaatatttcttacagctaatacttgcaggtaatgctattatgcctctcacaaaagcaagagggatgaggcatagaaggaacgtggttttgagggcaatgaaaacaagcagttactgcaatctgttacaagctgcattcaattgactagaagacaggggtttcagtgccataatttttacaatatttgcttgccatctgatgttgggaaaaatatt

SEQ ID NO: 44691 - DNA, 601 bp, Human
ttggataaatgagaggccagcactgtttagtgaaggcaaaaggaacagcaacgtggaaagtctaagaatgccattttaatatgccacaatgctacatttaagctaaactcggcgatcttttcttttctgagtgaatgaaaatgcattaattaaaaacacacatttcatacacatgttaatatctgctattctgcaagcaagtattttctgtacagtgtctaaatatctactccaatcgaaaaagtgcttaaacactttaatatgcctcttttcaaccaaaaagaaaaacagttgctatgaycatgtttcaacatattttaaatctacacataatcactgccaatttataatatcttctctgcagatgctaatttcctatatagcattttttatcccctttaactaccgaaaatgtaattgttcagtattataattaatgtttttcattgctattacatgtctgaacgttgttagaattttttgttaatctttttattaatggaatgctcttcagtacaatgtgtaatactcttcttctctgacactgttataagttatttcaaagattttccatacacttgttttaaatagaattttcaaa

SEQ ID NO: 44692 - DNA, 601 bp, Human
gtaataaattatattaaatatgtgatttggatacattttaatatatttgataaaatgtagtgtggagcttccaaaagtgcaattgcccaggatgggagaaaccttaaaaatggccctgctcataatgaaatagaagtgactttgattggcaggttgaggcagagatggtaggccctgagaataagggagcaggggtgcagtggagaagactgcctggtgaaataggagagtcagatattagtgatttattgagtgggaagcatgaaggtagaggattctaggttgacaattttagaattgyatctagatttctaacttggataaatgagaggccagcactgtttagtgaaggcaaaaggaacagcaacgtggaaagtctaagaatgccattttaatatgccacaatgctacatttaagctaaactcggcgatcttttcttttctgagtgaatgaaaatgcattaattaaaaacacacatttcatacacatgttaatatctgctattctgcaagcaagtattttctgtacagtgtctaaatatctactccaatcgaaaaagtgcttaaacactttaatatgcctcttttcaaccaaaaagaa

SEQ ID NO: 44693 - DNA, 601 bp, Human
cttatgtgagaatttattattttcatgttgacctctttatattatatttctgggtctttgattttcgaatccactacaatgtatggcacagagttttgtattttgttcctaaatccacaaaatgtattatgtagattgttcttgattatcttactcaagatcctccttgtttaagtaacttgatcgaggtcatacagttgttcatagtaaaactaggctgagagtatgtgtccttattcttacccagttcattttcctgtctaatgaaatattttttataaacttaagaagataaacacarttatgatctctagcacactttcttttcttatattcacaattataacaaaagattttttaaaataacagcaatagaaagcatctagaatcccgagtaatctaacctattttcacttcgttgatggcttcctcttttaagttttttatcaaatatatatgacgaaagtagcaaattaaagcatggaataatttcttctgtccttttgctagggctttttatatcatatatttaatatttcaaagggtttataaatcatttatccactaatctttgcaatacccctgctgagaaagtcaatta

SEQ ID NO: 44694 - DNA, 601 bp, Human
aataaaaacaatttctttctttcttttttttgtatgctctttaaattttatttgtatcttgctttcttactctccatagcaaatcttacctaataactttgtggagaccaaggtcatcattcatcttcaatcctctttctttattatcacatttaaggtcatccatctctttattcaagagtccttttgcccaccattattaatacctgactggtgctcttgattctatcttcttcctcattatcattccttcaattctgcctcttgcttctggagttacaattttacttcagctacttcyttaacactttgcaaattgcttacatcttccctgttataaaatcttttatcttttaactctgcattttttaaatctttcttttctttttttttttcctttctttttgagacagggtctcactttgttgcccaggctggggtgcaatggaacaatcaaccctgcatgttctttaagacattcatcgctttttctttcatttactcccatataggaaaagaggtagatactaattttccctgcttcctctacactgctttatttttaattccccttgtaattttacacatgtatctattaact

SEQ ID NO: 44695 - DNA, 601 bp, Human
aataatgtctggctcagctctcaacccacagttgcacaaggtgctttacttgtgataaccacatgtttgatacacaacagaagtgcttcatgagatgtcccatttcatcacatgaatattaaaaacatgtgtactcaaaggtcgagattcaagaaaatgaatttttttttttactgcttcatcaagtacattcttaggtaaacctggaactaaaaaaatactaattgtgagtgtgtaggggtgcagaatacatagatcactaggagagttcagtgccactgacttgcttagtgcaaaagtkccagcagttccctgcccacccccaccttgcttttgcatcattcctgcaaatgtcagccttcttccccaccccgaatggcatcattacttaatttctcctctcgaactttctttagatcagactcaaatactttttccccctacaatgtttaacacgtaaaaactttaaaatgagaactctttacctgtaaatgtttaaaatgttagaagtactatctttctttagaaaatacttttataattgggcaacgagtgacctcaaagctactcataaattcttatactcattcctggtttaccc

SEQ ID NO: 44696 - DNA, 601 bp, Human
catggtgaaaccttgtctctactaaaaatacaaaaattagctgggcgtagtggtgcacgcctgtaatctcagctacacaggaggctgaggcaggagaatcgcttgaacccgggtggcggaggttgcagtgagccaagattgggtcactgcatttcagcctgggtgacagagcaagactccgtgtcaaacaaacaaacaggcttgaaaaaagcacgagtgctattatttctcatctgataacaatgatgtaaagtaggaaaacaaatcctcatttttcagatggagaaaataagtctcagarattttaagtaaccactaaatcatacatattaccatgacttaaactatgggtatatgtctttgggttttgtgtaaagggcattgtactttgcagtaaaggtccctgtttttttgccattatcatttctaactgccatgataatacatatccttgtaggggtttatatctaattctccttgctgaaaatagtttttaaaagatttgaaataccaaaaatgaggcagagaaatgtggtaacattttccatgagaaggtatatataaaagaaagtgtcttgtgttatgacttatctatgtggga

SEQ ID NO: 44697 - DNA, 601 bp, Human
gtctgttaatgaaatgggccaaaattcagtttgctttttattaccactatgcaccatgcaccagcaattctaaatattttcagtgatcaaatagcgcttccagtccagaaaaacagctccccacgttccccttgataagtcattacttgagaggagtaacaaacactcttgattaaatcttggaaataaaatgtcaaaaggtacaaaaactgattactcaaaaccctttcatttctatcattaaaatggccatactgcccaaattcacagattcaatgctattcctatcaaactaccaacratattttccacagaattagaaaaaaaattttctgaaattcgtaaagaaccaaaaaagagtccaaatggccaaagcaaccctaagcaaaaagaaaaaagccagaagcatcacgctacccaaacttaagctatactacaaggctatgggaacctaaaacagcatgatactggtataaaaacagatacagagaccaatgaatcaggttaaagaacccagaaataaagccacacttaaagctatctgatcttcaacaaaattgacaaaaacaagcaatggctaaaggactctctcttcaataaa

SEQ ID NO: 44698 - DNA, 601 bp, Human
tgaatgtgaaacaattgtcctgtttacaagttcacaaaacaagtaatgccttttctggtcctaagtatttagatcaaaggtctgggaacctttaatgtacatatttaaatatgtacatttttacatatttaaatgtaatatttaatattcatttaatattaatatattaatattaaatgtaataatattaattattattaataattaataatacatattattatgtatttttacataatatacagtattatgtattatatttgtgtccatttgtactcagtttttagctaccacttatacrtgagaacgtgcagtgtttggttttctgttcctgcattaatttacttaggataatggccttcagctccatccatgttgctgcaacagacatgatctcgtccactgttgatgggcatttaggtaggattatcaagcctgatagtacatatttaggctctgagggtcatatgatctctatcccaactactcaactttgtccttacagtacaaaagcagccatagccaatacgtaaaacaaatgtaataaacaaactttactaacaaaaatagagaatgggccagatttggcctgcatgccata

SEQ ID NO: 44699 - DNA, 601 bp, Human; identical to SEQ ID NO: 36625

SEQ ID NO: 44700 - DNA, 601 bp, Human; identical to SEQ ID NO: 36626

SEQ ID NO: 44701 - DNA, 601 bp, Human; identical to SEQ ID NO: 36627

SEQ ID NO: 44702 - DNA, 601 bp, Human
gctttaacgatcttttactatggtgtataataagaaatatcattggaaagatttcaatgtaagatttttggccgggcgcggtggctcacgcctgtaatcccagcactttgggaggccgaggcgcgtggatcacaaggtcaggagatcgagaccatcctagctaacacagtgaaaccctgtctctactaaaattacaaaaaaattagctgggtgcgctggcgggcgcctgtagtccgagctactcgggaggctgacacaggagaatggcgtgaacccgggaggcggagcttgcagtgagccsagatcgcgccactgcactccagcctgggcgacagagcaagactccgtctcaaaaaagaaaaaaaaaagatttttacatatataagtatatataaataaatgaaaaatatacgtaaaatacataaaacatatgtttttcatacatatatatgaaaactaaagacattcaaactcttttctaggagtatgaagtcattaatataatgagacagtgttattgtagaaacctttgaatttttaggagagttccagaatgaataaagcaattattgtcatgaaataccaaactttacatcctact

SEQ ID NO: 44703 - DNA, 484 bp, Human
tcaagtgtataacttaaaagtttcaaaaaaattatgctgaaatatgcccccaccaaagtaagaatacaagagaaaatgtgtctttataatttcaaattagaggaaatttataattgtcagtgtgagtccatctttaatatgtattatcaaacatgtcttaatgggctgggtatggtggctcackcctgtaatcccagcactctgggaggctgaggcaagcagatcatttgaggttgggagttcgagaccagcctggccaacatggtgaaaccccttctctactaaacatacaaaaatgagtcgggcatggtggcgggcacctgtaatcccagctacttgggaggctgaggcaggagaatcgcttgaacccgggaggtggaggttgcagtgagcagagatctgccactgcactccagcctgggtgacagagcaagactcagtctcaaaaaaaaaaggctttaacgatcttttactatggtgtata

SEQ ID NO: 44704 - DNA, 472 bp, Human
aaaaacatgtaaaatgttttgcatatggtaagctcttgatgtatattagctattaacagcataaactggcaaaccacgtagcttgaaataaccatgatataatttcttatctcactggaataaagaaataataactatcccacctccactattgtaaatgagactatatggtgtaggtgaagctgcagagataatgaataaactttcctcacatcactttcaatgtctttctattgcttcctaattgttaagttatactacaacagctttattaaaattgattttctatgttgagccatgttttttttttttgagacacagtttcgctcttgtcgcccaggatggagtgcagtggtgcgatctcggctcactgcaacctccgcctcttgagttcaagcgattctcctgcttcagcctgccaagtagctgggattacaggcgcctccacgacgcctggctaatttttttgtat

SEQ ID NO: 44705 - DNA, 601 bp, Human
tgttagccaggatggtctcaatctcccgacctcgtgatctgcccgcctcggcctcccaaagtgctgggattacaggcgtgaaccaccgggcccggccaaactagtgtcttcaattatttatttatcccaggatgtatctaaatcaggctcataaacgggtatgcatcagggacctgtcagataagacgcaccatactttatcacattaattcaggtataattcaggtaatttattaagttaaagaattataataaaagagataagcaatcttcatcatgcttaaaaaagctcatactgacrccaaaatggcaaataaaatgtagaactttagttataacttacatttaataggaattttcaaaacaacatacagatacatagtcatgactatcttaacagttgttcaaattcttaactgtgaacaagtgaaatcctagtttaatttatgcaataatacagaatatgtcaccaatagcttcattttcaggagcacagtacctccttcttttccaccttgggcagaggagtaagaataatcatgcatttttccatgcccttatgcaaatggaaacctacctacatacatttatttttgaagac

SEQ ID NO: 44706 - DNA, 601 bp, Human
actggtgtataggaatgcttgtgatttttgcacattgattttgtatcttgagactttgctgaagttgcttatcagcttaaggagatttggggctaagacgatggggttttctaaatatacaatcatgtcatctgcaaacagaggccatttgacttcctcttttcctgtttgaatgccctttatttatttctcttgcctgactgccctggccagaacttccaactctgtgctgaataggagtggtgagagagggcattcttgtcttatactggttttcgaagggaatgcttccagtttttgyccattcagtatgatactggctgtggatttgtcataaatagccttattattttgagatatgttccactgatacctagtttattgagagtttttagcacgaagggctgttgaattttgttgaaggcctttttgcatctattgagataatcatgggtttttgtcattgattctgtttatgtgatggatttattgatttgcgtatgttgaaccagccttgcatcccaggcatgaagccaacttgatcatggtggataagctttttgatgtgctgctggatttggtctgcagtattttattgagg

SEQ ID NO: 44707 - DNA, 601 bp, Human
gtgttcttgttcaactcccacttacgagtgagaacatgtggtgtttggttttctgttattgtgatagtttgctgagaatgatggtttccagcttcatccatgtccctgcaaaggacatgaactcatcctttcttacggctgcatagtattccatggtgtatatgtgccagattttctttatccagtctaccattgatggatatttgggttggttccaagtctttgctattgtgaatagtgccacaataaacatacgtgtgcatgtgtctttatcatagaatgatttatactcctttgggtrtatagccagtaataggattgctgggtcagatggtatttctagttctagatccttgaggaatcaccacactgtcttccacaatggttgaactaatttaaactcccaccaacagtataaaagcattcctaattctccacatcctctccaacatctgttgtttcctgactttttaatgatcgccattgtaactggtgtgagatggtatctcattgtggttttgattcgcatttttccaatgaccagtgacgatgagcattttttcatatgtttgttggctgcataaaagtcttcttttgagaa

SEQ ID NO: 44708 - DNA, 601 bp, Human
catatatatacaccttacatatatataccatatatatacaccttatatatacatatcatatatatacaccttatatataccgtatatatacaccttatatacaccatatatataccttatatatatcatatatacaccttatatataccatatataccatatatataccatatataccttacatatataccatatatacaccatatataccttacatatataccatatatataccttatatataccatatatactttatatatatcatatatatacacacacaccatatatataccttatrtatataccatatatatatataccgtacatatatatacacacacacatacacacaccttaagttctggggtacatgtgcagaacgtgcagttttgttacataggtatacatgtgccatggtggtttgctgcaaccatcaactcgtcacccacattaggtatttctgttaatgctatccctcccctagccccccaaccctgaacaggccccactgtgtgatgttcccctccctgtgtccatgtgttcttgttcaactcccacttacgagtgagaacatgtggtgtttggttttctgttattg

SEQ ID NO: 44709 - DNA, 601 bp, Human
agtggctatacatatatcagattaaatagattttaagtcaaaaactataaaaagatacaaaggtcactatataataataaaagggtcaattcagcaacatgagatataacagttgtaaatatgtgtgaacccaatatagcagcacctaaatatataaagaaaacattaataaatctgaagggagagataaacagtaatacaacaatagtaggggatttcaacagcccactttcagtaatggacagaacgtagagacagtaaataagaaaatatcaaatttaaactatactctagatcaaaygaacctaacatccatccaacagtagaagaatacacacgcttctcaactgcacacagaacattctccaggttagattatatatgaggccaaaaaacaaatcataacaaattctagaagactgagataattacaagtatcttttctgacaaaatcattaacaagagaaactacagaatattcacaaatacatggaaatttaaaaacaaaaaacatgctcttaaacatctaatgagtcaatgaaaaaatacaaagggaaactgaaaaatatcttaacaaatgaaaatggaaacaatataacaa

SEQ ID NO: 44710 - DNA, 601 bp, Human
ataagaggcttgcttcacctgtaaggacgtagactgaaaatgaaagaacagaaaatgatactccatgcaaatagaaaccaaaagaaagcagaagtggctatacatatatcagattaaatagattttaagtcaaaaactataaaaagatacaaaggtcactatataataataaaagggtcaattcagcaacatgagatataacagttgtaaatatgtgtgaacccaatatagcagcacctaaatatataaagaaaacattaataaatctgaagggagagataaacagtaatacaacaatagyaggggatttcaacagcccactttcagtaatggacagaacgtagagacagtaaataagaaaatatcaaatttaaactatactctagatcaaatgaacctaacatccatccaacagtagaagaatacacacgcttctcaactgcacacagaacattctccaggttagattatatatgaggccaaaaaacaaatcataacaaattctagaagactgagataattacaagtatcttttctgacaaaatcattaacaagagaaactacagaatattcacaaatacatggaaatttaaaaacaaaa

SEQ ID NO: 44711 - DNA, 601 bp, Human
taaaaacactcaacttatgctgcctataagaggcttgcttcacctgtaaggacgtagactgaaaatgaaagaacagaaaatgatactccatgcaaatagaaaccaaaagaaagcagaagtggctatacatatatcagattaaatagattttaagtcaaaaactataaaaagatacaaaggtcactatataataataaaagggtcaattcagcaacatgagatataacagttgtaaatatgtgtgaacccaatatagcagcacctaaatatataaagaaaacattaataaatctgaagggasagataaacagtaatacaacaatagtaggggatttcaacagcccactttcagtaatggacagaacgtagagacagtaaataagaaaatatcaaatttaaactatactctagatcaaatgaacctaacatccatccaacagtagaagaatacacacgcttctcaactgcacacagaacattctccaggttagattatatatgaggccaaaaaacaaatcataacaaattctagaagactgagataattacaagtatcttttctgacaaaatcattaacaagagaaactacagaatattcaca

SEQ ID NO: 44712 - DNA, 601 bp, Human
acacctataattccagctacttgggtggctgaggcaggagactcgcttgagcctgggtggtagaggttgcagtaagccaagatctcaccactgcattccagcctgggtcacagagactctgcctcaaaaataataataataatattaataagtaggaacaataaacatttgatctcagctataaaaagttgcaagaaatgggaaatactaaaaattgttgacagtggttctctgtgagtggttgcatactgggcaagttttactctagagtatattaaccttttcccaagctttctactgwtacttcagtaattgtattttaggttggaaaaggaacatcagaaagtatatcctcactttcacaaaaatattaagatgtaagaggaaacttactcataattgaggacagtcagtctttactggtgaaattaaaacaatgatttatttaggaagggatggagcaagatggcagagtaggacgcttcagcaattttccccagcagaaacaccaatttgaacaagcatccatactataacataccttcacaagagctaaataagccatataagagattacactatctggttgcagcacaataat

SEQ ID NO: 44713 - DNA, 601 bp, Human
aagctactaaaataaagaacaacggggcacacatttgtgaatacatattcattgtatgaaataggaaaaaaacataaaaacttatatacctactaataagaatggttaattctgggtaatgtgacagatcaaaattatgaagacattataaatcatgtttacaatttggaaaaagaggttgggtgcagtggctcatgcctacaatcacagcactttcagagactgaggcgggtggatcacttggggccatgactttaaaaccagcctagccaacatgatgaaaccccatctttaccaatayacaaaaattacccaggcatggtggttcacacctataattccagctacttgggtggctgaggcaggagactcgcttgagcctgggtggtagaggttgcagtaagccaagatctcaccactgcattccagcctgggtcacagagactctgcctcaaaaataataataataatattaataagtaggaacaataaacatttgatctcagctataaaaagttgcaagaaatgggaaatactaaaaattgttgacagtggttctctgtgagtggttgcatactgggcaagttttactctagagtat

SEQ ID NO: 44714 - DNA, 601 bp, Human
gcacggtggctcatgcctgtaatcccagcattttaggaggctgaggcgggcagatcacttgaggtcaggagttcgagaccagcctgaccaatacggtgaaactccatctctactaaaaatacaaaaattacctgggcatggtggtgggcatctttagtcccagctactagggaggctgaaacaggagaattgcttgaacccgggagacggaggttgcagtgagccgagatcacaccactgcacttcaacctgggtgacagagcgagactccatctcaaaaaaaaaaaaaaaaaaaaaaaarggaaaaatctccccatcttaaaatcagctgattagcaactttgaccttagttcccctttcctatgtaactgaacatattcacaggtcctgggaattaggacatgaccatctttgagggaccactgttctgcctacaaaaacatctaaaagaaggaaaaaaaaaaactaagaccagacggtttggagaagtggccagttgtgtgtttgtgtatgtgtggtgcagtggtggtggtggggtgtgtgtgtgtgtgttttcacacacgtgcagaagtccatttcaggcagcaggaaacacctgtg

SEQ ID NO: 44715 - DNA, 601 bp, Human
ttaaaaatcatatatattgtttacaaaatgttgttttgatatatgtatacattgtggaatggctaaatcaagccagttaacatgctttatctcacatactgatcattttttttgtgtgtggtaagaacactcaaattctattttcttagcaattttcaagaaggcaatacattgttattaactatagtcaccacgatgtgcattagatctctcaaatttattcttgtctaactgaaattttgtatcttttgaccaacatctccccaagctcctggtaaccaccatcctattcttagattcyatgaatttgactattttagattctatatatgagatcatgtgtctttctgtgcctggcttatttgcttagcaaaatatcctccaagttcttctatggcgtcaaaaactgacaggatttcctttttttttaatggttgaatagtagcacaaatttattatcttatagttctatagatcagaagtccaaaatggatctcactgagctaaaatcaaaatattgataaggctgtgctccttctagatgctctaaggaagaatcgatttctttgcctttccagcttctagaggctatcacacttct

SEQ ID NO: 44716 - DNA, 601 bp, Human
tacttctgatgctgtgagatggttggtcacaatcatatgctgctactggactgaaaactaatttcatctttttgcaatttgacaacattaagtaaaggacttaaaaactattattatgctctgctccagtaattctttagtataaactgtctaaaagcccaaaatgttttctggaacattaattacctctgttactaaaaccagtggacactattaagtcctgttgcatcctctgtagcactcgacactggttggctactccctcatcgttctctagtcttggtgttaccataccctcagrcttttctcttgtcttattttccctttcttctgccctctgctactgaactactagtgtttcagagttccattcttgttcctctttttgctaaaaaccattttccttacataaacttcataaatcaaccatatccaagtcaaacaggaagccctcaactttatcttgggttccaaacctataattccgataggctgccagagacctaccctaggatgtcccacaggcatcttattcatgtccagaactgaatttaccattcctctcaattctttctcccttttgataacttctaagtgaaaa

SEQ ID NO: 44717 - DNA, 601 bp, Human
tgtggtaggtaatattattgtcccatttttggaaaagaggaaaccaaggctgagtaacttgcccaagggcactaaatattgtaaagtcaggacataaactcagagataccatgctacttctgatgctgtgagatggttggtcacaatcatatgctgctactggactgaaaactaatttcatctttttgcaatttgacaacattaagtaaaggacttaaaaactattattatgctctgctccagtaattctttagtataaactgtctaaaagcccaaaatgttttctggaacattaattacytctgttactaaaaccagtggacactattaagtcctgttgcatcctctgtagcactcgacactggttggctactccctcatcgttctctagtcttggtgttaccataccctcagacttttctcttgtcttattttccctttcttctgccctctgctactgaactactagtgtttcagagttccattcttgttcctctttttgctaaaaaccattttccttacataaacttcataaatcaaccatatccaagtcaaacaggaagccctcaactttatcttgggttccaaacctataattccg

SEQ ID NO: 44718 - DNA, 601 bp, Human
ttttttatttttagtagagatggggtttcaccatgttggccaggctggtctcgaactcctgacctcaagtgatctgcccgcttggcctcccaaagtgctgggagtacaggcatgagccactgcacctggccaggaacattttaatatatgtaaagtatatatataaagttgactgaaaaaaaatactattcattacttttcaaatttgtaaaatataaaaaaaattagaatacccaacatttattttatgtatgtatgtatacatgtatgtatccatctctctatgtatctgtcagttacscaacaaacacttcaatgtagcatttactatgtgccagatactgtttaagtgctttaaaaataaaaactcattttgataacttctttaatcataaccacctgtggtaggtaatattattgtcccatttttggaaaagaggaaaccaaggctgagtaacttgcccaagggcactaaatattgtaaagtcaggacataaactcagagataccatgctacttctgatgctgtgagatggttggtcacaatcatatgctgctactggactgaaaactaatttcatctttttgcaatttgacaaca

SEQ ID NO: 44719 - DNA, 601 bp, Human
agtgaatatgaactatgatttgagtttaccctaactttcatgttagctgtcttcattaactgccgaatagcccattctcaaaactgattaaaactcccaaaattactgggcacacacatacacaaacatacatgcatatacagcaaaatgtcaaaaatttccttcatgggaacttataaatgttacatatatagaagaaataaaaagattagactatctcaataattaaaacatagaaaacataaaaccacaaaataaaacacggacaaaagatagaactcacaaaaacaaaaaaagttamcattcttgaaaaagttttcaaacttttaatgagttaataaaggaataataatcaaaggaatacacaccaaaacaataaaaatgtgtctatatgaaggcttatacatgaattcatagcggtattcataacaaccaaaactatacatttagtagagtaaatgtattcataagcaaagtgtggtacatccataaaacaaaacaccactcggggagtggaaggaatgaaccattggtacatgcaataatatgaatgcatctcaaaaacatgccaagtgaaagaagctaagcacagagtacctac

SEQ ID NO: 44720 - DNA, 601 bp, Human
gtgcctatttaactaggacaataatgctgaacctcagaaacctataaattattaagatctagagactgcttgcctacattttcaattgcatactttgaaaattctcttggccgatgcagtggctcatgcctgtaatcctagcactttgagaggctgaggtatgaggattgcttgagcccagtagtttgagaccagtctgggtaacagagaaagctccccatctctacaaaaaaaaattaaaaaaattagccagacaagttggtacgtgcctgcagtcccagctatttgggaggctaaagtygaagaatcactagaacccaggaggttgaggttgcagtgggccatgactgcaccactgcactctagcctgggtgacagagtgagaccctgtctcaaaaaggaaaaaaagaaaaaataaataataattcttttaagtattaacttcctaaaacaggagaaagattaagtgtgaatctgctattctattactgagatttgcacctactttttcttttttttgagacagagtcttgctctgctgttcaagctggagtgcagtagcacagtcttggctcactgcaacctccgcctcctgggtgca

SEQ ID NO: 44721 - DNA, 601 bp, Human
gaaattaaatataaaagaataaataacttactttaaagacgcaaagcgctccctccaggagccgcatgtttcaattcccagtcactactctaccacaaggaaatctctccttaaaaaatcttcaggggtcgtcttgtcactccaaactaactgctactgtatttgatatttttgaaatgcataagctttaaatttttaaaaaaaaatttttaataaactttgtataaacttttaaaaaaggaaattcatttctattgtcttaccaacagaaatcatcaaagatgactcaaatgaaaaaaakatatttgataaagtgcctatttaactaggacaataatgctgaacctcagaaacctataaattattaagatctagagactgcttgcctacattttcaattgcatactttgaaaattctcttggccgatgcagtggctcatgcctgtaatcctagcactttgagaggctgaggtatgaggattgcttgagcccagtagtttgagaccagtctgggtaacagagaaagctccccatctctacaaaaaaaaattaaaaaaattagccagacaagttggtacgtgcctgcagtcccagctatttg

SEQ ID NO: 44722 - DNA, 601 bp, Human
gagattacttaaggtgggagcaaacaggaaatagttcctggaggtggccactatgtgttttcaatgggtctgtaagggctaccaaatcaataaggaaattaaatataaaagaataaataacttactttaaagacgcaaagcgctccctccaggagccgcatgtttcaattcccagtcactactctaccacaaggaaatctctccttaaaaaatcttcaggggtcgtcttgtcactccaaactaactgctactgtatttgatatttttgaaatgcataagctttaaatttttaaaaaaaaawttttaataaactttgtataaacttttaaaaaaggaaattcatttctattgtcttaccaacagaaatcatcaaagatgactcaaatgaaaaaaatatatttgataaagtgcctatttaactaggacaataatgctgaacctcagaaacctataaattattaagatctagagactgcttgcctacattttcaattgcatactttgaaaattctcttggccgatgcagtggctcatgcctgtaatcctagcactttgagaggctgaggtatgaggattgcttgagcccagtagtttgagacca

SEQ ID NO: 44723 - DNA, 601 bp, Human
gctttaataatcatgaggccacgtcccttcatttgaacaaatgagtccactaagacccagtgttaactctggatagggagaaacattatgtggtagctttatttgagttaggattagctaaggctcattggctcaggcttgttcttctgatggaccatgatgttgtattaaaaaggctaatatcaaaacaataataggaaacatcctgtctttcaggttcttcacctgcaaagcaggtactttatttgctgtcttccaaaatcacaaaagtcaatacatatgcactcaatagtttagctaytgtgattcagaaacgaacactatgatgaagcaggccagaatcccaaaataaaaaatgtgcaacagaagtactatataaaaccaatcagttccacttgaaaagaagatgggaaggcccccaactgatgctccaaaattgcctatattttaatgagaattaaaataaaaactgaaagaacttgctttcaactgagccacatggtactttatgttgatctatttcatgatgaggtttggactaattattacttaattttaaacactgttaaagataatttatatctttagatgttaatgcaga

SEQ ID NO: 44724 - DNA, 601 bp, Human
ccactatcaccactaccttcctccattcatttaacaccaaaatgttccaggcttggttctgggtcttaaagatatagatgtgacagaacaaagtccctgccctcaaagaagagagggaagttaataatatacaaataattatgtttggagagaatgcaggcaagaggaaggtgctatatcaaataggattttcagggaaagagctctctgacaaggtgacatctgaacatttgaatggagtaggagacccctgtgaatgtttggtggtagagcattctgggcagaggaagcagcaagcacraaggttctgaagtgtgaggggtgcttagcttcttcaaggagaggcaggcaggccagtgtggcagaataatgagagggaaaatggaaaaaggagataaagacaggaaaggagaccaacaagatggcgatggcaataatccatgcaggagatggtagtggcttggatggaggggtagctatgaagatggtgaaaaatgttaacattctggatatattttgaaggtatggcaagcagcaggtccctagagaggaatcagaaatgacttcagtttttgataagagcaattacaaataaggtata

SEQ ID NO: 44725 - DNA, 601 bp, Human
ttactgcttaacaatcacaacatttaacccctagtttctaaaactaaacattatttctcaaatactttactatttaagtatgtaaacatataaatgactaacatgtacagatcatatgtaaaagaatctccaggagggttttattttagaaagtcccatcattcttttttttttttgagacagagtctccctctcttgccgaagctggagtgcagtggtgtgatcttggctcactgcaacctccaccacctgggttcaactgattctcctgcctcagcctcccaagtagctgggactacaggtgtgtaccaccacgactggctaatttttgtatttttagtagagacgaggtttcaccatgttggccaggctggtcttgagctcctgaccccagatgatccacccacctcgacctcccaaagtgctgagattacaagtgtgagccatggcacccagccagtcccatcattcttaagaagttctgaagctaaacacactgagatccagtcccagggctgccacttcctatcttcagctggcctcatcgtaagctcactaagcctcatttcctttttcataaaatggtataacatatactgaa

SEQ ID NO: 44726 - DNA, 601 bp, Human; identical to SEQ ID NO: 23754

SEQ ID NO: 44727 - DNA, 601 bp, Human; identical to SEQ ID NO: 23755

SEQ ID NO: 44728 - DNA, 601 bp, Human; identical to SEQ ID NO: 23756

SEQ ID NO: 44729 - DNA, 601 bp, Human; identical to SEQ ID NO: 23757

SEQ ID NO: 44730 - DNA, 601 bp, Human; identical to SEQ ID NO: 23758

SEQ ID NO: 44731 - DNA, 601 bp, Human; identical to SEQ ID NO: 23759

SEQ ID NO: 44732 - DNA, 601 bp, Human; identical to SEQ ID NO: 23760

SEQ ID NO: 44733 - DNA, 459 bp, Human
ctaataatttagtatctggacatcaaacagatcacaaactccttcgttatcatctaaattaaagttgtagtcatctgccggggtaggagaaagccttaagagaggaaacactgcgaacaaaaaacaaatttagtgttaaagatggtttctacatacggttaatgatctttaacaaaatactctcaaatacatcattccaaattaaagtcttgtgtaatgtgtattttgaaatattctcatttagtaacaatttgtacattgaatattgatattagattgagaaacagaagttaattttttytttttttttttttttttttaagatggagtctccctgtttcgtccaggctggagtgcagtagctcgatctcggcccactgcaagctcccgactcccgggttcacgccattctcctgcctcagcctcccgagtagctgggactacaggtgcctgccacca

SEQ ID NO: 44734 - DNA, 601 bp, Human; identical to SEQ ID NO: 23761

SEQ ID NO: 44735 - DNA, 601 bp, Human
cctggccaaacatgcatacacacacacacgcacgtgcacatttcataagttttattttcttttacaggtttgatcttgctcttctacctagttttttatgggttcctggctgcactcttctcattcacgatgtgggttatgcttcagactctcaacgatgaggttccaaaataccgtgaccagattcctagcccaggtaattatcttgcagttatgactttgttttttgttttttgttttttttttgagacagagtttcactcttgttgcccaggctggaatgcagtggcatgatcttggrtcactgcaacctctgcctcccaggttcaagcgattctcctgcctcctcagcctcctaagtagctgggattacaggcatgcgccaccacgcccggctaattttgtatttttagtagagacagggtttttccatgttggtcaggctggtctcgaactcccgacctcaggtgatctgccccgccttggcctcccaaagtgctgggattacaggcgtgagccactgtgcctggcagtggttacggcttttaacaaaattgagttatagtttatcttcaccataaatctgttttatatagcagat

SEQ ID NO: 44736 - DNA, 601 bp, Human
ttttcttttacaggtttgatcttgctcttctacctagttttttatgggttcctggctgcactcttctcattcacgatgtgggttatgcttcagactctcaacgatgaggttccaaaataccgtgaccagattcctagcccaggtaattatcttgcagttatgactttgttttttgttttttgttttttttttgagacagagtttcactcttgttgcccaggctggaatgcagtggcatgatcttgggtcactgcaacctctgcctcccaggttcaagcgattctcctgcctcctcagcctsctaagtagctgggattacaggcatgcgccaccacgcccggctaattttgtatttttagtagagacagggtttttccatgttggtcaggctggtctcgaactcccgacctcaggtgatctgccccgccttggcctcccaaagtgctgggattacaggcgtgagccactgtgcctggcagtggttacggcttttaacaaaattgagttatagtttatcttcaccataaatctgttttatatagcagatagaagatagctaaaccttggagctgagtaatgtgaaggttttaatttttgttgt

SEQ ID NO: 44737 - DNA, 601 bp, Human
gctaaaccttggagctgagtaatgtgaaggttttaatttttgttgttgttgtttaatatttacatactgatttaaagaccttcacatttatatactgataaatcttgagagtttgagtgggtttgttttgtttgtttcggtttctttttttttttgtcagaagtaagcaaatgaatattgagaattctagtaaaagccacgtttgaagaatatagttatagttatgagtgacttatgagtatcgtagagcagttttactttgccttgagtaattaaggtatatattttggcactagcttcrgttagagctttggacttataaaatacatactttgtcgttctaaatggttagttatgaaattggtaagatgttaaataatgatacctcatagagaacaaaatgaatatactcttcatatgtttaattcttcttgattttcttctggaaaaaaaattcattatacaggagaatgtatgcagtaaaaaactgaaacatctaaaccacattttctacctcctgattttattctttttaaacagtctttttttttttttttttttttttgagacagggctttgctcctgttgcctaggctggagt

SEQ ID NO: 44738 - DNA, 601 bp, Human
tttgtcagaagtaagcaaatgaatattgagaattctagtaaaagccacgtttgaagaatatagttatagttatgagtgacttatgagtatcgtagagcagttttactttgccttgagtaattaaggtatatattttggcactagcttcagttagagctttggacttataaaatacatactttgtcgttctaaatggttagttatgaaattggtaagatgttaaataatgatacctcatagagaacaaaatgaatatactcttcatatgtttaattcttcttgattttcttctggaaaaaawattcattatacaggagaatgtatgcagtaaaaaactgaaacatctaaaccacattttctacctcctgattttattctttttaaacagtctttttttttttttttttttttttgagacagggctttgctcctgttgcctaggctggagtgcaatggtgtgatctcggctcactgcaacctctgcctcccgggttcaagcgattctcctgcctcagcctcccaaggagctgggattacaagcatgtgtcaccacgcccagctaattttttgtatttttagtagagacggggtttcaccacgt

SEQ ID NO: 44739 - DNA, 601 bp, Human
tagacttctgagctatatcaccagccaaactgaactaattgtctcaaccattttttttcctagaacaatttttttctaatgatttcttttgtttacagctaatcttagtctaaatgtcttgaataactcttttaaaactcttagtgtattggagcaagtgtcagagattagttccatgctacttttccttcatctctcattgtagcactgtttttttctacctcagactaattctaagattattctttacttgctatttaagtgatgtgacttaccattgaacatagtctgatctattcaraaacactgaactctgtttataattgcatgaaatatataagcatatgtgttaaatatttttaagtacacagtttttaaactgagtttcttaaaattatttgtcgattattttagtacttaaagtatcattagtttaaataaatatacatgcatacacatgtacatataatacatatatattacatatgggacatattaaacatttccttatttaatatatcacatgtacatgtaatacatatataatatgtatttatgtgttgtatattatatacatataatatgtattatatgtacatgt

SEQ ID NO: 44740 - DNA, 601 bp, Human
gctatatcaccagccaaactgaactaattgtctcaaccattttttttcctagaacaatttttttctaatgatttcttttgtttacagctaatcttagtctaaatgtcttgaataactcttttaaaactcttagtgtattggagcaagtgtcagagattagttccatgctacttttccttcatctctcattgtagcactgtttttttctacctcagactaattctaagattattctttacttgctatttaagtgatgtgacttaccattgaacatagtctgatctattcaaaaacactgaactctgtttataattgcatgaaatatataagcatatgtgttaaatatttttaagtacacagtttttaaactgagtttcttaaaattatttgtcgattattttagtacttaaagtatcattagtttaaataaatatacatgcatacacatgtacatataatacatatatattacatatgggacatattaaacatttccttatttaatatatcacatgtacatgtaatacatatataatatgtatttatgtgttgtatattatatacatataatatgtattatatgtacatgtgtgatatatta

SEQ ID NO: 44741 - DNA, 601 bp, Human
catttagacacatcattcttagaatgtgtattaccttctatttccttctgttaagcagacaactgagcaagtgcattttataattacttgtgagactgttctaactatagaaagacacaggggcttactcatgggtagtagatttgatttttctgtcttataataaggacactaaatttcttgaaatgtaacatttattctgcattaaaactaaatattttaattaatagagcaaatctatattttatgaaatagtgtctctgaggacttggatttttttttgccattttattttatttctttttttttgtagctgatatacatttatgttgaatttgaaataggtcagtatagttattgagaaggaagaatctttttttttgtgccaggcattcttttttttttttttttttttttattatactttaagttctagggtacgtgtgcacaacgtgcaggtttccaatgtagtgcttgcttgggggatgggaaattatgtttattattttaaagttatgtctgtgtctgatttttaatacatccgtttttcaaagttaccagtttgtaatgctctttgatagccatcctagcccagtttttc

SEQ ID NO: 44742 - DNA, 601 bp, Human
ttggatttttttttgccattttattttatttctttttttttgtagctgatatacatttatgttgaatttgaaataggtcagtatagttattgagaaggaagaatctttttttttgtgccaggcattcttttttttttttttttttttttattatactttaagttctagggtacgtgtgcacaacgtgcaggtttccaatgtagtgcttgcttgggggatgggaaattatgtttattattttaaagttatgtctgtgtctgatttttaatacatccgtttttcaaagttaccagtttgtaaygctctttgatagccatcctagcccagtttttcctcctgttttgcttggccgagccatttatgtgaatggtgttaacagtcacatgagtaatcatcgaatgtcctggcctgctggttcatgatcagctcatctcttcctcagccacagacacctgcaactgctccctagaacattactttatctcatctcccaccccgtcttcccttttatgtagcttaattccatggttgttatttcatttttacttttactggtgctctaaaatcccagacctctcagtcttcatgtcacaccctgtgg

SEQ ID NO: 44743 - DNA, 601 bp, Human
caataataattgatttactatttttagtttcattattggttgcctttttatacttggtctttatatcttcttttatcatctatagatactctcttctgacttccttatttgtaaactatcatttgaggtattttcttgagtctcttttctggaaaactccttcctggagccctttccctcctgctgcactctactgtttctacatcagccttttactcccaactgtcctttggggaacttccttttaccactttctttagttggacccactgtttcttggctcttgccctgcccccccccytttttttaattatttttattttttctcttaatttactccttagttttgatggagtacattctcaagtaattttataagaaaagacacctgaaatgtaaatttgaacccttttatttctgaaaatggcttatttctgcctttatatttgctagtttatctccatatagaactcagttctttgtaatttgccttttctcttctctgaaagtttttcattttttttttcaattttctttatctcttttggattctaaaatttctatctggatttctgtctctaaagtattttgctgagacttg

SEQ ID NO: 44744 - DNA, 601 bp, Human
gaactattctgtttgttgggtcttagacctcttgtttttctcttactttgtttttacttaattagactttctgggggtttactttaattttcaactcctttttggtttttaaaacgttcgactgctgtcaatccttatgccctcctttttcatgtttgaaagatactataatatatctggttaaaaaataatgtcttctctattttttttcctgcagatactaattggacttaaaaagttttattttgttccaattatctctttcctttagggtcattcattcctccagttatcttggtctttttttttttttttcttcattgagacagtcttactctgttgcccaggctggagtacaatggcttgttctcagctcactgcaaccaccgcctcctgggttcaagcgaccctcatgcctcagccttccaagcagctaggattacaggcttgcgccaccacacctggctaatttttgtatttttagtagagacagggtttcaccatgttggccaggctggcctcaaactcctagcctcaagtaatctgcccatctcagcctcccaaagtgctgggatttcaggcatgagccactgcgctcggc

SEQ ID NO: 44745 - DNA, 601 bp, Human
ggtcatcacacagttccttacacttaatagtatggaagtggaagtcagcataataaaaaagcaaggtcactgatgaactgacctataccaacagagtctatgcagtagaagcccttggggaaattggtgaagggcttatttttttgcaaagtgttggatgtcatgatgctgttttgttataaagtttatctctacccccacaaaatacctgaatcattctttgcttttaaatgagtacatagtcccacagtaacctagtttctggtaagtataagatgaaaccaaacattttgacagtgattttttcccccaaggtaaagactttacacttcctttttgaggcatactctttgaaatttggttcttatttatttatttatttatttatttgagatggagcctcactctgtcgcccaggctggagtgcagtggcaacctccgccctctgagttcaagcgattctcctgcctcagtagaatccgagtagctgggattacaggcacctgccaccgcacccagctaatttttttgtgtatttttagtagagtcgtggtttcaccatcttggccaggctggtcttgaactcttcatctcgtgatcc

SEQ ID NO: 44746 - DNA, 601 bp, Human
aaacattttgacagtgattttttcccccaaggtaaagactttacacttcctttttgaggcatactctttgaaatttggttcttatttatttatttatttatttatttgagatggagcctcactctgtcgcccaggctggagtgcagtggcaacctccgccctctgagttcaagcgattctcctgcctcagtagaatccgagtagctgggattacaggcacctgccaccgcacccagctaatttttttgtgtatttttagtagagtcgtggtttcaccatcttggccaggctggtcttgaastcttcatctcgtgatccacccgcctcggcctcccaaagtgctgggattacaggcatgagccactgcgcctggcctggttcttactttcattgaattcaatacctttttctggtaccaattgcacccacacaccaatagttcttcctgaggcactgttatatcatatgttaattatttattagtaagcattgtccactagattaagttaattgagggcaggggtcacatcaggcttgctcactttgtgcctcttgggctaaacactgtgccaagtacggagcagaattgtattgtctgttg

SEQ ID NO: 44747 - DNA, 601 bp, Human
ttaataatgttttattttaactagtgttccgtaagcccagcactgattttaatcattgtggtctgtttgctacttctcagtctgtgttaaagttacactcattagaattaggcccatttagaaagtgttacatgtgaattttcataaattgcttatttatcatgaataatactagaaataactaatagcatgaattaattggattacaggtgatgcttgatttgtatgttgataaacatggaattctagtagacaagtaatacttaatgatttatatatgctcataaatttattcctgatacagtatttaaatttgtcgaggagagttttgcttgtagtaccttaaattttccttcatgcttcccctctggttgcagttctggttattaatcacatgaaactcacacctgctgtctcccaggcctgagtgctgcattctaggttggcaccttgtggtggctgttgctttccagtctggaagcacagcattttattcatttcaggaaaacatcggtcctaaacctgctggtgcattcctgctgttagtaggtagaaaggctggcatttggtatttggagggcagataagattttacaggagt

SEQ ID NO: 44748 - DNA, 601 bp, Human
atttatcatgaataatactagaaataactaatagcatgaattaattggattacaggtgatgcttgatttgtatgttgataaacatggaattctagtagacaagtaatacttaatgatttatatatgctcataaatttattcctgatacagtatttaaatttgtcgaggagagttttgcttgtagtaccttaaattttccttcatgcttcccctctggttgcagttctggttattaatcacatgaaactcacacctgctgtctcccaggcctgagtgctgcattctaggttggcaccttgtrgtggctgttgctttccagtctggaagcacagcattttattcatttcaggaaaacatcggtcctaaacctgctggtgcattcctgctgttagtaggtagaaaggctggcatttggtatttggagggcagataagattttacaggagtacatgagttaaagaagggactctcatgaaagagagtatagagtgtatctggaagtgtaagtatcaggatagttcatgtggaaggggttagttagataatatttgcaatcaagatgagcaagcttcttctcagaaatacacttgtaatgataata

SEQ ID NO: 44749 - DNA, 601 bp, Human
agtttctgcaaactgttcatgattgatattcctttaattataaacatagtttttacaaattctttttgtgacctaaagaggatttcttttgttttcaacttcagaatgaagatataccaaatgtagcagtttatcctcataatggaatgatagacttaaaatatttcccatattatgggaaaaaactgcatgtaagtattgagaagttcttatgtggtgattactcttttgggaagctggagcatgtgttgacgtaccacttgtctggggtaggtagacgccagccctgtttaatttgtgsgtcatctattcaggttttgttttattttaatggtgatggtaaatggagttcccacatttacaattcagaacacagaacccaagcagatacgttaaagttagatgattatttctaaaatatcattttctttttcattatagaggtagtagtaggtgcttatgtagagaaagtagaaaagtacttaaaaagaaaatcaaggccgggtgcggtggcttactcctgtaatcacagcactttgagaggccaaggcgggcgcattacctgaggtcaggagtttgagaccagcctggccaacttggc

SEQ ID NO: 44750 - DNA, 601 bp, Human
tggtggcaggcacctgtagtcccagctgctcgagagggtgaggcaggagactggcatgaacctgggagtcggaggttacagtgagccgagattgtgccactgcactccagcctgggcaacagagcgagactctgtctcaaaaaagaaaaaaaatcaaaagctcattgcggccgggtgtggtggctcacgcctgcaatcgcagcattttgggaggccgaggcgggcagatcacctgaggtcaggagttctagaccagcctgactagcatagtgaaaccccgtctctgctgaaaatacaaaawttagccgggcatagtggtgggtgcatgtaatcccagctactcgggagactgaggcaggagaatcgcttcaacctgggaggcagagattgcagtgagccaagactgcaccattgcactccagcctgggcaacaaagcaagactctatctcaaaaaaaaaaaaaataggttagtggactaatgagttatcataggagtgggactagcggctttataagaagaggaagagagacctgagctagcaggttagcatgctcagccccctggccacgtgatgccttgcaccacctcaggactctgtt

SEQ ID NO: 44751 - DNA, 601 bp, Human
aaatcaaaagctcattgcggccgggtgtggtggctcacgcctgcaatcgcagcattttgggaggccgaggcgggcagatcacctgaggtcaggagttctagaccagcctgactagcatagtgaaaccccgtctctgctgaaaatacaaaaattagccgggcatagtggtgggtgcatgtaatcccagctactcgggagactgaggcaggagaatcgcttcaacctgggaggcagagattgcagtgagccaagactgcaccattgcactccagcctgggcaacaaagcaagactctatctcaaaaaaaaaaaaaataggttagtggactaatgagttatcataggagtgggactagcggctttataagaagaggaagagagacctgagctagcaggttagcatgctcagccccctggccacgtgatgccttgcaccacctcaggactctgttgaaagtacccagcagcaaagaaggttctcaccagatgcagctccttgatcttggccttctcagcctccattaactgtaagaaataaattcctttctttataaattacccagtttcaagtattgtgttataagcaacagaaaacaaagaca

SEQ ID NO: 44752 - DNA, 601 bp, Human
ttgggaggccgaggcgggcagatcacctgaggtcaggagttctagaccagcctgactagcatagtgaaaccccgtctctgctgaaaatacaaaaattagccgggcatagtggtgggtgcatgtaatcccagctactcgggagactgaggcaggagaatcgcttcaacctgggaggcagagattgcagtgagccaagactgcaccattgcactccagcctgggcaacaaagcaagactctatctcaaaaaaaaaaaaaataggttagtggactaatgagttatcataggagtgggactagcrgctttataagaagaggaagagagacctgagctagcaggttagcatgctcagccccctggccacgtgatgccttgcaccacctcaggactctgttgaaagtacccagcagcaaagaaggttctcaccagatgcagctccttgatcttggccttctcagcctccattaactgtaagaaataaattcctttctttataaattacccagtttcaagtattgtgttataagcaacagaaaacaaagacagtagtacagttaacaaaggaagttaacatatagtgctcttatgaatctgtagactt

SEQ ID NO: 44753 - DNA, 601 bp, Human
cgggagactgaggcaggagaatcgcttcaacctgggaggcagagattgcagtgagccaagactgcaccattgcactccagcctgggcaacaaagcaagactctatctcaaaaaaaaaaaaaataggttagtggactaatgagttatcataggagtgggactagcggctttataagaagaggaagagagacctgagctagcaggttagcatgctcagccccctggccacgtgatgccttgcaccacctcaggactctgttgaaagtacccagcagcaaagaaggttctcaccagatgcagcyccttgatcttggccttctcagcctccattaactgtaagaaataaattcctttctttataaattacccagtttcaagtattgtgttataagcaacagaaaacaaagacagtagtacagttaacaaaggaagttaacatatagtgctcttatgaatctgtagactttgttgaaaatccatcaattgttccagtaatactctttatagtgaaagacaagtgttttcctgatcccagatgtcacactgttaacacgtttagcaacctataatcaggaatatttcctcagtctgtttcatggctt

SEQ ID NO: 44754 - DNA, 601 bp, Human
gggaggcagagattgcagtgagccaagactgcaccattgcactccagcctgggcaacaaagcaagactctatctcaaaaaaaaaaaaaataggttagtggactaatgagttatcataggagtgggactagcggctttataagaagaggaagagagacctgagctagcaggttagcatgctcagccccctggccacgtgatgccttgcaccacctcaggactctgttgaaagtacccagcagcaaagaaggttctcaccagatgcagctccttgatcttggccttctcagcctccattaacwgtaagaaataaattcctttctttataaattacccagtttcaagtattgtgttataagcaacagaaaacaaagacagtagtacagttaacaaaggaagttaacatatagtgctcttatgaatctgtagactttgttgaaaatccatcaattgttccagtaatactctttatagtgaaagacaagtgttttcctgatcccagatgtcacactgttaacacgtttagcaacctataatcaggaatatttcctcagtctgtttcatggctttgtactcttcaaaaataagtacgggccttttat

SEQ ID NO: 44755 - DNA, 601 bp, Human
ggcaggggaatcgcttgaacctgggaggtggaggttgcaatgagctgagatggtgccactgcattccaacctgggcaacatactccatttcaaaaaagaatattaaaaaataatgataagggtcgggtgtggcggctcatgcctatatattcccaagcactttgggaggccaaggtggacagatcacgaggtcaggagatcgagactatcctggccaacatggtgaaaccccgtctattaaaaatacaaaagttagctgggcgtggtagcgggtgcctgtaatcccacctacttgggaggytgaggcaggagaatcacttgaacccgggagtcagaggttgcagtgagccgggatcgtgccactgcactccagcctgggcaacagagcaagactctgcctcacaaaaaaattaataataataatgataataggccgggtgtggtggctcacacctgtaatcctagcattctgggaggacaaggcaagaggatcacttgagctcaggggcatgagctgtcacacccagtcaacatttttatcagtaattacaggtatggacttacagctccaaaaaattaaaaagaatgcagagaacagaaa

SEQ ID NO: 44756 - DNA, 601 bp, Human
ggcaagaggatcacttgagctcaggggcatgagctgtcacacccagtcaacatttttatcagtaattacaggtatggacttacagctccaaaaaattaaaaagaatgcagagaacagaaaataatagagctaaattttttttttaatttacaagccacgtatggtggctcacacctgtaatcccagcactttgggagggtgaggtggaagggccatttgaagcgaggagtttgagattagcctgggcagggagaccctgtctctacaaaaaaatttaaaaattagtgggctgtggcggcaygtgcctatagtcccagctacttaggaaactgaggtgggaggattggttgaggcttcaatgagccataattgcaccactgcactgcagcctgggcaacagtctcaaaaagaaaatttacagaataagccaattcctggtagagagaagtattaagtttccatagagtttgaattaatatattttccttttattgccaggttgggtatctacagccattggttgctgttcaggtcagctttgctcctaacaacactggggaaagaagtaacagttgagtgcaagattgatggatcagccaac

SEQ ID NO: 44757 - DNA, 601 bp, Human
cggactccatgctccctcccccatttcgcaggcagtcactggtcaggaagggacatggggctttctttgagatttccttaggaatttctggctgccttcatcagtttggtgtggctaaggccaaactcctccagctctcttccccttcccctgcttctctctcttgcctccaccctgcagttctgcaatatctcagtcactggacttagcctctccaccctgccatacatattccgtggccaggcttgggtcaggtccagtctagctcattccgatttgttctttccccctctctgctgcrgtcttttcagagagcttctgcttatgccagctcccttccccattgtttggacgctactcccttactcctccatcacccacctgacttcctgttgctctctgcttgggttattataacagctgccatttatggagtgccccctgtgtgtatattcacagactctcacgctcacaacaaccccgtgagccaggagctattgtcttcaactcacaggtgaggcaatgaaggctaacagaagctgagtaacttactacacaggtggtaagcaagtgctggagctcagagtaggaatcgtattgg

SEQ ID NO: 44758 - DNA, 601 bp, Human
aggttattcttaggcaacatatggagacccccgtctcttaaaaaaaaaattaaaaggaggcagaggtaggagtatcgcttgagtctaggagttcaagaccagccataggcaacatagtgagaccccatctctacaaaaaaagaaacacaaaaattatccaggcatggtggctggtgccattcacccatagtcctagctacttaagaggctgtggcaggcagatctcttgagtccaagaggtcgaggctgcagtgagcttcaattgcgccaactgcactccagcctgtctcagaaaataattataataataataataataataataataataagaccacctcaacattgtagcatttttattaaaaaaaaatttactgagtacctgttatatgccaggcccctgcacatgcactgtcatttaatccttaaaagaactttttgaggtaagtgttgctttatcctcatatcacagatgagcaaacagaggcaaagaaaggtgaaaggacttatctaagagtcacatagtcagtaagtgatagagctgggatttgaaccaggtcaagctgactccagaacacacactttttttttttttttgaga

SEQ ID NO: 44759 - DNA, 601 bp, Human
gttgacctatagggtctgtctgagaccccattgctgcccagcccccaaccccaagtgcatattgcaacctcgtggtttcaggagcttgccagttgctctagggaggaaattctcctctatcccttaggcaggctaagaaggcttctcccacctcttgccacttctgccattaagttgcaaggagatcatactagcagcaggaaactgaatgtgaggaggacatgcagccctggaccataggaggtgcagtgatccctggagtcatttcctgaccccagtgcatgctccacagcagagcaastggttgtggaagaagcctcatattcagccctgggtggtcctctatgctgtagaggaaaggggtggggtaacagcaactgcaaaagttgggaaatgggatgaaagaatctggggaaagaaggacagtccacaggacataggttacttctcagaacaaggtttcttcatttagctaaataaataaataaataaataaataaataaataaataaaaagccttagtgagttcatgtcatgtgccaaccagcatggggaagcagggctatgggtgccctttctcccaagcctgggattctatatg

SEQ ID NO: 44760 - DNA, 601 bp, Human
tttctccctaatgctgtgggttgttttttattagagggtggggacaaggtctggctatatcactaaggctagagtgcagtggcacaatcactgctcactgcagccttgacctcctgggctccagcgatcctcccacctcagcctctcaattagctgggaccacaggtatgtgtcaccatgcccagctaatttttcaattttttttttttgtagagatggggggcttgctatgttgcccaggctggtcttgaactcctgggctcaagcgatcttcccacttttgcctcccaaagtgttgggwttacaggtgtgagccaccttgagcagtccccaatgctgttgttgacctatagggtctgtctgagaccccattgctgcccagcccccaaccccaagtgcatattgcaacctcgtggtttcaggagcttgccagttgctctagggaggaaattctcctctatcccttaggcaggctaagaaggcttctcccacctcttgccacttctgccattaagttgcaaggagatcatactagcagcaggaaactgaatgtgaggaggacatgcagccctggaccataggaggtgcagtgatccctgga

SEQ ID NO: 44761 - DNA, 601 bp, Human
tcctatattgcttgtgaggcaagatctcctcttcaaaccttacctctccttcttatgaattcttttttctaaagggttatttcacaacacgggaaaattggtcataaccggtaacctagcagacaattcatggtgagtttatcaggactggtctggtacatcacgggcacatgggagatataccgcatcagggaaggttcccttgaatccttcctgctgtcgccgcatcatttcttcttgctgccgccgcatctcttcttcacggcgcctgcgctcttcctcctgcctacagagagtcacyaatgtatttaagacagaggcatttcagaacttgagcagattaacaggagactcaaccaaggagactggcctactgaaaactatcagttcaccaggaaactcactgttaagtgtgcccagccctgaggcaacccccaaagaaacctcatgagaccagcattcagctgctttctttttagcaggtaacttctaggaccatgggcagctaaaacatctccaatccaaagaaagaacctgagaagcagccaggaaatatttgccaacacatttataaatacacgaggtagcatggcagtaggaa

SEQ ID NO: 44762 - DNA, 601 bp, Human
ttagatatccactcatttttcattccaacctcaagagagtagtacaacgattctttactcactctgtgtggcctcattttctgcttcattttataatcacttaattcatttaacaaatatttattgaataccaactacacactactcctccatactactttttcatgaacctcaagttagtgagggaaaaacagccaaccaagttcagtactatgtgatcagtgccacgggaagaaagtagaggccaggcacagtggttcatgcctatcatcccaacactttagaaggccaaggcaggacratcgtttgagcctaggagttcaaaatcagcctgggcaacacagtaagatcccatttctttctttcttttttttttttgagatggagattcgttcttttagtccaggctggactacaatggcgtggtctcagctcccggcaacctccacctcccaggttcaagtgattctcctgcctcagcctcccaagtagctgggattacaggcgcacgccaccacgcccggctcattttgtatttttagtagagtcagggtttcaccatgttggccaggctggtctcgaactcctgacctcaggtgat

SEQ ID NO: 44763 - DNA, 601 bp, Human
aatgctgagtgtggcaggggtcgatagtgggtatgggagccagttattggagatggaaagtagataaatgggttgggcctgcttgtgaaaggttttaaaattcacgtagtactactatcccatgtttacagatgagaaaactgaggagggtatgagaagttaaataacttgtctatggtaactcaattagtaagtgccagagccatgatttacactctatctgtactccgaatccctacatttatatctgtgaatctgtgctcaaggatgcaaatggaaaccagaaaaccttatcctttayatgcagaagctatactgtttcctctttttaagacacagcaacaggccaggcgcaatggctcatgcctgtaatcctagcactttgggaggccgaggtgggcaagatcggttgagctcaagagtttgagaccagcctgggcaacatggcaaaaccccatctctaccaaaaaagtacaaaaattaacagggtgtgatggaaagcacctgtagtcccagctactcaggaggctactgggcaacaggaatgaaatcctgtctcacaagggaaaaaaaaaaaagacaaacagatttcttcctcttt

SEQ ID NO: 44764 - DNA, 534 bp, Human
cttcaagtgatctgccctcctcagcttcccaaactgctgggattacaggcgtgagccaccgtgcccggcctgtccctaagagttttactctggttcagcaactgcctaagttgcactgttgttctggaagcagtcactttgagcagaggtgttggacactggatgatacctagaggaagctgggaaaatgagttgcacagacagtaattgttgtaggaattcagaggggaaatacatttatccagatcaggaaagtcaaagaaggctattctcgaggaaggtggtgatgactgtgcccctyttctatcgaccttgtgtgtttgatccttatgcctattcctagatggaaaaagaaccggctgatggtcagtgaataccctggggtggtttcctaccagagttaaattatgctctggacttattttagctgtggaacctgtgctaaagaagacttctaggtgggaggcctcgccactcaaaattggctctgtgtgggcagagagcaacccctagtgggcttgtggaaagcatact

SEQ ID NO: 44765 - DNA, 601 bp, Human
tccaattacttcttttacatatcctttgctagattgtattcctctgtctatccttttgtgttagtgctccccagagccaaaacgtcagttctattctcacttattatttaattcagcattcacttgtttattcatttaacaaatgtttaatgactgtgtacaatgtgttcaatgatgggaatataaggaaaaataagacagacttcctgcctatgagacttattggcttaggccagacacagtggctcacgcctgtaaactcaacactttgtgagactgaggcaggaggattgcttcagcmtaggagtttgagaccagcctgggcaacatagtaagacctcacctctacaaaaaaaaattcaaaaattagctggatgtgatggcatgcacctgtagtcccagctactcggcaggctgacacaggaggattgcttcggcccaggaggtcaaggctgcagtgagccaagattgtgccactgcactccagcctaggtgacagtgagaccccatctcaaaaaatagaacaaaaaaataaagatagttgctggtctagtcaaagaaatgacttgaaaataaattattgcaagacagagtataaatg

SEQ ID NO: 44766 - DNA, 601 bp, Human
cctgaatctataattatctcaaaataaaaaggatcagaatacattcatgagcaaaaaagagcaaattacagaataaaacaaaaacttgaaaacctacatgtaattttctttttgactgctcttgcggaacagggctaccctataggcagtgtgctgagagcagcgtaataagtaaacacgttttgtctaagcatagaaaaaagtacctaagactatagaccaagctgttatctctggggaaatgaaaatatgggagacaggagtgggagggcaggcagaggctttaacttttaattttatrtatttctagattatttgatctttttataagagattttgcttttttgttttttaaaaggtctacctgacagaaatgtagatgataggttagaaggagataaatgtaaaggctgggacattcaccaggcgactaggcaaaatgtaatgtgaactttagtgacatactggatgttggaacttattcaaagtgaagaattaaaaaaaaagagtttcctagacgtagctactgggtaatgttaatgccccattaaacccagattggaaattgtaaatgagtgattcaagtaaagaaggagagagg

SEQ ID NO: 44767 - DNA, 601 bp, Human
taatttccttctgtatggtgatgtgagaagaaacgcaagtcacaagcttcatggttccagtaaggggggaaagcaagcattattgctattttttttttttttttgacacagtgtctcgctctgtcacccaggctggagtacagtggcgcgatctctgctcattgcaacccccgtctcccaggttcaagtacttctcctgcctcagcctccccaagtagctggaattacaggtgtgcaccaccacacccatctaattttttagcagagacagagtttcacgatgttggccaggctggtctcraactcctgacctccagtgatctacctgcctcggcctcccaaagtgctgggattacaggcgtgagccaccacgcccaacctattgctgctaactttctgaaaagattcagagaaaaacaccagtcaagttggcaagcacccctgggcaccaaggagaagaggggatttgtgatcactcctaggctcatgtttcccttgagaactcttccacaaatactaaaaataattcctccctaagaaaatgagtactctgtcaaaacagcataaattattatcttgacagtggatggtgtgaggatat

SEQ ID NO: 44768 - DNA, 601 bp, Human
cctctcaatatctcaattccctcactttataatacaaggaaaaattagttttatacattcgtgaagtttctctcttactttaatccattttgaaaatgggacctcttccttacccattttctttgcaacacatcactctaagaaatatccactaatggctgggtgcagtggctcatgcctgtaatcccagcattttgggaggctgaggcaggcaatcacctgaggtcaggagtttgagaccagcctgaccaacatggagaaaccccgtctctactaaaaatacaaaattaggccgggcacrgtggctcacgcctgtaattccagcactttgggaggcccaggtggacggatcacctgattgggagttcgagaccagcctgaccaacatggagaaaccccgtctctgctaaaagtacaaaattagccaggcgtggtggcacatgcctgtaatcccagctactcgggaggctgaggcaggagaattgcttgaacccgggaggcagaggttgcggtgagccgagatcgcgccattgaactccagcctgggcaacaagagctctcaaaacaaaacaaaaaaataaataaaaatacaaattagcca

SEQ ID NO: 44769 - DNA, 601 bp, Human
cgaggtgggcctgaggtcgggagtacgagaccagcctgaccaacatggagaaaccctgtctctactaaaaatacaaaattagccaggcgtaatggcccatgcctgtaaaaccagctactcgggaggctgaggcaggagaatcacttgaacccgggaggcgaaggttgcagtgagccgagattgcgccattgcactccagcctgggtgacaagagcaaaactcggtctcaaaaaaaaaaaaaaaaaaaaaaaaaaaaaaaaaaaaaaaaaaagaaaatacattattgaccaccaccatttaraagttgaaaggtatgattactatcatgcttcttacaaccaacattgtattaaggcaggttacacttttgcaaacacactctaataacatttgagtttgacagtagtaatgtaagtaaagtaaggacagtcactcatgtacaccttcctcaggttaagagataatgagttggttactatcttaaactgtttgtgagtgaagggaatgatgaaaaggtgaactggaataatgaagcagtactatctaatcctactcttcataggaaaccctctaactgcaccaaatgacagctaatgctcaa

SEQ ID NO: 44770 - DNA, 601 bp, Human
gagataaaggaatttcaattccaacaagagcatagaatgctttgatagtttatgagcccatcagaggatgctacgaagcaaaatggcatggtgaaaaatcataggccttggagtaaaatgtcctgggtttgagtcctggccccaacacttgctagtgagtaacaaattacttaacatctctaagccttgattaactcaactataaaacatggatgataatgtctacctcacagggttgttgtgagaattaagagatgtgtaagttccttacccatgcctggtactcaatatattatagatcccttccctgttttctgccctggaaagaacagggattcagcaaatggactattctgtgacaggagggcaagaaggactagataaagtgctcacaaaataatgtaaagtgaaaagagttaagacacaaaaccatattgatcaatttcattttaaaagtgtgtctataaacacaaatacatacgctacagatatgaaagaaataaaaatattcacactggctgatgttgcttctgagtggtggaagtgattacaagaggtaacttatttcttgtttttattttccagttttctctaacaaaca

SEQ ID NO: 44771 - DNA, 601 bp, Human
tgaccctgttcaaaaacatcaacttgccaacgtcatatacacaagaacctgaatggaagaaactcccttacacctgaacaacacactgccatcttacatgaccataaatgctctgacagcctcatggtttcatctaccacttacagtatccaattagtcaatagtcctgaagattctctcttcaatatatcttgtctctatcccctcctttccatccctactctgcctaccttggcttagtcctttgttatctctggcctgcactactgaaataagtcgtcatgccgccagtcttgctctyctccaattacttcttcacacttctgccagagtgctctttatttttttgtttgtttgtttattcttaattttacttgaaaaaaaaatcacacaagtaatgcacgttcactggttaaaaaaattagaatatacaccagaaaaaaatttaaaaaaatcaataactccatcatccagagataatcttttggtatattaccttccaaaattttttgtgaactttagatgcttaaacattttttttaatttacaaaattgggatactctacatactctccaggaaatctgccctcttcactaatga

SEQ ID NO: 44772 - DNA, 601 bp, Human; identical to SEQ ID NO: 26631

SEQ ID NO: 44773 - DNA, 601 bp, Human; identical to SEQ ID NO: 26632

SEQ ID NO: 44774 - DNA, 601 bp, Human; identical to SEQ ID NO: 26633

SEQ ID NO: 44775 - DNA, 601 bp, Human; identical to SEQ ID NO: 26634

SEQ ID NO: 44776 - DNA, 601 bp, Human; identical to SEQ ID NO: 26635

SEQ ID NO: 44777 - DNA, 601 bp, Human; identical to SEQ ID NO: 26636

SEQ ID NO: 44778 - DNA, 601 bp, Human; identical to SEQ ID NO: 26637

SEQ ID NO: 44779 - DNA, 601 bp, Human; identical to SEQ ID NO: 26638

SEQ ID NO: 44780 - DNA, 601 bp, Human; identical to SEQ ID NO: 26639

SEQ ID NO: 44781 - DNA, 601 bp, Human; identical to SEQ ID NO: 26640

SEQ ID NO: 44782 - DNA, 601 bp, Human; identical to SEQ ID NO: 26641

SEQ ID NO: 44783 - DNA, 601 bp, Human; identical to SEQ ID NO: 26642

SEQ ID NO: 44784 - DNA, 601 bp, Human; identical to SEQ ID NO: 26643

SEQ ID NO: 44785 - DNA, 601 bp, Human
tcggcctcccaaagtgctgggattacaggcatgagccactgtgcctggccttttttttttttttaaatggaattttgatgttgttgccctgagtggagtgcagtgggcgatctcggctcacctcaacctacacctcctgggttcaagcaattctcctgcttcagcctctcgaatagctgggattacaggcacccaccaccaccatgcccagctaatttttgtatttttagtagagatggggttttatcatgttggccaggctggtcttgaactcctgacctcaggtgatccaccctccccyccggcctcccaaagtgctgggattacaggtgtgagccatcacgctgggccaagcaatcctcttgtacctcagccttccacgtacctgggactacaggcatgcaccaccatacctaggtaatttttgtttttgtatttttttagagatgggatttttccatgttgctcaggctggtctcaaactcctgagctcaggcaatccacctgccttggcctctcagagtgctgggattacaggcatgagccattgtgcctgatcataccatattttctttattcagtctaccattgataggcattc

SEQ ID NO: 44786 - DNA, 601 bp, Human
ctgtgttgatagtttcctttgctgtgaagaagctctttagtttaattaggtccaatttgtcaatttttggtttttttgcagttgctttttgtatcttcaattatgaattctctgctagattctatgtctagaatgacatttcctaagttatcttccagggttttttataatgttaaaataaacatttcagtctttaatcttgagttgatttttgtatatggtgtaataaaggggtccagtttcaatcttctacatagtgcttgctagttattccaccaccatttattacatagggaattgkttccacatttctattgtcacctttgttaaagatcagatggttgtaggtgagtgacattatttctggactgtctattctgttgcattggtctatgagtttgtttttgtaccagttccatgttgctttgtttactgcagctctgtagtataatttgaagacaggtaatgtaatgccttcagctttgctgtttttgcttgtgattaccttggctattcagactctttggttttatatgaattttacaataatttttttttttagttcttttaaaaatattttggtcatttgattagaatagca

SEQ ID NO: 44787 - DNA, 601 bp, Human
tctgacaagtacttccaattttatgttgaatagtagtgttgagagaaggcatctttgccttgtgccagtttccaaagaagaatgcttcgggttttttttttcttttctttttgagatagagtctcactttgtctcccaggctggagtgcagtggcacaatctcggcgctctgcagcctccaccttctgggttcaagtgattctctttgctcagcctctcaagtagctgggattacaggcacctgccatcacacctggctaatttttatatttttagtggagacagggttttgccatgttarccaggttgatctcaaaatcctgacctcaggggatccacctgccttggcctcccaagttgctggaattacaggcatgagccactgcacccgtccacttccaggttttgtccattcagtatgttggctgatggtttgtcatatagataacttattattttaaagtatgtaccttcaatggctaggttgttgagggtttttaacatgaaagatgttaaattttatcaaaagctttttctgcatctattgtggtaatcttgtggtttctgtctagttttgtttatatgatgaatcacatttatt

SEQ ID NO: 44788 - DNA, 601 bp, Human
aattctcatttaatttttggacagattgaatatccttcaggactttgctgtgcagggcagacccaagggcaggtttctgcactcaggcctgcatatggtgagttttatatcaggatgtggatgagcatggctttcactgagtacaggagaggattttccgaggtaactttgggtttctacataggcaaaaccggccatgaactatggctcagggagctggaactgagtcatggaactgcttcagggaccacagtaaaggtcaaggtctgcaggcctgccagcatggctctaaatgggtgtmtttctccaggcctctggaaaggcaggacccccccagactgtgactgggaagagtttgggatgtttacagagtaagtttaaaattctcaggggaaccaagttaggtggaacaatttcttgtctttagccaaaaacagtagttctgtagtttgccacctgaatgaggacctgccttctgaaaagggttaccttcagtcttgggctttagcagagtttcacaactcctttcctggatctcagagttcttttaaaggcatttatttttgatctggggtattgtaacataacccaggcaggtctt

SEQ ID NO: 44789 - DNA, 601 bp, Human
ccactctccatataaattttaactgttttctacttcaaatttgtctgtaattttagattcagacatttagggcaatataatagaatatacatgtcgtgcctgaattaaattagataattagtatgcaggcaggcaaaaaggaattatagagccaggcgcggtggctcacgcctctaatccctgcactttgggaggctgaggtgtgtggatcacgagatcaggagattgagaccatcctggctaacacgatgaaaccccgtccctactaaaagtacaaaaaattagccgggcatggcggcaygcgcctgtagtctgagctactagggagactgaggcaggagaatcgcttgaacctgggaggtgggggttgcagtgagccaaaatcatgccactttgcttctaaacttggattacagtagttttattttgtgtaaaataacatgtatttaaaacataaaaattgagactagtttcttttaaatgcttatctattaaaagtttctcattagcatctcctaattatgattttactgcatttactctgaaattttattgctacataatagatgccattaatttaaaacacctgccttccttgaat

SEQ ID NO: 44790 - DNA, 601 bp, Human
gggtgggagtgacccgactttccagatgccgtctgtcacccctttctttgactaggaaagggaactccctgaccccttgcacttcctgagtgaggtaatgcctagccctgcttcggctcttccacgctttgctgcccccactgtcctgcgcccactgtctgtcactccctagtgagatgaacccggtacctcggatggaaatgcagaaatcacccgtcttctgcatcactcacgctgggagctgtagaccggagctgttcgtatttggccatcttggctgctcaagattttttttttaaarctgaatcatattccattctatcatacatgtcttcaaggtcttttgttgcatattttatatatagattcataaatgtaattgctgtatttgataattttatttttagttatttgaagtacatttataacataataaaatagtatgtgcatccttgttttccaccaacgatgcacatgggtttcttttttttcttttctttttttttttttgaaatggagtctccctttgtcacccaggctggagctcagtggcacaatcttgactcactgcaacctccgcctcccgggtttcaagcgattc

SEQ ID NO: 44791 - DNA, 601 bp, Human
agggaactccctgaccccttgcacttcctgagtgaggtaatgcctagccctgcttcggctcttccacgctttgctgcccccactgtcctgcgcccactgtctgtcactccctagtgagatgaacccggtacctcggatggaaatgcagaaatcacccgtcttctgcatcactcacgctgggagctgtagaccggagctgttcgtatttggccatcttggctgctcaagattttttttttaaaactgaatcatattccattctatcatacatgtcttcaaggtcttttgttgcatattttakatatagattcataaatgtaattgctgtatttgataattttatttttagttatttgaagtacatttataacataataaaatagtatgtgcatccttgttttccaccaacgatgcacatgggtttcttttttttcttttctttttttttttttgaaatggagtctccctttgtcacccaggctggagctcagtggcacaatcttgactcactgcaacctccgcctcccgggtttcaagcgattctcctgtctcagcctccttagtaactgggattacaggcacgtgccaccacatctggcta

SEQ ID NO: 44792 - DNA, 601 bp, Human
gcgcccactgtctgtcactccctagtgagatgaacccggtacctcggatggaaatgcagaaatcacccgtcttctgcatcactcacgctgggagctgtagaccggagctgttcgtatttggccatcttggctgctcaagattttttttttaaaactgaatcatattccattctatcatacatgtcttcaaggtcttttgttgcatattttatatatagattcataaatgtaattgctgtatttgataattttatttttagttatttgaagtacatttataacataataaaatagtatgtgyatccttgttttccaccaacgatgcacatgggtttcttttttttcttttctttttttttttttgaaatggagtctccctttgtcacccaggctggagctcagtggcacaatcttgactcactgcaacctccgcctcccgggtttcaagcgattctcctgtctcagcctccttagtaactgggattacaggcacgtgccaccacatctggctaatttttgtatttttagtacagatggggtttcaccatgttgatcaggctggtcttgaactcctgacctcaaaatccgcccgcatcagcct

SEQ ID NO: 44793 - DNA, 601 bp, Human
tgaacccggtacctcggatggaaatgcagaaatcacccgtcttctgcatcactcacgctgggagctgtagaccggagctgttcgtatttggccatcttggctgctcaagattttttttttaaaactgaatcatattccattctatcatacatgtcttcaaggtcttttgttgcatattttatatatagattcataaatgtaattgctgtatttgataattttatttttagttatttgaagtacatttataacataataaaatagtatgtgcatccttgttttccaccaacgatgcacatgrgtttcttttttttcttttctttttttttttttgaaatggagtctccctttgtcacccaggctggagctcagtggcacaatcttgactcactgcaacctccgcctcccgggtttcaagcgattctcctgtctcagcctccttagtaactgggattacaggcacgtgccaccacatctggctaatttttgtatttttagtacagatggggtttcaccatgttgatcaggctggtcttgaactcctgacctcaaaatccgcccgcatcagcctcccaaagtgctgggattacaggcgtgagcc

SEQ ID NO: 44794 - DNA, 601 bp, Human
tcttctgcatcactcacgctgggagctgtagaccggagctgttcgtatttggccatcttggctgctcaagattttttttttaaaactgaatcatattccattctatcatacatgtcttcaaggtcttttgttgcatattttatatatagattcataaatgtaattgctgtatttgataattttatttttagttatttgaagtacatttataacataataaaatagtatgtgcatccttgttttccaccaacgatgcacatgggtttcttttttttcttttctttttttttttttgaaatggagtctccctttgtcacccaggctggagctcagtggcacaatcttgactcactgcaacctccgcctcccgggtttcaagcgattctcctgtctcagcctccttagtaactgggattacaggcacgtgccaccacatctggctaatttttgtatttttagtacagatggggtttcaccatgttgatcaggctggtcttgaactcctgacctcaaaatccgcccgcatcagcctcccaaagtgctgggattacaggcgtgagccacctcacttggccaagggttttactgcatcatcaacaga

SEQ ID NO: 44795 - DNA, 601 bp, Human
ttattgtattttttattttttttgagatgaagtctcactctgtcacccaggccagagtgcagtgacacaatctcggctcactgcaacctctgcctcctaggttcaagcgattctcctgtctcagcctcccaagcagctgggactacaggtgtgtgcgaccatgcctggcgaatttttgcatttttagtagagaaggggtttcaccatattggctaggctgatctcaaaaccctgacctcaggtgatccacctgcctaagcctcccagagtgctgggattacatgtgtgagccaccattccyggccttatttgtttgttcttgagatagggtctcactctctcaaccaggctggtttgcagtgttgtgatcatggctcactgcagcctcaacctcccaaacttagaagattctctgattgcagcctctcaggtagctgggttacaagtgtgtagcttcatgtcctcccagtttttttgtatttttggttgagacaaggttttgccgcattgctgaggttggtctcaaacttctgagatccagtgaacaccccactttaacctcccaaagtcctgagattacatttctttttattaagtagtt

SEQ ID NO: 44796 - DNA, 601 bp, Human
gtgtgagccaccattcctggccttatttgtttgttcttgagatagggtctcactctctcaaccaggctggtttgcagtgttgtgatcatggctcactgcagcctcaacctcccaaacttagaagattctctgattgcagcctctcaggtagctgggttacaagtgtgtagcttcatgtcctcccagtttttttgtatttttggttgagacaaggttttgccgcattgctgaggttggtctcaaacttctgagatccagtgaacaccccactttaacctcccaaagtcctgagattacattkctttttattaagtagtttaattaatttatatttaaaattatttcttaaaatgaaattactagttttattgctattgttttatgtgtttgagtggtatgttttttcttatttactgttttattgccttattttaattgtgtagtgacatgcttcaattattttttaaattttgttttgcatactttctataaatattatcttcataatcctcttgtatattagtctgttttcatgctgctgataaagacatacctgagactgggcaatttacaaaagaaagaggtttattggtcacagttt

SEQ ID NO: 44797 - DNA, 601 bp, Human
tttacaaaagaaagaggtttattggtcacagtttcatgtgactgaggagtcatcacaatcatggtggaaagtgaaaggcatgtctcacatggtggcagacaaaagaaagagcttgcgcaggaaaactgccttataaagccttctgctttcatgagacttattctctatcatgagaacagcacagaaaacatctgcccccatgattcaattacctcctactgcatccctcccacaacatatgggaattaaagatgagacttgggttgggacatggccaaaccacatcatcttaaaaatggartttacataaaacatctaaaacttaaaaatatattttaatctcatgacaacttcagttgaatataaaaattatacctctgtatttttcagtttattaatataaaaattattttgtgtattaacatttatgcagatttttattgttttaaatattctacagaagagctttaagggttttatgcatcatcattatgatagtaaagatttctacatttgtatatttacattcaatagagagctttatttttatatatggttttatgatgctgtccagtattattttatttttaaataaaattga

SEQ ID NO: 44798 - DNA, 601 bp, Human
ttttgttttgcaattttatatttttgtgttatatattctagcatatgccaccatacatctgatatttgtgttttgattttttagtatatatcataattgtgcatgacaatatttaactttgtacaatttaagaccctgtggagcaaaatcaaatatgaatcagccatatgtctttttccagtagaattatatctgtttgtttgcctgtataaatgttatcttttttaaattttttttttgagacagagttttgctcttcttgaccaggctggagtgcagtggcacgatcttggctcactgyaacctccgccttccaggttcaagtgattttcctgcctcagcctcccaattagctgggattacaggcgcccactaccaagcctggataattattgtatttttagtagagacagagtttaccatgttggccgggctggtcttgaactcctgacctcatgatccaccctcttcagcctcccaaagtgctgggattacaggtgtgagccaccacaccaggctacccttggtttttttttgtttgttttttgtatatttgttgtataggtttgttgtgaatggttttctaatcctttgtagatga

SEQ ID NO: 44799 - DNA, 601 bp, Human
agaatgtggcaaagcatttatctggtcctcaacccttactaaacataagagaattcatactagagagaaaccctacaaatgtgaagaatgtggcaaggcatttatatggtcctcaaccctaactagacataagaggatgcacactggagagaaaccctacaaatgtgaagaatgtggcaaatcttttagccaatcctcaacccttactacacataagataattcatactggagagaaaccctacaaatgtgaagaatgtggcaaagcctttaactggtcctcaactcttactaaacataasataattcatactgaagagaaaccctacaaatgtgaaaaatgtggcaaagcctttaagcagtcttcaatccttactaaccataagagaattcatactggagagaaaccctataaatgtgaagaatgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaa

SEQ ID NO: 44800 - DNA, 601 bp, Human; identical to SEQ ID NO: 36628

SEQ ID NO: 44801 - DNA, 601 bp, Human; identical to SEQ ID NO: 36629

SEQ ID NO: 44802 - DNA, 601 bp, Human; identical to SEQ ID NO: 36630

SEQ ID NO: 44803 - DNA, 601 bp, Human; identical to SEQ ID NO: 36631

SEQ ID NO: 44804 - DNA, 601 bp, Human; identical to SEQ ID NO: 36632

SEQ ID NO: 44805 - DNA, 601 bp, Human; identical to SEQ ID NO: 36633

SEQ ID NO: 44806 - DNA, 601 bp, Human; identical to SEQ ID NO: 36634

SEQ ID NO: 44807 - DNA, 601 bp, Human; identical to SEQ ID NO: 36635

SEQ ID NO: 44808 - DNA, 601 bp, Human; identical to SEQ ID NO: 36636

SEQ ID NO: 44809 - DNA, 601 bp, Human; identical to SEQ ID NO: 36637

SEQ ID NO: 44810 - DNA, 601 bp, Human; identical to SEQ ID NO: 36638

SEQ ID NO: 44811 - DNA, 601 bp, Human; identical to SEQ ID NO: 36639

SEQ ID NO: 44812 - DNA, 601 bp, Human
cttctaagatataatatgactgatgtaattgtatatcatgtatcactcccaggtgctcaccttagggactcaattacataaacccagcaatttcctatacggcttcaagtctattaaaatgtcatcattctattggattttaaattgtgaaaatttctatcctcaacatttgtcttccctctatctctgtctgccaataaataaataaataaataaataaataaataaataaaaataagttttaggaaagaaaatcttccaaagagaacagcatgaggcatgaaaggccaggttgttttcycacatacggaactgccggtcgtttctaatgtcctgttgtgttttcctcttcaatattcatttgggatcagcagcagtgttcaaaaacaactgtgtccaaaatgggaaaaggaggggcaaccagggaaacagagagcagccttctgtaatggctcagcagccagtcatcgccaggctgccttttgtttaggttcagtcagatataccacaggcgccctattactttgtaatcagaggattgttacatgttatttactatttggcttgaaaaccctgaaaagtttataaggttttattagcc

SEQ ID NO: 44813 - DNA, 601 bp, Human
gtagcccagttgtaacagtggtatggaatgatatgtaggcagaaagtggacactggactactctctaaagacctcagttctttaaaggtaaacgagaagagcatcttcaaccatgagcagcctctgactctggagcacatcttagaagatgctgtggcctttttctttgctacctacaagccaagcatacaggcaagcaaacaacaaagctttgattcaaaagcagccaatcaatacccaaagctctcacggcccctgcagaaatgcaaaaggattgttatgtcttccaattaaactcttctaagatataatatgactgatgtaattgtatatcatgtatcactcccaggtgctcaccttagggactcaattacataaacccagcaatttcctatacggcttcaagtctattaaaatgtcatcattctattggattttaaattgtgaaaatttctatcctcaacatttgtcttccctctatctctgtctgccaataaataaataaataaataaataaataaataaataaaaataagttttaggaaagaaaatcttccaaagagaacagcatgaggcatgaaaggccaggttgttttctcac

SEQ ID NO: 44814 - DNA, 601 bp, Human
gaaacacacactttgttcaaggtactttgtcccagactacatttggaatgttttaagttttcaaaaaaatgagaaaaaaagcaacagactgttgcatatggcctgaacagaaaatttgtgtggtaaaaggacacactgcaaactggaatgtcttatggagggacaccagattttccagagaactaagttcttttcagcaaaattgatctaaatacaaaggatattaggaaagcaaggttctagcaaggttctagctcttcagtactcacaactgacactggaaagggggtgggggttgggrggcaggggagggtctgactgtagggcagctgaaacacaagacttgcccataggagtcatccaggaccaagaaaggtcctttctagacccttttcattcagcccagggattcctgggcagggttgtccttctcactgaaagtggcttatgtactgaagatgcacctcgtctgatagaaggaaaccttcactgaagctagcaaggtgagcctttcaaactccagagactcctctataatattctcagtgctgtttctaactctggccatgcaatttttaatgtataattcatttttttatat

SEQ ID NO: 44815 - DNA, 601 bp, Human
tatcctttccacagttaacactgacagtttgatcagtttatgaatgaatgtcatcacttctctcccgtagacgtggccataaatgtaaggtacctgcaacaggctcctcaggaaagagagggtaataggtcagaaatcttctcataaaacagtttaatttccataaaagcaaaatgcttgaatcatcttcaggtccgttctatttttttccatttctctctatatcctagcatcccagttatcattctgtcaaaaattattagactagtaatactccatatgcaaacaataatagtttgtwacttttaaagcaaagaaatatttaacttccatctaacttggggttgggatgaaaacagtgatcatgcacccttgaaggtcctcaactcatatcttttctgtttcggtgacttggctatttctctaggaacatggtggagaagagtctacttatactagcaatgagagcagagagagaggttccggggtccaatgtgaagtgaattaagatgaaatcagttagacacagggtattccagatatacagtagtaatggtgaactgtcgccaactttaagaataattcaaaatgctgggaaaag

SEQ ID NO: 44816 - DNA, 601 bp, Human
cagatatattcctacactaatttttagagatacattataaatgacaacatcttaaaatactgttttgttgctgctacactattgatttttgaatattgatgatataaccacctaccttttgaattttttgctgaaatggattataagttagttcccttaggttgtaccaatttatgtttttccagtctcttctaagtatgtgattacagcattacaaattaggttagaaactctatcctttccacagttaacactgacagtttgatcagtttatgaatgaatgtcatcacttctctcccgyagacgtggccataaatgtaaggtacctgcaacaggctcctcaggaaagagagggtaataggtcagaaatcttctcataaaacagtttaatttccataaaagcaaaatgcttgaatcatcttcaggtccgttctatttttttccatttctctctatatcctagcatcccagttatcattctgtcaaaaattattagactagtaatactccatatgcaaacaataatagtttgttacttttaaagcaaagaaatatttaacttccatctaacttggggttgggatgaaaacagtgatcatgc

SEQ ID NO: 44817 - DNA, 601 bp, Human
agcatgtcctgtgtgattccataggaagaggctcttggaagcttgcacctggcttcctctgaactttgtccatgtgacttctccctgtccttattctgctttgtatcctttcactgtaataagtcgtagccatgagaacaggacaactcacaggatgactgagtcctccttgtgaatcaccgaatctgagggtagtctcgggaacccctgagacagatacatatctagataatataatatttaaatcataatacatctatataggtactgcataccttttaacttttattagttattttayctcttttttacaaattaaacaataaagtgtatattctttgttgtctggcttttactcaaataatgttggttatacttatgtatattattttgtgtagtcatagtttgcattctttgctttagagcatggcattatgtgaatatgcccaacttacttatccaatctactactggttgttgctgggttatttccagtttgttgcttttataaacagtgctgctataaattttgtactacatgtttttgggtgtattaacatacatatttctttggtgagtatcccaggaatggaattgttgg

SEQ ID NO: 44818 - DNA, 601 bp, Human
ttttaactagcccttgagacacttgatatagatattgtacagaaaagagttaacgtagcaggactaagactgaaattcttggaaagggcggcttgcaaagttgaccttggactgatgtccgggaactcggatttgggagggttcccatcattccctgagaagagtggttcattgtgcctaaactgtgcaaataatgtgctttatgctaaaagtctagtttccttctgggagaagggaatcttggcagatgatagcaagaaggggtccatgtgaccagttcccactaaaaaccttaggaacygagtctctaataagctttcttgatagacagcatttcacatgtgctgtcccaattccatcctggagaaattaagcatgtcctgtgtgattccataggaagaggctcttggaagcttgcacctggcttcctctgaactttgtccatgtgacttctccctgtccttattctgctttgtatcctttcactgtaataagtcgtagccatgagaacaggacaactcacaggatgactgagtcctccttgtgaatcaccgaatctgagggtagtctcgggaacccctgagacagatacatatctaga

SEQ ID NO: 44819 - DNA, 601 bp, Human
gatttctctcttagtgtcaataatgattaattttctaattatttttctacatccaattttctacttccttaattgtatgtataatttttggaattttctctaatttcttcaaatattcttttaactagcccttgagacacttgatatagatattgtacagaaaagagttaacgtagcaggactaagactgaaattcttggaaagggcggcttgcaaagttgaccttggactgatgtccgggaactcggatttgggagggttcccatcattccctgagaagagtggttcattgtgcctaaaytgtgcaaataatgtgctttatgctaaaagtctagtttccttctgggagaagggaatcttggcagatgatagcaagaaggggtccatgtgaccagttcccactaaaaaccttaggaactgagtctctaataagctttcttgatagacagcatttcacatgtgctgtcccaattccatcctggagaaattaagcatgtcctgtgtgattccataggaagaggctcttggaagcttgcacctggcttcctctgaactttgtccatgtgacttctccctgtccttattctgctttgtatccttt

SEQ ID NO: 44820 - DNA, 601 bp, Human
tcataactcattatctaaaggaagtccttaaattatccctcagatttctctcttagtgtcaataatgattaattttctaattatttttctacatccaattttctacttccttaattgtatgtataatttttggaattttctctaatttcttcaaatattcttttaactagcccttgagacacttgatatagatattgtacagaaaagagttaacgtagcaggactaagactgaaattcttggaaagggcggcttgcaaagttgaccttggactgatgtccgggaactcggatttgggaggkttcccatcattccctgagaagagtggttcattgtgcctaaactgtgcaaataatgtgctttatgctaaaagtctagtttccttctgggagaagggaatcttggcagatgatagcaagaaggggtccatgtgaccagttcccactaaaaaccttaggaactgagtctctaataagctttcttgatagacagcatttcacatgtgctgtcccaattccatcctggagaaattaagcatgtcctgtgtgattccataggaagaggctcttggaagcttgcacctggcttcctctgaactttgt

SEQ ID NO: 44821 - DNA, 601 bp, Human
agaaatagatttgactaacatacaaacttctgccaaaactaaatgctaagtaacaaggtttgttctaaaaaatccagaagttcacaggatgggaaaattagatacaaccaaagtagtttcaaaatataaactacttacataaacagattacaatacttgcaatttcccataccattggttttgtttcttagttttagtctaaggattattcagcatcttgatttcttatcaatgcccgcttgctttactttaagaataattttatgtaaacaagtacatggttccacaaataactatttayatattgagaaaattttaaatgacataatatgctaaatattattaaataatataaaataaaaattcaattgaaatgcctcttttgttagtttaatatggataaagcatatttctagtgaaatacttttaaagattctttaagtaaattttaatataatttatatatttgcatgattcagcacatttaaatctaaccataaaaatgttacttgttacgatagtttccttaagaaacaaataatcgcagtataaattcttgatggcatcatggcacaaaattcttagctgctaatttacaaat

SEQ ID NO: 44822 - DNA, 601 bp, Human
tggacataaaataaatatttgctatagaaatattgatatccaaatgaaatcagaaatcaaaaaatggctcatgaatagacaagaaacattattaaattaaaaaaaacctctttcaccataaatactatgttcaaataaatttacctatattagaaatttttccattctatcagatttcatagcttttatctatggaaatgtcaggttttttaagaaatagatttgactaacatacaaacttctgccaaaactaaatgctaagtaacaaggtttgttctaaaaaatccagaagttcacaggwtgggaaaattagatacaaccaaagtagtttcaaaatataaactacttacataaacagattacaatacttgcaatttcccataccattggttttgtttcttagttttagtctaaggattattcagcatcttgatttcttatcaatgcccgcttgctttactttaagaataattttatgtaaacaagtacatggttccacaaataactatttacatattgagaaaattttaaatgacataatatgctaaatattattaaataatataaaataaaaattcaattgaaatgcctcttttgttag

SEQ ID NO: 44823 - DNA, 601 bp, Human
ggtatactatggacataaaataaatatttgctatagaaatattgatatccaaatgaaatcagaaatcaaaaaatggctcatgaatagacaagaaacattattaaattaaaaaaaacctctttcaccataaatactatgttcaaataaatttacctatattagaaatttttccattctatcagatttcatagcttttatctatggaaatgtcaggttttttaagaaatagatttgactaacatacaaacttctgccaaaactaaatgctaagtaacaaggtttgttctaaaaaatccagaarttcacaggatgggaaaattagatacaaccaaagtagtttcaaaatataaactacttacataaacagattacaatacttgcaatttcccataccattggttttgtttcttagttttagtctaaggattattcagcatcttgatttcttatcaatgcccgcttgctttactttaagaataattttatgtaaacaagtacatggttccacaaataactatttacatattgagaaaattttaaatgacataatatgctaaatattattaaataatataaaataaaaattcaattgaaatgcctc

SEQ ID NO: 44824 - DNA, 601 bp, Human
taaaccaatcactggcagagggtgaatgggacttgcttagaccagttgttgacctgaccagcagtgtcaggggtaaactcattagaaatgcaaattcttgggcctctttccaggcccagtgatttagaaactgtggagttgaggcccagcaatctgcttaacaagcccccaagtgattctgacttaagcttaactttgagaagagctgatttagaacattctagctcatcccctggatttgacccaccttctctgagcagataaggaaaaattctcctcaaggttccgcatatgttccctytgcctctaatgctcctgccctacatgggtgatgccctcattcccttcaggtttctgctgaaacattacctcaccagcgagactttctctgataactgtatataaagtagtaatgccctagacacattcttccagtatttcctatccccagaccctttatttttcttcaaaggatttatcaccatttgccatgccacatacagtcagccctctgcattcatgggttctgcatccgaagagtcaaacaaccacagacttacactgtatttggtattataagtaatctagagattaagtatac

SEQ ID NO: 44825 - DNA, 601 bp, Human
acacacttgctcccttgcaggagaaaagagtgtgattatcagcaagagtgctcaggcactcagaggaaaaactacaaaattctgctcactgattacaagttttcagaagggctagcagctttccccaggctaattccaccctagggaccaagaaaagccacatccctgcccaaagtttctgaatggctaggcgaatctaccacagttgatcctaacttccatccctttaaaaaaaagtggtaaaaaagtatctgaaaatttattgctaatgttttcctatttccttcaacgtgcagcagamtaaaaataaaacatcttagtacaatttaagaaattaagactaggatttcaggccctgaagcccatttaaatatagatttttttaaacccttgcttttaaaccaccctccacttttgtaaattctgtgagggatgaaacacaagagtgcaatttaagagtggagattgtggagttgttcaagttcaccagtggtgactctaatggaaatgaattcagtcaaaaagtttctaaacgcatggagtacaaccaaatggagcttccacagttttactgtaacttcttgacagataaactgttctt

SEQ ID NO: 44826 - DNA, 601 bp, Human
tcgcttagatatgctttcatttccctcaggctatagtctattactctattactaatatacttttctgtaatttcctcccttctgagttcaggaaaagaaaaaccttaaatcagattaatttttgacaacttgtgcatagatccaacaggcaggaagaatgatacacacttgctcccttgcaggagaaaagagtgtgattatcagcaagagtgctcaggcactcagaggaaaaactacaaaattctgctcactgattacaagttttcagaagggctagcagctttccccaggctaattccaycctagggaccaagaaaagccacatccctgcccaaagtttctgaatggctaggcgaatctaccacagttgatcctaacttccatccctttaaaaaaaagtggtaaaaaagtatctgaaaatttattgctaatgttttcctatttccttcaacgtgcagcagactaaaaataaaacatcttagtacaatttaagaaattaagactaggatttcaggccctgaagcccatttaaatatagatttttttaaacccttgcttttaaaccaccctccacttttgtaaattctgtgagggatgaaac

SEQ ID NO: 44827 - DNA, 601 bp, Human
gttttcttcctgtattttgtccattctaagagggtatgtggggacaggagcaaaagcaaaggcagaacttctattcataaacattttatctttttctgtattagattaaaagaaaaatgaccactccacattgtttctaaattatgtcaataaaattaaaatatagcaggaaaaaacactgatacatcttcagggcattgaaaagaataattatgaattattgtactaaataatattctgaataacaatattaattaattcagccattccaaagagattaatacatatcttttaaatatcrggcacacacaattataaggaggttgatacccataccctcatgaactttacagtccagtccatccagacagttcttcatttcaataagaaatttctgaataattaacaatttgaccactcgttagcctttaaatccattgtggtaatataacatttttattctactccagtttttcaaaggcaaagagagactttagccttgcaaacaggttgaaaataatctattagctgttaattttttagtacctttatattgaaacaaaaaagaatttataatgataaggatgttgacagaaaagca

SEQ ID NO: 44828 - DNA, 514 bp, Human
tagtcttagccaccattgcagcagtatgtgctctaaacacactctgaggagcttacaatctcttctccatggagtatccagagtgatccttaaaagcacagatcaaatcatgattccctgtttatatgctccagtggctctccttcacacttaaaacacaaattctctaccatggtttaccaggccttcatgatcctttctattccttgaatatctaaagtttgttccaacatcaaggcctttgcatctgctgttccttctccttggtaagctcttctggcaacttataagacaggctaattttttttttccatttaagtctcagctgaaacatcaactcagtgaggatttatccgaaatcctttcaaaattagttttactcaggaaactcactcaaaatcacattatactgctctttttttcttcactgaattatgtatcaaaacttcaaaactatcttgattacttaatttgtatatatgtgtgtgtgtatatatatatagtatacatatag

SEQ ID NO: 44829 - DNA, 601 bp, Human
tttttctactatatcaaatccaacattttcaatcctcatcctatctgggaaagaagtcatagatttcaacttacttagatttcaaagagcttattttttgcacaatgtcacaaaaccaaatgaaatagcaaactcatccacttagtcgcacatgccaaaaacctatcattcttcattttattttccttcctacattacatttaatctatcaacaagtactatgtatctgtatctaaaagtattaaatacacccatttctctctcatgccacttccactcccttagtcttagccaccattgyagcagtatgtgctctaaacacactctgaggagcttacaatctcttctccatggagtatccagagtgatccttaaaagcacagatcaaatcatgattccctgtttatatgctccagtggctctccttcacacttaaaacacaaattctctaccatggtttaccaggccttcatgatcctttctattccttgaatatctaaagtttgttccaacatcaaggcctttgcatctgctgttccttctccttggtaagctcttctggcaacttataagacaggctaattttttttttccatttaag

SEQ ID NO: 44830 - DNA, 601 bp, Human
aggaaaatatttggaatatataatgctaagtaactcaaactggaaaatttgataattctattttctaataacaatagatttttctactatatcaaatccaacattttcaatcctcatcctatctgggaaagaagtcatagatttcaacttacttagatttcaaagagcttattttttgcacaatgtcacaaaaccaaatgaaatagcaaactcatccacttagtcgcacatgccaaaaacctatcattcttcattttattttccttcctacattacatttaatctatcaacaagtactatrtatctgtatctaaaagtattaaatacacccatttctctctcatgccacttccactcccttagtcttagccaccattgcagcagtatgtgctctaaacacactctgaggagcttacaatctcttctccatggagtatccagagtgatccttaaaagcacagatcaaatcatgattccctgtttatatgctccagtggctctccttcacacttaaaacacaaattctctaccatggtttaccaggccttcatgatcctttctattccttgaatatctaaagtttgttccaacatcaaggcct

SEQ ID NO: 44831 - DNA, 601 bp, Human
attgaacatatattatcattttaactgatgattctacatggacagtgtgaaataaatgtggtgcattgaaaaaagtagagggaattgatttctgttcccacactttcaactgtctgtactgcctcagaaaatcaaatcatcaataaacatcagtcttctcatccataggaagagggcattgacttaggtcaaggattccaaactttttagtatgaaatcattttgaaaaagaaatatgaaatggagtataactattttattaataactttataagtttaaattcacttatgaccaatatcatactataaagccaatcagtgaaaagaagtgttctaaatttgaaaccaaaggttaagaaagatggttgcatagggttaaaaataatgcattttgttgcttgaaggggcaaaaaaaaaagagaaagatagatgtgatattatagaaactatttaatgtactatttgtttgcatgttatcaatatatagaatctgaatgttattacacactatcatctcagtaactaacattgcaatttcaagttatacatataaaagaattagaagaaaacttttttttttacatctgttcaggaataaaga

SEQ ID NO: 44832 - DNA, 601 bp, Human
tgaagttacatgggcagtagttatttccgtttcattagtcacttaatgcgacattcctagaattaaaggcaataagtaatttagactttactgttgatattatttgaaaaaaactctaaattataaaattctccctaataaacaaatggcatcctcagtttgatgctatcagtatactctatcaaataaaaatctctggcttgttctttaaacacattagagaaattattacgatagacctctggtaattatatactcatattattcttgttgatatgaaaatagggattgaacatatatkatcattttaactgatgattctacatggacagtgtgaaataaatgtggtgcattgaaaaaagtagagggaattgatttctgttcccacactttcaactgtctgtactgcctcagaaaatcaaatcatcaataaacatcagtcttctcatccataggaagagggcattgacttaggtcaaggattccaaactttttagtatgaaatcattttgaaaaagaaatatgaaatggagtataactattttattaataactttataagtttaaattcacttatgaccaatatcatactataaagcca

SEQ ID NO: 44833 - DNA, 601 bp, Human
tctacctggaaaatgcagaataacttttccatctcaagatccttaacttaatcacaactgcaaattctctttttccaaggaaattaacatctttacagcatctggggattagatgtagacatctttgtggggggacattattcagcctatcacagaggccccaaccaagaattatcatgattacaaataacttatctatttgataaaatattattctctagaaatgttaactggctcagttttgattgacagcattaaaataaaggttgtgagggggagataatgtcattatcaagtattytgccatctttgctctgacataaatgtctatgaagggcatttatgaagttacatgggcagtagttatttccgtttcattagtcacttaatgcgacattcctagaattaaaggcaataagtaatttagactttactgttgatattatttgaaaaaaactctaaattataaaattctccctaataaacaaatggcatcctcagtttgatgctatcagtatactctatcaaataaaaatctctggcttgttctttaaacacattagagaaattattacgatagacctctggtaattatatactc

SEQ ID NO: 44834 - DNA, 601 bp, Human
ttgaaggcaacctaggccgtgtatcatatgcctcaaaattcttccaagcttctgcccactgtccgattccaaagtcattttcatgtttttagatatcaattacagtaagaccacacttgcaggtgccagaatttgtattcattaggtataagtgctataacaagttatagcaaatttgtgggttaaaacaacacaaatttatattttatatatttgagagatcagaagtcataaatgagtcttatgggactaaaatcaaggtgttggcagggctttctttttctacagactcaagggagakaatctgttttcttgatttttccagtttctagaggctgcctgaattccttggctcatggccccagtcttcttcaaagcaggccattcccacttttgcttctgtcatcacatcccttctctgcctttgattctgctacctcacatgtatcagcactcttgtgattacactcgatctacctggaaaatgcagaataacttttccatctcaagatccttaacttaatcacaactgcaaattctctttttccaaggaaattaacatctttacagcatctggggattagatgtagacatctttgtg

SEQ ID NO: 44835 - DNA, 601 bp, Human
gtctataatagggcaatagtcataaaccaatgctctataacactctgcaaatgtgcttcaatgaggccaaactggattttaatactttttccctgcaattggataaatatagaaaaaagaggcagaaatcatattaccataatactgcaataaaactaatgtaatccttttcatgtagagtttcaatataaaggtctgtttttaattgctaagtataaaaatacttaagacttttctgtagcatttgctacttcataatcaaagtgaaggttgaactgccactacatatagatgataataycaacaaattatatattatatatgtatatatatgtgtgtatatgtgtgactgtgtatgtgtagatatacagttttatatatctatagttttataaaagtgtatacatatgtaatacacatttgtgtgttaatgtctgtgtatatatagctatatatatagttttataaaagtgtgtatatataatatacatttgtgtgtgtgtctggaaaggctacaccttcaacattgcttggaaatcaccttacctcatatccaaattcataacttataaatttggctttccccagaactgcacaattc

SEQ ID NO: 44836 - DNA, 601 bp, Human
acactgataaaggataaagaatactttgtttgtctataatagggcaatagtcataaaccaatgctctataacactctgcaaatgtgcttcaatgaggccaaactggattttaatactttttccctgcaattggataaatatagaaaaaagaggcagaaatcatattaccataatactgcaataaaactaatgtaatccttttcatgtagagtttcaatataaaggtctgtttttaattgctaagtataaaaatacttaagacttttctgtagcatttgctacttcataatcaaagtgaagkttgaactgccactacatatagatgataataccaacaaattatatattatatatgtatatatatgtgtgtatatgtgtgactgtgtatgtgtagatatacagttttatatatctatagttttataaaagtgtatacatatgtaatacacatttgtgtgttaatgtctgtgtatatatagctatatatatagttttataaaagtgtgtatatataatatacatttgtgtgtgtgtctggaaaggctacaccttcaacattgcttggaaatcaccttacctcatatccaaattcataacttat

SEQ ID NO: 44837 - DNA, 601 bp, Human
ctctaatgcatttattaaatcagatagataatctttgaagtaatccacatttcattaaaaactgaatggaattcataatttcagtcactacactgataaaggataaagaatactttgtttgtctataatagggcaatagtcataaaccaatgctctataacactctgcaaatgtgcttcaatgaggccaaactggattttaatactttttccctgcaattggataaatatagaaaaaagaggcagaaatcatattaccataatactgcaataaaactaatgtaatccttttcatgtagagwttcaatataaaggtctgtttttaattgctaagtataaaaatacttaagacttttctgtagcatttgctacttcataatcaaagtgaaggttgaactgccactacatatagatgataataccaacaaattatatattatatatgtatatatatgtgtgtatatgtgtgactgtgtatgtgtagatatacagttttatatatctatagttttataaaagtgtatacatatgtaatacacatttgtgtgttaatgtctgtgtatatatagctatatatatagttttataaaagtgtgtatata

SEQ ID NO: 44838 - DNA, 601 bp, Human
acatagtggtcaccattcattcaagaaagatccaattaactttctactctaatgcatttattaaatcagatagataatctttgaagtaatccacatttcattaaaaactgaatggaattcataatttcagtcactacactgataaaggataaagaatactttgtttgtctataatagggcaatagtcataaaccaatgctctataacactctgcaaatgtgcttcaatgaggccaaactggattttaatactttttccctgcaattggataaatatagaaaaaagaggcagaaatcatatyaccataatactgcaataaaactaatgtaatccttttcatgtagagtttcaatataaaggtctgtttttaattgctaagtataaaaatacttaagacttttctgtagcatttgctacttcataatcaaagtgaaggttgaactgccactacatatagatgataataccaacaaattatatattatatatgtatatatatgtgtgtatatgtgtgactgtgtatgtgtagatatacagttttatatatctatagttttataaaagtgtatacatatgtaatacacatttgtgtgttaatgtc

SEQ ID NO: 44839 - DNA, 601 bp, Human
aaaatgaattaaaatttctccatgatttttgtaagatcaataggggttacataatttatttgagaaaaccgatcacacaaaaattgattttctaacctaaaagttttaaacacataaaacaaactcaaagaatatcatattctatctttccctcctatgaatcacacatagtggtcaccattcattcaagaaagatccaattaactttctactctaatgcatttattaaatcagatagataatctttgaagtaatccacatttcattaaaaactgaatggaattcataatttcagtcactrcactgataaaggataaagaatactttgtttgtctataatagggcaatagtcataaaccaatgctctataacactctgcaaatgtgcttcaatgaggccaaactggattttaatactttttccctgcaattggataaatatagaaaaaagaggcagaaatcatattaccataatactgcaataaaactaatgtaatccttttcatgtagagtttcaatataaaggtctgtttttaattgctaagtataaaaatacttaagacttttctgtagcatttgctacttcataatcaaagtgaagg

SEQ ID NO: 44840 - DNA, 601 bp, Human
cttcgctgcttactgccaatgtcatctggacacaaaacgacaacatggtaatgatacaatataaggcaagttgggatttcaccttatgatctgccacttgaagatatactcataaaaatatatcatatttccaagtgtggacatatctgtattctattttaggaaacagaaaaaaaaattccaagtttctatttgctcatggaagattgagagcaaaatcttctacagagccaccagggacagacattacaaataagaagtgatattgaaggtaaagttctatagcaatggttctcagtayagcagatagtgccttctggaggcatctaggaaatgtgtagggacacttgggtctcccagttagattaagactctataatatttagtgggaaagggcagggctgatagacatcctgagatctacaggacagtctgcataattagtagttgcatttggtgattctcagaatagtggcaaacatcagagtattctttctgtcttctaatgtggttgtgttcaacagtttaggcaataagcatatgttttagttcctttagctctttttaatattaaagttaggtaactttggttatcttttga

SEQ ID NO: 44841 - DNA, 601 bp, Human
gattaaaaacaattacattggctgggcacggtggctcaagcctggcagccctttgagaggccgaggcaggcagatcacttgaggtcaggagttcaagaccagcctggccaacatgttgaaatcccggctctacaaaaaatacaaaattatccaggcgttgtagcaagtgcctgtaatctcagctacttgggaggctgaggtgggagaatcgcttgaaactgggaggcagaggttgcagtgagctgagattgtgccactgcactccagcctgggtgacaagagtgaaactctgtctcaaaaaaaataaataaataaataattacattaatgctctttttatcaaaacattactgaatccttcgctgcttactgccaatgtcatctggacacaaaacgacaacatggtaatgatacaatataaggcaagttgggatttcaccttatgatctgccacttgaagatatactcataaaaatatatcatatttccaagtgtggacatatctgtattctattttaggaaacagaaaaaaaaattccaagtttctatttgctcatggaagattgagagcaaaatcttctacagagccaccagggacaga

SEQ ID NO: 44842 - DNA, 601 bp, Human
gtgaaatgtttaaactgaaaagtgaaaaatctgttaaagatacacattttaagtaatatgaaatgtttcacagcaatgtcagaaaacatattaccaaggagaaagataaaagtgaaacagacatgaaaatttgcaaactacttagtttacatccatttatgctggttaaagaaaatttagacagtggtcattttctgatatttaaaatgtctttttattcaaaagatgatgcagattaaaaacaattacattggctgggcacggtggctcaagcctggcagccctttgagaggccgaggcrggcagatcacttgaggtcaggagttcaagaccagcctggccaacatgttgaaatcccggctctacaaaaaatacaaaattatccaggcgttgtagcaagtgcctgtaatctcagctacttgggaggctgaggtgggagaatcgcttgaaactgggaggcagaggttgcagtgagctgagattgtgccactgcactccagcctgggtgacaagagtgaaactctgtctcaaaataaataaataaataaataattacattaatgctctttttatcaaaacattactgaatccttcgctgctt

SEQ ID NO: 44843 - DNA, 601 bp, Human
ttttataatttacaacttctctttggagaatggagtagttgtatgagacagttgttttggtttgttttgttgttaatttgaaaaagaagggttagacaatcagaagtaggtgttcaagatttgatgactgaaacatcaattggtgttatgtcaagtatataagtccttaataaatacgtgtggattgtgtgaaatgtttaaactgaaaagtgaaaaatctgttaaagatacacattttaagtaatatgaaatgtttcacagcaatgtcagaaaacatattaccaaggagaaagataaaagkgaaacagacatgaaaatttgcaaactacttagtttacatccatttatgctggttaaagaaaatttagacagtggtcattttctgatatttaaaatgtctttttattcaaaagatgatgcagattaaaaacaattacattggctgggcacggtggctcaagcctggcagccctttgagaggccgaggcaggcagatcacttgaggtcaggagttcaagaccagcctggccaacatgttgaaatcccggctctacaaaaaatacaaaattatccaggcgttgtagcaagtgcctgtaatctc

SEQ ID NO: 44844 - DNA, 601 bp, Human
atgtttaacaagctgtattcattcacacatttatatcttcatgcagtcagtacaaaattattaaatatacacagtactgtaaatgttttggtttagggactgatacagggggaaaaaaatcaaaagcaacactccaaggttgtaaacctatagtccctttagatttattaagtaggccatcaaagaaaaaataagactgttaaagttttataatttacaacttctctttggagaatggagtagttgtatgagacagttgttttggtttgttttgttgttaatttgaaaaagaagggttagrcaatcagaagtaggtgttcaagatttgatgactgaaacatcaattggtgttatgtcaagtatataagtccttaataaatacgtgtggattgtgtgaaatgtttaaactgaaaagtgaaaaatctgttaaagatacacattttaagtaatatgaaatgtttcacagcaatgtcagaaaacatattaccaaggagaaagataaaagtgaaacagacatgaaaatttgcaaactacttagtttacatccatttatgctggttaaagaaaatttagacagtggtcattttctgatatttaaaat

SEQ ID NO: 44845 - DNA, 601 bp, Human
aaagttaaagtaggggataaaagatgaatttcacaagtcaggaatagttcagtacacaacattgggtttgattagagtcctctgagtgccaaagaggatgcggacacctcaaataccactcatatttctattctttatatcttcatacgaaaagatatacttcggtacacttaggaccatcttcttgaatccagactggtcctccagtacaagctgtacctcttgtcaataactgtgtagactaaaccgttctcaaacttacattattatcattattatgttttttatacaaagggcagtrcattcttttcaccagaaacatctatgtgcacagttagagggattaaagtctaaacacctgtcaccatagaaaaaggcagctaaggcagcccaatcaacttctcccttgtgttttcagaaataaaccaacaacatgatagaaaagctataagatgtattcaaatcgatgaccaatttttgattagcagcatttcaaccaccacaatgtttaatacaacttccctttgctaaggaaaaagaatccgtaaactcttctttgaagaaatatacttgcatgtttaacaagctgtattcattcaca

SEQ ID NO: 44846 - DNA, 601 bp, Human
tggaagctgtagttagctataacactctagcctgggtaacagaatgagaccttgtctcaaaaaaaaaaagttaaagtaggggataaaagatgaatttcacaagtcaggaatagttcagtacacaacattgggtttgattagagtcctctgagtgccaaagaggatgcggacacctcaaataccactcatatttctattctttatatcttcatacgaaaagatatacttcggtacacttaggaccatcttcttgaatccagactggtcctccagtacaagctgtacctcttgtcaataactstgtagactaaaccgttctcaaacttacattattatcattattatgttttttatacaaagggcagtacattcttttcaccagaaacatctatgtgcacagttagagggattaaagtctaaacacctgtcaccatagaaaaaggcagctaaggcagcccaatcaacttctcccttgtgttttcagaaataaaccaacaacatgatagaaaagctataagatgtattcaaatcgatgaccaatttttgattagcagcatttcaaccaccacaatgtttaatacaacttccctttgctaaggaa

SEQ ID NO: 44847 - DNA, 601 bp, Human
atatgtctgctattattgcattcaaataaatttttgttttattttactgatacatggatttgaaagtcaaaggaaatggtggctttacatttaatgaaagcttttgtgtttaaaaggtaaaattggggtagctgagcacagtggtgcatgcctgtgatcccagcactttgagaggccagggtgagaggattgcttgagcccaggagtttgagatcagcctgggctacgtagagagatctagtttctacaaaaaataaaattgtttaattagctgagtgtgatggcttgtgtctgtggttcyagctacctgagagactgaggggggagtatttcttgggcccaggtggaagctgtagttagctataacactctagcctgggtaacagaatgagaccttgtctcaaaaaaaaaaagttaaagtaggggataaaagatgaatttcacaagtcaggaatagttcagtacacaacattgggtttgattagagtcctctgagtgccaaagaggatgcggacacctcaaataccactcatatttctattctttatatcttcatacgaaaagatatacttcggtacacttaggaccatcttcttgaatc

SEQ ID NO: 44848 - DNA, 601 bp, Human
agtgtttctagctcaatcagcagttgctcatatttatctgtacatcctgacattatctgtagacggtccttaaaacctgactcttcccttagctgtgtcctgtaagatatggatatttcttagttgctgtttctagctgtgcatcttgaaattgcattcttggattattttaatcttatcaaagcctttatatgcgtgactctgactgaaaatggagggcttcttcatttccacagaacaactcctacctggctgatcagatagcagctggattattcttttaaaaacagttgattctctrtataaagcttgtgcacatcaggcttgctttttttcccccaagtcagaaatcaagttcaagaagaatttcaagctgacataaaaataattcccctcaaaagtctaaaatgtcattctctacagcctatactaaacttttcacatggaaatggttacgaacatctgagtattgcatgattgaaccatagcattcatttttttccccagcaaatatttattagacacttactaggttcaaaaattacactaaatgacatgatagataaaatgattaaatcaaatgaaacttcaaatttgaaag

SEQ ID NO: 44849 - DNA, 601 bp, Human
ccagcagtgtttctagctcaatcagcagttgctcatatttatctgtacatcctgacattatctgtagacggtccttaaaacctgactcttcccttagctgtgtcctgtaagatatggatatttcttagttgctgtttctagctgtgcatcttgaaattgcattcttggattattttaatcttatcaaagcctttatatgcgtgactctgactgaaaatggagggcttcttcatttccacagaacaactcctacctggctgatcagatagcagctggattattcttttaaaaacagttgatyctctgtataaagcttgtgcacatcaggcttgctttttttcccccaagtcagaaatcaagttcaagaagaatttcaagctgacataaaaataattcccctcaaaagtctaaaatgtcattctctacagcctatactaaacttttcacatggaaatggttacgaacatctgagtattgcatgattgaaccatagcattcatttttttccccagcaaatatttattagacacttactaggttcaaaaattacactaaatgacatgatagataaaatgattaaatcaaatgaaacttcaaattt

SEQ ID NO: 44850 - DNA, 601 bp, Human
acatattactttatagcaatgcaaggactaactaacacaccaaatgaaggccaaatttcttactttgcttactcttcaaaatacttgtaaagcatcatgatccagatgtgctggagattgaggatgaaagataaaagaagaaagaatctatactctcaaaaatatcactgcttaggttccctagaagcagagcctaagacaaggatttggatgcacatgatttattaagggagtgttgtcagatgaaaaggagagaggaaagtagggtaggaaagggaaagcagctaagtgagaatgtggyattagcataagtctaacttcagcctgatgtcacggggagcactagagcatgaattgccccagagttgacctaatgaagtgagggcactggctttttgtattccccatgtcagttagtcatcagatatgagctgatagtgctgggagatgggcacataaggtttggcaaagtaaatgtttttcagctacaagtgattctgaagagaagtgggggctgtgagccaatagcagctaacactgacggaaactgggcattttacaggcttggtaaaagggatctggccagggcaccaaaggtgac

SEQ ID NO: 44851 - DNA, 601 bp, Human
acccagtctctgactgcatgcagtggctcacacctgtaatcccagcactctgggaggctgaggcaggtggatcatttgagttcaagaccagcttggctaacatggtgaaacccgatcactactaaaaatacaaaaattagctggacagggtggcgggcacctgtaatccgagctactggggaggcgaggcagaaaaatcacttgaacctaagaagcagaggttgtagtgccaatgcactccagcctgggtgacagagtgagattccatctcaaaataataataataataataataataatrataataataataataataataatccagcctcacatattactttatagcaatgcaaggactaactaacacaccaaatgaaggccaaatttcttactttgcttactcttcaaaatacttgtaaagcatcatgatccagatgtgctggagattgaggatgaaagataaaagaagaaagaatctatactctcaaaaatatcactgcttaggttccctagaagcagagcctaagacaaggatttggatgcacatgatttattaagggagtgttgtcagatgaaaaggagagaggaaagtagggta

SEQ ID NO: 44852 - DNA, 601 bp, Human
ctcttatttaccaggatcatttttaaggaaaataaaaaattactggttctctattacatgtttacatttatgataaatgtaaatttagcactaagtatgaaaattagtaatttgacattttcttagtgtacaaaatgagacctatggccaggcatggtggctcacgcctgtaatcccagcactttgagaggctgaggcaggcagatcacttgaggtcaggagttcaagaccagcctggccaacatggtgaaaccccatctctactaaaaatacaaaaaattagctgggcatggtggcaggyacctataatcccagctacctgggaggctgagacaggagaattgcaacctcctgggaggcagaggttgcagtgagccgagatcgtggcactgcactccagcctgagtaacagagcaagattccttttcaaaaacaaaaacaacaacaacaacaaaccaggcctatattgtaatcactgataattgctagaatttatcattagatttttcaggatcattagatttttcagcaatatagttttgcaatttattaacatgtaccaaaagaatgaatatgagagaatagaatgtaaattgtaata

SEQ ID NO: 44853 - DNA, 601 bp, Human
catattatttttctttcccaaacaggcatttaacatacccgcacaattcaaagctacttaaatattccaagtcatcacagtaactcaatcctttaagcacataacatttcaacccagatgaacacactaaaataatttagaaacagactaaaataattccttgtaagagctctgtaaacatctggacaaatcttattctatcatatcacaatgtactttaataactaagtctattctaggcacatggccacaactacttgcattgtaacagatgatgttctcaatataagattatgttgcyatggcatcaacaaaccatgatcttatgaatcaattctcttatttaccaggatcatttttaaggaaaataaaaaattactggttctctattacatgtttacatttatgataaatgtaaatttagcactaagtatgaaaattagtaatttgacattttcttagtgtacaaaatgagacctatggccaggcatggtggctcacgcctgtaatcccagcactttgagaggctgaggcaggcagatcacttgaggtcaggagttcaagaccagcctggccaacatggtgaaaccccatctctact

SEQ ID NO: 44854 - DNA, 601 bp, Human
atgcgaagaaatgacttcactgctttacattcaagaggaaaaggcaaaagttatgacacatacggcctttcacaagcaggtgccaatcaacattttcaacctcatcttctgagacactttcattcatatactcttatcattaaaatcctttcaccatttctcaaatactctttattttaggagttggcaaactgtggtccctgagttttatccatcccattttgataaaacaaagattgtaaatattcagctttacaagataataccaaactattaccaatttacatacccaccagcagcrtatgccaaccccatttaaattatatcttaccactttgtattatcagccttcttgatttttgtcacttcagtagtagaaaatgaaatgtaatacatatttgattactactaaaatgaccttttgagatacctgaaatatctctacctgtttttttctctgaaatgctcagtatatagctttgactgaaatttgtattacaaatatcttctcctatcagactgtataagggatgaaaaccatcctttcaagatgttaaaagttcatggctaggacccctattacaaaagacagattaagaag

SEQ ID NO: 44855 - DNA, 601 bp, Human
tagaaatagtagtagacgctgctgctctaggtagagataatctagatgtcagttctttgggtccattacatagaaatgaaaaactatgaataggaaaaatgaaattactgaaaaacagcttttaaaaaatcttagctgcctattatataaatatacaatgacaggttttgtaaagcacatgttatttattacacaggctgccacactggacacctaaaccttatgggtgtcttgaagtatgtattatttaactcaatgatcttttgaagtaatttggcttcctcattgcatgtgatcttaygaaacttgcccagtattagatcactgactaaaacagggtctaccagagattttactggtgagaaaagagagcagctaaatgccacgtgctttaacagtagttggaaaataatttattctcctttaataatgatatggacgtgatccaaagatttctgatgtggaaaatagtgcaaaagtctatgaagactttaaacaactaagaaataaaattacagattaatactgcagatattgaaaattaattttacactgcttaaggcatctccttctagtcttagagtctctaaatttgttttgg

SEQ ID NO: 44856 - DNA, 601 bp, Human
tctcctttccagatttttgtttgctcatcccttaaaaataggtgcccctttgagttcctcagggacctatgcctcttgacactgtgttccatactttctggcttggtgatcttatccattttcatctctttagttaccatcctgataactgatcactctctaatcgatatatctctgaccaaaagttgcaacccgaattcctgacccatggagtcatgtgattaatatgtcttcacgtcaatgtatgacagtcaccttaagcacaccatgtccaacccgaactcataatcttatctcatgccagttctttttctagtgtatcccctttcagtaaatggcaaaactatccatacagttcttcaagccagaaacctatgcatcattcttgaatcctccactttccttatctctaggattaacatttatcatccaaattgggatgcttttgaaggaaaacaaaaactggaattatcttgggcaaactggaatgcacagtcactttctcacacaattagttacaaaattactacttcctaaatattctttgtcatcacttttcccatccccactgctactaccttcattcagatcagtatcctct

SEQ ID NO: 44857 - DNA, 601 bp, Human
ttagtttggatattttaatcacatgtatttttttaagtacttggcttgctataaccgaggaacataaatatcctatttaaaatcattcaagcttagaagattcattaaaggaaatacaagcagtagcccctaagtcagcattttccattttcttcaaagagagcaaaaagctattatagtggtggtgcccctgagttctgtttataatttctgcacatacacaaagacaatgtggagcacctttttcagaaatgctttccttggccataaatctttaccattttttttatctgccaaagakcatataaggaatccccagtgttcagaagccaagagaagcataattctttgtacaacgagaaaaaaaactaaggcacaattttatttttattgagcaaatttctaggatgcattttggggggtaaaaatagctaaagtgacttgatcaattgtgtccttgctcccactacttaaaaatgaaatagctttaaagtcacacaaatttacctaaaaaattaaaactatcttaatagctgtgattaggcaaactaattcttctactttcataatggacattagagatagaagcctgtaagtacaa

SEQ ID NO: 44858 - DNA, 601 bp, Human
atatcattatataaaatggtaatttaaagctaaactggtgagaaagacatagctcaaataaaagcgtcagaacagttaactttgtaaaacaattcactataactgtcttaatttatcttatttcaattgcataaaaacttctccatagactagattcactaactattattctcaagcagaaaaagcaaggctttggctggtgtattttgggaaactaagggagattccctttctgacttgacactttccatatattccggctgtagggaatttctaacctcataattatgaacagagataycttaaggctttcaaattattttatggttgaatttaccaaaacatgtagtaaatatgttagagatcttttcctttccagggcgacgttagaaatatatacatatatctatatctctatatatgtagatattgaaaacaggtggaatatattacaaagttgaatgaaaaaacctaaaaggaacatagtcattgcttgtaactcaaattacattggtttgccacagatactacttcaaataggaagagaaacagaagtttgatgtagaaatctctagaaaaaaagctttagtccatgcaacaa

SEQ ID NO: 44859 - DNA, 601 bp, Human
atgtttctaatgcagatgtgtcttctccaacatatatatctccaggggataatcgtaaagaggcaatatattaaaataaactctgatggaatcattaaaacatgtagtatgagtcttatctataatgttaatgctttatttcaagtataaaataactataatagtaaactagataatttaatgtaatataagcaacatcacttattatatttttcaatagaattcactgatcacaaccacttctatacaccaaactattttaggactgtacttttgcttataaatattttttttaaaagtccttccaaattgtagcattaacccaaatacatgatgggaaggattagagtgctatattagtttccaagacaatgccttacagatttatggcattttatataatgtacaatagctcatattataaaaactgtgtactttgaaatgcttttcatcaggaatatactttggtctccagagcaaagctcagtttaaattccagtaggtctcagtatcttcaagtaacgtcagaagatggtgatattagttgatatagtataaaaagttaatgttcaattaaaacaatttactctctattttaaaa

SEQ ID NO: 44860 - DNA, 601 bp, Human
tataatgcatacctaatgtttctaatgcagatgtgtcttctccaacatatatatctccaggggataatcgtaaagaggcaatatattaaaataaactctgatggaatcattaaaacatgtagtatgagtcttatctataatgttaatgctttatttcaagtataaaataactataatagtaaactagataatttaatgtaatataagcaacatcacttattatatttttcaatagaattcactgatcacaaccacttctatacaccaaactattttaggactgtacttttgcttataaatattttttttaaaagtccttccaaattgtagcattaacccaaatacatgatgggaaggattagagtgctatattagtttccaagacaatgccttacagatttatggcattttatataatgtacaatagctcatattataaaaactgtgtactttgaaatgcttttcatcaggaatatactttggtctccagagcaaagctcagtttaaattccagtaggtctcagtatcttcaagtaacgtcagaagatggtgatattagttgatatagtataaaaagttaatgttcaattaaaacaattta

SEQ ID NO: 44861 - DNA, 601 bp, Human
tactttctatcaaaagacaatcaaagcataattatgaaagctcaaatgttaaatattttaatagagaggctcattaacttaaccatttaatatatgaaccagaaaatcaagttgtcatattacacaattttagagagctgtcagagcattttaccttcccccaaaatcttgcttagtgatggttttagcatactttaggaggttaatttttcaattttttcattattgctaaatcagaggcctggatagggagagttatcaagacaaatgaatgttttcaaataaataacaaataaaactraatagtttagcccaattctagctgaatgaggatataatcagaagccactttcatgtttacatccaatctgaagtgaccagaacattgtgaagcaatgtttagttaactttactctctaaattgtttacttaagtctccaaatacaaatttaaactaaacagagacataaggtctgaaggttacatttggtgatttttattgatctttactggcaaatttttattgctaaaatacttaaaacttttgcctcacatatgatgtattttccaaccacagagggagacaacagcaagagaaagc

SEQ ID NO: 44862 - DNA, 601 bp, Human
aatccagataagcatcactaggtatggttaagcagcctttaaaagcatatctctgtgataatatctgtagttatgattaaaattaccagtagccccatgtactataataatattagtataacctgttacgttgtctggaacacagaaatgttgtctatccaccaaaaaagggaatctcattttaacatcagagctacatcaatggttaatgttaagcttattgacagtctcataattaaatacttagtgattccagtatgtttgatgctttgtctcctcctgagtaactagcatacataawgtgcacttcagaacagttaagaaattcgttttgcaactactttgagtttgacagatgtgcaaatgactttcattatcaaagcagccaacagcacaaacttctgcaggtggatgtatgggtgggccataaagggggaaagtgctccatcattgtatgaaatggcacagttgattatctctggcttcatcaaacataatttaacaaggatattatgattcatcacaataagttaggagcactgttagtgtacagctacttggtttagcagattttaggaagcaaaatgtttataatatttaa

SEQ ID NO: 44863 - DNA, 601 bp, Human
cattgtcttagatgttatacagtggtaacccaagtagcttgttctaaatttcttgaaagataacattacttatcaggtaaggttcatgtagaatgtcaaaccccacatcaagattttagcaactttacctacattaaaacattcttaataaagacaaaagctagagcaaatgcacataatcctaatatttacttgtaaatttgttctttcgtggttataaattgggaggatttagaaacatccctttccattaggtagacttttacatataaactagttattcaggcaacattgcaccctsagatgtatgcatttggcttcattctactaattttgacacattaatattagtcagacattaagggccatgtacttttgctccaaatctaacaaccaagaattgaagaatacattaaatagcatgccttgctaatttgaaatccactagatctgatattgggttgaacacagttgctctctttgataataccatggctgtctattttcaaaaccaagctgcctcctgcactgtaaataatctctatgtgggcaaacccatgcaaggaggtgtgatccatgcaatgaaaagatgataaagatt

SEQ ID NO: 44864 - DNA, 601 bp, Human
atgataattattacagtttataaaactcatacacatcatctaattttctctttataataaaaccccatgaaaaaggtatggtaggaattattatactgttttatagatgggaaaacaaagatgtaaggtatttttatgagttcatattgtaaatccacaggaggaccgagacttggactttacatatgtgtagaaaattattgtaaggaaacttttaacatttaggcaactaatttttttccaattagttctcaatattttaattgaaatttatttattaactttatactgacagcattcyacagtgcttagcagaagatgacattttcagaggcatctgatgtatccttaatgatccccagtgatcatgatttatggctcctccctgtgtgataagaccactccctggggcaaatccccagttcacttcctaaccattattggtggacatcaaagggagagtgcaagtagagatgaagaacattgacttttcagattattttagaatatatatcctttatagtaattataaaattataattttaaatatttattttagtaaataagaggtatattttacataactgagttagttgtgttg

SEQ ID NO: 44865 - DNA, 601 bp, Human
tttaaaaccagcttgactttcaaaattaaataaaatgtgtaatgaatgtttatataactagactttatgactctattgtgttaaatctagctttccttaaacatgaatatcctttttcacagggaaaattactatgataattattacagtttataaaactcatacacatcatctaattttctctttataataaaaccccatgaaaaaggtatggtaggaattattatactgttttatagatgggaaaacaaagatgtaaggtatttttatgagttcatattgtaaatccacaggaggaccsagacttggactttacatatgtgtagaaaattattgtaaggaaacttttaacatttaggcaactaatttttttccaattagttctcaatattttaattgaaatttatttattaactttatactgacagcattccacagtgcttagcagaagatgacattttcagaggcatctgatgtatccttaatgatccccagtgatcatgatttatggctcctccctgtgtgataagaccactccctggggcaaatccccagttcacttcctaaccattattggtggacatcaaagggagagtgcaag

SEQ ID NO: 44866 - DNA, 601 bp, Human
agtacaatgagcagtaaggtctttaaaataatcacatatgcattattaatctcaatacatttccacctcattaaaccacctaataatgtgactagtagtgagggtacacgtactaatcattatccttattatacatttaagaataataacttgaaatatatccttgattgaaaggttttctagagttctttgcaatacacttacctgttataggaacttaaacccaatgaagcagtaaaacacaaaaaccaaaaatacgaatcagtatgaaaagtttctaagcccttttaaatcagtaagyattagcattaagcaatatttgaagtgatttcagaaactgcattataaatacaaaaatgattggatgcaaaactctaaagaccacaatcctaagaatgatgaaaaatacaacaaatcatttctacatctaatatgattaatgagatatttagcttttaaagaatgccaatatatttttaaaaccagcttgactttcaaaattaaataaaatgtgtaatgaatgtttatataactagactttatgactctattgtgttaaatctagctttccttaaacatgaatatcctttttcacagggaa

SEQ ID NO: 44867 - DNA, 601 bp, Human
ataaacagtactttaatgaccgaagtactaaacattacaacgagaagcatgctcatatttatcacatttaaacttaccacttaaaaaaaaaaacaaatgttttaaggggtgttactttgaaaagcattataccgtcatactcattaacagaagagaaaatacactcttaggggaacttttttttttaatgataatgcatactgtagagaatgatatttaattaacagataaacatatttcaagtgctagtacatttgcctgttctatcaccaactctacaaataggatatagcaaaaaatcaattgttgtccccatgataaacattttttcttcctggagaagggaaaaaaaaaagaaccctacaatcagatttgtgtgcctctgtaatttagcttgattgcatttatctttactccctcttattaagctgaatgctctttttgtagcattcattcctaaaaatacactgaatcaaaaaatccctgatagattctgttgtgacctaaccactcaagtgaattcatgtcttttactcagattttgcccacccctctacacaaaaacattggctaacaaacatgattcatgagagtttcctgt

SEQ ID NO: 44868 - DNA, 601 bp, Human
attaagcgtaagtcccttcccaattgtgttattagcttaaaaagaaaagaaactttaaattctttttctgtcataagaaggaagaaaagaacaagaacatttttgcctatgaagaataaacagtactttaatgaccgaagtactaaacattacaacgagaagcatgctcatatttatcacatttaaacttaccacttaaaaaaaaaaacaaatgttttaaggggtgttactttgaaaagcattataccgtcatactcattaacagaagagaaaatacactcttaggggaacttttttttttaatgataatgcatactgtagagaatgatatttaattaacagataaacatatttcaagtgctagtacatttgcctgttctatcaccaactctacaaataggatatagcaaaaaatgaattgttgtccccatgataaacattttttcttcctggagaagggaaaaaaaaaagaaccctacaatcagatttgtgtgcctctgtaatttagcttgattgcatttatctttactccctcttattaagctgaatgctctttttgtagcattcattcctaaaaatacactgaatcaaaaaatccctg

SEQ ID NO: 44869 - DNA, 601 bp, Human
tctttctattcctagtgcctgatgcataacagtaactcaataaatattccaatgaatgaattaaaaagtcaactgaatccctgaccactcacaattaagcgtaagtcccttcccaattgtgttattagcttaaaaagaaaagaaactttaaattctttttctgtcataagaaggaagaaaagaacaagaacatttttgcctatgaagaataaacagtactttaatgaccgaagtactaaacattacaacgagaagcatgctcatatttatcacatttaaacttaccacttaaaaaaaaaaacaaatgttttaaggggtgttactttgaaaagcattataccgtcatactcattaacagaagagaaaatacactcttaggggaacttttttttttaatgataatgcatactgtagagaatgatatttaattaacagataaacatatttcaagtgctagtacatttgcctgttctatcaccaactctacaaataggatatagcaaaaaatgaattgttgtccccatgataaacattttttcttcctggagaagggaaaaaaaaaagaaccctacaatcagatttgtgtgcctctgtaatttag

SEQ ID NO: 44870 - DNA, 601 bp, Human
ttcaaagcaaaatattacttggattctttcactttaaatgtgtgcatactgtgatgtgttcatgggtagtggactggcttccttccatgccccagattggtatttctcagtaagtgaagggtggcaaaggaactattttccttttgctatattatgtttgttggaatgtttggttttaaatcattgcctttgtgagataagtcctggtattttggtttgagtaggaaggggaaataaggttggaagaagaatttcccactgccttcttttggcttctcagtgttgtttactagatttgcaktgctctattttttttctcagccaccctcaaccaataatccataaaattaaactgagagtggcaagtagtatatttagagcacaaagcttcatctgatttctcaaccataaggtcaacaaaaaaaggggcagagaagtacctgctacttgattcattcaaatgatagaatctgcaatggaacaatgggacccaaagtgtattgctacttgatttttgcatggggagatacgcaaagtgtttttttttaataccatagtaaaataaattacggaatccaacattaaagattcttgtaataaa

SEQ ID NO: 44871 - DNA, 601 bp, Human
tttttcattatcctgatagtctcagctgttcagtaataccccatgcatttatgtacaaacatgaaatcaaacagcaagttatctccacagggtgaagtggctgagtcaatttaattaatgaggatgatgacaatttcagaatcactgctaatagccaatgttgtttttgtttgttgttgttgttttttgagacagagtctcgctttgtcgcccaggctggagtgcagtaatgcagtctctgctcactgcaacctcaacctcctgggttcaagcaattctctttccttagcatcctgattarccaggattacaggtgcgtgccaccaagccagctgatttttgtatttttagtagaaatagagttttgccatgttggccaggctggtctcaacctcctgacctcaggtgatccacctgccttggcctcccaaagtgctgggattacaggcatgagccctcaagcctgattgtaaatgctgttttaatattaaatagattacttcataaacagacacaccactctctgggatttttcttaaagtttaaaaccatataagcatataatatttacattcaccaagaattgaatgggaacttacat

SEQ ID NO: 44872 - DNA, 601 bp, Human
gaaatttagtaattattttgcctgagtaattttattactttaaaagccaatacaacacatcacaaaatagtctccctactcattttaacgtcagaagtcaaatgtaaaaagtaaaatttcagtaacactaatacacatcatactatccagcttctcacatatgtttagggaagggtaagaataaaagccagaaacagaaatcatcaacaaataaaactcgagtacataataaactgtcaaagctaaaaatggtcctgtttttctacacaagaaaagggaaggtggtaaaatagatctttaygcatgtgaaagaattacaaaaaaacgaacagagatatattgtatgaagctaattaggtgaagcatgcagaaataactagtagtaacagagcgttagtaataactgtaattaagaatgtttgtatttataatagggtgctgttatttacatatagtggtacttacatccctgtacagccaaatctacagcccaaaccaaagtcaggtgtgaaagaaagcacaacaatgtcagtaagtactaggacgcagaacaaggaaaagtgtacagtttgtacttttatattttaaaaagctagcaatc

SEQ ID NO: 44873 - DNA, 601 bp, Human
gacaatgcatgtgtgcatccaatcaaagtcctgctgagatttttagagaatattcctgttctacaacacattcagggatatgcaaaaactattttgtgcgtgctcacaatgttaatttacacacacataattatagatacacacatatatatagggaaagaagaatttttaaaaatgcatcttatcttgagcaaaaatttagtattttttttttcagtgtgctaaaagttctgttgaggaggaatagatttttagttgctttcaattggtttgaataacaacaaagcataagttgtaaaamtgttgatgatatgatcctaagttctgaatttgttgcatatttaccaatgagccttagtaaaagtctgtggtacaatttgtccacatactggtgtgggcaactcaatacacatataaatacatgtgaactgagatctccaacctaaaatttaatagcatgagtattacgttattgcaaatttggaagatttcaaatttttaatataccacaatgttttatggaaaatagcacaatgttttatggaaaaatttttccaagctttataagtatttcatttccacttcttaaaaaaaataccaa

SEQ ID NO: 44874 - DNA, 601 bp, Human
agaaattaatttgaatattatgttatcaaaggaattttgtagttagtaagaagtttagctaagataagaagcagagtaaactaagtaattccaaaaaaggtctaacacaaaatgtcactgaaaatacttaaattcagttcatatctaaattcccacaataggcaaaaacacaggcatatacaagttttttttttttttttttcaatttgccctctacacttcccaatttagaagaaactatcactagtttcttgggtatttatatttgtcactaagtcactttaatgcatcttcaaatatrtgtaaaaaatagaactcttataccaccatcaaccagacagcatatattaccaattaaataagtgcccactatttataaatagtgcatgtttagggatcaataaaaacatatccttacacgtaaggacatatcctaatcttatcataatatctccaaactgcaaaagcatgtgctgggctgttctctaccgaataccataaaactgaatattgttcaccactatggtcgatctttctaactttaaagagtacacaactgaactcaattactccaaagatatgtgaaaacacagaaaaatga

SEQ ID NO: 44875 - DNA, 601 bp, Human
ttaacctaagtgacaaaaagaatatatagacagacctgaatatataatactaattagccaaggtgatttaattccagcaataactccttaggtcacaattaaaactcagtttaaaaatctataaatgagaaaaaaatctattatacaataaacagagtttatatagtctcacaaaaaatatacaagcctgataatgcagttagattctagtacaaaattaaagcttattttattactcaatgagaaatcaaataatttttcagccagtcaaggtctacttagaagtactcaactaaaatgytgtgcctataattttttttaaacaattggatgatattctattttgagtgtcttacatgttgcttctcaactatgttcatttttatgacaaaaaaattctttttcttcctcttacccggccaacctcaactaaatttgtaaccatcacaatgcaagcagattgttcttgccaaatcatcctccagaaatcatacactgtttcatgaacgggacctacaaagaaattaatttgaatattatgttatcaaaggaattttgtagttagtaagaagtttagctaagataagaagcagagtaaact

SEQ ID NO: 44876 - DNA, 601 bp, Human
ctaactacatattcagcaagtggttccatttctacacacgttactttgaagtcaccataaacttcagtatcatcaggccaatatttatagcatttaacctaagtgacaaaaagaatatatagacagacctgaatatataatactaattagccaaggtgatttaattccagcaataactccttaggtcacaattaaaactcagtttaaaaatctataaatgagaaaaaaatctattatacaataaacagagtttatatagtctcacaaaaaatatacaagcctgataatgcagttagattcyagtacaaaattaaagcttattttattactcaatgagaaatcaaataatttttcagccagtcaaggtctacttagaagtactcaactaaaatgttgtgcctataattttttttaaacaattggatgatattctattttgagtgtcttacatgttgcttctcaactatgttcatttttatgacaaaaaaattctttttcttcctcttacccggccaacctcaactaaatttgtaaccatcacaatgcaagcagattgttcttgccaaatcatcctccagaaatcatacactgtttcatgaac

SEQ ID NO: 44877 - DNA, 601 bp, Human
cttcattttgtatttctttccccttcacttatggatatctgcacatcttggcctggtgactgtctggcattctaacagctttacacatgcctctaggcttctgaaatgactctcccctctgtcagaaacattattgccctggacataacccgtcactccctcacttatttcaggtctctactcatattactttctcaacaatgagtttttctttgatcatcctttcagaattgtaaaccatttcttaccctgcctaaataatattccctacttccttccccaacattatttttctctatakcacttgtcatgatgtatgatatattagttgatttatttatttttattgctgtcttaattcaatcggctctaagatccacacgaggcgattttaacatgtgtcccaaggtttagaaacatgtctggcacatagtaaactctcaaataaacatttgtggaatgaatacatgaatgaatggattttatagcatcatcaaaacagaacttggcaaagattttaagagaaaaagcagttttgatatcactttttaaaatagaattttagagtacttaccctttccagggtgaatgtcctaactac

SEQ ID NO: 44878 - DNA, 601 bp, Human
atgaggattattcttttttaaagttcttgctgatttggaaggacaaaatggtatataagtacactaggttaaacatttttaataggcttgttaacaattgtgtttcttcagagattctagtttttttttttttcttctactggtattaacattataaattaaggacattaataaacaatcgcaaggttcttctgtctgtatgtacctttgatatttttttgtgccacaggtaatttcacaattttgtgtggtcaaatctaccaagctttaccacaaaatgtatttcactgttactatattycactttagtctactacaccagccaccttacgttattctttgcaatgtaacacttggagtgatccttttagaaataaaattcagaccatgttatccctgagctcacaaaccctacaatggcagcctaactcaattttagtatgaactaaaatcatcatggcctacaaggcaccacttatccaattttgtgatttctctgccttcattttgtatttctttccccttcacttatggatatctgcacatcttggcctggtgactgtctggcattctaacagctttacacatgcctctaggcttc

SEQ ID NO: 44879 - DNA, 601 bp, Human
catcattgctttctattggattttggcaatatctcaactttttgttatgtattcaggttttccttattactaagttcatcattgatttttacaagacttgtatgaacttaagagactgcatattccacatttcttttttaataatatgagctagttattcattaaatcaagcttaatggttctttctgaaatctcccatatcaattgcttattttattctacttgatttgtctaagaaattttcatacatattttacagttacaataatcatgattatgttgttctgtataatgctattttcaacttaatattttgcctaattttttcatgttggtaggataactcacaagtatttttataaaatactatgcaattatttctctattgttgggcatttatggttatctataagtttttaatactataaatgaagtcattgtattttaaataaattccttaggagagattcatgaaagttaacttctcaaaggacataaacattttaaagctctggagatatactgttttattgatttaaagaaggtttgtagcgatttaactatgatcagtaatgtataaaaatatgtttcaacatactct

SEQ ID NO: 44880 - DNA, 601 bp, Human
agacagtgtctccctctgtcgcccaggctggagtgcagtggcgccatcttggctcactgcaacctctgctttcccaactcggatgattctcttgcctcagccttccaagtacattatgctaacttttaaaacatagatattagctattccttaaagtataaaggaactttaactttaaaaccatagtgcaattttaatgataataacaatcatcctattttcttctaccatctattcatgcttctaaatctttgtgacctaatttttgagaatcagcatttgtcagaaaatccgtgtcctrgactaaaagttatatttttaagtttatacataatattttccatagcttttctaatagcaagtataatggctatgtccctctgtgttttctaatattgtatattttcattgtacctcatttagaattaatagtggtttaattactttattgatcttttcaataaacaagctttttcttttttctcatttgtttcttttttatatttaatttttcctttgttctattctactttttctgattttccaatgttataatttttcacatgatttcagagcacatttcaaaacagaaatcacttat

SEQ ID NO: 44881 - DNA, 601 bp, Human
attttgaaaataaaattaaatgcattaatctattaaagtcatacagttttggtactttaatgtactgcacataatgaaatatcctgttaagatttcccactacagttgaaatattcttgcattcttagggaaaaaataataggtcatgtagtgatattttcttaattcactactagatccaaattttcaatatcttattttgaattttttcatgttcttgaatgaaattggtctgcaatatgtgtgtgcatggggaagagaggaagagggggaagagaggaagagagagaagaaagacatmatgaaagagggaatgagagctccagagaatgctatctttatctgattctgttatcatcattatgctaacctttttttttttttttttttttgagacagtgtctccctctgtcgcccaggctggagtgcagtggcgccatcttggctcactgcaacctctgctttcccaactcggatgattctcttgcctcagccttccaagtacattatgctaacttttaaaacatagatattagctattccttaaagtataaaggaactttaactttaaaaccatagtgcaattttaatgataataaca

SEQ ID NO: 44882 - DNA, 601 bp, Human
attctgagatattttggcactttgtatttttaaagattatttagtaatattttcttacttctgtttatcactaatataaagacaagctataactcatgaatatttatgcagatttggtcatttaaataaatgtttatacatcccatttaaaaatattatccatacttttcttggtataaatcctttcatcttaaaataatttgtcttttctagtagttacacagtttattcctcttgctgccttatttcatttgctaaaacttccaaaaatgtttaatattagtgacactgattatccacrtaacattcatgattgtagaagcagtaatataatctttatactagttttttatgataaatgaatagtcgttagttcttcattccttaacatggctgctactaggtattgttgaatcacctttatcatgtttaggatgcctcttaatttccctaattagagtattactataaatattttgaaaataaaattaaatgcattaatctattaaagtcatacagttttggtactttaatgtactgcacataatgaaatatcctgttaagatttcccactacagttgaaatattcttgcattcttag

SEQ ID NO: 44883 - DNA, 601 bp, Human
aatggaaaatcaccttttgctacttttcaactctagtgaggaaggtcaaaaattgtttcatggcctgattttaggtaatactttactccttctatattaattcttttattggagttgcttaataggccttgctccctttatctttctattacatgtatagggtttgctctttttagtacattttcatatgtcagcacctattccctgattttttttttaatttttctgaatgattttcaaatatgtggttaaaaaaacaaccccccccattttcttgttctaaataacaagaaaaaaaaaatccaatgattttccaaataggattgtattaaatccatacagtgatattaatatcaagtactcccatattctggaacatggtgcatgtctccactcattcacatattatgcgtatccgtaagtacacttttgtgtttttattaaatcaggaactatatcgttcttattaaatatattctgagatattttggcactttgtatttttaaagattatttagtaatattttcttacttctgtttatcactaatataaagacaagctataactcatgaatatttatgcagatttggtcatttaaat

SEQ ID NO: 44884 - DNA, 601 bp, Human
tcacctcacaaagagattttaatgccttgcttatccatgttgaaaatggttttgaagcatagcatgtagggattttccaggacagtgctgctctagattggcttgtgaaaatatacaggcagctaaactgttctttgggcaaactatttttcttagctctgtgaaataattcagcgcagtattatttatagtaacaaaaatacaaaatgaaagaagtgaagcatctgctgttgtgctgctctcctattgggttaatttaagagaaccctgtaaatgcacatttcaaagctttttccttccyttttttagaagaagtctgtagactgaggtagcacagcttggaaggtatagatgaaatattgccgaatttatttttaagaactcacatttgtagcaaaaggaaaaaaaatcccactataatctatataattcaaattctactgtgaactatctgtgaactatcaatctcacttgttcaatcagaaaaggtagacacattacatgaaataaacaaaactgagaaaaacagtttatctttagattcaatcttatacaaaccaataccaccaaaaccttggaagttagtgatcatttcttaaag

SEQ ID NO: 44885 - DNA, 601 bp, Human
ctgcaatgtacaacgatggggccagcactgggagggtttgataacttgactcgccggataaaggaaagcagccctgtagcatggtagggcactccatggtcaggccagcccgtgaaatggaactgtttaacttcacggatttcattgtaccccctctgtgcaaagatggaaagaaatgttttcaaaagccattttaatggccaaaataaagccattaaacacaattatgggtacagacccaactgacaatgataacaataaaacctttacgaaagactatgccttttcttaaaaaaaaaaatataataaaatgaaggcctaacatggactaggagcttacctttattgtcagacaactgccaaagaaagaaaattataagtcttgctcagttctaaaagtctgggtaaattttatttactttgacagcttgtttcttgctgggagtgacaacacattaaattattaggggaaaagaaggaaatgggaaagctaaaatgctgccccattgacccaatgcattgagttctcaagtggtgtataaaagcaactttccagcttctcacctcacaaagagattttaatgccttgcttatccatgtt

SEQ ID NO: 44886 - DNA, 601 bp, Human
aaaaaaagctgattgcatacagtcaataccatttggaccaccacttacctgcaatgtacaacgatggggccagcactgggagggtttgataacttgactcgccggataaaggaaagcagccctgtagcatggtagggcactccatggtcaggccagcccgtgaaatggaactgtttaacttcacggatttcattgtaccccctctgtgcaaagatggaaagaaatgttttcaaaagccattttaatggccaaaataaagccattaaacacaattatgggtacagacccaactgacaatgakaacaataaaacctttacgaaagactatgccttttcttaaaaaaaaaaatataataaaatgaaggcctaacatggactaggagcttacctttattgtcagacaactgccaaagaaagaaaattataagtcttgctcagttctaaaagtctgggtaaattttatttactttgacagcttgtttcttgctgggagtgacaacacattaaattattaggggaaaagaaggaaatgggaaagctaaaatgctgccccattgacccaatgcattgagttctcaagtggtgtataaaagcaactttc

SEQ ID NO: 44887 - DNA, 601 bp, Human
tatttcaacctagcattctatacaatatgggatttgcaaaagtgataaaaacaaaaaacacagatgttgccattaaaaggcagagtttctatactttaaattgtggataacactacacgcattaggatgaatgtatgtatttcttaagttcctgttttatagactacttacagccaacttttattttattgctgttttactttatctataatacaagcaagctggaacttcgtaagcacacattagtttttgtgctcaaaagccttgtcttgatactctaaaaaaagctgattgcatacartcaataccatttggaccaccacttacctgcaatgtacaacgatggggccagcactgggagggtttgataacttgactcgccggataaaggaaagcagccctgtagcatggtagggcactccatggtcaggccagcccgtgaaatggaactgtttaacttcacggatttcattgtaccccctctgtgcaaagatggaaagaaatgttttcaaaagccattttaatggccaaaataaagccattaaacacaattatgggtacagacccaactgacaatgataacaataaaacctttacgaaa

SEQ ID NO: 44888 - DNA, 601 bp, Human
tctgtatgtctgaaatttagttttaaagctggaattctattgggaattttctagattggcaagaaatgtctatttcaacctagcattctatacaatatgggatttgcaaaagtgataaaaacaaaaaacacagatgttgccattaaaaggcagagtttctatactttaaattgtggataacactacacgcattaggatgaatgtatgtatttcttaagttcctgttttatagactacttacagccaacttttattttattgctgttttactttatctataatacaagcaagctggaacttygtaagcacacattagtttttgtgctcaaaagccttgtcttgatactctaaaaaaagctgattgcatacagtcaataccatttggaccaccacttacctgcaatgtacaacgatggggccagcactgggagggtttgataacttgactcgccggataaaggaaagcagccctgtagcatggtagggcactccatggtcaggccagcccgtgaaatggaactgtttaacttcacggatttcattgtaccccctctgtgcaaagatggaaagaaatgttttcaaaagccattttaatggccaa

SEQ ID NO: 44889 - DNA, 601 bp, Human
cagaagaaagtctggatataatgctcgtgttttttggcatatatttgctgaatctcactgatgcagttttcaaggtcctctaatgtgaattctttaaaaaaaatttttaaatagctgttttgcagcacaaatccttgcaatttaggccatttagtaactctgtatgtctgaaatttagttttaaagctggaattctattgggaattttctagattggcaagaaatgtctatttcaacctagcattctatacaatatgggatttgcaaaagtgataaaaacaaaaaacacagatgttgccaytaaaaggcagagtttctatactttaaattgtggataacactacacgcattaggatgaatgtatgtatttcttaagttcctgttttatagactacttacagccaacttttattttattgctgttttactttatctataatacaagcaagctggaacttcgtaagcacacattagtttttgtgctcaaaagccttgtcttgatactctaaaaaaagctgattgcatacagtcaataccatttggaccaccacttacctgcaatgtacaacgatggggccagcactgggagggtttgataact

SEQ ID NO: 44890 - DNA, 601 bp, Human
ggattttttgcggggagtggggaattcactttgtagtccagagatgcttcagtgtaggtggaaaatgacacttctgtttcaagagagtatctgagaatcttggagcatttctgaagcaagcaattcataagaaagtaaacctctctgataaatcaagaaattcttaagttgaaaacctatttatctcattttctaagtgcttagataggctagtaacattatttccttgttattcagatttggtcacttctcttaaactcactgttcttttagaaatttaagcaaaagatattgtggctayctctatttatctttgtcccctaccatcttctcaatcactgttcccagagttggagacaggaatgtaatttaagagtacatcagatttcatgaggaggattgaaaggaagttttttttgttttcagggtacatagtatctgatcctatgggacgttttacctttacttcattctctgctttttttcccctcttttatacatggttatttaaatcctgaataggttggattttcagaaagcaaaaaatgcttaggtacaacctattatgtagcttggagggaagagcgtatgagaatggtgt

SEQ ID NO: 44891 - DNA, 601 bp, Human
tctcaccatattttgtgtcctttaattgtaatatactgtgattattttgcagctggggaatgtttctccaattttatatatagaagtcaatggggaaaacaaaataaggattttttgcggggagtggggaattcactttgtagtccagagatgcttcagtgtaggtggaaaatgacacttctgtttcaagagagtatctgagaatcttggagcatttctgaagcaagcaattcataagaaagtaaacctctctgataaatcaagaaattcttaagttgaaaacctatttatctcattttcyaagtgcttagataggctagtaacattatttccttgttattcagatttggtcacttctcttaaactcactgttcttttagaaatttaagcaaaagatattgtggctatctctatttatctttgtcccctaccatcttctcaatcactgttcccagagttggagacaggaatgtaatttaagagtacatcagatttcatgaggaggattgaaaggaagttttttttgttttcagggtacatagtatctgatcctatgggacgttttacctttacttcattctctgctttttttcccctcttt

SEQ ID NO: 44892 - DNA, 601 bp, Human
gcagagtatctgctttggtataaactaaagattggaacaagagttctaaattattttcaaattgaaaataacactgtttaagttccacacctctctcacaattttcattttatgtaaatttaatacacataatttcaagttcatagaattgatcaagtggcagattcacgcttcaaaatttaactcaagattgaatatttttagattcatctagttgtgtgtcctctggcaacaatgtgagaatgttggctcactcactgtcttcacctcttgtaaataccaaggcaaaagaaaattaattcccaaaactttaaacgggaaatctgaggagccacgcttcacaggaaatgcaaatggtgggggtgggcaagagaatgacggttatcaaaggggaggagagtaacagtgtaaagactatttgaatcatgatctgaagagaaatgaaaatgaattattaggtgtagaatatgattcccagcaaatcaaaaggctagccgctatcttactgtatttaattctaaagttaatttttaaaaatacttttaaaaaattatattttagtctttaattggcaaataataatgtatatattcttgggtac

SEQ ID NO: 44893 - DNA, 601 bp, Human
agctaatattgattacacatgaaaaacatctctttcggttgagtagagtatatatgagagacatctactctttgtttgcaaaaaaaataaaaaataaaaacaaagtccactacaggtaaatctacatacctctgtctggaccatattaatacgccgagatcttaaggctttgacacaattgtaaatatcaacaacaccctctctttcagccatgtctagcatgatgtcaatcacaatgtagcagccagttcgtccagcaccagcactgaaaaacaattaaatttaatgaattgtaagaagsatgttagtcttcataaccttaaataaggactttttccactgtcagataggtagaatcaaattgatttaacaaactgcaaggcacagcacttgtccctgctgtgtaaaagcttattaatgtacaaatagcttcatgcagagtatctgctttggtataaactaaagattggaacaagagttctaaattattttcaaattgaaaataacactgtttaagttccacacctctctcacaattttcattttatgtaaatttaatacacataatttcaagttcatagaattgatcaagtggcagatt

SEQ ID NO: 44894 - DNA, 601 bp, Human
caggtatggcagtttctccacataagcaggcttctaaaatggcatcatgaataaaaatgtactgttcctaccaaaagaatgaaaaagaaaattttgtactagttttagtatcacttttctgtcatcaaagttaggaaatacagaaaattttctctatatggaaatatgaattaaaacaccaatatttttctatatgactcagctaatattgattacacatgaaaaacatctctttcggttgagtagagtatatatgagagacatctactctttgtttgcaaaaaaaataaaaaataaaaacaaagtccactacaggtaaatctacatacctctgtctggaccatattaatacgccgagatcttaaggctttgacacaattgtaaatatcaacaacaccctctctttcagccatgtctagcatgatgtcaatcacaatgtagcagccagttcgtccagcaccagcactgaaaaacaattaaatttaatgaattgtaagaaggatgttagtcttcataaccttaaataaggactttttccactgtcagataggtagaatcaaattgatttaacaaactgcaaggcacagcacttgtccctgct

SEQ ID NO: 44895 - DNA, 601 bp, Human
tgtgagtgacccaggtcaaaatctgtatgactgcatgaaaaaaaggctataaatacacactaaatacacacaaatcaccactcattttgacttgttattatttcttttttttttctgagacggagtctcgctctgttgcccatgctggagtgcagtggtgcaatctcggctcactgcaagctccgcctgccaggttcacgccattctcctgcctcagcctcccgagtagctgggactacaggcacccgccaccatgcctggctaattttttttgtctttttagtagagacggggtttcacygtgttagccaggatggtctcgatctcctgacctcgtgatccacccgcctcggcctcccaaagtgctgggattgcaggcatgagccactgcgcctggcctaatttttgacttttatgatacctttcccctttgctcttccctaagtctgaacttatttgtcattttggatatagtagatataaattcatcaatagaaaagtgactatataatatgtataatgaaagagatacgtattgtatttaaaacaggatcaaaggttataaatttgacttgaaagaccttccttgaaaggattccta

SEQ ID NO: 44896 - DNA, 601 bp, Human
atgttggaaagagcactggatcaacaatcaaagaatttggtctctgcccttgattttattttcacccaccttcaggggtgttttaagggcagtgaaaacatttagggctattttgaaataacatgtactacaaacttcatttattattattattactattattatttttgagacagggtcttactctgttgcccaggttggagtgcagtggcaatatcttggctcaccacagccttccagggttaagcaaacttccagggtcaagcaatcctcccatctcaacctcctgagtagctgggastacaggcatgcaccaccacacccggctattttttatattttttgtagagatgaggttttgccatgttggccaggctggtcttgaactgctgacctcaagatctgcctgccttggcatcccaaagtgctaggattataggtgtgagctgccactgaacccagactcagttataattaatgtgcttgatctcatcacattgtgagtgacccaggtcaaaatctgtatgactgcatgaaaaaaaggctataaatacacactaaatacacacaaatcaccactcattttgacttgttattattt

SEQ ID NO: 44897 - DNA, 601 bp, Human
gatagaccttgtagttaaagctaatgaagcctgagaagtgacaaagaaacaagacacacattgttcagggctcctcttcttaaaaggaaaaggtacgctaaacaacactgctacctgcaaaatgcattgccttaaccaaagaaaatgcaatcgggcagtccattatgataatgacccttcatcacactgggaaacggtatcatttgtagtaacatctgggcttgccatatttgaagataagctatggcatgttggaaagagcactggatcaacaatcaaagaatttggtctctgcccttgrttttattttcacccaccttcaggggtgttttaagggcagtgaaaacatttagggctattttgaaataacatgtactacaaacttcatttattattattattactattattatttttgagacagggtcttactctgttgcccaggttggagtgcagtggcaatatcttggctcaccacagccttccagggttaagcaaacttccagggtcaagcaatcctcccatctcaacctcctgagtagctgggactacaggcatgcaccaccacacccggctattttttatattttttgtagagatg

SEQ ID NO: 44898 - DNA, 601 bp, Human
cataagatggttactagctttgaggtggatgatatagtgcttattaattgtagtctccctgttgtctgaataaaattataccacatcttggttatgactgacctattctagatcagctcaaaggatccgatagtgacttactcttgttagattgcatatcctaaaaatccggttgatcacatcacagtccattgaacaagacatacattccacttggatggggccatatcgtagcatcccttcctctggccagtactgagggcagccctaaatgatgaacgttttgaaagaaaaaaaaaaagagtattattttttctagttaggatagtataaagcagattttagcaattcattactactctattaagttgtatataagtacataaaagcaatccatagccattaacctgggacaagtcgacttcgtttaacatcacaatggaggtacagccataatcatacactaatctccagaagtcttttacagtgtttggcagagggtattgtgtgacgatgaaagcagctggttgcctgtagctctgtgaagaaacaaggtagatggagaaatataaaaacttaaaatgtatgatcggttgtacaa

SEQ ID NO: 44899 - DNA, 601 bp, Human
gcttgttatttggttacataatctaaattgtttttattaatatctttttttgggggacgaagtctcgctctatacagcctggggtgcagtggcgtgatctcagctcactacaacttctgcctcccgggttcaaatgattctgctgcctcagcctccccactagctgggactacaggcatgccaccaccatgtccagctaatttttgtatttttagtagagatggggtttcaccacgttgccaggctggtcttgaactcctgaccttatgatctgcccgccttggcctcccaaagtgctggrattacaggcatgaggcactgtgcccgggctttattagcacttttttttttaagatcttccccacccacattgaatttgtcatgtagtggaaagcaaatgaggagtcagagaaagacgatacagttactactttgctgctgggaaaaggcatggtggtagcagcactggttctacctttagatctgcttagagccataggttgagacgtttaggaagatgaaattgcaggtaggataatcaataatgaacttggaacagtgacatggaacccttctataatggttgatccaacatgtctct

SEQ ID NO: 44900 - DNA, 601 bp, Human
aaagaatgagaaaaagagctataattctatcatcagaagaaattgttaaaatatcaccttagtttgcctcagttctttttgtgcatggttgaaataattatcttagaataaatataactatgtatatttcaaaatataattttaaatgtaacttttaaaatttaacattgttacaattctttttccatgttatttaacatcttttaataccacataaaaatcaaatatatgtattgtttgactattaagttgcttttatttttttctctattttataatgctacagtgataaactgcaaawgtttttctccatatatttcagatgatttccttgagaaaaaaaaagccagccattttaaacagccatttatgcaatttcaagttcttaatttttgacactgtttttgtccatcagagtatttaagcaaatttttcaagaatggttagtgatccttaaattttgagcctacttatacctgaaaatgtatttctgctgcctttatatgtttaagacaacatattggcaataaaatttttgagttaaaactgcctttcctctaagcccatctatggacttgctccataataagaatttagaaaa

SEQ ID NO: 44901 - DNA, 601 bp, Human
ttccaggtactccaaagctacatcatagcagaaacggtattgctcctgaaagatgtcaaaacacaaagagtgagaaaacttaagaaagagactaatgttgaataacagttaccaaatgaaacttgacaaccaatttagattactcaaggattacaatttattttttctatatatgagattaatatctaggcatacatattttatacttgagtctaatgatccatttaagaaaaaggaaatttatcttaaaaagacattttatctttgccgcatattttctatcaattttttaaatatctakaattttttatctgtttataatagtaatatttgatcattacagaacaattctgtacaaatataaagaatatacacattctgaacaaatataaagaatgagaaaaagagctataattctatcatcagaagaaattgttaaaatatcaccttagtttgcctcagttctttttgtgcatggttgaaataattatcttagaataaatataactatgtatatttcaaaatataattttaaatgtaacttttaaaatttaacattgttacaattctttttccatgttatttaacatcttttaatacc

SEQ ID NO: 44902 - DNA, 601 bp, Human
tcggccccaagggcgcacgggcgggcctcctctgccctaagcctgcggcctggggtgcggccgtggcgccgaaagacccgcatgctcggcgacccagctttccaggacgaagaaaggacagaagtgtcgtccgacagcggtgcgccagaaacccgggtccgaggcggcggcagcagccgagcttcccgcctgacgcagcagaggcgcaggccaaagtgcggccgccatcgccacctcgccgctccctaccctctctgtccgccacagacccgacccgcactgcggctccgtcagcgccggkcccctcccccagccctcaccttccgcgtcggagcgggcccgcagcggcggagactcggacgcaggcctggggaagacggctcgcaaggtagaggctgtttattttgagggtccttgcctgcgccacacgcgggtctgcacacggccccacatacgccgctgcgcacggctctcctccgcctcgcccacgcggccaatcagcgcgcggggttcggcagtccaatcagagccgcccgcggcagggccgcccactagagcgcggcgcggggcgggtgtttctgcgcgcagcgtcttttcccgc

SEQ ID NO: 44903 - DNA, 601 bp, Human
aaaatgtaatttaaaagcaagatggggatattcattagacctccttcactttgagaaagacaaaaaacaaattcagttttggcttatctcacctgagtccttctgaataatgcctgaaacacactagctaaaatcacagacgattactgagcaatgttctctttttacaagacccccaagaccagaaacagtcacttcctttggaagtgccctgtggctgaggccatatggttaacatgtgggaacaagcacaagccttacccataataaaatcaacacctaaacccaaatgtggaccatyatgccattctaaaacaggttctcacgatatggaaaaatctagatggaggggagctagttgaatttcgtgtctcgtttgtaattacatctgtttcattaatccaagaaatgatgcagactaccgcccgctgctgtggttttggaggtttgacaaattcgtgttttttctggtaatggcgcttttaaaggatcccagcaacttaaatagtgttaactcttggaatgtgagccccatcagccccttttggaatggtaatgtaacacaagcaacttagtatttaaatgacgataaaaattcaag

SEQ ID NO: 44904 - DNA, 601 bp, Human
atacaaaaactagctgggtgtggcggcgggcgcctgtaatcccagctacttcggaggctgaggcaggagaatcgcttaatccgggaggcggaggtcgcagtgagccgagatcgcgccactgcactccagcttgggcgacagagtgagactccgtctcaaaaaaaaaaaaaaaaaaaaaaaaaaagaaaaacccctggtcttccactgatttggttcaaaatattttacagactgcaccatctgaaatacattacctctcctgttaccaatatgaaaaaaaagaggacctttggttcctcaraaaaacacaaactgttatttttttaaagaaaaacttatcaagagatgaaatcggaaaaacttaagtctttaattctgcccttgggaatgtaataaattattccttttatattccaatacacaaagaactcttgtagacaagaatcaggctcaacaaactaaaaacagcatgtacctaggatcctggcagtttacaggtgtttgattatccttaaccagagtaactcattagaagcatttaaaactatttaggaggggggagggggaagcccaggagataaggactatatctcttatcttt

SEQ ID NO: 44905 - DNA, 601 bp, Human
tctccaaaaaaaactaaaaaaacaaaaattagccgggcgtggtggcacacgcctatagtcccagctactcaggaggctgaggcaggagaatggcttaaacccaggaggcagaggttgcagtgagctgagatcctgccattgcactcccgcctgggcgacagagcaagactttgtctccaaaaaaaaaagaaaaggaaaaaaaaagttaagtggtaaagtacacaaaaatgctatcgtaatatatgacaaaaatgctattgtgtaatatttttaaggtagggaattataccaattcaatctstacttcaaaatattacataaaggtattactactatatatctagtaactaagaaaaaaaaaagccacgcacatttgaattgtaatgctgtaagtattcattctgtatttctctttagataaaaatcaaagtaaaactaatactgatagctttttaaaagatctacagtcataataattttgaattcattcacacagctttcttgaatcttaaaaaatattttctttaacttcatggcagaacttaggagtctcaccaaacacacaaacactggcaacttgcttcactagttaacacctcat

SEQ ID NO: 44906 - DNA, 601 bp, Human
cttaattccactgtcaaacaatggcacacaaagtcgtattttaaatatcctctcaaacctaagcacaggcaccatcatctagaaaaacatatttccaactgagtaaaacttgagtggataatcgaattagctaacctaaccacagtgccaaagacccaaaacgcagtccgaaaaatggcaaggttctccactttcagtaactgtttaatcattaacttgtggacaaatttagtgacttaaaattacactgaagttgagtttcaaaaagttcccattgtcaaatatacaaaagaaaataacmcaatactcacttaccccaactctgtgtaatctgatttaggataaattcttagagaaatctttctactaactcttgccacttgcctatgaacatattaccaaaaaaattatatggctatgagttactggtgctttcagatatacaaaacatttctagtcagaacaaacagccagtgaaggatattaaaaacagatttttacagaatttgaaatagtatctgctttgtaatcattcttttaactgtactagtattagcatcctaaattatgtgaagtatttgctggtttccaccacagaaga

SEQ ID NO: 44907 - DNA, 601 bp, Human; identical to SEQ ID NO: 30847

SEQ ID NO: 44908 - DNA, 601 bp, Human; identical to SEQ ID NO: 30848

SEQ ID NO: 44909 - DNA, 601 bp, Human; identical to SEQ ID NO: 30849

SEQ ID NO: 44910 - DNA, 601 bp, Human
ttactacattaacctcatcagctatcttagcaatgagaaaggaaaactattaatcttaaactgatgtgactctcttttgccatttactcatatagttttcaaatcacagacctacacagggaaatatttttctgttcactggtgaggagtcagagaccagagatgttcacactgaatgtgatgatttctaagctactttctagctctgacttctgtgacttcataattcatatttgctctcccagtaaatatacccatagtagatgaaaaataagctatactgaaacttaagaattgatcrtggatctatgcaatgatcatcaacaaagttttcccaggtaaatcaagttgatgtttactagtgaatttttcacaagttgtttctttacctgttacgattattacaggggatccagtttacttcagggtctgggatgtcctccaaatatgggtagagagagtccctgttgaagttccagccataaatagcatcttctggagtcacaataatatgcgcaccctgttaaaaatgcaacttaatccaaaggggggcctgcaagaggagctgaggagctgagtggctgagtaacaactatttggg

SEQ ID NO: 44911 - DNA, 601 bp, Human
tctccagcatctgttgtttcctgactttttaatgatcaccattctaactggcgttgtgcggttttgagaatagttccaaaagaggaattcctaaaataattttagccatgtgtattcagaaagaagtatgtgaatcgacatgattttcttaggtgtataagatattggtttccttacattaaaattaatagtgctgctttcaccacacttaatatctctgtagccgagacctgacttaaaccacttaaaatcctgccatatcacctcttagattacaatcagcttacactttaaggactttactacattaacctcatcagctatcttagcaatgagaaaggaaaactattaatcttaaactgatgtgactctcttttgccatttactcatatagttttcaaatcacagacctacacagggaaatatttttctgttcactggtgaggagtcagagaccagagatgttcacactgaatgtgatgatttctaagctactttctagctctgacttctgtgacttcataattcatatttgctctcccagtaaatatacccatagtagatgaaaaataagctatactgaaacttaagaattgatcat

SEQ ID NO: 44912 - DNA, 601 bp, Human
atgcatgcatgtgtctttatagtaaaatgatttatgatcctttggtatatacccagtaatgggattggtgggtcaaatggtatttctggttctagatccttgaggaatcaccacactgtcttccacaatggttgaactaatttatactcccaccaacagtgtaaaagagttcccctttctccacatcctctccagcatctgttgtttcctgactttttaatgatcaccattctaactggcgttgtgcggttttgagaatagttccaaaagaggaattcctaaaataattttagccatgtgyattcagaaagaagtatgtgaatcgacatgattttcttaggtgtataagatattggtttccttacattaaaattaatagtgctgctttcaccacacttaatatctctgtagccgagacctgacttaaaccacttaaaatcctgccatatcacctcttagattacaatcagcttacactttaaggactttactacattaacctcatcagctatcttagcaatgagaaaggaaaactattaatcttaaactgatgtgactctcttttgccatttactcatatagttttcaaatcacagaccta

SEQ ID NO: 44913 - DNA, 601 bp, Human
ccctcagacgaccttttaaaatttcagccccacgcttgccaccctattcaccttccccactttattttttccataacatttacttccacctcatatcatagataggtagacagatgaaagatacctatataaagataggtagatagataatagatagatgatagatagatgatagatagataattatctttttaaaacatttattacctccccacactagaatataaatttcaaggggacaggaatttttaatctgttttgttcacttcattgcccagaacaatgtttagacataataggyactcaaaaaaaatttgcagagttaataaattaaggcagctgggcatgatgactcatacctgtaatcccagcactttgggaggccgagcaggtggatcacttgaggccaggagttcaagaccagcctggccaacatggtgaaacccatctctactgaaaatacaaaaaactagctgggtgttgtggctcacacttgtcatcttcgggaggctgaggcatgagaattgcttggacctgggggatagaggttgcagtgagctgagatcacgccactgcactccagcttgggcgacacagagtc

SEQ ID NO: 44914 - DNA, 601 bp, Human
agaaagcaatcaactatgtgcatacttcaaacatactcaataagatgagatctgattctatgagagcagggaaggatattgagtcctccttttctctcacatcctacatccagtctttcaacaaaacctgccagtgctactttcaaactttattcggaatctgtccacttctcaatacctaaacttctaccatttcttggtctcagacccatcatctctatgccataatgatcacaacagcttttgaactgccctctgcttctttggtgacctataccctggagtctattctcaacattgygctcctcctgcccttctgcctccatttcctacttttctcctcttctgtcacatcactgtaaccacactaaccctttttctgttccataggttagacacatactctgaccacaggatcttggaatttagaattccttcagcctggaatgcacttttttcagatactcacatgatctattgcctcatttctttcaggtctttgctgaaatctcactgtgatgccctcagacgaccttttaaaatttcagccccacgcttgccaccctattcaccttccccactttattttttccataacatt

SEQ ID NO: 44915 - DNA, 601 bp, Human
ttaccattgcatgcttgtgtacaaacatcaaaacatctcatgtaccctataaatatatacatctactatgtacccatgaaagttaaaaataaaataattaacaaaaacagttgaataagtaaattcatctttaagttaggttattagacatagtttgtctctgaagaaatatgcaagctttcttctatgatgcaatcaaagtgtctgaacaaaattgtacttctcttagctgctcagaaactcttagaactatacttaacatccagttgtaatgagcagctctttaccatgatgcctcatracaactgcttcctctattcatatgggttctagtttgttgttagaactaaagtatcctatttttaattatattagatataattagaaacttcaaatccttctggaacgatatgacatataaatgctaaataaattaaataaaaaagaaaagtgatgagagcctgttcctttaacgctcagtctaagaggtgatgtaggtcccaaaagtttggtgaatatgagaagagaaagcaatcaactatgtgcatacttcaaacatactcaataagatgagatctgattctatgagagcagggaagga

SEQ ID NO: 44916 - DNA, 601 bp, Human
aaatcaaccgggcatggtgattcacacctgtaatcccagcatttctggaggctgaggcaagaggatcacctgaggtcaggagtttgagatcagcctggacaacatggtggaaccccgtctctaccaaaaatacaaaaatagctgggtgtagtggcaggcacctgtaatcccagctactcgtgaggctgaggcaggagaattgcttgaacccaggaggcagaggttgcagtgagccaagatggcaccattgcacttcagcctgggcaacaagagggaggctctgtctcaaaaaaaaaaaaaagcaaatcaaaagtacaattatatcatctcacacctgttaaaatgacttataacaaatgctggtgaggatgtggagaaaagggaaccctcatacactgttagtgggaatgcaaattagtacagtcactgtagagaacagtttgaaggtttctcaaaaaactaaaaatagagccaccatacgatccagcaatcccactgctgggtatatactcctcaaaaagaaaatcagtatatagaaaagatatctgcactttcatgtttattgcaactctgttcacaatagccaaaatttggaaacaac

SEQ ID NO: 44917 - DNA, 601 bp, Human
atcttataagggattcataaccggaatatgtaagaagtccaaacaactctataggaaaaaaaatctaataatccaatccaaaaatgggcaaaagatttgaacagacatttctcaaaagaagttatacaaatggcaaacaggcatgtgaaaagttgctcaacatcactgatcatcagaaaactgcaaatcaaccgggcatggtgattcacacctgtaatcccagcatttctggaggctgaggcaagaggatcacctgaggtcaggagtttgagatcagcctggacaacatggtggaaccccrtctctaccaaaaatacaaaaatagctgggtgtagtggcaggcacctgtaatcccagctactcgtgaggctgaggcaggagaattgcttgaacccaggaggcagaggttgcagtgagccaagatggcaccattgcacttcagcctgggcaacaagagggaggctctgtctcaaaaaaaaaaaaaagcaaatcaaaagtacaattatatcatctcacacctgttaaaatgacttataacaaatgctggtgaggatgtggagaaaagggaaccctcatacactgttagtgggaatgcaaatta

SEQ ID NO: 44918 - DNA, 601 bp, Human
agatacccatatgcggaagaatgaaagtagacccctatctctcaccatatacaaaaatcaaataaaaatgaattatatacttaaatatttgacctcaaactatgaaactactaaaagaaaactttggggaaactctccaggacattggtctggacaaagatttcttgagtaataccccacaggcacaggcaaccaaagcaaaaatggacaaatggaatcacatgaaggtaaaaagcttctgcacagcaggggaaactatcaagaaagtgaagagacaacccacagattgggataaaatatktgcaaactatccatcttataagggattcataaccggaatatgtaagaagtccaaacaactctataggaaaaaaaatctaataatccaatccaaaaatgggcaaaagatttgaacagacatttctcaaaagaagttatacaaatggcaaacaggcatgtgaaaagttgctcaacatcactgatcatcagaaaactgcaaatcaaccgggcatggtgattcacacctgtaatcccagcatttctggaggctgaggcaagaggatcacctgaggtcaggagtttgagatcagcctggacaaca

SEQ ID NO: 44919 - DNA, 601 bp, Human
ctaaagactccaccaaaaaactaatagaactgacaaacaaattcagtaaagttgcaggatacaaaatcaacataaaaaatcagtagcatttctgtgccaacagcaagcaatctgaaaaagaaatcaagaaaggaatagcatttgttatagctataaataaaatacaatacctaggaattaatttatccaaagaagagaaagctctctacaatgaagtctgtaaaacattgatgtaagaaattgaagaggacacaaaacatggaaagatattccatgttcatagattggaagaatcaatatkgttaaaatgcccatactatccaaagcattctacagattcaatgcaatctccatcaaaataccaatgtcattcttcacagacatagaaaaaaaaattctgaaatttacgtggaaacacagaagatccagaagccctcctaagcaaaaagaaaaaaaactggagaaatcacattacctgactttaaattatactacagagctctagtaaccaaaactgcatggtactggcataaaaacagacacatagaccaatgaaacagaagagagaacccagaaataaacccaaatatctacagtgaac

SEQ ID NO: 44920 - DNA, 601 bp, Human
gaacattgatgcaaaaaaacctcaacaaaatactagcaaaccaaatgcaacgacacattaaaaaattattcatcatgaccaagtcggatttatcccaagggtgcaaggatggttcaacatgcacaaatcaattgatgtggcacatcatatcaacagaatgaagaacaaaaaccaaatggtcatttcaattgacactgaaaaaatatttggtaaaattcaacattccttcataataaaaaccctcaatgactggatatagaaggaacatacctcaacacaataatagccatttatgacagayccatggctggtatcatactgaatgagggaaaactgaaagcttttctctaagatctagaaaagacaagaatgtccattttcaccactattattcaacatagtagtggaggttctcactaaagtaatcagacaagagaaagaaataaaatgcatccaaattggaaaggaggaaaattatttttgtttgcagatgttattatcttatacttggaaaaccctaaagactccaccaaaaaactaatagaactgacaaacaaattcagtaaagttgcaggatacaaaatcaacataaaaaatcagt

SEQ ID NO: 44921 - DNA, 601 bp, Human
tgatatttctagacatacactaggctataagggaacttcttgccttaaatggaaggacccagtcctggcaagaatcatcacctgctaactaaagagcccttgggctttgaataaacatcagtgatagccaggcagtactcaccacgaggcttgggtgggacccagtaccatgctggtttcaggtgtgacccagcacattcccagctgttgtagccatggggaggcatggggaggaaaggagagggaagagtaaaaggactttgtcttacaaattgggtaccaacttagccacagtaacatraagcaccaagcagactcctaaagtcctcaattccaggacttagctcctggatggcatttctagacccaccctgagccagaaaagaacccactgccttctcttataagaaatgctaaagaaatttcttcaatctgaaagaaaaagacatcaataaccaataagaaagcatcttaaggtacaaaactcactagtaagtacacagacaaacatggagtgttataactctgtaattgtggtgtaaacttctcatatcttgagtagaaaaactaaaagatgaaccaatcaaaaataataattata

SEQ ID NO: 44922 - DNA, 601 bp, Human
ctcacagctttgagagactccgtccctctgccttaagaaaggagacaggagcataaagaggactttgtcttgcaacttggataacagctcaaccacagtaaaataaagcaccaagtagagtactgaatcccccaacccaggccctagctccctgatgatatttctagacatacactaggctataagggaacttcttgccttaaatggaaggacccagtcctggcaagaatcatcacctgctaactaaagagcccttgggctttgaataaacatcagtgatagccaggcagtactcaccacsaggcttgggtgggacccagtaccatgctggtttcaggtgtgacccagcacattcccagctgttgtagccatggggaggcatggggaggaaaggagagggaagagtaaaaggactttgtcttacaaattgggtaccaacttagccacagtaacatgaagcaccaagcagactcctaaagtcctcaattccaggacttagctcctggatggcatttctagacccaccctgagccagaaaagaacccactgccttctcttataagaaatgctaaagaaatttcttcaatctgaaagaaaaaga

SEQ ID NO: 44923 - DNA, 601 bp, Human
agatggccaaatagaaccttccagcaattgtcttcctgcaggatcaccaaactgaacaaccatccacaacaagaatgaaccttcataagaaccaaaaatcagaagagtaatcacagtaccttgttttaaaatcatatcaaggaaagaggcactgaaggaggtaagaaagaaagtctttaattgccaataccactctcccccatcctccaggttaccacatggtgtggagagaaaatttgtgcccttgggggaaggaaagtacagtgattgtgggactttacattggaagtcagtgttgccwtgtaacagcagaaagcaacatggcacagaattcagccagtgcccacagagggcacatttagaacagctcttgtcagagaggaattgtcctacccagcagtcagaacctgagttctaccaaggatcaccaatgtgggataaagttctctggggttctaaataaacttgaaaggcagtctaggccaggggttcccaatccctatgccatggactgtggcctgttaggaattgggctgcacggcagtaccagtccatggcctgttagaaactggctgcacagtaggagatgagtgacattact

SEQ ID NO: 44924 - DNA, 601 bp, Human
ggcacccacaaggcaagtaatatataattcagacatgtgcactttattatacagaaggaatatacctcaacataataaaggctatagatggcgtatatgtcagcacctacagctaacatcctatggaatggggaaaagctgaaagcctttgttctaagaactgtaacaagacaaggaagcccaccttcaccacttctattcaacatcatactggaagtcctagccagagcaatcaggcaagaggaagaaataaaagatgaggaggaagcagaggaagatggccaaatagaaccttccagcrattgtcttcctgcaggatcaccaaactgaacaaccatccacaacaagaatgaaccttcataagaaccaaaaatcagaagagtaatcacagtaccttgttttaaaatcatatcaaggaaagaggcactgaaggaggtaagaaagaaagtctttaattgccaataccactctcccccatcctccaggttaccacatggtgtggagagaaaatttgtgcccttgggggaaggaaagtacagtgattgtgggactttacattggaagtcagtgttgccatgtaacagcagaaagcaacatggca

SEQ ID NO: 44925 - DNA, 601 bp, Human
attatgtgttgatttaagttcatctgtgaaacattcaaatcaaagctaaaactataaatatgaaatgctaacgacaagtctggaaaggtacactgtgactctttatttctaacattgatctaactttctatattggatcaatatattgtatttaggtggtattaaaaattataacccatttaatttaaatgttaaattttaaactatgaggtctacatcaaaaccaacatttgactaatgaactctttaggcataataaaggttaatattctaggcagtataaatagtttcttggcacccwcaaggcaagtaatatataattcagacatgtgcactttattatacagaaggaatatacctcaacataataaaggctatagatggcgtatatgtcagcacctacagctaacatcctatggaatggggaaaagctgaaagcctttgttctaagaactgtaacaagacaaggaagcccaccttcaccacttctattcaacatcatactggaagtcctagccagagcaatcaggcaagaggaagaaataaaagatgaggaggaagcagaggaagatggccaaatagaaccttccagcaattgtct

SEQ ID NO: 44926 - DNA, 601 bp, Human
aatatttaagcagacttcaaatacgtttgggtttttttctgtttgtttctttaaataaggttatagtagcaaaaaaaacttctctgaagcctttctccatagccctgctctatagattccataatggtataatggatttaagctatgaagcctcaaaacatcacaactacattaaggcaatgttctcaaatttagggaaactgcctaattactattatgctatggtggaattatgtgttgatttaagttcatctgtgaaacattcaaatcaaagctaaaactataaatatgaaatgctaaygacaagtctggaaaggtacactgtgactctttatttctaacattgatctaactttctatattggatcaatatattgtatttaggtggtattaaaaattataacccatttaatttaaatgttaaattttaaactatgaggtctacatcaaaaccaacatttgactaatgaactctttaggcataataaaggttaatattctaggcagtataaatagtttcttggcacccacaaggcaagtaatatataattcagacatgtgcactttattatacagaaggaatatacctcaacataataaa

SEQ ID NO: 44927 - DNA, 601 bp, Human
atgattatgaatgttagatataaacacttcacatttaacagtaatatttaagcagacttcaaatacgtttgggtttttttctgtttgtttctttaaataaggttatagtagcaaaaaaaacttctctgaagcctttctccatagccctgctctatagattccataatggtataatggatttaagctatgaagcctcaaaacatcacaactacattaaggcaatgttctcaaatttagggaaactgcctaattactattatgctatggtggaattatgtgttgatttaagttcatctgtgaracattcaaatcaaagctaaaactataaatatgaaatgctaacgacaagtctggaaaggtacactgtgactctttatttctaacattgatctaactttctatattggatcaatatattgtatttaggtggtattaaaaattataacccatttaatttaaatgttaaattttaaactatgaggtctacatcaaaaccaacatttgactaatgaactctttaggcataataaaggttaatattctaggcagtataaatagtttcttggcacccacaaggcaagtaatatataattcagacatg

SEQ ID NO: 44928 - DNA, 601 bp, Human
cagaaactgctgggccacccactgacacccatcttggctatccccactgcttcccaaaccctgttctagtctggggctgagcctgagtggcatgggaagaagtcaagaccccaagcagaacaccagaggctggaaaccaagaagggcaccctggggatgaaactctggggagggtggagatgggaaggatgaaatggacatgctccctcacacatctccatttaaatttcttaactcacagtaatgatttatctttttctactcgaaactaaatgttgacattcatatgattatgaatgtyagatataaacacttcacatttaacagtaatatttaagcagacttcaaatacgtttgggtttttttctgtttgtttctttaaataaggttatagtagcaaaaaaaacttctctgaagcctttctccatagccctgctctatagattccataatggtataatggatttaagctatgaagcctcaaaacatcacaactacattaaggcaatgttctcaaatttagggaaactgcctaattactattatgctatggtggaattatgtgttgatttaagttcatctgtgaaacattcaaatcaaa

SEQ ID NO: 44929 - DNA, 601 bp, Human
taagacaatagggacaaaaagtttaaaccatatgtgaacaaatttgaaactattcatatgtaagcaaaatcaatatgaatttgaatattgtacctaaagaaaaagtaagatatggcagatggtctccacattgggtttctgaaaactgtcagggtgttttgacactgtagttacatatcattgctacagcagttagatgactgtaaagtagttatatgcttggtcactgcatatatgatatatacttgtcatctaaattttatttaaaaaaaaattttcagaggcattgtctgcccaaacmctctagagctctgcccctcagatgctgtaaggtgaaagagagggccctgacaaggatgggacaatggcagcaggctggccacatgcacagccaccactacccctggcctgtggccactcctgggacagaaactgctgggccacccactgacacccatcttggctatccccactgcttcccaaaccctgttctagtctggggctgagcctgagtggcatgggaagaagtcaagaccccaagcagaacaccagaggctggaaaccaagaagggcaccctggggatgaaactctggggagggt

SEQ ID NO: 44930 - DNA, 601 bp, Human
gctcattttaagttacacaagcctgagtaagacaatagggacaaaaagtttaaaccatatgtgaacaaatttgaaactattcatatgtaagcaaaatcaatatgaatttgaatattgtacctaaagaaaaagtaagatatggcagatggtctccacattgggtttctgaaaactgtcagggtgttttgacactgtagttacatatcattgctacagcagttagatgactgtaaagtagttatatgcttggtcactgcatatatgatatatacttgtcatctaaattttatttaaaaaaaaattttcagaggcattgtctgcccaaaccctctagagctctgcccctcagatgctgtaaggtgaaagagagggccctgacaaggatgggacaatggcagcaggctggccacatgcacagccaccactacccctggcctgtggccactcctgggacagaaactgctgggccacccactgacacccatcttggctatccccactgcttcccaaaccctgttctagtctggggctgagcctgagtggcatgggaagaagtcaagaccccaagcagaacaccagaggctggaaaccaagaagggca

SEQ ID NO: 44931 - DNA, 601 bp, Human
ttgctgtgtgtagacccatgctcaggctcattttaagttacacaagcctgagtaagacaatagggacaaaaagtttaaaccatatgtgaacaaatttgaaactattcatatgtaagcaaaatcaatatgaatttgaatattgtacctaaagaaaaagtaagatatggcagatggtctccacattgggtttctgaaaactgtcagggtgttttgacactgtagttacatatcattgctacagcagttagatgactgtaaagtagttatatgcttggtcactgcatatatgatatatacttgycatctaaattttatttaaaaaaaaattttcagaggcattgtctgcccaaaccctctagagctctgcccctcagatgctgtaaggtgaaagagagggccctgacaaggatgggacaatggcagcaggctggccacatgcacagccaccactacccctggcctgtggccactcctgggacagaaactgctgggccacccactgacacccatcttggctatccccactgcttcccaaaccctgttctagtctggggctgagcctgagtggcatgggaagaagtcaagaccccaagcagaacac

SEQ ID NO: 44932 - DNA, 601 bp, Human
aatagcatgaattttgaaagtagcactaaaattgtgtttttattacacatcttgctgtgtgtagacccatgctcaggctcattttaagttacacaagcctgagtaagacaatagggacaaaaagtttaaaccatatgtgaacaaatttgaaactattcatatgtaagcaaaatcaatatgaatttgaatattgtacctaaagaaaaagtaagatatggcagatggtctccacattgggtttctgaaaactgtcagggtgttttgacactgtagttacatatcattgctacagcagttagaygactgtaaagtagttatatgcttggtcactgcatatatgatatatacttgtcatctaaattttatttaaaaaaaaattttcagaggcattgtctgcccaaaccctctagagctctgcccctcagatgctgtaaggtgaaagagagggccctgacaaggatgggacaatggcagcaggctggccacatgcacagccaccactacccctggcctgtggccactcctgggacagaaactgctgggccacccactgacacccatcttggctatccccactgcttcccaaaccctgttctagtct

SEQ ID NO: 44933 - DNA, 601 bp, Human
gagatgtgaccttctggaaagagtttgtatccaagtgtttaactgaatactcatcaaacaaatgttccaaatcaaacattcagaagttgaaatggattgtttctgggcatactgcattgcaactaaagcatagttactgaagaaaaattcaccatccaacaattcctgaaatggttccctaattggtaaatttggttcattgttattctccatatacagaaaattttccaatgctataattttcttttgcaattaaaatattaattatcttcaaaataaacaaaatgaagttggaatcacraaggggaaaatgacttcactgatctttcagttaatatttgaaggcatttactacacagaaaatataacacctcaatagtaaggaattatccaacctctgatatgtaagttagccatttcatgatcttttcagctttgaaaacagcatctttcttaatagcatgaattttgaaagtagcactaaaattgtgtttttattacacatcttgctgtgtgtagacccatgctcaggctcattttaagttacacaagcctgagtaagacaatagggacaaaaagtttaaaccatatgtgaacaaat

SEQ ID NO: 44934 - DNA, 601 bp, Human
tttggctttaacacaaaggcattttctctgtgaatttactggacagattcctgtgttaaatgaaggtgcagcccaagcaccttggatgtgttgaactgagcttcttctattcggctgtaaaatcaatagaagaggaaagggatgtcccattggcaactgatgtgttccaaataggtgaatataggttcacggtttcagacttgatgagaatggaaaagattgcattggagaagttgtaatgtaaagtgaaagctactactgcctttcaatttctacaactccactattcactcattcaagrgaacttgccatttgaaaggagaagtggcctcaattttgactggaagcccaatttaaggcatgtcaagatcaaatgctctaaactttggagtctaaatcaaagccttctatgttgatattgtctataatcatattggagatccaaaaacagaagtgtatacagttaataaaatgagtagaatgtcttcagaaacattccaagataaatggtagagatgtgaccttctggaaagagtttgtatccaagtgtttaactgaatactcatcaaacaaatgttccaaatcaaacattcagaagttg

SEQ ID NO: 44935 - DNA, 601 bp, Human
actaatctaaaatcagcacatgttaaatattcaacaaatatgcattaggttttgacacaacacaaagcactatattggacatgtgggcaactgggggaagaatattccaggcagagctgtccaagcatacaatgtgagagacatagaaatgtcagatgtggttgctatgcttataaagcattaggcttactgaagaaacaatgtgtgcacacaaaactctgaaataacagtatgaaataatatgcaatcaaatatcaaaatgccttttcagcccttcagctccaagctgaccctgatgagrgcaatatgatcttggtggctctgcagagacatccacccaggaaggcttcccctccctgggcctctctgtttgctttgtttcctaggcctctgagattggatttcgtggggtgaggtgagtgcaggcccaagaagggtggttaccactgaggctcaatcactatcaagatgatagaggtactgaaacctgactgtcagaaactgctacaccagctgaatgccttgttggaactgaagtctagatgtcagttaaagatctgtggtttgagactaattgagtttgcacatgatagacaatagc

SEQ ID NO: 44936 - DNA, 601 bp, Human
catatagaaaattattatttcaatgtgtttgtaagaaagaacaaccgttcaatagtttaacccacctttgcttcaattgatatctgaaatgcatagatataaattacaacacattgaaccacttgaaacatgtttacccccagtctttttggatcaccttaagtggtggaataagtaggttggtgttttggatttctgaaacagttctgatgacaaacatattttcctactgactctattagtcttcatgtattctaatatatttcaattcaagctacatttctcaggctgtttggcgtayacataaaatgctccaaaattagaccacatgtcctaatttagggtttaaaaattcagtttgcttatggtgcctgaaatctgcctgttgcttcatccatgatatttgctgagtccttaatccatgcagagttttgccctgggcacagaaggaggaggtgaaagagaataattgaaatgcattttctaaggctgctttcaaagtgttcaatctttaggtataacaaaaatcatcaattatcggaaagatatttactaatctaaaatcagcacatgttaaatattcaacaaatatgcattaggt

SEQ ID NO: 44937 - DNA, 601 bp, Human
aatacatatagaaaattattatttcaatgtgtttgtaagaaagaacaaccgttcaatagtttaacccacctttgcttcaattgatatctgaaatgcatagatataaattacaacacattgaaccacttgaaacatgtttacccccagtctttttggatcaccttaagtggtggaataagtaggttggtgttttggatttctgaaacagttctgatgacaaacatattttcctactgactctattagtcttcatgtattctaatatatttcaattcaagctacatttctcaggctgtttggygtatacataaaatgctccaaaattagaccacatgtcctaatttagggtttaaaaattcagtttgcttatggtgcctgaaatctgcctgttgcttcatccatgatatttgctgagtccttaatccatgcagagttttgccctgggcacagaaggaggaggtgaaagagaataattgaaatgcattttctaaggctgctttcaaagtgttcaatctttaggtataacaaaaatcatcaattatcggaaagatatttactaatctaaaatcagcacatgttaaatattcaacaaatatgcatt

SEQ ID NO: 44938 - DNA, 601 bp, Human
aaatattggctactagatctacaaacaaatttgtataatgaatataaggaaagccatagcaatcatctataaaacatatccttgaaaaagattggaaaaggatataataatacatatagaaaattattatttcaatgtgtttgtaagaaagaacaaccgttcaatagtttaacccacctttgcttcaattgatatctgaaatgcatagatataaattacaacacattgaaccacttgaaacatgtttacccccagtctttttggatcaccttaagtggtggaataagtaggttggtgtttkggatttctgaaacagttctgatgacaaacatattttcctactgactctattagtcttcatgtattctaatatatttcaattcaagctacatttctcaggctgtttggcgtatacataaaatgctccaaaattagaccacatgtcctaatttagggtttaaaaattcagtttgcttatggtgcctgaaatctgcctgttgcttcatccatgatatttgctgagtccttaatccatgcagagttttgccctgggcacagaaggaggaggtgaaagagaataattgaaatgcattttctaagg

SEQ ID NO: 44939 - DNA, 601 bp, Human
attaaaatacaattttgaaaataatatttaacatattgctatatttatcctctattgcacaactctgaaatgataaatggttattgaagaatagctgagaaggctgagataactgttgtatgaataaaaatttggtgacatcaaatattggctactagatctacaaacaaatttgtataatgaatataaggaaagccatagcaatcatctataaaacatatccttgaaaaagattggaaaaggatataataatacatatagaaaattattatttcaatgtgtttgtaagaaagaacaaccrttcaatagtttaacccacctttgcttcaattgatatctgaaatgcatagatataaattacaacacattgaaccacttgaaacatgtttacccccagtctttttggatcaccttaagtggtggaataagtaggttggtgttttggatttctgaaacagttctgatgacaaacatattttcctactgactctattagtcttcatgtattctaatatatttcaattcaagctacatttctcaggctgtttggcgtatacataaaatgctccaaaattagaccacatgtcctaatttagggttt

SEQ ID NO: 44940 - DNA, 601 bp, Human
ttcaaataagaggtaacaaggattggctagggcagtaccagctagtatgaaactatggaaatcctggagcatttgttaatgcctgatttttttattcttttacaaagttaccaataattgtcccagtaaagcaattaaaatacaattttgaaaataatatttaacatattgctatatttatcctctattgcacaactctgaaatgataaatggttattgaagaatagctgagaaggctgagataactgttgtatgaataaaaatttggtgacatcaaatattggctactagatctacaaamaaatttgtataatgaatataaggaaagccatagcaatcatctataaaacatatccttgaaaaagattggaaaaggatataataatacatatagaaaattattatttcaatgtgtttgtaagaaagaacaaccgttcaatagtttaacccacctttgcttcaattgatatctgaaatgcatagatataaattacaacacattgaaccacttgaaacatgtttacccccagtctttttggatcaccttaagtggtggaataagtaggttggtgttttggatttctgaaacagttctgatgac

SEQ ID NO: 44941 - DNA, 601 bp, Human
agaagcaacctggtcaaaattttcttcataaagataaatagaacacggagtgcagaatgtactggaacagtgagagactaaatgcaggggattcattaggaagctgttgccattgttcaaataagaggtaacaaggattggctagggcagtaccagctagtatgaaactatggaaatcctggagcatttgttaatgcctgatttttttattcttttacaaagttaccaataattgtcccagtaaagcaattaaaatacaattttgaaaataatatttaacatattgctatatttatcctcyattgcacaactctgaaatgataaatggttattgaagaatagctgagaaggctgagataactgttgtatgaataaaaatttggtgacatcaaatattggctactagatctacaaacaaatttgtataatgaatataaggaaagccatagcaatcatctataaaacatatccttgaaaaagattggaaaaggatataataatacatatagaaaattattatttcaatgtgtttgtaagaaagaacaaccgttcaatagtttaacccacctttgcttcaattgatatctgaaatgcatagata

SEQ ID NO: 44942 - DNA, 601 bp, Human
ttaaaaaaaagaaagaaagaagggaggcagggaggaaggaaggaaggaaggatggatattgagctttgcacaagaggctaagatttgttccaaatttagtaataaataggtactattaaagcctttgaagacagaagcaacctggtcaaaattttcttcataaagataaatagaacacggagtgcagaatgtactggaacagtgagagactaaatgcaggggattcattaggaagctgttgccattgttcaaataagaggtaacaaggattggctagggcagtaccagctagtatgaaacwatggaaatcctggagcatttgttaatgcctgatttttttattcttttacaaagttaccaataattgtcccagtaaagcaattaaaatacaattttgaaaataatatttaacatattgctatatttatcctctattgcacaactctgaaatgataaatggttattgaagaatagctgagaaggctgagataactgttgtatgaataaaaatttggtgacatcaaatattggctactagatctacaaacaaatttgtataatgaatataaggaaagccatagcaatcatctataaaacatat

SEQ ID NO: 44943 - DNA, 601 bp, Human
gagaatggcgtgaactcgggaggtggagcttgcagtgagctgagattgcgcccctgcactccagcctgggtgacagagtgagactctgtctcaaaaaaataaaaaatttaaaaaatttaaaaaaaagaaagaaagaagggaggcagggaggaaggaaggaaggaaggatggatattgagctttgcacaagaggctaagatttgttccaaatttagtaataaataggtactattaaagcctttgaagacagaagcaacctggtcaaaattttcttcataaagataaatagaacacggagtgyagaatgtactggaacagtgagagactaaatgcaggggattcattaggaagctgttgccattgttcaaataagaggtaacaaggattggctagggcagtaccagctagtatgaaactatggaaatcctggagcatttgttaatgcctgatttttttattcttttacaaagttaccaataattgtcccagtaaagcaattaaaatacaattttgaaaataatatttaacatattgctatatttatcctctattgcacaactctgaaatgataaatggttattgaagaatagctgagaaggct

SEQ ID NO: 44944 - DNA, 601 bp, Human
attgaaattattgagtctgcagaacaacaacaaaaaatattaaagaaaattgaacagagccttaggaacaccattgagtgtccaacacatgcactgtgggagtctcagaaggagaagagagattatttgaagaaataatggctgaaaacttcccaaacttgaagaaagatatgaatataaagatccaagaagctcaacaaactccaagagaatgaattcaaagagactcacactaagacacactataatcaaattgtagaaagccaaagacaaaatgagaatcttgaaagcagcaagacaraagtgactcatacatacaagggatccccaataagattatcggcagatttctcatcaataactttggagaccacaaagcattgagctgatatatttaaagtactgaaagaaaaaaaaaatctgacaaccaagaattctatatccatcagaactgcccttcaaaagggagggagaaatgaagacattctcagatttgagaagaaaggaaagagagaagggaggggaggggagaggaggggaggggaggagaggagaggagagggcacagtggctcacgcctgtaatcctagcactttgcaag

SEQ ID NO: 44945 - DNA, 601 bp, Human
gcatgtagaaaaaagaaacagtgaactggaagacaggaccattgaaattattgagtctgcagaacaacaacaaaaaatattaaagaaaattgaacagagccttaggaacaccattgagtgtccaacacatgcactgtgggagtctcagaaggagaagagagattatttgaagaaataatggctgaaaacttcccaaacttgaagaaagatatgaatataaagatccaagaagctcaacaaactccaagagaatgaattcaaagagactcacactaagacacactataatcaaattgtagaragccaaagacaaaatgagaatcttgaaagcagcaagacagaagtgactcatacatacaagggatccccaataagattatcggcagatttctcatcaataactttggagaccacaaagcattgagctgatatatttaaagtactgaaagaaaaaaaaaatctgacaaccaagaattctatatccatcagaactgcccttcaaaagggagggagaaatgaagacattctcagatttgagaagaaaggaaagagagaagggaggggaggggagaggaggggaggggaggagaggagaggagag

SEQ ID NO: 44946 - DNA, 601 bp, Human
ctgaaatgaatattttataggaggattcgaagaccaattcaggcatgtagaaaaaagaaacagtgaactggaagacaggaccattgaaattattgagtctgcagaacaacaacaaaaaatattaaagaaaattgaacagagccttaggaacaccattgagtgtccaacacatgcactgtgggagtctcagaaggagaagagagattatttgaagaaataatggctgaaaacttcccaaacttgaagaaagatatgaatataaagatccaagaagctcaacaaactccaagagaatgaattyaaagagactcacactaagacacactataatcaaattgtagaaagccaaagacaaaatgagaatcttgaaagcagcaagacagaagtgactcatacatacaagggatccccaataagattatcggcagatttctcatcaataactttggagaccacaaagcattgagctgatatatttaaagtactgaaagaaaaaaaaaatctgacaaccaagaattctatatccatcagaactgcccttcaaaagggagggagaaatgaagacattctcagatttgagaagaaaggaaagagagaaggg

SEQ ID NO: 44947 - DNA, 601 bp, Human
atggttttacagaagcttaagaaaataaaggaagatgtggagaaaatcaaaaaacaaaacaaagtagaaatatcaataaaaagatagaaaacctaaaaagaatctggagctgaaaattacaataactgaaatgaatattttataggaggattcgaagaccaattcaggcatgtagaaaaaagaaacagtgaactggaagacaggaccattgaaattattgagtctgcagaacaacaacaaaaaatattaaagaaaattgaacagagccttaggaacaccattgagtgtccaacacatgcaytgtgggagtctcagaaggagaagagagattatttgaagaaataatggctgaaaacttcccaaacttgaagaaagatatgaatataaagatccaagaagctcaacaaactccaagagaatgaattcaaagagactcacactaagacacactataatcaaattgtagaaagccaaagacaaaatgagaatcttgaaagcagcaagacagaagtgactcatacatacaagggatccccaataagattatcggcagatttctcatcaataactttggagaccacaaagcattgagctgatatat

SEQ ID NO: 44948 - DNA, 601 bp, Human
agaatctgattcccagagtaaccatgtgataagattcaaatgtctagttatcaaccaaaaaaatcacaaatcatacaaagaaacaggaaagtatgactcactcaaaagaaaggaaaaataaaccaacgaaaatcatccctgaaaaggaccacatgacagacctactaaacacagactttaaaacaatggttttacagaagcttaagaaaataaaggaagatgtggagaaaatcaaaaaacaaaacaaagtagaaatatcaataaaaagatagaaaacctaaaaagaatctggagctgaaaattacaataactgaaatgaatattttataggaggattcgaagaccaattcaggcatgtagaaaaaagaaacagtgaactggaagacaggaccattgaaattattgagtctgcagaacaacaacaaaaaatattaaagaaaattgaacagagccttaggaacaccattgagtgtccaacacatgcactgtgggagtctcagaaggagaagagagattatttgaagaaataatggctgaaaacttcccaaacttgaagaaagatatgaatataaagatccaagaagctcaacaaactccaaga

SEQ ID NO: 44949 - DNA, 601 bp, Human
ggaataagcaattaaatatacagggaaatttagaaagtcgccatacatgcccagggaaaggtacagactcataaaaggtctaagaagaccttaaatttacatctcaagctgatcctcaacacaaacatcctacaacaacaaaacaaacaaacaaacaaacatagcaaacccagagaatctgattcccagagtaaccatgtgataagattcaaatgtctagttatcaaccaaaaaaatcacaaatcatacaaagaaacaggaaagtatgactcactcaaaagaaaggaaaaataaaccaackaaaatcatccctgaaaaggaccacatgacagacctactaaacacagactttaaaacaatggttttacagaagcttaagaaaataaaggaagatgtggagaaaatcaaaaaacaaaacaaagtagaaatatcaataaaaagatagaaaacctaaaaagaatctggagctgaaaattacaataactgaaatgaatattttataggaggattcgaagaccaattcaggcatgtagaaaaaagaaacagtgaactggaagacaggaccattgaaattattgagtctgcagaacaacaacaaaaa

SEQ ID NO: 44950 - DNA, 601 bp, Human
ctctttctggctgaagtggcttccaggagatttaaagaaccagtgtcttatttatttatttattttctctttttctcctttggatagtgagacatttaaggaataagcaattaaatatacagggaaatttagaaagtcgccatacatgcccagggaaaggtacagactcataaaaggtctaagaagaccttaaatttacatctcaagctgatcctcaacacaaacatcctacaacaacaaaacaaacaaacaaacaaacatagcaaacccagagaatctgattcccagagtaaccatgtgrtaagattcaaatgtctagttatcaaccaaaaaaatcacaaatcatacaaagaaacaggaaagtatgactcactcaaaagaaaggaaaaataaaccaacgaaaatcatccctgaaaaggaccacatgacagacctactaaacacagactttaaaacaatggttttacagaagcttaagaaaataaaggaagatgtggagaaaatcaaaaaacaaaacaaagtagaaatatcaataaaaagatagaaaacctaaaaagaatctggagctgaaaattacaataactgaaatgaatattttata

SEQ ID NO: 44951 - DNA, 601 bp, Human
tgatcatggaggtacaaatgcaaaggcaagcagctattgttgtgtatacatacagacacaccatttttgcaggccctctttctggctgaagtggcttccaggagatttaaagaaccagtgtcttatttatttatttattttctctttttctcctttggatagtgagacatttaaggaataagcaattaaatatacagggaaatttagaaagtcgccatacatgcccagggaaaggtacagactcataaaaggtctaagaagaccttaaatttacatctcaagctgatcctcaacacaaacrtcctacaacaacaaaacaaacaaacaaacaaacatagcaaacccagagaatctgattcccagagtaaccatgtgataagattcaaatgtctagttatcaaccaaaaaaatcacaaatcatacaaagaaacaggaaagtatgactcactcaaaagaaaggaaaaataaaccaacgaaaatcatccctgaaaaggaccacatgacagacctactaaacacagactttaaaacaatggttttacagaagcttaagaaaataaaggaagatgtggagaaaatcaaaaaacaaaacaaagtagaa

SEQ ID NO: 44952 - DNA, 601 bp, Human
taacaattgcactgttggaatctgtctaatattactattttggagctctagtgcttgcaacttccagaagaatgcttggaaggtaacttacagttaatttcagtccattttagctcttagctcaatagtggttaccaattcctcatcccctgtccctgtgacaggctgccatgtctgtgttcctaaagcagcttgcaggcagcttatgggagcagggtggacaataatgaccttgtctttcaaatatacgagatctgcattctgatcactaattgttgcttctgatcatggaggtacaaaygcaaaggcaagcagctattgttgtgtatacatacagacacaccatttttgcaggccctctttctggctgaagtggcttccaggagatttaaagaaccagtgtcttatttatttatttattttctctttttctcctttggatagtgagacatttaaggaataagcaattaaatatacagggaaatttagaaagtcgccatacatgcccagggaaaggtacagactcataaaaggtctaagaagaccttaaatttacatctcaagctgatcctcaacacaaacatcctacaacaacaaaaca

SEQ ID NO: 44953 - DNA, 601 bp, Human
atcccaacattttgggaggccgaggtgggtggatcagctgaggtcaggagttcgagaccagccagaccaacatgaagaaaccccgtctctactaaaaatacaaaattagctgggcctggtggcgtgcgcctataatcccagctactcaagaggctgaggtgggagaattgcttgatcttgggaggcagaggttgtggtgagctgagatcatgccattgcactccatcctaggcaacaagagtgagactccatctcaaaaaaaaatttttttgaatgagttaacaaaaatttagaggtagarggatgctgggaagatagcagagcagggaatttttctccccacctagataacaattgcactgttggaatctgtctaatattactattttggagctctagtgcttgcaacttccagaagaatgcttggaaggtaacttacagttaatttcagtccattttagctcttagctcaatagtggttaccaattcctcatcccctgtccctgtgacaggctgccatgtctgtgttcctaaagcagcttgcaggcagcttatgggagcagggtggacaataatgaccttgtctttcaaatatacgaga

SEQ ID NO: 44954 - DNA, 601 bp, Human
aattttggggggccaggtgtggtagctcatgcctgtaatcccaacattttgggaggccgaggtgggtggatcagctgaggtcaggagttcgagaccagccagaccaacatgaagaaaccccgtctctactaaaaatacaaaattagctgggcctggtggcgtgcgcctataatcccagctactcaagaggctgaggtgggagaattgcttgatcttgggaggcagaggttgtggtgagctgagatcatgccattgcactccatcctaggcaacaagagtgagactccatctcaaaaaaaawtttttttgaatgagttaacaaaaatttagaggtagagggatgctgggaagatagcagagcagggaatttttctccccacctagataacaattgcactgttggaatctgtctaatattactattttggagctctagtgcttgcaacttccagaagaatgcttggaaggtaacttacagttaatttcagtccattttagctcttagctcaatagtggttaccaattcctcatcccctgtccctgtgacaggctgccatgtctgtgttcctaaagcagcttgcaggcagcttatgggagcagg

SEQ ID NO: 44955 - DNA, 601 bp, Human
aatagccaggcatagtggtgtgtgcctgtagtctcagatatttgggagactgaggtgggatgattgcttgaacttgggattttgaggctacagtgagttccactgcattccaacctgggcaacagagcaaaaccctgtctcaaaaaacaaattttggggggccaggtgtggtagctcatgcctgtaatcccaacattttgggaggccgaggtgggtggatcagctgaggtcaggagttcgagaccagccagaccaacatgaagaaaccccgtctctactaaaaatacaaaattagctgggyctggtggcgtgcgcctataatcccagctactcaagaggctgaggtgggagaattgcttgatcttgggaggcagaggttgtggtgagctgagatcatgccattgcactccatcctaggcaacaagagtgagactccatctcaaaaaaaaatttttttgaatgagttaacaaaaatttagaggtagagggatgctgggaagatagcagagcagggaatttttctccccacctagataacaattgcactgttggaatctgtctaatattactattttggagctctagtgcttgcaacttccag

SEQ ID NO: 44956 - DNA, 601 bp, Human
tgtctctctacaaaaaatgaaaaaaaaaaaaaatagccaggcatagtggtgtgtgcctgtagtctcagatatttgggagactgaggtgggatgattgcttgaacttgggattttgaggctacagtgagttccactgcattccaacctgggcaacagagcaaaaccctgtctcaaaaaacaaattttggggggccaggtgtggtagctcatgcctgtaatcccaacattttgggaggccgaggtgggtggatcagctgaggtcaggagttcgagaccagccagaccaacatgaagaaacccygtctctactaaaaatacaaaattagctgggcctggtggcgtgcgcctataatcccagctactcaagaggctgaggtgggagaattgcttgatcttgggaggcagaggttgtggtgagctgagatcatgccattgcactccatcctaggcaacaagagtgagactccatctcaaaaaaaaatttttttgaatgagttaacaaaaatttagaggtagagggatgctgggaagatagcagagcagggaatttttctccccacctagataacaattgcactgttggaatctgtctaatattact

SEQ ID NO: 44957 - DNA, 601 bp, Human
aaaaatatcttggggtgggtgtggttgctcatgcctgtaattccagcactttgggagtccaaggaggaaggattgcttgagcccaggagtttgagaccagcctgggcaacaaagcaagactgtctctctacaaaaaatgaaaaaaaaaaaaaatagccaggcatagtggtgtgtgcctgtagtctcagatatttgggagactgaggtgggatgattgcttgaacttgggattttgaggctacagtgagttccactgcattccaacctgggcaacagagcaaaaccctgtctcaaaaaacarattttggggggccaggtgtggtagctcatgcctgtaatcccaacattttgggaggccgaggtgggtggatcagctgaggtcaggagttcgagaccagccagaccaacatgaagaaaccccgtctctactaaaaatacaaaattagctgggcctggtggcgtgcgcctataatcccagctactcaagaggctgaggtgggagaattgcttgatcttgggaggcagaggttgtggtgagctgagatcatgccattgcactccatcctaggcaacaagagtgagactccatctcaaaaaaaaa

SEQ ID NO: 44958 - DNA, 601 bp, Human
cttacatatcccgtttactaaaattttgtctaacagaagagaggcattaaaaaatatcttggggtgggtgtggttgctcatgcctgtaattccagcactttgggagtccaaggaggaaggattgcttgagcccaggagtttgagaccagcctgggcaacaaagcaagactgtctctctacaaaaaatgaaaaaaaaaaaaaatagccaggcatagtggtgtgtgcctgtagtctcagatatttgggagactgaggtgggatgattgcttgaacttgggattttgaggctacagtgagttcyactgcattccaacctgggcaacagagcaaaaccctgtctcaaaaaacaaattttggggggccaggtgtggtagctcatgcctgtaatcccaacattttgggaggccgaggtgggtggatcagctgaggtcaggagttcgagaccagccagaccaacatgaagaaaccccgtctctactaaaaatacaaaattagctgggcctggtggcgtgcgcctataatcccagctactcaagaggctgaggtgggagaattgcttgatcttgggaggcagaggttgtggtgagctgagatcatgcca

SEQ ID NO: 44959 - DNA, 601 bp, Human
acaaaatcctgaatgatagttgcctaaacctattatttgatatatgcaaaagtaaattctaaataacaataattagaagagaagtattaagacaagaaaggagttcagaggaagcccatgcttgagtaaaattggttgtaggaacctactgtaggataagattccagaccacgtattttttcttcatagcatttatcgtaatctatagtcatattttcacttacgtgtttgtcttataatgtctgcagcatcctgtggatatcatagatcaatgacttacatatcccgtttactaaaattwtgtctaacagaagagaggcattaaaaaatatcttggggtgggtgtggttgctcatgcctgtaattccagcactttgggagtccaaggaggaaggattgcttgagcccaggagtttgagaccagcctgggcaacaaagcaagactgtctctctacaaaaaatgaaaaaaaaaaaaaatagccaggcatagtggtgtgtgcctgtagtctcagatatttgggagactgaggtgggatgattgcttgaacttgggattttgaggctacagtgagttccactgcattccaacctgggcaacaga

SEQ ID NO: 44960 - DNA, 601 bp, Human; identical to SEQ ID NO: 30850

SEQ ID NO: 44961 - DNA, 601 bp, Human; identical to SEQ ID NO: 30851

SEQ ID NO: 44962 - DNA, 601 bp, Human; identical to SEQ ID NO: 30852

SEQ ID NO: 44963 - DNA, 601 bp, Human; identical to SEQ ID NO: 30853

SEQ ID NO: 44964 - DNA, 601 bp, Human; identical to SEQ ID NO: 30854

SEQ ID NO: 44965 - DNA, 601 bp, Human; identical to SEQ ID NO: 30855

SEQ ID NO: 44966 - DNA, 601 bp, Human; identical to SEQ ID NO: 30856

SEQ ID NO: 44967 - DNA, 601 bp, Human; identical to SEQ ID NO: 30857

SEQ ID NO: 44968 - DNA, 601 bp, Human; identical to SEQ ID NO: 30858

SEQ ID NO: 44969 - DNA, 601 bp, Human; identical to SEQ ID NO: 30859

SEQ ID NO: 44970 - DNA, 601 bp, Human; identical to SEQ ID NO: 30860

SEQ ID NO: 44971 - DNA, 601 bp, Human; identical to SEQ ID NO: 30861

SEQ ID NO: 44972 - DNA, 601 bp, Human; identical to SEQ ID NO: 30862

SEQ ID NO: 44973 - DNA, 601 bp, Human
agcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgc

SEQ ID NO: 44974 - DNA, 601 bp, Human
gggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagta

SEQ ID NO: 44975 - DNA, 601 bp, Human
gtggtcctttccctcaggagagaggactcagaataaacctgctgctgcttcgtaaacatctcctgataaaaatggctacaggtgttacctgggcagagcagctgggcgccgccttggaatcagctgggggagcacctctccttgggacgggatgacagggcttcccaggcggtccccacaagcccgcgccccagctcagccccagttctcccctcccacctcaactcctccttgggataaataaagatgagtgtgtgtgtgagtgcgcgcccggatggagaacagcaggcactggctttakcggggagctggccccactgctccagcctctcagtccagccccaagacggaggagggggtttccctcccagagggagtggagatggaggaaggtgggtttctgccgatgctctgcttgccggggagctctcctgctgtgggctggaaggcttggagacctgggaatcggtggacaagtggctccacgatacccccacccccaatttgttggtgtgtgtgtgtgtatgtgcgtaatgtttgtacgtatgcatgcgcctgcttgttgcttgggtttttctatttatttgtcatttggggcagg

SEQ ID NO: 44976 - DNA, 601 bp, Human
ccttgggataaataaagatgagtgtgtgtgtgagtgcgcgcccggatggagaacagcaggcactggctttagcggggagctggccccactgctccagcctctcagtccagccccaagacggaggagggggtttccctcccagagggagtggagatggaggaaggtgggtttctgccgatgctctgcttgccggggagctctcctgctgtgggctggaaggcttggagacctgggaatcggtggacaagtggctccacgatacccccacccccaatttgttggtgtgtgtgtgtgtatgtgygtaatgtttgtacgtatgcatgcgcctgcttgttgcttgggtttttctatttatttgtcatttggggcagggggtggcttggtgggggggtggctgggcgggctggccatcgggtagctgggaggggttcagctgttggaggtttcaaatagagcttgtttcaggcagggcacagctgctgcgagactgtcacattccttattgaaatccagccgcaaaaacctaggaggtgctgatcggatttcccccattcccagcatctcactttaatcggtgatgggcagactttcccgccctgga

SEQ ID NO: 44977 - DNA, 601 bp, Human
tgtcacattccttattgaaatccagccgcaaaaacctaggaggtgctgatcggatttcccccattcccagcatctcactttaatcggtgatgggcagactttcccgccctggaaacgggtggggcagacctgtcagacgacctgaatagccaggaccaagacttccaggcagagggtcctccagcaacccggctgctctctcagtgggctgccccagcggagggcagcacctggaagccgccttagtcaaaatagctcaaggatgagcgtctcagcgagcagaagcgagtggggtttcccytggaagcgcagctcacttagtcattccctgtaatgagcctctgcgtctgcgggtccttctgctcgctgccttctcagaaccgcctctcctgctgggcgctccaggatatggggctggcagcctcgctaggactggcagctgccctggtcacagccctggctctctccagtcctcccttggagaccaggggccctcactggggaaaactgatgaaggcccaaatgcaaggggggtgtggggaaggggcaatcccagcaccttctctttcagtgacacccgtagtcagagttcttaaggaaa

SEQ ID NO: 44978 - DNA, 601 bp, Human
tcaaaggcccttgggaggtgacaaactttttttttccccaggtgattgaagattaactaaccttgtgcctgagctgctgctttctgaagttctctgcttttttttccgtggggttgtggccttgctgttcacctatgtttggcgggtggctgctgctggggaagtaacttgtcatgcaggcctgggtcttttgaaaaggagggtggcatgtgccctgagcatgttcagttaatgcaaatgggagccaatgtgagggggttgagcaaccgggacagaacatccccagctcctgcctcacagrcctgtaggtgctgatgatggaagtaagctctgctaggaggcatcagcctggagcagggaggtggggcttgattcctgggtgagctcagataagaggagagcttctcattattatgcctgggacatgagatcaaacggcagagatgcctgagatggccccagtgggctcctaaaggtaccaggtgacccttgaaccaaatgaggagtcctttttttttttttaataggcaggtttactctctgaagtcttagacattgtgacgaggcctggtctagagattctgttgagaatcttaatcac

SEQ ID NO: 44979 - DNA, 601 bp, Human
ggggtggccagggcaagtgtgggcaccccaggttggcctgggatcagggtgagattgtggactggcccaaggtcagttcttgatgcctcctctctggggtctggtgctgctgccctcagggtgataccgggcaggttgtgaggagggtaggtgtggagaatacagggaaaatgaaagcccttcctgcaaaagctccttccacagcccctagcacccccaccttccacccctggagggccagcaggacccctagacctgactggacatgtccatacataactctctcacccctcacctccaycttgctcttctcttaggctgcctttctcctccagcactggctgtgtggctgtttatcgggggacagtcacatgagctcagcatcttacatcttacaaggcattttcacccctgggtccctcatgaccctcacggtggctggcccagggctcatgatgaccaactatctcagggatgagaaaactcggctgcacaggggttcccagggttgagtgactcactccaggtgcccatctcaggaaagagagggttctagaatgagagctcaggtctcagtacacttctgatttccctattccaa

SEQ ID NO: 44980 - DNA, 601 bp, Human
agtcacatgagctcagcatcttacatcttacaaggcattttcacccctgggtccctcatgaccctcacggtggctggcccagggctcatgatgaccaactatctcagggatgagaaaactcggctgcacaggggttcccagggttgagtgactcactccaggtgcccatctcaggaaagagagggttctagaatgagagctcaggtctcagtacacttctgatttccctattccaaaccccaccacaaacttctgctggggatttgagtgagggacctcgaagggcttctccattcctggktctagaagtttctttttcattcttgagtcccattttcctgcgtccctgtctgtgcctcatgcctctgttgagctctgtcatgggcagtgagtgccgagaaaaggcccgtctctgctttgagcccctcaggaggtgcttctgcctcttgcttccagcttgttgtgtgatctttgtcgagtcccttcccctctctgggcctcgtttctctggcctaaaaacaggagctgaactcccttcctgtgccgaggcttcgcaatctgattccagatcatgtttcatcacgaggatgagcagccacag

SEQ ID NO: 44981 - DNA, 601 bp, Human
ctctgttgagctctgtcatgggcagtgagtgccgagaaaaggcccgtctctgctttgagcccctcaggaggtgcttctgcctcttgcttccagcttgttgtgtgatctttgtcgagtcccttcccctctctgggcctcgtttctctggcctaaaaacaggagctgaactcccttcctgtgccgaggcttcgcaatctgattccagatcatgtttcatcacgaggatgagcagccacagtccggagagtcctgttcttaggggtgtcagacagcacccagatggcatccatcccaggcggayggtggtttatggtgttggtgcttgggaggactgaggaaggagacagtgactcagactggggatgctgggtggattccctgtaggaggttggggggtccctgaaggactagacaagccatgatgggaggggctcgggcaggggctcaattctgagtgtgagaagcccggggagagggggcagagtgtgtagggaatagagcaggcctgagggcagcttcaggttgctgccgtgtggtgcacacaggggcatgtagggaggaaagaggagactgtctcgtctggagaggctttgggcaggca

SEQ ID NO: 44982 - DNA, 601 bp, Human
agcttgttgtgtgatctttgtcgagtcccttcccctctctgggcctcgtttctctggcctaaaaacaggagctgaactcccttcctgtgccgaggcttcgcaatctgattccagatcatgtttcatcacgaggatgagcagccacagtccggagagtcctgttcttaggggtgtcagacagcacccagatggcatccatcccaggcggatggtggtttatggtgttggtgcttgggaggactgaggaaggagacagtgactcagactggggatgctgggtggattccctgtaggaggttgrggggtccctgaaggactagacaagccatgatgggaggggctcgggcaggggctcaattctgagtgtgagaagcccggggagagggggcagagtgtgtagggaatagagcaggcctgagggcagcttcaggttgctgccgtgtggtgcacacaggggcatgtagggaggaaagaggagactgtctcgtctggagaggctttgggcaggcagtgaacacaggcccagggcgagggcacagtgatggatggaatatttggtagcatcagtaaccaccagggctgcagagttctgcacactcag

SEQ ID NO: 44983 - DNA, 601 bp, Human
actcagttagcaatttgtggtctgggcagagctaaccgggtgtggacatgcaaatcggacaggtggagagagaacaaaaataaacccgtggggccaggccagaggctgagaggcctggaggaaggtcagggggacacacgatgaccaggcagaaaaaggctgagagagtagggccacagggagagccgaactaggaagctgacctgggacagaagcagggaagaaaagcattgccacagcttgcctgatgcgtcgtcaagagaacacaatttccccttcaagacttgagtcagggtgcttyctagaattctaaagattctttctgccccttcaccctgcttggagcaccagggctgtggcagtgggtgacgttcccagccaggtgccagggggcaggcagcaagagcagctgggcaggggagggacgtgcccagggcttgccctttgtggaagccatatctgtttcacaagccctgggcacagggtaaccagagttgtattctgagcagagccttgatgatactaaatgaacagcatgcaaatgatgtgtgaaataatatgcaaattggcatctgttatttttgagtcagcttgttgggca

SEQ ID NO: 44984 - DNA, 601 bp, Human
ggcagtgggtgacgttcccagccaggtgccagggggcaggcagcaagagcagctgggcaggggagggacgtgcccagggcttgccctttgtggaagccatatctgtttcacaagccctgggcacagggtaaccagagttgtattctgagcagagccttgatgatactaaatgaacagcatgcaaatgatgtgtgaaataatatgcaaattggcatctgttatttttgagtcagcttgttgggcatttttcttaaaggacaggagtgctgctcagtgtcaaatgaacaggaaagtcagcttraaggacactccttgcagggactgagctggcacctactccttagagcttgctgataccaggcctgccacgcgacatctgcaaggacagttgtttggtgttttgcttcaggttatagatggagagacctataaaggtgggtgccctgcccaggttacccagtaggtagggaggaggaagcagatgacctgttgcctggcttgagccattgaaccttgctgacctgtcagtggctttgagctgagggggccctgcagggaggcagggagaggctgcccttgctcattctggtccatctgccac

SEQ ID NO: 44985 - DNA, 601 bp, Human
ttcccagccaggtgccagggggcaggcagcaagagcagctgggcaggggagggacgtgcccagggcttgccctttgtggaagccatatctgtttcacaagccctgggcacagggtaaccagagttgtattctgagcagagccttgatgatactaaatgaacagcatgcaaatgatgtgtgaaataatatgcaaattggcatctgttatttttgagtcagcttgttgggcatttttcttaaaggacaggagtgctgctcagtgtcaaatgaacaggaaagtcagcttaaaggacactccttrcagggactgagctggcacctactccttagagcttgctgataccaggcctgccacgcgacatctgcaaggacagttgtttggtgttttgcttcaggttatagatggagagacctataaaggtgggtgccctgcccaggttacccagtaggtagggaggaggaagcagatgacctgttgcctggcttgagccattgaaccttgctgacctgtcagtggctttgagctgagggggccctgcagggaggcagggagaggctgcccttgctcattctggtccatctgccaccgttggttttcctt

SEQ ID NO: 44986 - DNA, 601 bp, Human
cggagctgcctgcatgggtgatgttaccttctcccaaggtgagggcttggggtaggcatgttgctcagggttgagccaccgcctttggagggctcagagctggatggcattggtggaggatgcaggggaggcctcctcaggggggcaccatacctgccctagatggccaagctctgtaggccagccaggtgtgctagcctgggtgggcaagatccctgcatatgcctcccagccctgtgaggaaggcagggaaaggaccatcctcctccttataggaccccaaggcccatagaagttatgyggtggctcacacctgtaatccagcactttgggaggctgaggcgggaggatcggttgagtccaggacctcaagaccagcctgggcaacatagtgacaccttgtctcaaaaaaaaaaaaaaaaaagttacatgacttgtccgaggctactcagcattgttagtggcaggggcatagctggaatcctggaattcctggttttagttcttcctctctttttgtttctcccatccctcttctggaaacatatcctgaacacccactgtgtggcaagccctgctccaggcggcaggagtgcagaga

SEQ ID NO: 44987 - DNA, 601 bp, Human
aggggaggcctcctcaggggggcaccatacctgccctagatggccaagctctgtaggccagccaggtgtgctagcctgggtgggcaagatccctgcatatgcctcccagccctgtgaggaaggcagggaaaggaccatcctcctccttataggaccccaaggcccatagaagttatgcggtggctcacacctgtaatccagcactttgggaggctgaggcgggaggatcggttgagtccaggacctcaagaccagcctgggcaacatagtgacaccttgtctcaaaaaaaaaaaaaaaaaagttacatgacttgtccgaggctactcagcattgttagtggcaggggcatagctggaatcctggaattcctggttttagttcttcctctctttttgtttctcccatccctcttctggaaacatatcctgaacacccactgtgtggcaagccctgctccaggcggcaggagtgcagagaatctgtgccttacagactccaggggggtctctccccagccagatgtgttgttctccaccaactcttcctaagagagcacaggctttccccatagacctggattcaaatcctggctatttggct

SEQ ID NO: 44988 - DNA, 601 bp, Human
ctagcctgggtgggcaagatccctgcatatgcctcccagccctgtgaggaaggcagggaaaggaccatcctcctccttataggaccccaaggcccatagaagttatgcggtggctcacacctgtaatccagcactttgggaggctgaggcgggaggatcggttgagtccaggacctcaagaccagcctgggcaacatagtgacaccttgtctcaaaaaaaaaaaaaaaaaagttacatgacttgtccgaggctactcagcattgttagtggcaggggcatagctggaatcctggaattccyggttttagttcttcctctctttttgtttctcccatccctcttctggaaacatatcctgaacacccactgtgtggcaagccctgctccaggcggcaggagtgcagagaatctgtgccttacagactccaggggggtctctccccagccagatgtgttgttctccaccaactcttcctaagagagcacaggctttccccatagacctggattcaaatcctggctatttggctgtgtggccttgcgcagcggcccctttatttgggaggtggtattttaattcctcttgtgggtggagaggtg

SEQ ID NO: 44989 - DNA, 601 bp, Human
tggagctcacaggctggtgggggaggcaggcactgaacaagtaacaacaggtctgatgtgagctttgcgagagacaagggcacacacatgtggcttgggtttgacccacaagcctgagacttggtgtcccacgcctccgtctgctccccttccccccatttcctgaaggtccatctcaccctcacttcttccatcctccctcatatctgtctcccaggccatcctctgattcttctatatgggctatctagcctggtgttaggagaacaggctttagtgccaagcagatattgggtacagygctggctgtgtcacttactgtaggctgtgtggctttgggaagctgtctcagtgctttgattcacagtttccatgggggtgaatcctaacctggccgctggggctgtcatgagagttaatgagatattgctgtttgtaaggcagaggacatggtttctggcacacatggagcgctctgtgaaggccagctgagttgcaggtgaggagaagcatcctaggctaggtgtggggcagcttagtttctggtcctctgttttgtcatctagagagtgagagaaggagcctgaggaggggatgtttc

SEQ ID NO: 44990 - DNA, 601 bp, Human
cctgaggaggggatgtttcctgcactggccatctgcgggaaggtcgtgagcaccagatggaatttcggagagaactggaagaaagctacgctattccagctggcgggggtcctcatcgatggtgcatgttggcagggtgggctgcggggggcgttatcttcctatcccacaagcgaaagcctgtgaagacatcgtggctaaggggattttctcactctcaggagacagctgagagacaggcccttctggccagcctccctccctgctgcctcctccctgcaggccagcccttggcacgagkcctgcttgtctcctgaaccctcctagcagcagggatttaattactataatgtaagtagctgtggcttgaggccttctggtggaggggaaacagatttgtcttctcactgggagaataaaagtctatggaaaggaaaagaaatgtacttttccccgaggtacctgaggctgttgggctcaggggagcttccctcagggcggggagagggagcatgggtggcagcgggaggaggcaccacgtctgactcaaggacccttggcgcttgcttttgctctctgtgggatcactcagctaagctgc

SEQ ID NO: 44991 - DNA, 601 bp, Human
ccctgcaggccagcccttggcacgagtcctgcttgtctcctgaaccctcctagcagcagggatttaattactataatgtaagtagctgtggcttgaggccttctggtggaggggaaacagatttgtcttctcactgggagaataaaagtctatggaaaggaaaagaaatgtacttttccccgaggtacctgaggctgttgggctcaggggagcttccctcagggcggggagagggagcatgggtggcagcgggaggaggcaccacgtctgactcaaggacccttggcgcttgcttttgctytctgtgggatcactcagctaagctgcctcagtttccccaatgaccctgctaacagatcagcctgacattcagtaggcatctgtcaagcacctaccatatgctagacacttagaaacttccagctgagtagccagcccaggcggaaaaataatttcattcatttgacaaagttattgaatgcctgttatgtgccagtgtattgttctaggcatcacagatatacagtcatgcgttgcaacgacggggacgcagtctaagaaatgtgtcattaggcaatttcatcattgtgtgagcatcatg

SEQ ID NO: 44992 - DNA, 601 bp, Human
cgggaggaggcaccacgtctgactcaaggacccttggcgcttgcttttgctctctgtgggatcactcagctaagctgcctcagtttccccaatgaccctgctaacagatcagcctgacattcagtaggcatctgtcaagcacctaccatatgctagacacttagaaacttccagctgagtagccagcccaggcggaaaaataatttcattcatttgacaaagttattgaatgcctgttatgtgccagtgtattgttctaggcatcacagatatacagtcatgcgttgcaacgacggggacrcagtctaagaaatgtgtcattaggcaatttcatcattgtgtgagcatcatgcagtgcacttacacagactaggtggcatggccttctgcacacgaggctgtatggtgtagcctactgctcccaggcctgtattgaatactgtaggcaatcataacacaatggcaagtatgtatctaaacatagaaaaggtacagtagaaatactgtacaatggatacaaaatactacacctgtatagggcacttaccatgaatggagcttgcaggactggaggttgctgtgggtgagtcagtgagtgagt

SEQ ID NO: 44993 - DNA, 601 bp, Human
ctagtgtaggctttgtaaacactgttcacttaggctaactacatttatttaaaatatttttttcttcaataacaagttaaccttaccttactataattttatttatttatttatttatttatttattttgagacagagtctcactctgtagcccaggctggagtgcagtggcacgatctcggctcactgcaacttcaacctcccaggttcaaagaattctcctgcctcagcctcctgagtacctgggattataggcacgtgccatcacacccggctaatttttgtatttttagtagagacraagtttctccatgtaggctaggctagtctcaaactcctgacctcaagtgatccacccgccttggcctctcaaagtgctgggatgacaggcatgagccactgcgcttggccaaatttttcactttataagctttttatactcttttgtaataacacaaacacattatacaattgcacgaaagtattttctttatattcttactctataagtttttttccattttagaaatatttatttaaaaagatgcatttttacttacaaaatcttttttggttaaaaactgagacacaaacacacgtt

SEQ ID NO: 44994 - DNA, 601 bp, Human
agtgtaggctttgtaaacactgttcacttaggctaactacatttatttaaaatatttttttcttcaataacaagttaaccttaccttactataattttatttatttatttatttatttatttattttgagacagagtctcactctgtagcccaggctggagtgcagtggcacgatctcggctcactgcaacttcaacctcccaggttcaaagaattctcctgcctcagcctcctgagtacctgggattataggcacgtgccatcacacccggctaatttttgtatttttagtagagacaargtttctccatgtaggctaggctagtctcaaactcctgacctcaagtgatccacccgccttggcctctcaaagtgctgggatgacaggcatgagccactgcgcttggccaaatttttcactttataagctttttatactcttttgtaataacacaaacacattatacaattgcacgaaagtattttctttatattcttactctataagtttttttccattttagaaatatttatttaaaaagatgcatttttacttacaaaatcttttttggttaaaaactgagacacaaacacacgttag

SEQ ID NO: 44995 - DNA, 601 bp, Human
gctggagtgcagtggcacgatctcggctcactgcaacttcaacctcccaggttcaaagaattctcctgcctcagcctcctgagtacctgggattataggcacgtgccatcacacccggctaatttttgtatttttagtagagacaaagtttctccatgtaggctaggctagtctcaaactcctgacctcaagtgatccacccgccttggcctctcaaagtgctgggatgacaggcatgagccactgcgcttggccaaatttttcactttataagctttttatactcttttgtaataacacraacacattatacaattgcacgaaagtattttctttatattcttactctataagtttttttccattttagaaatatttatttaaaaagatgcatttttacttacaaaatcttttttggttaaaaactgagacacaaacacacgttagcctgggctgacacaggttcaggatcatcaagatgtcacgaagtgataggaatttttcagctccattataattgtacaggaccttgactgaaatgtcattatgggacacatgactgtagtagaaaaaacccacaaaagagaaaaatctttgctgt

SEQ ID NO: 44996 - DNA, 601 bp, Human
ttgtaataacacaaacacattatacaattgcacgaaagtattttctttatattcttactctataagtttttttccattttagaaatatttatttaaaaagatgcatttttacttacaaaatcttttttggttaaaaactgagacacaaacacacgttagcctgggctgacacaggttcaggatcatcaagatgtcacgaagtgataggaatttttcagctccattataattgtacaggaccttgactgaaatgtcattatgggacacatgactgtagtagaaaaaacccacaaaagagaamaatctttgctgtcacgaatttacattttaatagataagcctgatagtaaactatctaagttaattatatattatgttcgatggtgataagtgctatgatgagtgttatgaagagcctcttccctccaagatacaacttcttactccattgacaagtcttagatcccaatctgttaaggccccaactaattttacagccagagttagataacaggaaaaagacatctcttttcctttcatcattgtcatcatcaataacaatcacaattgttaggaccactctggatgggagtgcaggggc

SEQ ID NO: 44997 - DNA, 601 bp, Human
ctccattgacaagtcttagatcccaatctgttaaggccccaactaattttacagccagagttagataacaggaaaaagacatctcttttcctttcatcattgtcatcatcaataacaatcacaattgttaggaccactctggatgggagtgcaggggcttctgagaggagagtggtcatattattttatttattttcaaattaatttattattattattatttttgagatggagtcttgctctgtcgcccaggctggagttcagtggcccaatctcggctcactgcaagctccgcctcccrggttcacgctatcctcctgcctcagcctcccgagtagctgggaccacaggtgcctgccacaacacctggctaattttttgtatttttagtagagacggggtttcaccatattagccaggatggtcttgatctcctgacctcatgatctgcctgccttggcctcccgagatgctgggattataggcataagccaccgcgcccagctttttttttgtgagacggagtctcactctgtcacccagactggagtgcagtggcgtgatctcggctcactgcaacttccgcctcccagattcaagt

SEQ ID NO: 44998 - DNA, 601 bp, Human
ccagattcaagtgattctcctgcctcagcctcctgagtagctgggattgcaggcacataccaccatgcccagttaatttttgtatttttagtagatactgggtttcatcatgttggtcaggctggtcttgaacccctgacctcaagtgatctgcctgccttgccctcccaaagtgctgggattacaggcatgagccaccatgcccggctgagagtggtcattttaaataaatgctcagagctaggtgcagtggctaatgcctgtaattctagcactttgagaggccgaggcaggaggatckcttgagctcaggagtttgagaccagcctaggccatatagtgagacgccttctaaacaaaacaaaaaattagctgggcatggtggtgcgtgcctgtggtcccagctacttgggagtctgaggtgggaggatcgcttgagcccaggaggtcaaagctgtagtgagctgtgatcgtgccactgcactccagcctggggaatagagtgagacctggtctcaaacaaaaacaaaaacaaaaacaaaaaacaaaaaccacaaataaaacaaataaagaagtgcttagggccaggcatggtagctca

SEQ ID NO: 44999 - DNA, 601 bp, Human
cattttaaataaatgctcagagctaggtgcagtggctaatgcctgtaattctagcactttgagaggccgaggcaggaggatcgcttgagctcaggagtttgagaccagcctaggccatatagtgagacgccttctaaacaaaacaaaaaattagctgggcatggtggtgcgtgcctgtggtcccagctacttgggagtctgaggtgggaggatcgcttgagcccaggaggtcaaagctgtagtgagctgtgatcgtgccactgcactccagcctggggaatagagtgagacctggtctcawacaaaaacaaaaacaaaaacaaaaaacaaaaaccacaaataaaacaaataaagaagtgcttagggccaggcatggtagctcacgcctattatcctggcactttgggaggccaaggcaagaggcttgcttgaagccaggagtttgagaccagccaggacagcatggcaagactctcatctttacagaaaaaaaaaaaaagctgagtacattggtgtgcacctgtagtcctagctacttgggtggctggggtgggaagatcccgtaagcccaggaattcgaggatgcagtgagctgtgatta

SEQ ID NO: 45000 - DNA, 601 bp, Human
tcccgtaagcccaggaattcgaggatgcagtgagctgtgattacgccactgtgctccagcctgggtgacatgtgaaaccctgtctctaaaaataaacacataaataaataaattaaataagtgctcagggaaggccttaccaaaaaggtgatgtctattggaggatctgaagtggtgagggatccagccacctgggggaagaggaatagcaaggtgaaggccctgaggggggatcatgcctggtgtgttgtagacagcactgtccggtggacacgaaatgggagctaccgctgtcattttmaattcctgagtagccatattaaaaatagtgaaaagagaaaagtagaattatacatgttaataatatttttaatttaacccaacatagccagaatattattatttgaatgtgcaagcaatacaaaaaattattgagatcttttacactttattttttgtactaagtctttgaaatctggtgtgtctctgacacagcatatctcaatcagacattaagttttcattggagatacttgatctgtatttagagtttataaaatttacaattaaaagaacagacttgctgggcatggtggctgac

SEQ ID NO: 45001 - DNA, 601 bp, Human
gcagtgagctgtgattacgccactgtgctccagcctgggtgacatgtgaaaccctgtctctaaaaataaacacataaataaataaattaaataagtgctcagggaaggccttaccaaaaaggtgatgtctattggaggatctgaagtggtgagggatccagccacctgggggaagaggaatagcaaggtgaaggccctgaggggggatcatgcctggtgtgttgtagacagcactgtccggtggacacgaaatgggagctaccgctgtcattttaaattcctgagtagccatattaaaaakagtgaaaagagaaaagtagaattatacatgttaataatatttttaatttaacccaacatagccagaatattattatttgaatgtgcaagcaatacaaaaaattattgagatcttttacactttattttttgtactaagtctttgaaatctggtgtgtctctgacacagcatatctcaatcagacattaagttttcattggagatacttgatctgtatttagagtttataaaatttacaattaaaagaacagacttgctgggcatggtggctgacacctgtaatcccagcactttgggagg

SEQ ID NO: 45002 - DNA, 601 bp, Human
agggatccagccacctgggggaagaggaatagcaaggtgaaggccctgaggggggatcatgcctggtgtgttgtagacagcactgtccggtggacacgaaatgggagctaccgctgtcattttaaattcctgagtagccatattaaaaatagtgaaaagagaaaagtagaattatacatgttaataatatttttaatttaacccaacatagccagaatattattatttgaatgtgcaagcaatacaaaaaattattgagatcttttacactttattttttgtactaagtctttgaaatctkgtgtgtctctgacacagcatatctcaatcagacattaagttttcattggagatacttgatctgtatttagagtttataaaatttacaattaaaagaacagacttgctgggcatggtggctgacacctgtaatcccagcactttgggaggcagaggcaggtggattgcttaaggccaggagttcgagtccagcctgggtaatgtaacacagtgagactctatctctctaaaaaaaaaaaaaaaaaaaattagctgggtgtgtggcatatgcctgtggttctagctacttgggaggttgagg

SEQ ID NO: 45003 - DNA, 601 bp, Human
tttaaattcctgagtagccatattaaaaatagtgaaaagagaaaagtagaattatacatgttaataatatttttaatttaacccaacatagccagaatattattatttgaatgtgcaagcaatacaaaaaattattgagatcttttacactttattttttgtactaagtctttgaaatctggtgtgtctctgacacagcatatctcaatcagacattaagttttcattggagatacttgatctgtatttagagtttataaaatttacaattaaaagaacagacttgctgggcatggtggcygacacctgtaatcccagcactttgggaggcagaggcaggtggattgcttaaggccaggagttcgagtccagcctgggtaatgtaacacagtgagactctatctctctaaaaaaaaaaaaaaaaaaaattagctgggtgtgtggcatatgcctgtggttctagctacttgggaggttgaggtgggggatagcttgctgttgaggctgtggtgagccatgcgtgtgcctctgcactccagcctgggcagcagagcaagaccctgactccccgtccgagaaaaaaaaaagaatagattcacac

SEQ ID NO: 45004 - DNA, 601 bp, Human
gtgtgtctctgacacagcatatctcaatcagacattaagttttcattggagatacttgatctgtatttagagtttataaaatttacaattaaaagaacagacttgctgggcatggtggctgacacctgtaatcccagcactttgggaggcagaggcaggtggattgcttaaggccaggagttcgagtccagcctgggtaatgtaacacagtgagactctatctctctaaaaaaaaaaaaaaaaaaaattagctgggtgtgtggcatatgcctgtggttctagctacttgggaggttgaggygggggatagcttgctgttgaggctgtggtgagccatgcgtgtgcctctgcactccagcctgggcagcagagcaagaccctgactccccgtccgagaaaaaaaaaagaatagattcacacactcaagttgttgaaaacgtacttaaaatttttccaataaaagagtggagtgtctttttatatttaattttaaatgaaatggacttaaaatccagttgcactggtcatgttgcaggggctcagtggacacacgtggctcgtgtcctcacactggacggtgcaggcctgggagcagagagga

SEQ ID NO: 45005 - DNA, 601 bp, Human
ctgggcatggtggctgacacctgtaatcccagcactttgggaggcagaggcaggtggattgcttaaggccaggagttcgagtccagcctgggtaatgtaacacagtgagactctatctctctaaaaaaaaaaaaaaaaaaaattagctgggtgtgtggcatatgcctgtggttctagctacttgggaggttgaggtgggggatagcttgctgttgaggctgtggtgagccatgcgtgtgcctctgcactccagcctgggcagcagagcaagaccctgactccccgtccgagaaaaaaaaaagaatagattcacacactcaagttgttgaaaacgtacttaaaatttttccaataaaagagtggagtgtctttttatatttaattttaaatgaaatggacttaaaatccagttgcactggtcatgttgcaggggctcagtggacacacgtggctcgtgtcctcacactggacggtgcaggcctgggagcagagaggatgcctgtgaggctgattcagtgagtggagggatcatgtgggcggggttgtgaggtcacaggggaggcgggtctggctctgcagggatttgtagaccgtcctgagg

SEQ ID NO: 45006 - DNA, 601 bp, Human
gagtggagtgtctttttatatttaattttaaatgaaatggacttaaaatccagttgcactggtcatgttgcaggggctcagtggacacacgtggctcgtgtcctcacactggacggtgcaggcctgggagcagagaggatgcctgtgaggctgattcagtgagtggagggatcatgtgggcggggttgtgaggtcacaggggaggcgggtctggctctgcagggatttgtagaccgtcctgaggagtgtggcctttaccctgggtgagatgggagcaagaggagggcttggagtagagaaktgacaagatctgacttacattttaatgggaccactctgactgcagtgtttggaacagacagggagggtcaagccagggtcagggagccccgctgagaggctgtggggacagctcaggtgagggtggtgatggtttggacctgggtggtagcattgagttggtaaaaagtggctggacccttgggctatttaaaaggagggcattcctgatgaattggacaaaaggtcatggtgtgcaggtcaggcagtggtgagagaaaggggaagtcaaggatgaggctgagacttttggcccaagcaa

SEQ ID NO: 45007 - DNA, 601 bp, Human
ggctcgtgtcctcacactggacggtgcaggcctgggagcagagaggatgcctgtgaggctgattcagtgagtggagggatcatgtgggcggggttgtgaggtcacaggggaggcgggtctggctctgcagggatttgtagaccgtcctgaggagtgtggcctttaccctgggtgagatgggagcaagaggagggcttggagtagagaagtgacaagatctgacttacattttaatgggaccactctgactgcagtgtttggaacagacagggagggtcaagccagggtcagggagccccgytgagaggctgtggggacagctcaggtgagggtggtgatggtttggacctgggtggtagcattgagttggtaaaaagtggctggacccttgggctatttaaaaggagggcattcctgatgaattggacaaaaggtcatggtgtgcaggtcaggcagtggtgagagaaaggggaagtcaaggatgaggctgagacttttggcccaagcaactggaaggatggaatttctgttaattgaatggagaagactgtgggagaagcagtttttttggggaagacagggagtttgtggttggactcgt

SEQ ID NO: 45008 - DNA, 601 bp, Human
agcttctgcctgggctcctgacccagaacagatggctcctctcaccttccagaggtctgttcgaggcatggctggcaacgttaaaaaaaatttggccgggcacggtggctcacgcctgtaatcccagcactttgggaggccgaggcgggtggatcacgaagtcaggagtttgagaccaacctggccaacatggtgaaaccccgtctctacaaaaaatacaaaaattagccgggcatggtggtgcacgcctgtagtcccagctactcgggaggctgaggcaggagaatcgcttgaacccggraaggcggaggttgtggtgagccgagatagtgccattgcactccagcctgggtgacagagcgagactctgcctcaaacaaagcaaacaaacaaacaaacaaaaatcagctaagttatccatgcctccagcaccgtgggtgttgactccctgaaggtcactggaagttgctagggtctttctgagtcaatccacatttcaaggtcaaatctccctgctctgggctgatgaataaaatgtgtcataaatgctcagaagctcccccagtgtggcctggaagcctgattttatggaaacttactg

SEQ ID NO: 45009 - DNA, 601 bp, Human
gatgaataaaatgtgtcataaatgctcagaagctcccccagtgtggcctggaagcctgattttatggaaacttactgaaatgatacaaaacgctaaagatatgcattcctaattttctagcactttcaactccacagggatgttgggggaagggattaatgagcttggagaggtggaataacctcctcaaggtctcccagctgggggaaggtaagcactggatgttgggaatcaccagcctcatgtgcaccaaccatgtcgccaaatgtccaaagcctgcagagggcccagggctctcacrgaccacacagggaagccactgcacctgttctttttaagactgggaggagagtggggaaaggcagcaggtatggcttttgaggtcctctcctagcccagctggtgtctgatgctggcacccgggcttggagggtgagagtcttgggacctgtagaccaaggccacctcacttgggcagcccaggcctgctggacatgggccttctgacttagtttcaaagctggaccctgacccttgttggttgcaggacttcagtgatttaatctttgagtttatctgtttcattggggtgatggtgcct

SEQ ID NO: 45010 - DNA, 601 bp, Human
ttctagcactttcaactccacagggatgttgggggaagggattaatgagcttggagaggtggaataacctcctcaaggtctcccagctgggggaaggtaagcactggatgttgggaatcaccagcctcatgtgcaccaaccatgtcgccaaatgtccaaagcctgcagagggcccagggctctcacggaccacacagggaagccactgcacctgttctttttaagactgggaggagagtggggaaaggcagcaggtatggcttttgaggtcctctcctagcccagctggtgtctgatgctrgcacccgggcttggagggtgagagtcttgggacctgtagaccaaggccacctcacttgggcagcccaggcctgctggacatgggccttctgacttagtttcaaagctggaccctgacccttgttggttgcaggacttcagtgatttaatctttgagtttatctgtttcattggggtgatggtgcctgccttggaggagttttgtgaagtgatgttaatgaaggagcttaggccggtgacttgacacatgcccaacataaggaatgcctgtggggccgcctggctctgcccctagagtgga

SEQ ID NO: 45011 - DNA, 601 bp, Human
ttgggcagcccaggcctgctggacatgggccttctgacttagtttcaaagctggaccctgacccttgttggttgcaggacttcagtgatttaatctttgagtttatctgtttcattggggtgatggtgcctgccttggaggagttttgtgaagtgatgttaatgaaggagcttaggccggtgacttgacacatgcccaacataaggaatgcctgtggggccgcctggctctgcccctagagtggagggagatggtgcagagggaacagtagaactggtatgggctgcggatgcctggcgartggcatgagtaggggagaaagaagcgcctgccagaatgggagtgagggagaacagtggggggtcccctcccttaccacaagacctgggatctaactgtgcctttagatcagagcttctcaactggggcacttttgctcctcaggggacttttagcaatgcctggagacatttttggttgtcacagtcaggagagggatattatagtcctttaatgtggagaggccagggatgccccctacaacaaagaattacccagcccacaatgtcagtggtactgaggctgagaaaccctgctttcg

SEQ ID NO: 45012 - DNA, 601 bp, Human
tgacttagtttcaaagctggaccctgacccttgttggttgcaggacttcagtgatttaatctttgagtttatctgtttcattggggtgatggtgcctgccttggaggagttttgtgaagtgatgttaatgaaggagcttaggccggtgacttgacacatgcccaacataaggaatgcctgtggggccgcctggctctgcccctagagtggagggagatggtgcagagggaacagtagaactggtatgggctgcggatgcctggcgagtggcatgagtaggggagaaagaagcgcctgccasaatgggagtgagggagaacagtggggggtcccctcccttaccacaagacctgggatctaactgtgcctttagatcagagcttctcaactggggcacttttgctcctcaggggacttttagcaatgcctggagacatttttggttgtcacagtcaggagagggatattatagtcctttaatgtggagaggccagggatgccccctacaacaaagaattacccagcccacaatgtcagtggtactgaggctgagaaaccctgctttcgatgactcattctcaccagcttgttatgaggatga

SEQ ID NO: 45013 - DNA, 601 bp, Human
catgttcttagctcaataaatggccgctgtttttaattgtcaagatatgatgatggacttgacttgatgggtggggagaggcaagacctccttgcctttaaaggagttgaagacttgggaagcagttggaatggtgaattctatcttgggcgtgttggctttgaggggctggggaaaatcctaggatattcagaagaaatctagggtcttctaatcatgtggttcacataaatgacccttactataatatctatctcagagtcaacttttcaagacaccagcctccctgcaggcaaccccwgtgtggcatcaggagagcggggtcttgggtcagcatggccagcccagcctctggctttgcttgtgtcattggtgactccccgtggtcctcggtgccttcctccgtgatggcatttcccattggctggctgggcctctgcccagggatccagctgggtgccggcccagctcaggctccagagaggaaagagccctggatctggggccagtgacctgatattcacgctggctctgccccttccctctcggtgtggcctggagagatgtgcaggctccccgagggcaggggggggtagtgagg

SEQ ID NO: 45014 - DNA, 601 bp, Human
caggcaaccccagtgtggcatcaggagagcggggtcttgggtcagcatggccagcccagcctctggctttgcttgtgtcattggtgactccccgtggtcctcggtgccttcctccgtgatggcatttcccattggctggctgggcctctgcccagggatccagctgggtgccggcccagctcaggctccagagaggaaagagccctggatctggggccagtgacctgatattcacgctggctctgccccttccctctcggtgtggcctggagagatgtgcaggctccccgagggcaggggrgggtagtgaggagggttccaggagatgagggatgtgaaagcagcagcacgtgcctggcacacaggggccctggtagatgcttggcggacaagtgagggcaggcaggggagggggcagacaggattcagggaggcaggcctgggaggagcccagggctcagggaggggggtgaggggtcaggcggagccggctcaactcctggctctgccgcttactagcaggaagactccgagtccggtgcctgctttggtcacatccatgtgtgggtggtggcgatgggaggttggccttgggggccgc

SEQ ID NO: 45015 - DNA, 601 bp, Human
atgagggatgtgaaagcagcagcacgtgcctggcacacaggggccctggtagatgcttggcggacaagtgagggcaggcaggggagggggcagacaggattcagggaggcaggcctgggaggagcccagggctcagggaggggggtgaggggtcaggcggagccggctcaactcctggctctgccgcttactagcaggaagactccgagtccggtgcctgctttggtcacatccatgtgtgggtggtggcgatgggaggttggccttgggggccgctctaatgcctacctcacaacatagkgataggtctagatggatacacagcaccagggcctgagagtgctgaataaaccttcattcctcctctagtaagcacagtaaatccctagagggcagtccccaaaggccttgattaccccaactgtggagtacagcgagaagtggagcttctggagccagtgctttctctgctcaattttgtgtattctttcactcgttcatctgaaatctgacccagccccatggaaactggctgcagacacccaatggcagtagggtaccaaggggcaggggagcaatcggctcccggtgcagacaatga

SEQ ID NO: 45016 - DNA, 601 bp, Human
gaggtaactgctgtgggttctggctgggagaggcatcgtctaggccctttagacgtggtcaggaagagggtgtacttcatctcccttgggcctggcaggaagccagcgctgatgggttccagaaggaaagccccccagccagggcagccgctgccagctggtgttggctggtgtgggtgctgtgccaccccactcttttggaccggcaggctgcttgccatcttccaaaggggactggcctcttgacaagggtaggaaaggagccagggctgccctatgggcttgggggctggtagggcgytggggaaggcaggattcacatttctctagcctggacaacaagcatgtgcctgaggatcaaaatgagcacttttagggttttattactattatttactaaacaagtttccttgcagggttgtggaaggggcccatgcagaaggatctgtctagaggaggaggctccgcatgtgtacaagggaaggacgtgtgcccttgggactggctggggcacggccctagggaagtgtgtgtgtgtgtttgcgggggtgctctggtcatgtggccccttccctgactgaaccccttgcagggccccatg

SEQ ID NO: 45017 - DNA, 601 bp, Human
cagtgagaaaagcagagacctcttgggcccgggggtgtaggagtcactctccctgatctgctcccaaatgcaggtgcatctggttccatttggagccggtgagctggctgatggtggctgtctggggctcctggggctgagcagccaggctaagcttagcccacaggcacttcccagaaactggtggcactgtcacagtgttggctggatgctgaggagttggcaggatacagtgcaggaacagcaaataggttttatctgggtgtcaagttgaaacaattggtaccagcttccaggaggrctgtgttgggaaggattctgaggtgttgtctgagctcaatgggaagagtgccctgattgattcatgaggtctatcttgggcaggggaaatggaagagtggcaaggggtttgccgtccctggtgtagtggaaaaaatacagagagcctagatttgatcttaggtgagtggccccagttttttttctctctctttttttttgttttttgagacggggtctggctgtgttgcctaggctggagggcagtggcacaatttcagttcactgcgacctccacctcctgggctcaagccatcttccc

SEQ ID NO: 45018 - DNA, 601 bp, Human
gagaggccaagcagaccgtcaaggctacaaacaggctggggttcagcttatttcaacatacttcttcagcatctatgtctatgggctgggcttgtgctaggccctaggtgtcagagatatgaaggcactcatagctgtcatttattgagctcctattataagtgtcaggtccttcgctaagccacttatttacacgtgtcatctcatgtaatgtgtatgacaactttatgaggtcactactcttactgccccattttatagatgagtaagttgaggcttggtcacatggcgaggaagtggyaaagtggggctctaagtgaggtcttcggactccaaagccccttctgcagaccgtgatgctttgctgcctctgttgagtcaaaccggactcttcccttgaggccctgatggtaacagcagtgtaaacagatggtgagcacagtgtagtgtaatatatgcaaggggagaggttggaaccaggcacagaagtagcactgagcatttaattatgtcagggagggccggggaaagctcacagaggaggtggtggggggggggtccctgaatgagccacaggagggaaaccagattctgtctggca

SEQ ID NO: 45019 - DNA, 601 bp, Human
cttatttcaacatacttcttcagcatctatgtctatgggctgggcttgtgctaggccctaggtgtcagagatatgaaggcactcatagctgtcatttattgagctcctattataagtgtcaggtccttcgctaagccacttatttacacgtgtcatctcatgtaatgtgtatgacaactttatgaggtcactactcttactgccccattttatagatgagtaagttgaggcttggtcacatggcgaggaagtggtaaagtggggctctaagtgaggtcttcggactccaaagccccttctscagaccgtgatgctttgctgcctctgttgagtcaaaccggactcttcccttgaggccctgatggtaacagcagtgtaaacagatggtgagcacagtgtagtgtaatatatgcaaggggagaggttggaaccaggcacagaagtagcactgagcatttaattatgtcagggagggccggggaaagctcacagaggaggtggtggggggggggtccctgaatgagccacaggagggaaaccagattctgtctggcacttagggaagcagccagtggaggctgcaggtcagtgggctggggtg

SEQ ID NO: 45020 - DNA, 601 bp, Human
gtcagagatatgaaggcactcatagctgtcatttattgagctcctattataagtgtcaggtccttcgctaagccacttatttacacgtgtcatctcatgtaatgtgtatgacaactttatgaggtcactactcttactgccccattttatagatgagtaagttgaggcttggtcacatggcgaggaagtggtaaagtggggctctaagtgaggtcttcggactccaaagccccttctgcagaccgtgatgctttgctgcctctgttgagtcaaaccggactcttcccttgaggccctgatkgtaacagcagtgtaaacagatggtgagcacagtgtagtgtaatatatgcaaggggagaggttggaaccaggcacagaagtagcactgagcatttaattatgtcagggagggccggggaaagctcacagaggaggtggtggggggggggtccctgaatgagccacaggagggaaaccagattctgtctggcacttagggaagcagccagtggaggctgcaggtcagtgggctggggtgaggggtaggggctttaaatcccagttgcttatagcccccttctgccccacttttggggtgcga

SEQ ID NO: 45021 - DNA, 601 bp, Human
ctaagtgaggtcttcggactccaaagccccttctgcagaccgtgatgctttgctgcctctgttgagtcaaaccggactcttcccttgaggccctgatggtaacagcagtgtaaacagatggtgagcacagtgtagtgtaatatatgcaaggggagaggttggaaccaggcacagaagtagcactgagcatttaattatgtcagggagggccggggaaagctcacagaggaggtggtggggggggggtccctgaatgagccacaggagggaaaccagattctgtctggcacttagggaagcrgccagtggaggctgcaggtcagtgggctggggtgaggggtaggggctttaaatcccagttgcttatagcccccttctgccccacttttggggtgcgaccaggtgatgtgaagctcaggaggtcatggctgggacactcaggaaggtcaagtgtggggtgctgccccagggcccctctcctcggcctgtatgttcaataggtgcactggcctccctgtcttggccagacagctctgagagccagggctctgtgggtgcctgaactgtgtgtggaccctgcctgggatgaggccacagctgc

SEQ ID NO: 45022 - DNA, 601 bp, Human
aggtcttcggactccaaagccccttctgcagaccgtgatgctttgctgcctctgttgagtcaaaccggactcttcccttgaggccctgatggtaacagcagtgtaaacagatggtgagcacagtgtagtgtaatatatgcaaggggagaggttggaaccaggcacagaagtagcactgagcatttaattatgtcagggagggccggggaaagctcacagaggaggtggtggggggggggtccctgaatgagccacaggagggaaaccagattctgtctggcacttagggaagcagccagtrgaggctgcaggtcagtgggctggggtgaggggtaggggctttaaatcccagttgcttatagcccccttctgccccacttttggggtgcgaccaggtgatgtgaagctcaggaggtcatggctgggacactcaggaaggtcaagtgtggggtgctgccccagggcccctctcctcggcctgtatgttcaataggtgcactggcctccctgtcttggccagacagctctgagagccagggctctgtgggtgcctgaactgtgtgtggaccctgcctgggatgaggccacagctgctcccaca

SEQ ID NO: 45023 - DNA, 601 bp, Human
tgttgagtcaaaccggactcttcccttgaggccctgatggtaacagcagtgtaaacagatggtgagcacagtgtagtgtaatatatgcaaggggagaggttggaaccaggcacagaagtagcactgagcatttaattatgtcagggagggccggggaaagctcacagaggaggtggtggggggggggtccctgaatgagccacaggagggaaaccagattctgtctggcacttagggaagcagccagtggaggctgcaggtcagtgggctggggtgaggggtaggggctttaaatcccagwtgcttatagcccccttctgccccacttttggggtgcgaccaggtgatgtgaagctcaggaggtcatggctgggacactcaggaaggtcaagtgtggggtgctgccccagggcccctctcctcggcctgtatgttcaataggtgcactggcctccctgtcttggccagacagctctgagagccagggctctgtgggtgcctgaactgtgtgtggaccctgcctgggatgaggccacagctgctcccacacccgcacctgctcacacccaagaagggggccgccatgatcactgtggaggcc

SEQ ID NO: 45024 - DNA, 601 bp, Human
gtgtaatatatgcaaggggagaggttggaaccaggcacagaagtagcactgagcatttaattatgtcagggagggccggggaaagctcacagaggaggtggtggggggggggtccctgaatgagccacaggagggaaaccagattctgtctggcacttagggaagcagccagtggaggctgcaggtcagtgggctggggtgaggggtaggggctttaaatcccagttgcttatagcccccttctgccccacttttggggtgcgaccaggtgatgtgaagctcaggaggtcatggctgggayactcaggaaggtcaagtgtggggtgctgccccagggcccctctcctcggcctgtatgttcaataggtgcactggcctccctgtcttggccagacagctctgagagccagggctctgtgggtgcctgaactgtgtgtggaccctgcctgggatgaggccacagctgctcccacacccgcacctgctcacacccaagaagggggccgccatgatcactgtggaggccagggtgggagaaccctctggaccatagggtcccaccccattgcagggcaaagaggggatctgaggcccagtgact

SEQ ID NO: 45025 - DNA, 601 bp, Human
cctgtcttggccagacagctctgagagccagggctctgtgggtgcctgaactgtgtgtggaccctgcctgggatgaggccacagctgctcccacacccgcacctgctcacacccaagaagggggccgccatgatcactgtggaggccagggtgggagaaccctctggaccatagggtcccaccccattgcagggcaaagaggggatctgaggcccagtgactggaagtgatttgctgcaagtcacacaggcagcaagaagtgggtcaatcccccaaggttctggtttggagcactcccggsggtctcccctcaccccttaccctgggctcgccctctccaggctgtgtgccatcctcaccacctctgtcgtgccctcgctcacccacgtggctacactctcgcgtgcgtttccctcacacctggccatcctcttaggccaggccaaggctttgctctggagagaacttaaatggcattgtcagatgaggaaggagcagaacctgccgatcccatgacctcccaataggccatctgcacacactcagcccgctctccccagccctgcacagccccttcggctcgcacatctcatccttactc

SEQ ID NO: 45026 - DNA, 601 bp, Human
attgcagggcaaagaggggatctgaggcccagtgactggaagtgatttgctgcaagtcacacaggcagcaagaagtgggtcaatcccccaaggttctggtttggagcactcccgggggtctcccctcaccccttaccctgggctcgccctctccaggctgtgtgccatcctcaccacctctgtcgtgccctcgctcacccacgtggctacactctcgcgtgcgtttccctcacacctggccatcctcttaggccaggccaaggctttgctctggagagaacttaaatggcattgtcagatraggaaggagcagaacctgccgatcccatgacctcccaataggccatctgcacacactcagcccgctctccccagccctgcacagccccttcggctcgcacatctcatccttactcctgctagcaagcaaagatgtctgcaggtgctctcattcggggatggggatgtagtagggagacaatacctggtagatagagctgaacaactttctgcagaaagtttggagtgaggggggctctgtgatggaataacaggcatgaaccagaagcctaattctattgcttagaagctgtgtggcttt

SEQ ID NO: 45027 - DNA, 601 bp, Human
gctgtgtgccatcctcaccacctctgtcgtgccctcgctcacccacgtggctacactctcgcgtgcgtttccctcacacctggccatcctcttaggccaggccaaggctttgctctggagagaacttaaatggcattgtcagatgaggaaggagcagaacctgccgatcccatgacctcccaataggccatctgcacacactcagcccgctctccccagccctgcacagccccttcggctcgcacatctcatccttactcctgctagcaagcaaagatgtctgcaggtgctctcattcggkgatggggatgtagtagggagacaatacctggtagatagagctgaacaactttctgcagaaagtttggagtgaggggggctctgtgatggaataacaggcatgaaccagaagcctaattctattgcttagaagctgtgtggctttaggcaagcgacttaacctctctgagtttcaatctccttattaataaaacaggtacgaacagtgccttgctcagtggtcccctaacttggcttcattttggaatcccctggggatctttaaaaaaatgctgatgcctggctcccagcttctgacctg

SEQ ID NO: 45028 - DNA, 601 bp, Human
agcagaacctgccgatcccatgacctcccaataggccatctgcacacactcagcccgctctccccagccctgcacagccccttcggctcgcacatctcatccttactcctgctagcaagcaaagatgtctgcaggtgctctcattcggggatggggatgtagtagggagacaatacctggtagatagagctgaacaactttctgcagaaagtttggagtgaggggggctctgtgatggaataacaggcatgaaccagaagcctaattctattgcttagaagctgtgtggctttaggcaagygacttaacctctctgagtttcaatctccttattaataaaacaggtacgaacagtgccttgctcagtggtcccctaacttggcttcattttggaatcccctggggatctttaaaaaaatgctgatgcctggctcccagcttctgacctgatgtcaccgccctgaggtgcaacctgggtgtggggattttaaaaagctccctgggtgatactaatgtgccgcaaagtttgggaaccactgtcccagggtttgttggggattaaaggaagaatgcagacacgtggagagcgcttactaaatgg

SEQ ID NO: 45029 - DNA, 601 bp, Human
ctctccccagccctgcacagccccttcggctcgcacatctcatccttactcctgctagcaagcaaagatgtctgcaggtgctctcattcggggatggggatgtagtagggagacaatacctggtagatagagctgaacaactttctgcagaaagtttggagtgaggggggctctgtgatggaataacaggcatgaaccagaagcctaattctattgcttagaagctgtgtggctttaggcaagcgacttaacctctctgagtttcaatctccttattaataaaacaggtacgaacagtgcyttgctcagtggtcccctaacttggcttcattttggaatcccctggggatctttaaaaaaatgctgatgcctggctcccagcttctgacctgatgtcaccgccctgaggtgcaacctgggtgtggggattttaaaaagctccctgggtgatactaatgtgccgcaaagtttgggaaccactgtcccagggtttgttggggattaaaggaagaatgcagacacgtggagagcgcttactaaatggaggtgattatttcagtgttcatctccctgcctctcactccatttaatgtggagtctg

SEQ ID NO: 45030 - DNA, 601 bp, Human
cctggctcccagcttctgacctgatgtcaccgccctgaggtgcaacctgggtgtggggattttaaaaagctccctgggtgatactaatgtgccgcaaagtttgggaaccactgtcccagggtttgttggggattaaaggaagaatgcagacacgtggagagcgcttactaaatggaggtgattatttcagtgttcatctccctgcctctcactccatttaatgtggagtctgtgggactgaggtttttatttttataccacagtgggtttgccagagtgctgacctaagggggctgtcagyggcccatctttacccggaaaagcccctcccttgcgccctcaccatctctgcagccctagggcaggcctcagtctttctgacaggccccagggtcctgattaggccggggcctgaccccgcaggggcaggcctgcccctggtctccacctggtggctttgggaatggaaatgctggttcccacaaaggcttctgggagacagaagcctaagatggcagggtgcggtgcacacactcagtctggattcggtggcctgacctgggggatccggggagggcgttggtgggggcagaggcgtggg

SEQ ID NO: 45031 - DNA, 601 bp, Human
tgaggtgcaacctgggtgtggggattttaaaaagctccctgggtgatactaatgtgccgcaaagtttgggaaccactgtcccagggtttgttggggattaaaggaagaatgcagacacgtggagagcgcttactaaatggaggtgattatttcagtgttcatctccctgcctctcactccatttaatgtggagtctgtgggactgaggtttttatttttataccacagtgggtttgccagagtgctgacctaagggggctgtcagcggcccatctttacccggaaaagcccctcccttgcrccctcaccatctctgcagccctagggcaggcctcagtctttctgacaggccccagggtcctgattaggccggggcctgaccccgcaggggcaggcctgcccctggtctccacctggtggctttgggaatggaaatgctggttcccacaaaggcttctgggagacagaagcctaagatggcagggtgcggtgcacacactcagtctggattcggtggcctgacctgggggatccggggagggcgttggtgggggcagaggcgtgggaggggctgcttctttggagctctccactctgctcc

SEQ ID NO: 45032 - DNA, 601 bp, Human
tgagggaagacacatttctccagattcctcagctgtcctgacaggaagttgtgcatcactgggctgacaggaaggaaatggctctgctgtttggaaagaaatagagaattctgactggggctgagggaaaaggtgtctgcttggagaagccgttttgtcccgatatgaggactctttgtctctgcaggcagttgctccctgtttattttcctttgaatgacaaggattggcttcagttaatgaggagcggtgagaggaaagtgagaagcggcttgtgagattttgggacacggaagccttygcaggaaacctggccctctgcttgtaataagcatctttctttcccagctccctgcttcggggactgtgaggtgacaaaggattttgtgatctcacacgccgctttttctccatccaccaaccatacctttgcaaatgctttgatttctatttctttttaccaccccaaaaacacagtggatcttttaatagcacaaggccttttgaatctctaaccaatcagtctccaaatcctatccaaagtgcacttagaatagacacttttaataaaatatattgcttttaagccagtgtaaacctg

SEQ ID NO: 45033 - DNA, 601 bp, Human
gccctctgcttgtaataagcatctttctttcccagctccctgcttcggggactgtgaggtgacaaaggattttgtgatctcacacgccgctttttctccatccaccaaccatacctttgcaaatgctttgatttctatttctttttaccaccccaaaaacacagtggatcttttaatagcacaaggccttttgaatctctaaccaatcagtctccaaatcctatccaaagtgcacttagaatagacacttttaataaaatatattgcttttaagccagtgtaaacctgtgaaatttgtacrtttcttttagagcatctctacaaattttacattattgaaatcaccacccagtgaccttttaggaaatactagataaattgcaagagacaaatagacaaaccaaatggagtaagtacaatttccagtgcctttcctgctaggttcccagtctgagtcttagaaatccctgactccctgtgcccctccccccagctctgtgacctagcccctgctctgcaggcctctctgcccaccctgcccctggcaaggagctagcagctggggtgtcatctgagagccatttgcagctctgagaagcag

SEQ ID NO: 45034 - DNA, 601 bp, Human
tgcacttagaatagacacttttaataaaatatattgcttttaagccagtgtaaacctgtgaaatttgtacatttcttttagagcatctctacaaattttacattattgaaatcaccacccagtgaccttttaggaaatactagataaattgcaagagacaaatagacaaaccaaatggagtaagtacaatttccagtgcctttcctgctaggttcccagtctgagtcttagaaatccctgactccctgtgcccctccccccagctctgtgacctagcccctgctctgcaggcctctctgcscaccctgcccctggcaaggagctagcagctggggtgtcatctgagagccatttgcagctctgagaagcagctctggtatgtggctcctggcaccttgtcccgtctgtgtttgtctctgcgctccatcattcaaaacacttccaccagtggccagggcccccagaagggctcttgggggtggctgaggactgctttagaaaggctcagatgctctgtggccgagtctgccccaggcgaggtcctcagccttgtcgagtgagagctgagcgggggtctgagtccagcaaccctcactcactg

SEQ ID NO: 45035 - DNA, 601 bp, Human
agtgaccttttaggaaatactagataaattgcaagagacaaatagacaaaccaaatggagtaagtacaatttccagtgcctttcctgctaggttcccagtctgagtcttagaaatccctgactccctgtgcccctccccccagctctgtgacctagcccctgctctgcaggcctctctgcccaccctgcccctggcaaggagctagcagctggggtgtcatctgagagccatttgcagctctgagaagcagctctggtatgtggctcctggcaccttgtcccgtctgtgtttgtctctgcrctccatcattcaaaacacttccaccagtggccagggcccccagaagggctcttgggggtggctgaggactgctttagaaaggctcagatgctctgtggccgagtctgccccaggcgaggtcctcagccttgtcgagtgagagctgagcgggggtctgagtccagcaaccctcactcactgtggagcactctctgtgcctgggtcagccaggtgtggattatccactttgtggattgcctgtagtgtcttttccaaacccaggtcacgttcgtccctgctgctgtctcactgcatggggac

SEQ ID NO: 45036 - DNA, 601 bp, Human
tagcttcgggagaaacaaggtactgtcaaagctgcccaggcttcattcactccttaatttgataattaattccacaaacattaatggagtttttctcacattccaggcactatgcaaggtgctgggggtgggggagaaacagaaagatgacaaagacttggttcccacactcaaagagctcacagcctggtaagcagatgctcaacgcacttagaattgtctcccgaagaggcctgaagggacagggtggaggaagcgcagaggcggaggcagctctggagggtagggtggtgggagtggmgagaacggagccggtcctgaaggttgactgggaacgggaaaggctaaggcagggaggttgttcccggcccagcaagcacatggaaaggttgagggaaacgaaagcttagtgcattttgaaggagtgtgagcaactcggtatggctagaatttatggtgtgagtatgagatatggggctgtagaggcaggcaggggtcagatcatgccttgcttagggggtctgccttcatcccagaggctgtggggagccgcagaagggatttaaggagtgggatggcacgatttgtgtcttaaattact

SEQ ID NO: 45037 - DNA, 601 bp, Human
gccaaaatccccacccacctggcccccacgtgacaagaggcagctgcttcggggttgccacctggtagcccgtgacatctgtgagatgtctgtgcatttggctggtgtgagctttttcctttgctctgacccaagctttgatagctcagtgtgtcatcaccggcagtggatgcctgggagccccagactggctcttcctgcccagggacccccagacccacttctgcaggacgccttgaaacagctgtgggtggaaagccaggttttcccccataagcatcactcgttctgctgccttccyagcttctgtgctctcgggcccagagctcctccagggtgaggaaccaggaggaggagttggctgggttggctgttttcctaggtctttgatcacagctgttacatgtagataggctgggcgcggtggctcatgcctgtaatcccagcacattgggaggccgaggcgggtggattacgagctcaggagatcgagaccatcctggccaacatggtcaaactctgtttctactaaaatgcaaaaaaaagaaaaacacaaaaaatgaaaaacaaacaaacaaacaaaaaactagccgggcatggt

SEQ ID NO: 45038 - DNA, 601 bp, Human
ccacctggcccccacgtgacaagaggcagctgcttcggggttgccacctggtagcccgtgacatctgtgagatgtctgtgcatttggctggtgtgagctttttcctttgctctgacccaagctttgatagctcagtgtgtcatcaccggcagtggatgcctgggagccccagactggctcttcctgcccagggacccccagacccacttctgcaggacgccttgaaacagctgtgggtggaaagccaggttttcccccataagcatcactcgttctgctgccttcctagcttctgtgctcycgggcccagagctcctccagggtgaggaaccaggaggaggagttggctgggttggctgttttcctaggtctttgatcacagctgttacatgtagataggctgggcgcggtggctcatgcctgtaatcccagcacattgggaggccgaggcgggtggattacgagctcaggagatcgagaccatcctggccaacatggtcaaactctgtttctactaaaatgcaaaaaaaagaaaaacacaaaaaatgaaaaacaaacaaacaaacaaaaaactagccgggcatggtggtggcgtgcgcct

SEQ ID NO: 45039 - DNA, 601 bp, Human
aaaaaaaaaaggcttaaacaatgggttctaagcaaataagtatctgtttagtcagtggaacgaggaaacaaaagttgatggagttctccccacaattggaagtgttgttccccacctagatgatggggcctgcagggaagtgattttgcacgattctcctcttcttgggaacaggccatagggtagcatcccttcattcattcatcaagtatttattgagtgcctactgtgtgccaagtcctctgtgaggtgatggagcagagagacagaaaggaccccgactgtgccatgaagcagcccygagcctggaggggccactcagagggagcccaggggcggcggctctcgggctccagccgagtttccttcagacctagcccctttagctgacaatcttaaagcctggtcccggaaaacaggaatagtgcgagagggatgaaatgtgggtgaggagagtgagacaagggtggaggtaagaaagagggatggaagaaaagacgcagcaaactttcccgtgagagaaacgctccagacagcaccccagttcccagctgagactcccagccacagtcagcaagaacccacaggaggggaggcccac

SEQ ID NO: 45040 - DNA, 601 bp, Human
aagtatctgtttagtcagtggaacgaggaaacaaaagttgatggagttctccccacaattggaagtgttgttccccacctagatgatggggcctgcagggaagtgattttgcacgattctcctcttcttgggaacaggccatagggtagcatcccttcattcattcatcaagtatttattgagtgcctactgtgtgccaagtcctctgtgaggtgatggagcagagagacagaaaggaccccgactgtgccatgaagcagccccgagcctggaggggccactcagagggagcccaggggcrgcggctctcgggctccagccgagtttccttcagacctagcccctttagctgacaatcttaaagcctggtcccggaaaacaggaatagtgcgagagggatgaaatgtgggtgaggagagtgagacaagggtggaggtaagaaagagggatggaagaaaagacgcagcaaactttcccgtgagagaaacgctccagacagcaccccagttcccagctgagactcccagccacagtcagcaagaacccacaggaggggaggcccacgtccctgctcagctctgccctggcaagtggggtcgga

SEQ ID NO: 45041 - DNA, 601 bp, Human
aggggcggcggctctcgggctccagccgagtttccttcagacctagcccctttagctgacaatcttaaagcctggtcccggaaaacaggaatagtgcgagagggatgaaatgtgggtgaggagagtgagacaagggtggaggtaagaaagagggatggaagaaaagacgcagcaaactttcccgtgagagaaacgctccagacagcaccccagttcccagctgagactcccagccacagtcagcaagaacccacaggaggggaggcccacgtccctgctcagctctgccctggcaagtggrgtcggagatggggcattccctgcttggggtctcagtctctccatctgtaaaacgaggctttggactaggggagctcagagatctgtttagaactaatattctgtaaccggtgcagggcaaaatagacggggggcaggagcccaaattaaggccagtcgagtatcaggtggggtgttcctctggctcctcctattacaacagcaagagggacccaggggtactgtgggagtcctaccatctcctcacttgtacgaggtaccttctggctgctcttccggctgctcaacactcaaagaagga

SEQ ID NO: 45042 - DNA, 601 bp, Human
ggccacttgaaatgctcaaggtaagggctgctctgcctggcagacatgcgtcaggtgcctttggctcctccctggcaagtctgcctccagacgccctcagatcctgtccccatgcctggccatggggctatctgaccactgatgccagagggtcacactcatcagtctatacagaagacttggaaatgttttggcaaccctgtgttagaagagtggggtttcctaactgtatggctttgggtaattgcttaaatcctcccagccttagtttttccatctgtgggttaggagtggtcctctytacctcccagcatcaaataggaaactgtgcaagaaaatgctttgtaaacaggaaagccctaaactgacatccaggacacagtgactcagtagcaaatatattctgatattcagccttttccatggttacagcctcctctgtgccaagaaattcaagtcaccaagggttaaagcaagcaaggcacatggccgtgattgtccataattgatgaaataaaccttaaaggagtgacatataattaattgcaattaatccaggcactgtgacaccaccttgctaaaaatactgtctactaacaat

SEQ ID NO: 45043 - DNA, 601 bp, Human
gaaagccctaaactgacatccaggacacagtgactcagtagcaaatatattctgatattcagccttttccatggttacagcctcctctgtgccaagaaattcaagtcaccaagggttaaagcaagcaaggcacatggccgtgattgtccataattgatgaaataaaccttaaaggagtgacatataattaattgcaattaatccaggcactgtgacaccaccttgctaaaaatactgtctactaacaattgctttgatccagcagaatgatgtctgcccatgagcctggcaaagtgtctgytaatggagtgcacatagtgggtgtggaagctggcaggtgtgggggcagagggcgggaagggggccccaattctctcagaccctttggcagcaaatactacatatatagggtgatcatatgattcattgtctaaactgggacacttttgagattattatattaatgattaccattcatagtaataattatgccagataacaggcatacactggactctcctgggtaaacccgaatgtatcgccaccctctgcataggctgttttaagcccgtgggaaccctcgactgggagagtattttca

SEQ ID NO: 45044 - DNA, 601 bp, Human
acctggcctctggtaagtgaataataaatgttagctgttactttcatcacctctctttagttttgatgaatttggaaattcaggatggaagtgtctacctgcttgacatatctcaaaaattttgctcccttccttcaaatattcaacgttcaactaatatttattgacttactatgtgccagaccagtgttctaggcatggggctctaggagtgaacaaatgcaatgtaaaaattccctgccctctggggttgacactctggtgggggtgtgagaacaacatcagtgggaaaatggggtcrgatggtgaaaggtgctctggtcaccccagctgggcagtgccaatgggagacaccaggcatggccagcctcgggaagggtgtggggcccagggcagaccagcggggttcctggtgctgaggttaccctgtgtactattaaagcaggtaatggctcccagcttcgatggtgggtatatggaccccgttcagggatgggggctgaggagggcacaggaggactgaagacagggctctgaggagccacctgctctcgggtctaggtcagaccccgcatcctgatgcgggtcagctggctcatga

SEQ ID NO: 45045 - DNA, 601 bp, Human
taagtgaataataaatgttagctgttactttcatcacctctctttagttttgatgaatttggaaattcaggatggaagtgtctacctgcttgacatatctcaaaaattttgctcccttccttcaaatattcaacgttcaactaatatttattgacttactatgtgccagaccagtgttctaggcatggggctctaggagtgaacaaatgcaatgtaaaaattccctgccctctggggttgacactctggtgggggtgtgagaacaacatcagtgggaaaatggggtcagatggtgaaaggygctctggtcaccccagctgggcagtgccaatgggagacaccaggcatggccagcctcgggaagggtgtggggcccagggcagaccagcggggttcctggtgctgaggttaccctgtgtactattaaagcaggtaatggctcccagcttcgatggtgggtatatggaccccgttcagggatgggggctgaggagggcacaggaggactgaagacagggctctgaggagccacctgctctcgggtctaggtcagaccccgcatcctgatgcgggtcagctggctcatgatgcctggctggct

SEQ ID NO: 45046 - DNA, 601 bp, Human
tcatcacctctctttagttttgatgaatttggaaattcaggatggaagtgtctacctgcttgacatatctcaaaaattttgctcccttccttcaaatattcaacgttcaactaatatttattgacttactatgtgccagaccagtgttctaggcatggggctctaggagtgaacaaatgcaatgtaaaaattccctgccctctggggttgacactctggtgggggtgtgagaacaacatcagtgggaaaatggggtcagatggtgaaaggtgctctggtcaccccagctgggcagtgccartgggagacaccaggcatggccagcctcgggaagggtgtggggcccagggcagaccagcggggttcctggtgctgaggttaccctgtgtactattaaagcaggtaatggctcccagcttcgatggtgggtatatggaccccgttcagggatgggggctgaggagggcacaggaggactgaagacagggctctgaggagccacctgctctcgggtctaggtcagaccccgcatcctgatgcgggtcagctggctcatgatgcctggctggctcctgggactgagaggagagtgtggatggtc

SEQ ID NO: 45047 - DNA, 601 bp, Human
ttggaaattcaggatggaagtgtctacctgcttgacatatctcaaaaattttgctcccttccttcaaatattcaacgttcaactaatatttattgacttactatgtgccagaccagtgttctaggcatggggctctaggagtgaacaaatgcaatgtaaaaattccctgccctctggggttgacactctggtgggggtgtgagaacaacatcagtgggaaaatggggtcagatggtgaaaggtgctctggtcaccccagctgggcagtgccaatgggagacaccaggcatggccagcctcrggaagggtgtggggcccagggcagaccagcggggttcctggtgctgaggttaccctgtgtactattaaagcaggtaatggctcccagcttcgatggtgggtatatggaccccgttcagggatgggggctgaggagggcacaggaggactgaagacagggctctgaggagccacctgctctcgggtctaggtcagaccccgcatcctgatgcgggtcagctggctcatgatgcctggctggctcctgggactgagaggagagtgtggatggtcttgtctcagctttccgcccactggggat

SEQ ID NO: 45048 - DNA, 601 bp, Human
acactctggtgggggtgtgagaacaacatcagtgggaaaatggggtcagatggtgaaaggtgctctggtcaccccagctgggcagtgccaatgggagacaccaggcatggccagcctcgggaagggtgtggggcccagggcagaccagcggggttcctggtgctgaggttaccctgtgtactattaaagcaggtaatggctcccagcttcgatggtgggtatatggaccccgttcagggatgggggctgaggagggcacaggaggactgaagacagggctctgaggagccacctgctctcrggtctaggtcagaccccgcatcctgatgcgggtcagctggctcatgatgcctggctggctcctgggactgagaggagagtgtggatggtcttgtctcagctttccgcccactggggatccacctcaagcatcccctggctgtggggttgaggggtgggcccagaacagaagcttcatgtaagaaggtgactgggctggagaaaaggtggcagtgaggtttagccccatctccagcccctgggacctgtggtaaagatgtcctcacccacacagtgggctcaggcaggcaggaaaggttcc

SEQ ID NO: 45049 - DNA, 601 bp, Human
cctatgttatttagaaagagacaaggaacatcttcgttagcccccccatgactaaaaataggaagcttgccttgttgtgtttgaggagaagatggtgtgagtgggttttgtggctgaccgtttcacacccaacatttcatcacagaaatgcctgggaaaagaaaactcctaagaaaaaaaaaaaaaggaatgagtgttggacatgtccctatgacctgtttgtcatggcatgtgtgctcggcgccttggtcatcaggcttaactgaacttcggagaaggttctgtccaggagtctcattttactgggggctgaggcttaggagaaggaagcaacttgtccaggccaggcattcactatggaggaggctgagactcctgcgccctcggatgcacaccctgggcctctgttccagagctgtcttggctagcaagtatcaggcccttctcccttctcaggctggtcagaggtccagctgccctctggagtccccagagtctcccttcccactgtgacagcatcggctgtctctcccggtctcaggttggacagtcctgggagagagagggtctgagtgacttcattctgtcacttcattcatta

SEQ ID NO: 45050 - DNA, 601 bp, Human
ctatgttatttagaaagagacaaggaacatcttcgttagcccccccatgactaaaaataggaagcttgccttgttgtgtttgaggagaagatggtgtgagtgggttttgtggctgaccgtttcacacccaacatttcatcacagaaatgcctgggaaaagaaaactcctaagaaaaaaaaaaaaaggaatgagtgttggacatgtccctatgacctgtttgtcatggcatgtgtgctcggcgccttggtcatcaggcttaactgaacttcggagaaggttctgtccaggagtctcattttwctgggggctgaggcttaggagaaggaagcaacttgtccaggccaggcattcactatggaggaggctgagactcctgcgccctcggatgcacaccctgggcctctgttccagagctgtcttggctagcaagtatcaggcccttctcccttctcaggctggtcagaggtccagctgccctctggagtccccagagtctcccttcccactgtgacagcatcggctgtctctcccggtctcaggttggacagtcctgggagagagagggtctgagtgacttcattctgtcacttcattcattag

SEQ ID NO: 45051 - DNA, 601 bp, Human
agagctgtcttggctagcaagtatcaggcccttctcccttctcaggctggtcagaggtccagctgccctctggagtccccagagtctcccttcccactgtgacagcatcggctgtctctcccggtctcaggttggacagtcctgggagagagagggtctgagtgacttcattctgtcacttcattcattagtgactgaaacaggattctgttagctgacttctggtaggagccaggttgggaagccgctctgaggatgctgggagggccaacagctgcaattattattattattgttgttrttattattattattattattgagacagagtcttgctctgtctcccaggctggagtgcagtggtgtgatctcggttcactgcaacttctgcctcctgggttcaagccattctcctgcctcagcctcctgagaagctgagactacaggcttgcaccaccatgcccagctaatttttgtatttttagtagagatggggtttcaccatgatggccaggccggtcttgagctcccgacctcaagtgatccacctgccttggcctcccaaagtgttggacttacaggcgtgagccaccacgcctgg

SEQ ID NO: 45052 - DNA, 601 bp, Human
tatttcccagattgaatgcacaaaacatagtgatgtcaggcaggcacatcagaccttaattcagaaattatgaacttcagatactatcaccttttccctttgggggtttcagccagtgacagaaatcgtgaatggaccacatatgtgtataaacacacacacacacaaccatacacatatactctttgtgggtaacagcttggttggggaaggagcctgcgcatcattatctcagttaagctaatatttcagtttggttcagtgcccctccaggtctctgtctgtaagcatagctttctcytttttgcgatgacccaaacaataaaatacatttagaacttcaaagtctctgggaagatataccataatcattacagttctggcctgtttttggaagctacaaggcaggccaggagagcaatttatgtggctggctcagaagctggggaacacactccatcaccctctgcacagcctcaggggaggaaaggctggaacagctctaagaagcctcgctgcagatattggagggccagcaaggcgtggccgccagagcaggtggggtgctgggacacaggcggggcaatggaacctggaggca

SEQ ID NO: 45053 - DNA, 601 bp, Human
cagttctggcctgtttttggaagctacaaggcaggccaggagagcaatttatgtggctggctcagaagctggggaacacactccatcaccctctgcacagcctcaggggaggaaaggctggaacagctctaagaagcctcgctgcagatattggagggccagcaaggcgtggccgccagagcaggtggggtgctgggacacaggcggggcaatggaacctggaggcagacagatctgggtgtaaaacctggcttttgcaaatcctggctttgccatggtgagaagttaggtaacatgcccytggacaagttacctaacttctgagagcttaagctttctcctctgtaagagtgggttgacaatgccatccttgcatggtaggcccctatagatgtgctttattacagattattgtcatcaatgagaaatcacagatctgtgaagggctggctcgtggcctggagcagaacagggaccacatggatggaggcagctcttaggaattctattgacatattttcagtctttttctacactaaaaaagcttaaaaatgaaataattggaaatatactacatatcgttttggggtctgagtttatc

SEQ ID NO: 45054 - DNA, 601 bp, Human
ggccagggaggttgtactggccaaaaccaagaagcaggtgggagttgcctgttcatgtaaaggttttgagctttaggacaaaaggaagaggcccaaaggagagagcatctggcccctttcccttcactgcttcctttaaaatgatggaaatagacttggattctgatgtcaattcattgctgccaaaagaaataaataaggggctgaaatgtgcagctgatcccaaatccttcccggggaggtgtgatgctcccagatgctttcagacccctttgaaaagaaagttatggtcatttctggmtggaaaacattgtgagctgtccccagttgatccccagttgattgatgtagggaggtttgttttaccctaatacagtctgagtgttcctgaattcaccatttgctcttttcagccccatctgggtcttgtggttgggtagcatttcaggcaccaggaagtgcttgtgaagatcaaaatatttttgagggccagcactgtgttctgtccttctctgtgcttatgttggaccagaacagcaccagccctccttaggcccccatacatgtgtgctgagtaaatgattgcaggctgctcttatgg

SEQ ID NO: 45055 - DNA, 601 bp, Human
gtcaattcattgctgccaaaagaaataaataaggggctgaaatgtgcagctgatcccaaatccttcccggggaggtgtgatgctcccagatgctttcagacccctttgaaaagaaagttatggtcatttctggatggaaaacattgtgagctgtccccagttgatccccagttgattgatgtagggaggtttgttttaccctaatacagtctgagtgttcctgaattcaccatttgctcttttcagccccatctgggtcttgtggttgggtagcatttcaggcaccaggaagtgcttgtgmagatcaaaatatttttgagggccagcactgtgttctgtccttctctgtgcttatgttggaccagaacagcaccagccctccttaggcccccatacatgtgtgctgagtaaatgattgcaggctgctcttatggaactgtggaacatgaagaggctaaaagaagactggcttatgtgtagatcatcttatgcatagcaaataatggagaccttttcccatagttggacgaccccatgcaatgtagaaagtcagagttagtgaataagccagatcagaagcttctggtgtatatcactgtat

SEQ ID NO: 45056 - DNA, 601 bp, Human
gggaggtttgttttaccctaatacagtctgagtgttcctgaattcaccatttgctcttttcagccccatctgggtcttgtggttgggtagcatttcaggcaccaggaagtgcttgtgaagatcaaaatatttttgagggccagcactgtgttctgtccttctctgtgcttatgttggaccagaacagcaccagccctccttaggcccccatacatgtgtgctgagtaaatgattgcaggctgctcttatggaactgtggaacatgaagaggctaaaagaagactggcttatgtgtagatcrtcttatgcatagcaaataatggagaccttttcccatagttggacgaccccatgcaatgtagaaagtcagagttagtgaataagccagatcagaagcttctggtgtatatcactgtatatatagaatctagcacactgttggatatctagcaagtgctcagcaaatgagaagtggttgaaatttttgtgaaagagtgaatgaattagttactttattagttttctttgtatctccagtgggcctcaagaactgtaccaattaaatgaatggggagattaatagacatcagggagagcactt

SEQ ID NO: 45057 - DNA, 601 bp, Human
gccctccttaggcccccatacatgtgtgctgagtaaatgattgcaggctgctcttatggaactgtggaacatgaagaggctaaaagaagactggcttatgtgtagatcatcttatgcatagcaaataatggagaccttttcccatagttggacgaccccatgcaatgtagaaagtcagagttagtgaataagccagatcagaagcttctggtgtatatcactgtatatatagaatctagcacactgttggatatctagcaagtgctcagcaaatgagaagtggttgaaatttttgtgaaakagtgaatgaattagttactttattagttttctttgtatctccagtgggcctcaagaactgtaccaattaaatgaatggggagattaatagacatcagggagagcactttcattccatctcagcacacagagtggggccgagagcatggacctgggcacttggaagtcctgggttcgagtcccaagccctcctctcattcttgtggttgccatattggacataccgcctcaccccacagatctcagctgctcctcacatctgcctctgaaagctgtctctgacccatccacagtggcctcc

SEQ ID NO: 45058 - DNA, 601 bp, Human
tcccattggagagtgtgcctgagggcttgtgggcagtgctctgtactgcgagtcagaggccttgactttgaattctggcacaagccacccaccctcctctgggcctcagcctgtaatatctataaggtaaaaggccgagggctgttgtgaggatggatgagaacaaatacgtgaaaccaccttgtaaactgtaaggtgccttccagaaatcaggcatcattcttctaatgaccagctccctgaggaagggaatgtttcttttgtggcgtgcaccactcaggaccaagtgcagggccgccayacacacagtcactgcttggaaatgcttcctggatctcatctgctgcctttgctcagggctgtgttcccgccttcctttggaactaggagctatctctacttccagcttcgaaatgcccagaggtgcaccaagttccaacccagacaccctgatttgtagaggatgcaaagtaaatgataagggtagttaacacttacttggccaggcactgttctgggcactttgcatacattaactcctttattttcacaacagccctgtgaggtagtccagaatattatctccatctgacacaggagg

SEQ ID NO: 45059 - DNA, 601 bp, Human
tccagcttcgaaatgcccagaggtgcaccaagttccaacccagacaccctgatttgtagaggatgcaaagtaaatgataagggtagttaacacttacttggccaggcactgttctgggcactttgcatacattaactcctttattttcacaacagccctgtgaggtagtccagaatattatctccatctgacacaggaggcatgctggtgcagagaggtggagtgggcgttccaaggtcaggtagccctaaatggctgtcgcagggctgggacccagcagtctggccccggaggtcatgcycttaaccacacttctcggtttctctaagctgccctgggactgaaaggctgcagtggaggccacggggctcacctcccccacctaatccctagcaggagggaccatcagggtacttctcctgccaggacccctctctgctcctgtgcttcctggcttctctctccagtagctcctctgccgtccctgcctccctcccctgcccttggcctaagccaggagatgagagcagctgccgggacattcaaattcattcctgaaagaattctgcctccgaaatcctctggtttgggtttaagagaa

SEQ ID NO: 45060 - DNA, 601 bp, Human
ttggccaggcactgttctgggcactttgcatacattaactcctttattttcacaacagccctgtgaggtagtccagaatattatctccatctgacacaggaggcatgctggtgcagagaggtggagtgggcgttccaaggtcaggtagccctaaatggctgtcgcagggctgggacccagcagtctggccccggaggtcatgctcttaaccacacttctcggtttctctaagctgccctgggactgaaaggctgcagtggaggccacggggctcacctcccccacctaatccctagcaggmgggaccatcagggtacttctcctgccaggacccctctctgctcctgtgcttcctggcttctctctccagtagctcctctgccgtccctgcctccctcccctgcccttggcctaagccaggagatgagagcagctgccgggacattcaaattcattcctgaaagaattctgcctccgaaatcctctggtttgggtttaagagaaaacagaggcccaagctggcgtaatattgatgcccaaaccatgtaatagcggcacaacaaagaatgacgttcatatgagttatgagcatggaagcaca

SEQ ID NO: 45061 - DNA, 601 bp, Human
tctgggcactttgcatacattaactcctttattttcacaacagccctgtgaggtagtccagaatattatctccatctgacacaggaggcatgctggtgcagagaggtggagtgggcgttccaaggtcaggtagccctaaatggctgtcgcagggctgggacccagcagtctggccccggaggtcatgctcttaaccacacttctcggtttctctaagctgccctgggactgaaaggctgcagtggaggccacggggctcacctcccccacctaatccctagcaggagggaccatcagggtmcttctcctgccaggacccctctctgctcctgtgcttcctggcttctctctccagtagctcctctgccgtccctgcctccctcccctgcccttggcctaagccaggagatgagagcagctgccgggacattcaaattcattcctgaaagaattctgcctccgaaatcctctggtttgggtttaagagaaaacagaggcccaagctggcgtaatattgatgcccaaaccatgtaatagcggcacaacaaagaatgacgttcatatgagttatgagcatggaagcacaaattctaaataacac

SEQ ID NO: 45062 - DNA, 601 bp, Human
acagccctgtgaggtagtccagaatattatctccatctgacacaggaggcatgctggtgcagagaggtggagtgggcgttccaaggtcaggtagccctaaatggctgtcgcagggctgggacccagcagtctggccccggaggtcatgctcttaaccacacttctcggtttctctaagctgccctgggactgaaaggctgcagtggaggccacggggctcacctcccccacctaatccctagcaggagggaccatcagggtacttctcctgccaggacccctctctgctcctgtgcttccyggcttctctctccagtagctcctctgccgtccctgcctccctcccctgcccttggcctaagccaggagatgagagcagctgccgggacattcaaattcattcctgaaagaattctgcctccgaaatcctctggtttgggtttaagagaaaacagaggcccaagctggcgtaatattgatgcccaaaccatgtaatagcggcacaacaaagaatgacgttcatatgagttatgagcatggaagcacaaattctaaataacacatcagcaaactgaatctagccgtgtataacaaacataat

SEQ ID NO: 45063 - DNA, 601 bp, Human
cagccctgtgaggtagtccagaatattatctccatctgacacaggaggcatgctggtgcagagaggtggagtgggcgttccaaggtcaggtagccctaaatggctgtcgcagggctgggacccagcagtctggccccggaggtcatgctcttaaccacacttctcggtttctctaagctgccctgggactgaaaggctgcagtggaggccacggggctcacctcccccacctaatccctagcaggagggaccatcagggtacttctcctgccaggacccctctctgctcctgtgcttcctrgcttctctctccagtagctcctctgccgtccctgcctccctcccctgcccttggcctaagccaggagatgagagcagctgccgggacattcaaattcattcctgaaagaattctgcctccgaaatcctctggtttgggtttaagagaaaacagaggcccaagctggcgtaatattgatgcccaaaccatgtaatagcggcacaacaaagaatgacgttcatatgagttatgagcatggaagcacaaattctaaataacacatcagcaaactgaatctagccgtgtataacaaacataata

SEQ ID NO: 45064 - DNA, 601 bp, Human
ggtctcgatcttctcatctagaacatggggcctttattccagctctgctgagctgttgtgaggatgggatgaggagcgcatgggagagtgctttgtgaagcgctatttaacaacaccgttcaaatccagtcccatttgttactcggcattttcagggtggagcagcagtgcggacgcaggtgggagtgcctcctcctcttagagagccttggctttttgtctgaaggtcaggggccactgtggctggctgggacatggaagccttggctccaggccaccttggcagggctgcattctgtcratgactagaggatactgacctggatgctgggactcttcagcctctaaagggttgcagatgcttggacaggggctgtgcctgtgccagatgccaccaggcagcttccttcatggagtctgaattggacagagtggtggactttaactcagaccattgtccagtcagccccagaaaggagccaggagtacaggcagggaggactagggccacggaatcgagacaggacagaagttgacagtctgggctccgggcctggttccaccccacccaaagccagccgcgggatccaggcagtccctc

SEQ ID NO: 45065 - DNA, 601 bp, Human
gagctgttgtgaggatgggatgaggagcgcatgggagagtgctttgtgaagcgctatttaacaacaccgttcaaatccagtcccatttgttactcggcattttcagggtggagcagcagtgcggacgcaggtgggagtgcctcctcctcttagagagccttggctttttgtctgaaggtcaggggccactgtggctggctgggacatggaagccttggctccaggccaccttggcagggctgcattctgtcaatgactagaggatactgacctggatgctgggactcttcagcctctaaakggttgcagatgcttggacaggggctgtgcctgtgccagatgccaccaggcagcttccttcatggagtctgaattggacagagtggtggactttaactcagaccattgtccagtcagccccagaaaggagccaggagtacaggcagggaggactagggccacggaatcgagacaggacagaagttgacagtctgggctccgggcctggttccaccccacccaaagccagccgcgggatccaggcagtccctcagtgttcatgttctcatctgtagggagactgtattactatgtgtcaccc

SEQ ID NO: 45066 - DNA, 601 bp, Human
cagccctaatcatgggcagtagatgatgctattgggggtcattcattttggcctgacacaatttggagaaacaaagtgaaatcagttgtgttgaatcctgactctggggctcagtttccccatctgaagtatgggaaccacatcacccactttgctgaactcttgcaggggttggaaacagtgtagagtacagagtgggctttcacagaatggaaactttggtccctttcctgtgacctttgtcccactgcttctagctgggccttgcacttaccagctgggtccaccaggtggtcactawcacgactgcctggtactggcaggtggctgggcttcctcctgctctggcccagccctgcctgtaccctgagctcccaccacccagccccttatcctccctgcagcctccgtcacttgaggaaagtcaccaaaaccggcttcctctgtgcctcttacctttccagtaaagttctttctgtgcccagctagaccttctcttgccagagggaaatgggaacagtttgggcccagagagtcagtgggagggaggttcctacggagcgcccttgtatataccgcactgggccatattgtagttttc

SEQ ID NO: 45067 - DNA, 601 bp, Human
agggaaatgggaacagtttgggcccagagagtcagtgggagggaggttcctacggagcgcccttgtatataccgcactgggccatattgtagttttctgttgggtgtctttcttccctacctcagggacagttatctttgcattaatctttgcatgtccagagacttatagtgtctgacagtatactcttctcggcagagtatagcacgtttgtagcacgttctttgaatggaaagcatgctgagttcaaggtaactcttttccaaagctggtcgtaccttgacttagctttttggtctcrggcctcagtttcctcatctattacttagccccccaatcttgtaattctctgatttagatctggctgctcagccagctgcggaacctgcttcctgcgagtggaggaaggagttatcccaagtgtgactgatgaagttatgcagaggggagtgcttagcaagcacccttccacaggcaaaggccagctgctgctcacctgttgcgaagcaggcagggcagggggtggctgccgcatctcccctttgggtgatgtcaggacctttgctaggaatctgctcacagctttcctcatccacagtgg

SEQ ID NO: 45068 - DNA, 601 bp, Human
gccatattgtagttttctgttgggtgtctttcttccctacctcagggacagttatctttgcattaatctttgcatgtccagagacttatagtgtctgacagtatactcttctcggcagagtatagcacgtttgtagcacgttctttgaatggaaagcatgctgagttcaaggtaactcttttccaaagctggtcgtaccttgacttagctttttggtctcgggcctcagtttcctcatctattacttagccccccaatcttgtaattctctgatttagatctggctgctcagccagctgcrgaacctgcttcctgcgagtggaggaaggagttatcccaagtgtgactgatgaagttatgcagaggggagtgcttagcaagcacccttccacaggcaaaggccagctgctgctcacctgttgcgaagcaggcagggcagggggtggctgccgcatctcccctttgggtgatgtcaggacctttgctaggaatctgctcacagctttcctcatccacagtggttcctgatcacctagctaaattttagcagggaccagatgatcatgtccccgtcttccccagccttgccccagaagctcac

SEQ ID NO: 45069 - DNA, 601 bp, Human
atcatgtccccgtcttccccagccttgccccagaagctcacacccaggacccaggccctgcccagcacacatgtgaggctgggggagtaccttttagaacagtattcttacttgttcatttagatggcttgagtttttcaggaagaagaattctaaaacactgttgggtaactctcacccaagctgggtaatttataaggaacataaatgtatttctcacagttctggagatcgggaagtccaagattagggtgccagcagcttcagttgtctggtgagggctgctctctgcttccaagayggcgctacgttgctgcatcctcaggcagggaaggcaggaggctgagggactgaacactgcatggggcctctttgatacaggcctcaatcccattcacaagggaggagccctcatggcctcaacatctctgaaaggccccatctcttggcactaccacattggcaacatctgaattttggaggggacacgtttaaactgtagtgtccacctagtgcaggaaccccagggcctctgtgtgtgctactgtgacggagctgctggcccccctgggagaggctgccctaccaatgtctttagaaa

SEQ ID NO: 45070 - DNA, 601 bp, Human
tggcctggttctgcttctggagcagggaaaagaaggggttggtttcccgcatggtagcctccattgttggaagatggcaccccaccccatctctcctcagtctccctctctgttggcgttttggagcacggacctttcaaagactcaggcacctcttttcctcaggccagtgtgtccgggagagaaatgaaaacacaagaagcaatgcattttgtttatttaccaaaactctgactgaaaaccatgctctcccttggagagtccatttacttctgtggtttagctctcaccaacagctctyagaccgtgctaatcccctccccaggctgcaggctcacgttttacatgccaccggcagcccctggctccacacacaaaacactgaactcctcttgctccccagtatcctctcctcctttgcccttgatgacccaccaagtgcagtcattggttcagcatctatttaataatgttcttctaggtgcagagcccaggacaggagcccagttctctagatgagaaactcagaattcaccattgcttctcccaggggtcatcagccttgagtgaatctatggctctaatgaatggccctggtgcc

SEQ ID NO: 45071 - DNA, 601 bp, Human
tggaaggcaggctagcaggcagaatcataaaactcagttatgacccaggcttgaggaacgttctctactgagaatgtagacttcagagcagcccagcttggcgcaaatcatgctgtttgtcacatttagtgtgtaggtggcctttagcaagttacttaatccttcttagtctatttcctttctgtaaaataggactaataaccatactgtggaggccacagcaactccatcttggatgctgatcctccatattgacttccgattaacccagtttcgggaaagcctctaagatttctccttyatctactgtttactgtaagtcctgcccttaggcaaattgcttctgaagcacatatacccctttcctctggtatttaatccctgggactagggggtcgtggtgcaggatccaccatcttgtcttactgctgccagagactgtggcttttgttcataagtccctattaaatgcttctttctgagaaactggatatgtcagcccctttcttcagcctttcagcttcctcagcctttgggggtaggtttgaatatgcctacccacccggaaccagtacctaccagaaagggttattgtacagat

SEQ ID NO: 45072 - DNA, 601 bp, Human
tgtcctgtaggcagcagcagaaactatgagaaggtttcaagctggggacagagatgatcagatttacattttagacagcactcttcatctgcagcatgcaaatataggaaaggccaatttcagaggcaggaggacagtgggaagcacgtcatcatgggccaggtgaggggtgttgatgcccagagctggggcaggagtgaggaagggaggatgggagggatccagtacccctgggaggaagtgcctggctcagagccccaggcatggaataaggggtggggtgcagacacattcacatccrgaggcgtggagcagagcctggcatccttaataaagttgcagggatgggaggtgccgtccctacatccaggccaatgccgggcacgtagcaggtagtcagtgaatgtttattgaattaaactgaagagactactgtgacccaggatgggatacagagcagtggcagagttcatataatccagtcccagaatgggagcttcagagatcattaatttcaaattgtggttcttggccatattcaaagtaaaaggcatcaatcagatcaatggggtggagatccactcttgcctggggatatcaa

SEQ ID NO: 45073 - DNA, 601 bp, Human
acaaacatttattgtaggactactttgtgctaggcattgagaatccagaaataaagcagacctgattcctgcctttggaaattggtttgtcctagacctttatccactgtgacccagggtcataagtgccataatatgagggtctgtgaaacaccaagtggccacggaggagggagtgatgcatttctcccagagaggctgggcaggtttcacgcggagatgatgctgtgccctgcattcgccaggagcagagaccttgtatgctcaggacaaagctggcccagagcgtttcaggagaggaaaaaaaaagagaaggaagctgtgcctgtcctccgaagggaggtggaggctgcccaaaccccccaggtaggggctagagtccccatccttcttcagacacctggtagaggtttcctaagggtgtctctggctggttggttgatgaattagaaataccttcattgaacctccgagatcttgagacccccagacagacttctcagcctggctaggtttgagcatgtcagctccttaactcaggtgtgatgagcagatggaaggagggagctcgggccactcgtactgaaggggaggagacctt

SEQ ID NO: 45074 - DNA, 601 bp, Human
tggaaattggtttgtcctagacctttatccactgtgacccagggtcataagtgccataatatgagggtctgtgaaacaccaagtggccacggaggagggagtgatgcatttctcccagagaggctgggcaggtttcacgcggagatgatgctgtgccctgcattcgccaggagcagagaccttgtatgctcaggacaaagctggcccagagcgtttcaggagaggaaaaaaaaagagaaggaagctgtgcctgtcctccgaagggaggtggaggctgcccaaaccccccaggtaggggctrgagtccccatccttcttcagacacctggtagaggtttcctaagggtgtctctggctggttggttgatgaattagaaataccttcattgaacctccgagatcttgagacccccagacagacttctcagcctggctaggtttgagcatgtcagctccttaactcaggtgtgatgagcagatggaaggagggagctcgggccactcgtactgaaggggaggagaccttgacaaggaaattccagatgggggcctcctctgccaggtttacatccctctcctgtcccactttcatgagtgtgcc

SEQ ID NO: 45075 - DNA, 601 bp, Human
cccctggatgatcacagcacacaagggaaattgaaaatggggaatgtgttccagagaacagcgactggtgatggggattcactggagcgctgctcttctttgggcctcggcctcctgcctggcccagctgtgcacagtggggctagaaagaaagggagaaatagagagaggagctacaccaccaactgggcccgagaagtcagaacaccatggaataaatcctcgtcagactacactttgaagacagaaagctcagagctgatacattagcaagcgcctcagagacgatggtgtggccacrtcttgtctagcgctttgtattttttagagggttttcacatctatgaggccttgggcctggccgccttcacctttttgccttttaggtttcagcatagatatttcctcctccaggaactctctctggccatcgtcccccttccctgaccccagggtgccccttctaggagtggacctagcaccagctcttatagcagcggctcttacttgtccctgcgtgtcttatgttggttgtgaatactatttcttgcctgcaactcccttctctgactgtgggctccatggcagtggggactgtatt

SEQ ID NO: 45076 - DNA, 601 bp, Human
cagggtgccccttctaggagtggacctagcaccagctcttatagcagcggctcttacttgtccctgcgtgtcttatgttggttgtgaatactatttcttgcctgcaactcccttctctgactgtgggctccatggcagtggggactgtattggtttcactgttggacccccaaaggcatgagagtgcctagcacatagtaggtgctattcaatgagtgtaggctgaataaatgaatgaatgaatgacaaaactggggtaggcatggcagatttactccctcctcattctaaggagaaagtrgagcctctaacaggctgagagcctgacctgaagcccacagacctggcatctggcccgtgctttctgcatcctaaggggctgcgggtcccagcaggttgcccagtgagctggccatgcccaccatggccctccctgccactctctgggaggcccacctcgatcccagcaccttttcacttggatcggccgctggccatggattgccatggttactacaccagccctggcagtctctgtgtgacattttggttttatttgctaaacatttaaacacttgggcttaaccctttctgcctcaga

SEQ ID NO: 45077 - DNA, 601 bp, Human
cagagaagagactggtgaataatactgcataaactctgaaccagtgcttctcacatttggattgagaaaaagtagtttgtaattgccctgggagctttaaaataatactggtgcctgagtcccacccctagggattctgatttaattgctcaattgctcaattgctcaggggaggcattgaatagaggcgatttttccaagctccccaggtgatttgaaagtgcatcagaatgtgagaatcattgccctgaactaacccatggccacagccattccccctacctgacaattgtgtccatartctgattagaccatgcccagaacacacccctcccaccttttgggccttttccctgaacgcccaggtccccctgtttcctcttcaccgcctcactcgaaccctgactgtgtgccgagcagcattagatgtgtagagaggaccctcccatgggaaatggggcatattctctcctctggcatctctcacgcccctcttgcatggctgtctgcagaatagaattgttttaatgtcctctttgtatatgctatatttctatagagtctttccttgaaaatgtaattcactatgttttcggtgtct

SEQ ID NO: 45078 - DNA, 601 bp, Human
ttctatagagtctttccttgaaaatgtaattcactatgttttcggtgtctgcatcagttcagcttgaaaggcagtgtgtgcagagggttggaggtctgactctggagccagactgcctgggtgcaaagccgaaccctgccagttcctgactgagcttggggtgaacgattctagctttctgtgcctcagtttcctcatctataaaatagggatcagaatagccgttacctagggttggtgtgagaactaatgctttcatatatgtaaaagggattaggactatgtatttgctcatgttacyagtattgctactactcttgtcttcaccgagatctgtgggattcagttaatttcagcagataccgattccctactcagtgccaggatgggaaagaataagatgtgttctctgccttcaaatagttcatggtcttgggagggagagggctggtaaggagaagggaaggagtcaaataggtgaacagctaattaatgatataatacagtgttgacttggaaccacgttgctgtggaataataaagatggggacatcatgatgtggggattcaccatggtcgtgaaggcatatcatgaattcta

SEQ ID NO: 45079 - DNA, 601 bp, Human
ggctgcctcccaacgtgggatgcagagctgcagttgccccagcacaaagtcagtttcatgctcagctacagaactaatctcagtgacctttcctgggtcccatgctctgctgccagatctcttgtgggatgaggccaccatgctgaccaagaagctccagaccacgatcagctggctgtccgctgtaggggcacaggtctccccaccccagggcacttgcggattcaggaaggaggcagtggaggctctccttgctttcagtaggagctaagccttttcaactgcactctagggcatttcyagcaaattcctacatgaccctatgcaggggaggggacacaaccctggtggcttcactttatgggttgaaagtctctgtgggctccaaaagcgggtcagcctgccctcgttttctggagactctgtctacgctctttggacagttcacagggataatctctagaggtgccctggctagaacacggagatgcctggcactgctgtgcattcatccaatgagtgacagtgatcttgagcccttgacctaatccgacagtgtgacctaatcccacagtatgacccaatccatttggcattaatg

SEQ ID NO: 45080 - DNA, 601 bp, Human
gggatgaggccaccatgctgaccaagaagctccagaccacgatcagctggctgtccgctgtaggggcacaggtctccccaccccagggcacttgcggattcaggaaggaggcagtggaggctctccttgctttcagtaggagctaagccttttcaactgcactctagggcatttctagcaaattcctacatgaccctatgcaggggaggggacacaaccctggtggcttcactttatgggttgaaagtctctgtgggctccaaaagcgggtcagcctgccctcgttttctggagactctgkctacgctctttggacagttcacagggataatctctagaggtgccctggctagaacacggagatgcctggcactgctgtgcattcatccaatgagtgacagtgatcttgagcccttgacctaatccgacagtgtgacctaatcccacagtatgacccaatccatttggcattaatgctggctgagactggagaccactgacctcttttcctttcagtttgatcatataataagaactgtgttagtataaatcattatttaaagtgtgctttaggccaggcatggtggcacatgcctgtaat

SEQ ID NO: 45081 - DNA, 601 bp, Human
ttgctcttattactacattagtttaaacaatgtctcccatagaggctgctcctgaattagtagtgtattcttgccataaattacacttgggaatagcctgattaatagtcagagataagaggcctagggtgtaaactccaccaaattgttcaatgtgtgagactttgagttagaaggcttggcgaatgtcctgcctcgctatttgctgccttcatgggtataactaatgtaccttctcctcatctgtgaatggggataatgatgttcctgagctatggagaggaccaggcaagcactgtgygtcagagcacctggcatagggcctggtacaggtcaatgcccacctattttctgtccttcctttcttcctgtttgttcaaaccaggtctgaggctaacagatgtgtcttggtgagtccaagagggtggctgggccataagggttgggggagtggagaagtggggctaccagttgctgctggcaatttgcaatatctaccctgtcccaggaattgtaccctggcctctcgggatgatttagtatggcagtcatggagctgaaagttacaaatggaggctccagtgatggagctggatttcct

SEQ ID NO: 45082 - DNA, 601 bp, Human
ccaagcagatcacccccatgtccacaagcacaccgggattagatacatttaagtcctagatcccaaacgcctttttcatttctggttttgcatttgtttccattctactatcttcatttggaaaaccctttcattcctcaagaaaacaagccacacaatcaaaaaaagatgtgtcttatcctctgggcgctgcctcattgcctgccccattattgaccaatgccaccggagtgccttgcacagcttggccagcgttcgctgtgcacatcgaccagtgagctggcatgctgacagcggcagrggcccccagcttcagacacttctgaacccagctgctttacggacacaatcggttgaatcggttgaatcatgacttgtctcccaaaccacaaatttgtaactagttcaccgtgagcctatgcagccagatgaattgtaacttgggcagtccctgcacctaaattttttttttacccaataaaaaatgatatctagacatctctgtgtgcatgaaagcatgtctgtacgtgcgtgtgtatgtttggcaccaatgggaaatacagagacgtggaatgccagctctgccctcaacctcttccca

SEQ ID NO: 45083 - DNA, 601 bp, Human
cctccttccaagtgctgttctcatctcttaagcctgagctgtcctccctgacccacccccaccaactttcagtgcccccacggagcctcatgcatacagacgtctcttgctgcacctcttatatgcaatatattcctctgtttacatcactgctcatttactgagttatatgagggtggtccaggcccgtgcctctttgagtccccatgccttatacagcatctgacagaagggtggctcagggaatgtgtggcacagcagtgaatgatgtgcagcttccaccgtacttccagacatgaaytgatggtcctggaaccttcagagaagccttaccacgttgtgatcagtaggtgggggactcgacactaccactgcagaggtggctttgtggggtggcccctgtgtgcgctcttatgtttgcaaagtgcgttctttcacgcagtcagcctaccaatgggtgaccagattctttcttcagaagccagtcagaaaagggacttggcttcccagattacgcaaaggcaatctaatcccagaccttcagtttttggttagccagcggctgcacaagtgtcacagaccacaggggctgggcgacggg

SEQ ID NO: 45084 - DNA, 601 bp, Human
ttgctgcacctcttatatgcaatatattcctctgtttacatcactgctcatttactgagttatatgagggtggtccaggcccgtgcctctttgagtccccatgccttatacagcatctgacagaagggtggctcagggaatgtgtggcacagcagtgaatgatgtgcagcttccaccgtacttccagacatgaattgatggtcctggaaccttcagagaagccttaccacgttgtgatcagtaggtgggggactcgacactaccactgcagaggtggctttgtggggtggcccctgtgtgygctcttatgtttgcaaagtgcgttctttcacgcagtcagcctaccaatgggtgaccagattctttcttcagaagccagtcagaaaagggacttggcttcccagattacgcaaaggcaatctaatcccagaccttcagtttttggttagccagcggctgcacaagtgtcacagaccacaggggctgggcgacgggcatggtggtccctctgctttcctgggcacgttaggatgtcattctctcacaggactcgtttcagagaattttccgtgtaaatgtgaaagacctaaatttatgcctg

SEQ ID NO: 45085 - DNA, 601 bp, Human
tgctgcacctcttatatgcaatatattcctctgtttacatcactgctcatttactgagttatatgagggtggtccaggcccgtgcctctttgagtccccatgccttatacagcatctgacagaagggtggctcagggaatgtgtggcacagcagtgaatgatgtgcagcttccaccgtacttccagacatgaattgatggtcctggaaccttcagagaagccttaccacgttgtgatcagtaggtgggggactcgacactaccactgcagaggtggctttgtggggtggcccctgtgtgcsctcttatgtttgcaaagtgcgttctttcacgcagtcagcctaccaatgggtgaccagattctttcttcagaagccagtcagaaaagggacttggcttcccagattacgcaaaggcaatctaatcccagaccttcagtttttggttagccagcggctgcacaagtgtcacagaccacaggggctgggcgacgggcatggtggtccctctgctttcctgggcacgttaggatgtcattctctcacaggactcgtttcagagaattttccgtgtaaatgtgaaagacctaaatttatgcctgt

SEQ ID NO: 45086 - DNA, 601 bp, Human
ggcatggtggtccctctgctttcctgggcacgttaggatgtcattctctcacaggactcgtttcagagaattttccgtgtaaatgtgaaagacctaaatttatgcctgtctcagtaactaagtataggctacttatggaaccacccagctatgggaaatccagccatgacaactaactgtgaagaaatagccccccttattacacagagcagacatcctcagggattggatgaaaaagagctctctaggaagtcagtgaaaacgagctccctgcctcctcagagtatgcctggtcaatgtrtgacaggctcgctactgggttcccatgctgcatccataacagacataaccaatcgatcccagcattctttctagatgggctcaaagtccttcctccctccagtgccacctccatgcacaatgcctagcctcaggcatactgctgctcctgcacctctgtgaatgagccctccacagaggtccacctttggtccatggttgatccatggaccaaaatgcctgttccttgtgggcctcaagacagctgaataatctactaattcaaagggagaccagaaaggcaatagtcaaagataataaa

SEQ ID NO: 45087 - DNA, 601 bp, Human
gaaaggatccagtgtgatggaatgacggatgctctcccacccagattatgtgcaaaccctggaatgaatccgcctccacactgactttggagatctggggcaggtcgggtttccaactgcaggtctttagtattccttgactaagtcagcttagtcaactacgttaacgaggtcaagtcaagctaagttaactactccagccattcttagaggtatttcactgcaggctttttgtgttctatttctgcctttccccccacaacagttgggtaacagtccccagcatagtgaataagttctrtaagatttaatattgatttgttggagtttttaaaaattgaaagtataattaatgatttattgctactttgcagtttgcattaatcactgtcattaatggtaatccttttaggtggtttataacttttaaatggagtctgttaattcccaagcctggtggctttgtctctaggctgcattggggtctgccaccctcccatgcccccgacatccctccccatcaccccatttgctttaagatacagggatgaaactccaggtgtaaacttttcagggtcagcctcttaccaaggaacagaca

SEQ ID NO: 45088 - DNA, 601 bp, Human
ggctcacgcctgtaatcccagcactttgggaggccgaggcgggcagatcacctgagatcaggagttcgagaccagcctggccaacatatatgttgccatatatgtagcgaatcctcatttctctactaaaaaatgcaaaaaattagctgggcattgtagtgcatgcctgtagtcccagccacttgggaagctgaggcaggagaattgcttgaacccaggaggcagaggttgcagtgagccaagatcgcaccactgcactcctccagcctgggcgacagagcgagactctgtctctcaaaacaaacaaacaaacaaacaaacaaaaaaagcaagcattcctaacctggggcccgtgaactcccagaaactagctgcaatacatggtgtgtttctgtaaatgcttcttgttctagggaaagcaaattcatagctcgcatcaggttttcagtgggcttaggatgtcaggagggctcagtctagagagtaacaaaagcagcacctccttcggaatcccccaaggccctgcctgtcctgagtgccgcctctccgatggcagggcaggtgtgaaggagcaagtcattcacttcttggttcctgtccc

SEQ ID NO: 45089 - DNA, 601 bp, Human
caacctccacgttagtctagtgaaactgattccacacatctggcctccggagctgtaatataataaatctgtgttgttttaagtaatgtgttacagcagcaataagaaatgagtgtacgtggactctggggccagactgcctgggtctgagtaaaccacttaccagctgtgtgaccttgggcatgtcacttaatctcttcatgcctcagtttcctcatctttcaataataaggcccaccacaaaagggctgctatgaggagtaaagaagctagtatgtgtaagtcattgagactagcaccyggaacctagtaaacgctgtgttaagtatttgttaaataaaataactaaaaagcacgtgaaggtggctggctcacaggaggctgtggggtgatgcgagtggatgctgacgggtttggcggcgtgggctgtgctccgtggagtcagttcaggaaggcaggggagtatttggtgcctctcaggaagactatggtaatcttcatgaaaatgaaccatggatgcttgaaggaatgaaccctccattgtctgttacactgaatgcctcacaccctgcatttcccagtgttccttgaaatattaata

SEQ ID NO: 45090 - DNA, 601 bp, Human
ttcatgcctcagtttcctcatctttcaataataaggcccaccacaaaagggctgctatgaggagtaaagaagctagtatgtgtaagtcattgagactagcacccggaacctagtaaacgctgtgttaagtatttgttaaataaaataactaaaaagcacgtgaaggtggctggctcacaggaggctgtggggtgatgcgagtggatgctgacgggtttggcggcgtgggctgtgctccgtggagtcagttcaggaaggcaggggagtatttggtgcctctcaggaagactatggtaatctycatgaaaatgaaccatggatgcttgaaggaatgaaccctccattgtctgttacactgaatgcctcacaccctgcatttcccagtgttccttgaaatattaatagctgttacttcaaaacaagagtcaaggtcaaataagtttgagaaactgcatttcaaagccgacttgttttcttttctttagaagtctcagaagctttaatatgctaatgagcctgatgaatctctgagaagcatttttcaaacatttggccactcaaccactttgtatggtgcttccaacatggccagcactcggca

SEQ ID NO: 45091 - DNA, 601 bp, Human
gttacactgaatgcctcacaccctgcatttcccagtgttccttgaaatattaatagctgttacttcaaaacaagagtcaaggtcaaataagtttgagaaactgcatttcaaagccgacttgttttcttttctttagaagtctcagaagctttaatatgctaatgagcctgatgaatctctgagaagcatttttcaaacatttggccactcaaccactttgtatggtgcttccaacatggccagcactcggcagaaggcgcctcagagcaagcctgtatacctgtgcctgctacagaggtgkgtgaaggtgggacaacccatctgagaggcagtgtcaggggcctgtttgcctgacctcagaactaactagaaaatgcagctgctgctgctcctgtcattcatatcccagacagtcagaaagggttaccgacaggcccatccatccctgtttccttcagggcctgggccagcctccagtggaggcgcctagaccctgaggccccagaccctagcatgcccctctcttgcctccctcctgacccaatctaagaccctgagggcactgtggatgccacagccctcagatctaaacttcatcctg

SEQ ID NO: 45092 - DNA, 601 bp, Human
cagtcacattgatatagttttgacaccttaaaccctttatgtattcatttgggtggccctgggcgctgtgcctggcactgtggaggacagtgaccaaggagatgtctgtcctcaaggacccctgctttagtgagggtgctgacaagcaggtggacaggaatgcggctcagatggacgatcaagaaggaggtttcggccagaatggaaacttaatagatgagagtgtggcctcttggtttaaatcctgtctccaccacttagttgctatgaggtctgggggatgttcacttttcttatgggrctattgtgagactcaaagagttgatgtaaagaaaagtgcttaggaggccaggtgtggtggctcatgcctgtaatcccagcactttggaaggccgaggatggctgatcatatgaggctaggagtttgagaccagcctggccaacatcgcaaaaccccacctctactaaaaatacaaaaattagccgggtgtggtggtgcacagctactcgtggtagctgggtactaatcccagctactcgggaggctgaggcaggataattgcttgaacccaggaggcagaggttgtagtgagccataatc

SEQ ID NO: 45093 - DNA, 601 bp, Human
agacttagcagatgcacagaaacctttgactcctggatctgccaaggcacacaaagaaccagaaacacctattggcctggcctgggataggcaaacactggggctcagcccaacaagccttcctagcacagcctggggcagcacacacagtagtcaagagagctgcctgccctggctgtagagcctaggtctgccccttattaactgtatgacctgtagtaaattatttagcctctccgagcctcagtttccctgtctgtaaaatagaaataagaatacctgtctcaaaaccctgttaagractaaatgagatggtgcctgtaaggcacacagcacaggacctggtgcacagtgaggctgcaatacatggcccctgctgttaccattgttaatggagaccgccgccctgctccctccgccccctgaaacgggggctagcactccccaactgtctggccatccttctccagctgccatttggggattggctctgtgacaagcagggggcacagggcctggggaatactggaggaaggcacccagccccacctgggagtcagaagggaccagcttaggcctgtggaagggtgggacgctggat

SEQ ID NO: 45094 - DNA, 601 bp, Human
aggtgacatgatttggtttgtattttagaacatttgctctggcagcaatgtaaagatggctggggtggagcacatgatgagaccaaggtgtggccacagcaacccaaggattggccggggtcacttggccttactgcttcaaatataattggttacaaactcccaccccacacaggaggggacccggtgtctttccactggtctctgggggcttggaaacttccatttctctcttgacagctcatctgatgccaaactctttctgctgaattctccacctccatcctgtacttagtaaccsctttaggcacccttcctgttcctgttgctcctcgagggacccatgaccaaggcctctaggttagctgacatttccatggatctggagcaaggggaaggggtgaggtggtggtggcacaacagataagacagcgctgaacgccacatgctcctgatcttacagtctcagcactgtccctgtctcatgggtggtcaagtcctcagtgggctccggcctccccctctcatgggactggcccaaggtgctgcttagccagctcccctctccttccagtcccacagctcacaatcccccatctcc

SEQ ID NO: 45095 - DNA, 601 bp, Human
tgtattttagaacatttgctctggcagcaatgtaaagatggctggggtggagcacatgatgagaccaaggtgtggccacagcaacccaaggattggccggggtcacttggccttactgcttcaaatataattggttacaaactcccaccccacacaggaggggacccggtgtctttccactggtctctgggggcttggaaacttccatttctctcttgacagctcatctgatgccaaactctttctgctgaattctccacctccatcctgtacttagtaaccgctttaggcacccttcctsttcctgttgctcctcgagggacccatgaccaaggcctctaggttagctgacatttccatggatctggagcaaggggaaggggtgaggtggtggtggcacaacagataagacagcgctgaacgccacatgctcctgatcttacagtctcagcactgtccctgtctcatgggtggtcaagtcctcagtgggctccggcctccccctctcatgggactggcccaaggtgctgcttagccagctcccctctccttccagtcccacagctcacaatcccccatctccagtgttcctgttcatttc

SEQ ID NO: 45096 - DNA, 601 bp, Human
cagtgttcctgttcatttctagggcacatatattaagccctgtgttggtctcctctgaccccaccccaagcctgtccagaggaatcttcttcattagcaaacatgctggggtgcataagtgggctcctaaactaagatggtctcttcctcgctagggaccccatcaccaggtctccatagaggcctgttcactggcgggaagaggaggaagggaaagatgataaatggatattgtatctgtggaaatgaaagccgtggtcttagttccacaaacatagcccagtctagattacagataacratgtgggtttcccaggtggtgtggacaccagggatagaacccagtttattttaatcatatattgattctctggtcagcaaagattcttctgagaatgagcatttaaagggtgggcttgagttttctttcttttcttttttcttttttttttttttgagatggagtctcgttctgtcacccaggctggagtacagtggtgcgatctcgactcactgcaagctctgcctcccgggttcaggccattctcctgcctcagcctcccgagtagctgggactacaggcgcccaccaccacgcccgg

SEQ ID NO: 45097 - DNA, 601 bp, Human
gtgagcctccgcgcccagccgagttttctttagaagacaaagtaaagcccaaactggccagcccccaaatagagtgcctgcttagcaggctggcaggtgaaagggcgtgggacttggaagacacagaatgctgcaagccccaggcaattgattgaacctgtcttggtttgggtttcttcatctgctaaatggatgtatgactcccttacagggacattatgagatggcaatgaaatggtatgtgcagaatcacctggctcggcccacagtctggcttttgggtaattttgacacaaaaggraatagctatgaactgaattgtgtctccccaaaacgcatttgttgaggccctaacctccaatgtaactgccttggagaaagggtctgtgggaggtaattaagtttaaataaggtcataaggatgaggtctagtcctataggactgcagctctaggagaagagaaaaagagagatccctctccctttctctgccatgtgaggacacagtgagatggcagccacctgcaagccgggaagagagcctgaccgtgttggcaccctgatctcagacttccagcctccagaactgtgaaaaaataca

SEQ ID NO: 45098 - DNA, 601 bp, Human
tacctttgcaaggctcactttggattcagaggtcccttccatagagagccctccctgtcctggctgtctgggacttctctcatttcctttgccctgtcttattctcttcctggcaggcatcactctctaaaattaaatggtttacctgtttaatatctgttttcctcccctgaaatgtaagctctgtggggacaggggccttgtctacttgtcttgctatatccctagagcttaccaaggactgtcacataatgggggctcaactcatgctcaatgaatgaatgagtgaataagctgatcrgggcaaagctccctgcctgtgcatcgagcacctcttgaaccagaccccaaacacttgatttccagcatcacaccttgtctctccttacaactagagaccagctggtccatccaaaggatttccagtcaaagggttctatggagagcatggggtccactacagagacctaggctggaggaggaggtgagtgagttgatctttgaatgttcttctctaccctttcaactacaacagctctgaatttgtctgtttcccatgttgggcgtacatgaaaaatcttatgaaagaaatggccccaca

SEQ ID NO: 45099 - DNA, 601 bp, Human
cctggccaacatggtgaaaccccatctctactaaaaatacaaaaattagccaagtgtggttgtgggtgcctgttatcccagttactcaggaggctgaggcaggagaatcgcttgaacccgggaggcagatggtgccattgcactccagcctgggtgacaggagtgaaactctgtctcaaaaaaaaaaaaaaaaaaaaaaaaagagacagagagagagggagagagaaataggctgtacttcttgattggaagagaggcaaagtcacatgtacagaagtaagtgaatgggatgggaggaatytgtggccttttctgcaagctgccccctctggtgtgtctgatgcatgccttccgggcgctgctgaagccctatgtaacccaagaagcttttcaaattgcatcctaatcatgcatgtcttttgctagaactacttgagattgtgcactgattcatgggacatgtgtttgattcagatttatatacccacaatggcctaaccttgttgattcttaataattattatattgaactgagttgggttagttctcctttttctctaattacaagctccttaaaggaaagtttggaatcactgttgca

SEQ ID NO: 45100 - DNA, 601 bp, Human
tgaacccgggaggcagatggtgccattgcactccagcctgggtgacaggagtgaaactctgtctcaaaaaaaaaaaaaaaaaaaaaaaaagagacagagagagagggagagagaaataggctgtacttcttgattggaagagaggcaaagtcacatgtacagaagtaagtgaatgggatgggaggaatctgtggccttttctgcaagctgccccctctggtgtgtctgatgcatgccttccgggcgctgctgaagccctatgtaacccaagaagcttttcaaattgcatcctaatcatgcmtgtcttttgctagaactacttgagattgtgcactgattcatgggacatgtgtttgattcagatttatatacccacaatggcctaaccttgttgattcttaataattattatattgaactgagttgggttagttctcctttttctctaattacaagctccttaaaggaaagtttggaatcactgttgcataaaatctccctcccagagctctcagaattatactaacggctgaaaatccggcaagttctcagaaccaccagttaagtggtagagggattaggcctagagccacctctggac

SEQ ID NO: 45101 - DNA, 601 bp, Human
tctcaaaaaaaaaaaaaaaaaaaaaaaaagagacagagagagagggagagagaaataggctgtacttcttgattggaagagaggcaaagtcacatgtacagaagtaagtgaatgggatgggaggaatctgtggccttttctgcaagctgccccctctggtgtgtctgatgcatgccttccgggcgctgctgaagccctatgtaacccaagaagcttttcaaattgcatcctaatcatgcatgtcttttgctagaactacttgagattgtgcactgattcatgggacatgtgtttgattcakatttatatacccacaatggcctaaccttgttgattcttaataattattatattgaactgagttgggttagttctcctttttctctaattacaagctccttaaaggaaagtttggaatcactgttgcataaaatctccctcccagagctctcagaattatactaacggctgaaaatccggcaagttctcagaaccaccagttaagtggtagagggattaggcctagagccacctctggacagagcaactatctgaggaaagaatggaattttcaggaaaccagagactgtggtactgacac

SEQ ID NO: 45102 - DNA, 601 bp, Human
ccgggcgctgctgaagccctatgtaacccaagaagcttttcaaattgcatcctaatcatgcatgtcttttgctagaactacttgagattgtgcactgattcatgggacatgtgtttgattcagatttatatacccacaatggcctaaccttgttgattcttaataattattatattgaactgagttgggttagttctcctttttctctaattacaagctccttaaaggaaagtttggaatcactgttgcataaaatctccctcccagagctctcagaattatactaacggctgaaaatcckgcaagttctcagaaccaccagttaagtggtagagggattaggcctagagccacctctggacagagcaactatctgaggaaagaatggaattttcaggaaaccagagactgtggtactgacacattgcatcttcaggtcagtcataccctcaatgagtgaaatcacttttttaggcttaggaggcagaaagagtcagtgactcgaagaatgtggctttccttttcccattcagggaagccagagtacaaggagcaaacctatgcctcatcaggaagagactcgtttgtcagccctgggcct

SEQ ID NO: 45103 - DNA, 601 bp, Human
tcccatagtgccctgtagtttcccttcaggatcctcatgggtgggtgggtggggggctggctgctcagagggccatcaacacatttttgttgaatgaatgaatgaatgaacaaatgatcctttgtagtttattaaaccctttcaatccattgtctcctctgctctccagtatggctctgtaagggtacggagcagggagaaagagaaactgaggctcggcaaggtaagagacttgcctcctagtgctgcctcccctgtctgtgcctctcagggcccatgaattgcctggaatgttcccctygctgcagaaacatatcacaggtagatgctaaaagcaaggcaagcatcgcccgcccacaccacaccaggcctggtaccataggtcctctcctgggtcctcagttcttgctgaactgtaaggaaggcagcaaagtggagtgagaaagctgcttggtgactaactttgaagcagagcagaagcttcctttggcccagaccatcaaggagacagttgggtggacagaataaagggctcctcattccctgatctccctgtgcaagggaggaaaggaaggcttcactcggctttcagccagccccc

SEQ ID NO: 45104 - DNA, 601 bp, Human
tcaccagattggttcccctggcaaccagcgccatcctgaggccaccctggatccccaccccgaccgaccccagccactagtcatctcattagcatacaaatgacacttatcactttggaaattccgagcgttttgggaactgtgcctaaaccaggataaagaccaagtacattatttcttattataaatcactatatctcaggcagcgatttgcagaggaggaaagtgaggccaagagagtcaaagtgtcttagccagggcttcccaggtagactgaatccagctctccctactccacatmcagggctcttgccacatagcaaggcccctaaagagcatgctgaggtggtcaggctgacctgagcccagcagcctgccccagcctgccccacctgtcctgcctggaccctgctgtgggcttcctggtcctggccacactaatggactttctgctcccaccagctcttcgtgatcgacaacggcgcggatgactggcggatagccatgacctacgagcgcatcctctacatcagcctggagatgctggtgtgcgccatccaccccattcctggcgagtacaagttcttctggacggcacgcc

SEQ ID NO: 45105 - DNA, 601 bp, Human
tacaaatgacacttatcactttggaaattccgagcgttttgggaactgtgcctaaaccaggataaagaccaagtacattatttcttattataaatcactatatctcaggcagcgatttgcagaggaggaaagtgaggccaagagagtcaaagtgtcttagccagggcttcccaggtagactgaatccagctctccctactccacatacagggctcttgccacatagcaaggcccctaaagagcatgctgaggtggtcaggctgacctgagcccagcagcctgccccagcctgccccacctrtcctgcctggaccctgctgtgggcttcctggtcctggccacactaatggactttctgctcccaccagctcttcgtgatcgacaacggcgcggatgactggcggatagccatgacctacgagcgcatcctctacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagt

SEQ ID NO: 45106 - DNA, 601 bp, Human
aatcgtatctcctacctatttttgagacattctgtttgcagacatttctttcagcgttttggccaacagacacacggtcaaactgagagggcattctgctgccgcagaacaagggttcaggctccaggatgcaggttcaggttctgagagccagtgcagtgttggaagacctttctcacacacagagccccagggacacaccatgctcacctattcagaacctcgccattactcagcagctgacattgcaacatctgctctgagtgggaccacactgcacagggcttcatgagccttctcyggtaagcagacactcttcccccaatggagaaagcatgtgcttgggttccgaccccaaactcttcatggtactgttagctgagcaacattgtgctggtcgcttcacctctctggacctcaattttcttatctgaaagctggacacaggatttattgttagagtcaaacaaggtgtatatatgcactatgtactgcaatccaatgatggtgaaagttaataataatagtgcagatcccttgataactcttgggaattttgtgctgccttcttttaattagaacagcccaacttgtaccatac

SEQ ID NO: 45107 - DNA, 601 bp, Human
aagtacttagatgatgcaccttatttgatattgcatggccttccatagcttccaagctgaggctgggttagtttggtccctggtgggccactgggtctctctctctctctctgcagacatgggtcacaagcccccgctaagaccaaggcacagaggaacaatgagcaaatcggaaattctctgaaagttcccttctcttgcgaaaaggccatttgaccaaagacttaggtataacatgaggtgtattaaagcatggtggatgttattgttgcacccctgtgctagttctgtgtaaaatccatgtcatcccagcttgccctcacaatagatctatgagagaggtaccttgcctgagggaaggagagcccgggtcctggaggggcatttgggtgaagcaacatgtcatccactacatggatgtgtttgaattggacatgaaggctcatgggagagttgaggaaactgatagaaagtaactggcccgaggtcacagagctattaataataagcgtggagccaaaatctgaactggtttctgactctgaacttccatgtgtgtgtcaccaacccaggctgaatcctgcacatacgaggaaatctt

SEQ ID NO: 45108 - DNA, 601 bp, Human
ctccttcccttagctggggttgtgactgagtccctctcttcaggtcaaaccccttgcctgggggcagcaagctcccgaggggatttgtcagtgtgggagttcaaaggcctaaccccgtttgcttctagtaggacactcagccaggctccagggtccctgagggatcgcctaaggcctctgttaccactgcatccgggaacttcctctataccccagaggtattgatcctgagagcagccccagtaaaactcccacccccaaatctcagcatctcacagactgtttcccaggaatctgcccygttaatatattgtttcctaaacaggcaaagcacttctcttaccaagactaagcactatttttagaatcaagcttaaatgatcattctgtttcccaatgtcaaataataagtaagattggcagaggccttcagccaggacttattcagccagagactggacagaagctggaagcaggggaagctttggggaactgaagcgtcagaccagggtagtgtggacaggatgccttgatctctctcagcctgatctaatgatgattctatcaccttaggcatcagagagggtaagtgacttgccca

SEQ ID NO: 45109 - DNA, 601 bp, Human
ggggttgtgactgagtccctctcttcaggtcaaaccccttgcctgggggcagcaagctcccgaggggatttgtcagtgtgggagttcaaaggcctaaccccgtttgcttctagtaggacactcagccaggctccagggtccctgagggatcgcctaaggcctctgttaccactgcatccgggaacttcctctataccccagaggtattgatcctgagagcagccccagtaaaactcccacccccaaatctcagcatctcacagactgtttcccaggaatctgccccgttaatatattgttkcctaaacaggcaaagcacttctcttaccaagactaagcactatttttagaatcaagcttaaatgatcattctgtttcccaatgtcaaataataagtaagattggcagaggccttcagccaggacttattcagccagagactggacagaagctggaagcaggggaagctttggggaactgaagcgtcagaccagggtagtgtggacaggatgccttgatctctctcagcctgatctaatgatgattctatcaccttaggcatcagagagggtaagtgacttgcccagggtcacacagcagc

SEQ ID NO: 45110 - DNA, 601 bp, Human
aggtattgatcctgagagcagccccagtaaaactcccacccccaaatctcagcatctcacagactgtttcccaggaatctgccccgttaatatattgtttcctaaacaggcaaagcacttctcttaccaagactaagcactatttttagaatcaagcttaaatgatcattctgtttcccaatgtcaaataataagtaagattggcagaggccttcagccaggacttattcagccagagactggacagaagctggaagcaggggaagctttggggaactgaagcgtcagaccagggtagtgyggacaggatgccttgatctctctcagcctgatctaatgatgattctatcaccttaggcatcagagagggtaagtgacttgcccagggtcacacagcagcatgacaggttctagaaaaatccacagctgctgatgcccagagcctgttcacattccaggtagctttcatcagcctggacttatctctagttgtatacacacacttctgaagttgctatggaaatctctctacagcaagatgtattttaaaagacagttctcatatcttgggttggtttttatgtgacaacaaaggtttttc

SEQ ID NO: 45111 - DNA, 601 bp, Human
agcaggagaaaaacaatttgtggcccattctttctctcattaagagagccaccactcccattgtaaggagataaaaagaggcttccttgctgtactctcttctgcccctgcctcagacacccaggcctgcacttgccagcagcaggaagcaagaccacagctccctcctcctcccatctccttcccacaacctcctaccccctccaagaaggggtacttccactccaagaaaacagtaggaatggccaggctcggtggctcacgcctgtaatcccagcactttgggaggccgaggcgggcrgatcacgaggtcaggagatcgagaccatcctggctaacacggtgaaacccccgtctctactaaaaatacaaaaaaattagccgggcatggtggcacacacctgtagtcccagctactcgggaggctgggacaggagaatggcgtgaacccaggaggcggagcttgcagtgagccgagatcacgccactgcactccagcctgggtgacagagccagactccatctcaaaaaaaaaaaaacaaaccccaaaacaaaacagtaggaaagtggtcattacagggatgaagcaccctacatgggg

SEQ ID NO: 45112 - DNA, 601 bp, Human
agctccctcctcctcccatctccttcccacaacctcctaccccctccaagaaggggtacttccactccaagaaaacagtaggaatggccaggctcggtggctcacgcctgtaatcccagcactttgggaggccgaggcgggcagatcacgaggtcaggagatcgagaccatcctggctaacacggtgaaacccccgtctctactaaaaatacaaaaaaattagccgggcatggtggcacacacctgtagtcccagctactcgggaggctgggacaggagaatggcgtgaacccaggaggcrgagcttgcagtgagccgagatcacgccactgcactccagcctgggtgacagagccagactccatctcaaaaaaaaaaaaacaaaccccaaaacaaaacagtaggaaagtggtcattacagggatgaagcaccctacatggggttgatggaagcctgcaagctaaaccctgtaggctgagcagaactgagcagagcctgggaacagtggggccaggcactgtggttcctcatggactgctttggtttgagttataacctccaatgtggggcacacgcacagtgatccatgggactattggg

SEQ ID NO: 45113 - DNA, 601 bp, Human
cgggcagatcacgaggtcaggagatcgagaccatcctggctaacacggtgaaacccccgtctctactaaaaatacaaaaaaattagccgggcatggtggcacacacctgtagtcccagctactcgggaggctgggacaggagaatggcgtgaacccaggaggcggagcttgcagtgagccgagatcacgccactgcactccagcctgggtgacagagccagactccatctcaaaaaaaaaaaaacaaaccccaaaacaaaacagtaggaaagtggtcattacagggatgaagcaccctacrtggggttgatggaagcctgcaagctaaaccctgtaggctgagcagaactgagcagagcctgggaacagtggggccaggcactgtggttcctcatggactgctttggtttgagttataacctccaatgtggggcacacgcacagtgatccatgggactattgggagaaatgatcagaacttctacatatatatatatatatatatatatataaagcctggctagtatttaataaatggatagagagcaatacatgtctgtaatttataataaatatatgtataatggaggagggcatgctc

SEQ ID NO: 45114 - DNA, 601 bp, Human
tagatggctggggagggggaaggtggggaggcgacagggatcctgctggaggcctttgagaaaaacctgcagcattaaggaagaggaaaataatcctgaagattcctgaaaaatgtttaattatgaaaaacaaaaagcaacattagaagagtcttgggtggccaggcacagtggctcacgcctgtaatcccaacactttgggaggtcaaagcaggtggatcgcttgaggtcaggagttggagaccagcctgaccaacacagcaaaaacccatctctgccaaaaacaaaacaaaacaaaacaaaaaaaaaccaaaaaaaacattagccgggagtggtggtgcatctgtagactcaggaggctgaggtggggggatcacctaacctgggaggtcaagagtgcagcgagcagagattgcgccactgcactccagcctgggtgacagagtgagaccctgtctcaaaaaaaaaaaaaaaaaaggaaaaagaaagaagagtcttgggcatctctaatagggtgccagaatatatatgatccttatgatagagaagagtgggcagatgtgaaatgaaaatgtatctggttcacataagcacagagttc

SEQ ID NO: 45115 - DNA, 601 bp, Human
ggggagggggaaggtggggaggcgacagggatcctgctggaggcctttgagaaaaacctgcagcattaaggaagaggaaaataatcctgaagattcctgaaaaatgtttaattatgaaaaacaaaaagcaacattagaagagtcttgggtggccaggcacagtggctcacgcctgtaatcccaacactttgggaggtcaaagcaggtggatcgcttgaggtcaggagttggagaccagcctgaccaacacagcaaaaacccatctctgccaaaaacaaaacaaaacaaaacaaaaaaaaamcaaaaaaaacattagccgggagtggtggtgcatctgtagactcaggaggctgaggtggggggatcacctaacctgggaggtcaagagtgcagcgagcagagattgcgccactgcactccagcctgggtgacagagtgagaccctgtctcaaaaaaaaaaaaaaaaaaggaaaaagaaagaagagtcttgggcatctctaatagggtgccagaatatatatgatccttatgatagagaagagtgggcagatgtgaaatgaaaatgtatctggttcacataagcacagagttccagaaaact

SEQ ID NO: 45116 - DNA, 601 bp, Human
agaattggcctaggtaaggggatgttgtgtgtggggatggtagatcagagtaggcagatcgaaacggattcctcttttccagttagaatgtgggggacaggaggagccacccctagacataccccaatacattctttttctggaaaatttattgaatcataaggtgaaacaatcctagaggcacacaggcatcccagagctgactctccctcaggaaccctaaattcagagtcattagaacagttccacagtattttaaatttggatccaccctgtcatttgaatgaggcaaccaaagggsaacaaaagtcattcttggagtttacttttggggggaactcgtttgccagttgaccaaagactgaatcacaattaagatcttaataatgaaatgttgtaaagaaaggcagacattggttcacacaggcaaacatgaaatcaagactaaacttacgcgtagttgcaaaactccaaattctaatgtcaaggaaaaagtagattctggaaagagtggatgtatgaaattaaagcaataattcaataataattagagggttgcaaatcctcagattaaaaatttgagaggagaaggctagaaggg

SEQ ID NO: 45117 - DNA, 601 bp, Human
ggcatcccagagctgactctccctcaggaaccctaaattcagagtcattagaacagttccacagtattttaaatttggatccaccctgtcatttgaatgaggcaaccaaaggggaacaaaagtcattcttggagtttacttttggggggaactcgtttgccagttgaccaaagactgaatcacaattaagatcttaataatgaaatgttgtaaagaaaggcagacattggttcacacaggcaaacatgaaatcaagactaaacttacgcgtagttgcaaaactccaaattctaatgtcaargaaaaagtagattctggaaagagtggatgtatgaaattaaagcaataattcaataataattagagggttgcaaatcctcagattaaaaatttgagaggagaaggctagaagggattagtaaaagcatgccagatgcgttgtcctatgtagaggagaattttaaaataaagccctattactcagttttagcaatcagagaaatattttttttaaaacctaaaggaaccacaggcaaaattttatgagtataacaagaataacagtagcatcagccatatattgtttcacttaatccatacc

SEQ ID NO: 45118 - DNA, 601 bp, Human
gaaaaacatccttaaagtttttcaggcacaatggtgtgcactgatagccccagctacttgggaggctgaggtgggaggatcacttgagcctaggagttcgagccagtagtggactatgattgtgcctgtggatagccactgcctcagcctgggcaacatagggagaccccatttttaataacaaaaacagaaaaaaatgaacagagaaaataactgaatccattagaagaacaaaacaaacctcaggagggaagattaagtttataacaaaggcaaagataggaattaatgaatttaaaawccagaaaaacataatttataaatccaaaagataccaacttctaaaatataaatttaattgagaaaaagaaaacacaaaattagaaattttaatggagaataactactgattcttaggatgttttaataaataagtgagaatagcttaactttttttgaaggagaagaccattgagggggctttctctactagatattaaaatgtattataaaactgaaagtaattaagtccctctggcattactgaaaaatcaataatgacagatcaatgaaacctaatggaaaacactgaaataaaccc

SEQ ID NO: 45119 - DNA, 601 bp, Human
gagaattactttttcccctctggagttgacaaaattttaaataaatataactcagtgctggagaatcttcttattgttggcggtgggcgggcatggggttgtcttacgctgagggcaagaaggaaattagaccatctttctggaaaacaatttaacaatttgtcacaggagccttgagtttgtaactttgatccaggaattctctttctaggaagctattttaatagaataatcaatttacatcaaacctcttctgcatggtgcagtttataatagaaaagaatgagaaaccaagtaaacrtctaggatttcaatggctaaacaagtatggcacatccatatgatgggtagttagcaagaattttaaaaaatcaaatcaacgtgtttgttttcgtttttgtttgtttgtttgtttgtttgttacttcgttgtttgtttttgatgcggagtctcattctgtcgcccgggctggagtgcagtggcgccatctcggctcactgcagccaccacctcccgggttcaagcaattatcttgcctcagcctcccgagtagctgaaattacaggcacctgccacaacgcctggctaagtttttgtattt

SEQ ID NO: 45120 - DNA, 601 bp, Human
tgtcacaggagccttgagtttgtaactttgatccaggaattctctttctaggaagctattttaatagaataatcaatttacatcaaacctcttctgcatggtgcagtttataatagaaaagaatgagaaaccaagtaaacatctaggatttcaatggctaaacaagtatggcacatccatatgatgggtagttagcaagaattttaaaaaatcaaatcaacgtgtttgttttcgtttttgtttgtttgtttgtttgtttgttacttcgttgtttgtttttgatgcggagtctcattctgtygcccgggctggagtgcagtggcgccatctcggctcactgcagccaccacctcccgggttcaagcaattatcttgcctcagcctcccgagtagctgaaattacaggcacctgccacaacgcctggctaagtttttgtatttttagtagagacggagtttctccatattggccaggctggtcttgaactcctggcctcaagtgatccacctgcctcggcctctcaaagtgctgggattacaggcgtgagccaccgcgcccggcctaaaaatcaatcttttgaaaattacagtaaggtaggaa

SEQ ID NO: 45121 - DNA, 601 bp, Human
ccaccacctcccgggttcaagcaattatcttgcctcagcctcccgagtagctgaaattacaggcacctgccacaacgcctggctaagtttttgtatttttagtagagacggagtttctccatattggccaggctggtcttgaactcctggcctcaagtgatccacctgcctcggcctctcaaagtgctgggattacaggcgtgagccaccgcgcccggcctaaaaatcaatcttttgaaaattacagtaaggtaggaaaatattcatgatgtaatatttgaaaaaggagcgtacaaaatascattatgtaggatattaccgatttatagataggtgcagaaatacctggaaaatacatagaaacattaagttgatttctttgtgttacatgtaatatttatttatttatgagatagagtctcgctctgtcatccgggctgtagtgcagtggcgcaatcttggctcactgcaacctctgcctcctgggttcaaactattctcatgcctcaccctcctgagtagctgggattacaggcgtgcgccaccatgcccggctaatttttgtatttttagtagagatgggttttcgccatgttggcct

SEQ ID NO: 45122 - DNA, 601 bp, Human
ttccataggaactcatgttttacatcaacgcggggtggaaagtaaagctgaatggctcagtttttacacataattttctctaacaagcgcaatgcaagttccgtcttgaagggctctcttccgacccgtcggccagtggccttggtggacagggccgcggggcgcctttgcggggccggagtgcttcttcgcgggcgcgcgcctcccttggagcccctctgcggccggccgcttatgggagcgcccgagccggcgtgcgggcaggtggagctccacaggggacgtgtgatcgaggcaggckccactggctcttcagtagcctcccgggcgtccccgcggtgttgcggggtccggtggggagaggccgcgagtccgcgggtggttcccgcgcggccaggcggtcgtggagaggccggggcccgggagaggccgaggctcgctccgccagggggcgcagggagggccaggtgggcggtgtccccacctgcagggactcgctgtggaggagcagagcgttcaggtttcctctcgctgtggcgacagccggagcggcttcagggctgggccggcggctccagggctgctgctagctcctggctcc

SEQ ID NO: 45123 - DNA, 601 bp, Human
gccggccgcttatgggagcgcccgagccggcgtgcgggcaggtggagctccacaggggacgtgtgatcgaggcaggctccactggctcttcagtagcctcccgggcgtccccgcggtgttgcggggtccggtggggagaggccgcgagtccgcgggtggttcccgcgcggccaggcggtcgtggagaggccggggcccgggagaggccgaggctcgctccgccagggggcgcagggagggccaggtgggcggtgtccccacctgcagggactcgctgtggaggagcagagcgttcaggttycctctcgctgtggcgacagccggagcggcttcagggctgggccggcggctccagggctgctgctagctcctggctcctgtctcgagtgggatcccattctgatttcacctgcgtgattcacagtctccagtcccactccgcggccgctttctcgttctgtgatctcgtattcagccgttctttcctcttcctcattggcagtatttttgtgccctttgacacttaaactgctcattcgtggctagtttttttcgtacttttatattaaataattatacatgacttagctattataagtaa

SEQ ID NO: 45124 - DNA, 601 bp, Human
actgaggcaggagaatcgcttgaacctgagaggcggaggttgcagtgagccaagatcgcaccattgcactccagcttgggagacaagagtgagactccgtctcaaaaagaaagaaagaaggaaaagaaagagaggagaaagaaagtgggagagagagagaaaataaaataaaaaagaaactggtaaagcaaggaaaatttccataaaatttgcattctgaagcactaagtttgggactgtgggtgcaaagtgaaatccatattgcattgagaaaccattccattttttcagtcaagtcaayccccaaattattccaaattatttgctgcattacaccaaacctgggtttcccttcactctcttctgctgggaagtcaccagtgtcttttgtctccaggatttttgccttagggagacccagttaaatgccagggttccttctttaactggggaggactatctgacctttgtcactggaatgaattccttcccaagtctgccaaagatggtacacagtgacagttagtgccatgctgggtgtgtaggagagaagtgacttcctttcctacagcggatgcctaagggcatggggcttcattct

SEQ ID NO: 45125 - DNA, 601 bp, Human
tgtgggctgacattagtcaagcaggaaatccatattctgtcagcttttccatccttcaactttggggttgttttgtttgcccctcgtgatcccattgtgccctacatttccggtgcagacccctccctcaaaggacgggcacctcagctccacagggccccttctccatgagtttggtgtcctaggctggctctcaggagcgcagctcttcacccccctgtgtttcccctgccctccactgccagcttggggcccccgcgccaggctggggtaaagccctgcattcctggctcacatagcrcagctgctagaagggtttttaaaaatgtgattttttttggccgggcatggtggctcacacctgtaatcccagcactttgggaggccaaggtgggcagatcacctgaggtcaggagttccataccaccctggccaacatggcgaaacgctgtctctattaaaaatacaaaaattagcccagtgtggtggtgagcgcctgtaatcccagctactcacgaggccgaggcaagagaatcgcttgaactcaggaggtggaggatgcagtgagccgagatcacaccattgcactccagcctgggca

SEQ ID NO: 45126 - DNA, 601 bp, Human
acacctgtaatcccagcactttgggaggccaaggtgggcagatcacctgaggtcaggagttccataccaccctggccaacatggcgaaacgctgtctctattaaaaatacaaaaattagcccagtgtggtggtgagcgcctgtaatcccagctactcacgaggccgaggcaagagaatcgcttgaactcaggaggtggaggatgcagtgagccgagatcacaccattgcactccagcctgggcaacagagcaagactccatctcaaaaacaaaaacaaaaacaaaaacaaaaacaaaacgrtgttctccttccatttaatacagactcctctgttccctgagacttggccccagtcccccagaggctgagctgagagggaatatgggtgagacatgccatattccttgagtaccccacctcgttccattcggtctggatgcctgcttgccccccactgcacagagagtttaagggcagccaaagtcccctggctgcctttgagtagtggccctggaagcctgctggccctaacacacctggtcattttgttttcccaaaaggcgcctgggagccgcctggtaacacagcccctgcgggccc

SEQ ID NO: 45127 - DNA, 601 bp, Human
agcccctgcgggccctctcagacagggccagacatgctgcaacgggcccagatgggctctgacactcccacaatagagggggcacagaacttagtaaaactccttttaaatatcttaaacatgtttcagctgagccaaggggaaaacacctagtacacagtggcaatcgcaccagcacaggatccatcctgtgatcaggactgcctgaactcagggtggaaaaactcggtttgacccctggttctaccattaaccttgcacttgtacttaacctgaccagagtcatgcagcctcttttgarcaccctctgggacactactttaaaagactatccaatccatttgcagacagctctgacttagaaatctcttcctattattggttaatattggttaaaacgtgtagtttctgtcttgggtcctaactcagttctctgggtccgcacgaaagaagttcaagtaccataggctggcggttaagccattgacctctgggaagatgtgagcgtggagccttgcttatgctcttactagcaggtgacgttgggccaggaaaggggataattcacaaaaagcccttagcacagtgtagaacatttagc

SEQ ID NO: 45128 - DNA, 601 bp, Human
ggtcagactccaccctctcgctcactctcctcccctggtcatcagtgtcctcatgaagcgaaggccccagaacgaacatagtgccccaagtgttaggcatcctcccatttcctcggcattattttccttttaatgcagcctgagagtggcccatattcttagggcaaagggctcccaggcataatggcctgggaattagggagcgagacccagggcccatctctgtttagattgggcactcttgacagttccattctatagccccatgctctattgttaacttttcttcaatacaattgtragggccttgtttagcctgaatcctgcagggagcaacttgcacccttgttccacatggccactaccagataagagccacagctcagtaaggccagaggagtggttcagccacgtgggaaccagccaggactcaaagagacaagaggctcctgtcctgtttccagctttagcaagggagttgagggctggcctgaagtccatttctctctgccttagttttcctgctgataaaagcaatagttagtttctcaggctcccgcagatttctcaacagattgtttgagcactgaagttgagatct

SEQ ID NO: 45129 - DNA, 601 bp, Human
gcctgaatcctgcagggagcaacttgcacccttgttccacatggccactaccagataagagccacagctcagtaaggccagaggagtggttcagccacgtgggaaccagccaggactcaaagagacaagaggctcctgtcctgtttccagctttagcaagggagttgagggctggcctgaagtccatttctctctgccttagttttcctgctgataaaagcaatagttagtttctcaggctcccgcagatttctcaacagattgtttgagcactgaagttgagatctctcctgctctctgsacacatctcatactgattccccccataccctatttcctacacaggtctgtcctttacctggacattctccctcctctgccgtttcccttcatcatgcttgctcccggagaatgcaggcactctcacaggaatgcatccatgcatcccaagtggagcattgagccacgcctctctctgagctgcagtgctctcatgagagacttgctaaataataatactgttatgtataggtatggagctctgctattcaccaggcactgtgctaggaattaaatatatcttaaagcataaaacacacat

SEQ ID NO: 45130 - DNA, 601 bp, Human
cgcaggctccttctcccttgttgccctgccatcgttggtacgtggcttcttcctcatacttcaagaaagctgctggagctccagccatcccacctaccttttagccatcaggaaagagaaatggacaaaataaggttgtttctttcttgttaaggacatttcctcgaagtaacacatgtcactttcatttacatccgttggtcattcacatggcgggaaaatgtagtctttattattggtaatcattgctccttcctgggcgctcttactaatgaagaagaggagacgtgctgttgggctrcaaccatctctcaggctcaaatcgttccccatccttatgccactcccagccccatttccagccctctatttaggcaccaagctctatggttcttattctgcggtgtcgcttgaagtcatctcttcctgctacctccctgacacagatccctgtcatcttacaccagtttacagaagtagcttttctggcttccagttaccgttcctactattacccctcaaaaaccttcaattgctccctctagaagattaagtccatatttttaaatttagtgaccaaggccctccatcatgcaattcc

SEQ ID NO: 45131 - DNA, 601 bp, Human
actcccagccccatttccagccctctatttaggcaccaagctctatggttcttattctgcggtgtcgcttgaagtcatctcttcctgctacctccctgacacagatccctgtcatcttacaccagtttacagaagtagcttttctggcttccagttaccgttcctactattacccctcaaaaaccttcaattgctccctctagaagattaagtccatatttttaaatttagtgaccaaggccctccatcatgcaattccagtcaacccatgataaaaccggtttggttcaattttagtaasatcagcaacaatggtaataatgatactttgcattcctacatggaaggttttattgctcacagaagggacagcacatggcccctggagtcagaaacgtgcgctcatagcctggcttgacaacggaccagctgtgcgatcctgggcaagtcacctgccctctattaaataagcacctgcgactggctggttcctgataaaccctgagccctttcctttcctgggcctctttcttgggatctgtagataggaagtaagcctggtctacctgcttcccaggggattaggaagttcaaacaagag

SEQ ID NO: 45132 - DNA, 601 bp, Human
cccctcaaaaaccttcaattgctccctctagaagattaagtccatatttttaaatttagtgaccaaggccctccatcatgcaattccagtcaacccatgataaaaccggtttggttcaattttagtaacatcagcaacaatggtaataatgatactttgcattcctacatggaaggttttattgctcacagaagggacagcacatggcccctggagtcagaaacgtgcgctcatagcctggcttgacaacggaccagctgtgcgatcctgggcaagtcacctgccctctattaaataagcrcctgcgactggctggttcctgataaaccctgagccctttcctttcctgggcctctttcttgggatctgtagataggaagtaagcctggtctacctgcttcccaggggattaggaagttcaaacaagaggagacctgaacagctgggggaaacataaaacactggacatcctcttctgtttttcaccacgaccctatgaagtgagcaggcaggacggggaacccacggtccctatttcgtggatgaggatgtggtggctcaaggaggctcatgatctgccctggccctgacttgtagggca

SEQ ID NO: 45133 - DNA, 601 bp, Human
ggttcaattttagtaacatcagcaacaatggtaataatgatactttgcattcctacatggaaggttttattgctcacagaagggacagcacatggcccctggagtcagaaacgtgcgctcatagcctggcttgacaacggaccagctgtgcgatcctgggcaagtcacctgccctctattaaataagcacctgcgactggctggttcctgataaaccctgagccctttcctttcctgggcctctttcttgggatctgtagataggaagtaagcctggtctacctgcttcccaggggattakgaagttcaaacaagaggagacctgaacagctgggggaaacataaaacactggacatcctcttctgtttttcaccacgaccctatgaagtgagcaggcaggacggggaacccacggtccctatttcgtggatgaggatgtggtggctcaaggaggctcatgatctgccctggccctgacttgtagggcagtggaggaggcctgggcccttgggaccccgatcgcctgtggcagggcttttggggtatgtgttccactggggaggtgtgttacagagtgagtctgtgttgagacaaaaggag

SEQ ID NO: 45134 - DNA, 601 bp, Human
agcaacaatggtaataatgatactttgcattcctacatggaaggttttattgctcacagaagggacagcacatggcccctggagtcagaaacgtgcgctcatagcctggcttgacaacggaccagctgtgcgatcctgggcaagtcacctgccctctattaaataagcacctgcgactggctggttcctgataaaccctgagccctttcctttcctgggcctctttcttgggatctgtagataggaagtaagcctggtctacctgcttcccaggggattaggaagttcaaacaagaggagrcctgaacagctgggggaaacataaaacactggacatcctcttctgtttttcaccacgaccctatgaagtgagcaggcaggacggggaacccacggtccctatttcgtggatgaggatgtggtggctcaaggaggctcatgatctgccctggccctgacttgtagggcagtggaggaggcctgggcccttgggaccccgatcgcctgtggcagggcttttggggtatgtgttccactggggaggtgtgttacagagtgagtctgtgttgagacaaaaggagaaagaacataagacgcaaag

SEQ ID NO: 45135 - DNA, 601 bp, Human
aacataaaacactggacatcctcttctgtttttcaccacgaccctatgaagtgagcaggcaggacggggaacccacggtccctatttcgtggatgaggatgtggtggctcaaggaggctcatgatctgccctggccctgacttgtagggcagtggaggaggcctgggcccttgggaccccgatcgcctgtggcagggcttttggggtatgtgttccactggggaggtgtgttacagagtgagtctgtgttgagacaaaaggagaaagaacataagacgcaaagtttttctttcagcttggrctgtgcagtcattttctaatttctttgaggtcatgctgtttggtacctaggaaaggaattgtgattggtgttctagaaaaacagtgatttttagggggaagccactgcctattagtaagtacaggcagaagcggctcattgtccttgaatgccatgatgtctgttttcgaggggtggggtggggtctggtgactggctagacttttttggagaaaatgtataacaaacttaataaagtaaacatctatgttgtcaaacttactgagttaagtagatgtgaatatagttaactgagtagta

SEQ ID NO: 45136 - DNA, 601 bp, Human
ggggaacccacggtccctatttcgtggatgaggatgtggtggctcaaggaggctcatgatctgccctggccctgacttgtagggcagtggaggaggcctgggcccttgggaccccgatcgcctgtggcagggcttttggggtatgtgttccactggggaggtgtgttacagagtgagtctgtgttgagacaaaaggagaaagaacataagacgcaaagtttttctttcagcttggactgtgcagtcattttctaatttctttgaggtcatgctgtttggtacctaggaaaggaattgtgaytggtgttctagaaaaacagtgatttttagggggaagccactgcctattagtaagtacaggcagaagcggctcattgtccttgaatgccatgatgtctgttttcgaggggtggggtggggtctggtgactggctagacttttttggagaaaatgtataacaaacttaataaagtaaacatctatgttgtcaaacttactgagttaagtagatgtgaatatagttaactgagtagtagctttagaattattttgtcaagtttaacatgtgaaattgttcccacttagttaccagtattctta

SEQ ID NO: 45137 - DNA, 601 bp, Human
ttcttaaattgtcttgtttataatttaaactgtgcattttatttagagagtaaatgtgtctggaggcttttcattatttcagaaattagaggatagattcctgaggtgcccggcctgtccctgaggccacgtgatgcagaactggaggcaggtgagtctgagccgggtgctcggagcctagtcaagggtgaccacaggccgagggaggagaaacttctgacatgcagtgtcctcataggaatgctttgtggtgttatctccatttccctgatggaaaaactgaggccaagagcagtggggyaactcccccaccatagtgtggagttgcttaattgcctcgcccccagcagggggcatgtctgtgtgataatgtctgctacagtgcccagcctctgtaggaggctaggaattgttttttaataaataaggagcactatcttcgttcatggccattcattctacacaggttctcctctgtggcccagcactctgtgaagtaagcagggcaggagcaattttcccattttagaaattaggaaatggaggctttgggaggtaagcgagccagggtctcactgctggcccggggctgctgcccgca

SEQ ID NO: 45138 - DNA, 601 bp, Human
gcctgtccctgaggccacgtgatgcagaactggaggcaggtgagtctgagccgggtgctcggagcctagtcaagggtgaccacaggccgagggaggagaaacttctgacatgcagtgtcctcataggaatgctttgtggtgttatctccatttccctgatggaaaaactgaggccaagagcagtggggcaactcccccaccatagtgtggagttgcttaattgcctcgcccccagcagggggcatgtctgtgtgataatgtctgctacagtgcccagcctctgtaggaggctaggaattgttttttaataaataaggagcactatcttcgttcatggccattcattctacacaggttctcctctgtggcccagcactctgtgaagtaagcagggcaggagcaattttcccattttagaaattaggaaatggaggctttgggaggtaagcgagccagggtctcactgctggcccggggctgctgcccgcagagtcctccacctggagcactcccattctccgaggttcccttgccagctgggcatggctgtccagactgaacatcactccttccttccttcatctgctcagtgcttgaagat

SEQ ID NO: 45139 - DNA, 601 bp, Human
ccaagagcagtggggcaactcccccaccatagtgtggagttgcttaattgcctcgcccccagcagggggcatgtctgtgtgataatgtctgctacagtgcccagcctctgtaggaggctaggaattgttttttaataaataaggagcactatcttcgttcatggccattcattctacacaggttctcctctgtggcccagcactctgtgaagtaagcagggcaggagcaattttcccattttagaaattaggaaatggaggctttgggaggtaagcgagccagggtctcactgctggcccrgggctgctgcccgcagagtcctccacctggagcactcccattctccgaggttcccttgccagctgggcatggctgtccagactgaacatcactccttccttccttcatctgctcagtgcttgaagatcccagagcccaaggtcacttcagctaacaagctgatgtccctatatttgggtgagctgatggtgctaatggcagtgtagatcttcgttttagaggataattatgttttctgaaagtctgtggagaattgtgccattgcttgagggatatctaataaaaatcacgcactggata

SEQ ID NO: 45140 - DNA, 601 bp, Human
caactcccccaccatagtgtggagttgcttaattgcctcgcccccagcagggggcatgtctgtgtgataatgtctgctacagtgcccagcctctgtaggaggctaggaattgttttttaataaataaggagcactatcttcgttcatggccattcattctacacaggttctcctctgtggcccagcactctgtgaagtaagcagggcaggagcaattttcccattttagaaattaggaaatggaggctttgggaggtaagcgagccagggtctcactgctggcccggggctgctgcccgcrgagtcctccacctggagcactcccattctccgaggttcccttgccagctgggcatggctgtccagactgaacatcactccttccttccttcatctgctcagtgcttgaagatcccagagcccaaggtcacttcagctaacaagctgatgtccctatatttgggtgagctgatggtgctaatggcagtgtagatcttcgttttagaggataattatgttttctgaaagtctgtggagaattgtgccattgcttgagggatatctaataaaaatcacgcactggataaaagcagaccagagt

SEQ ID NO: 45141 - DNA, 601 bp, Human
tgctggcccggggctgctgcccgcagagtcctccacctggagcactcccattctccgaggttcccttgccagctgggcatggctgtccagactgaacatcactccttccttccttcatctgctcagtgcttgaagatcccagagcccaaggtcacttcagctaacaagctgatgtccctatatttgggtgagctgatggtgctaatggcagtgtagatcttcgttttagaggataattatgttttctgaaagtctgtggagaattgtgccattgcttgagggatatctaataaaaatcacscactggataaaagcagaccagagttcacctaaggaatcatcatcgtcatcattgtcatcatcttccttatcaacagcctcatctctactcatgacagatttggccaaaaagaaaaaaaataaaggaggcctttcgaggacttaacacccggaggactttcctccatgcctcctctctctgtctgtcttcctaatttcagtgagtcagtttttcctccccatctgtttgctttctggcactttacacaactgtctgggctctttcattttgccttctgtggttgctcaactccatcatttc

SEQ ID NO: 45142 - DNA, 601 bp, Human
tcacgcactggataaaagcagaccagagttcacctaaggaatcatcatcgtcatcattgtcatcatcttccttatcaacagcctcatctctactcatgacagatttggccaaaaagaaaaaaaataaaggaggcctttcgaggacttaacacccggaggactttcctccatgcctcctctctctgtctgtcttcctaatttcagtgagtcagtttttcctccccatctgtttgctttctggcactttacacaactgtctgggctctttcattttgccttctgtggttgctcaactccatcrtttccctctcgatgcttctcctttgttccctggcaggctcctctcatctgccagtttccagtcctatgaagagtcagaggtgggttttagttttcaggcagcatttttgttgcctggcaacgtgtaacaagcatcttctgtggtggctgcttcccttaaaacagagccaggctggggatgcagtggacgaaggagtctctgggagcttctctggggtcatggggaggagtcaggggagggggacagacagacaggttggcttccatggtgactctgagtgttgccattcttactctttta

SEQ ID NO: 45143 - DNA, 601 bp, Human
tttcattttgccttctgtggttgctcaactccatcatttccctctcgatgcttctcctttgttccctggcaggctcctctcatctgccagtttccagtcctatgaagagtcagaggtgggttttagttttcaggcagcatttttgttgcctggcaacgtgtaacaagcatcttctgtggtggctgcttcccttaaaacagagccaggctggggatgcagtggacgaaggagtctctgggagcttctctggggtcatggggaggagtcaggggagggggacagacagacaggttggcttccrtggtgactctgagtgttgccattcttactcttttataatagccttggcactggcacgccctctcctgccccatttcaggcaccccaggtgtccagtggtgaaaagccttgggttaggagccatcagaagttctgtgtaacttgagaggcacctgctgcagctccctgaggcatggccagcctggatgaaggctgctaggtggtttccactggtgctgactcttgcttcatcttgtctgcacgggatgccacaggcctcctgtctggaaagacacctggcttttgcctctgcagtcagccc

SEQ ID NO: 45144 - DNA, 601 bp, Human
tttgcctctgcagtcagcccagctgctagttgtcccgagaatgggagtgggagagagaagggggacagaatgtgatccaaaaaaacacctgacttagagctggagggggctttagagcttctttagccaaatcctcatattgtacacacgaggaaaccaaagcccaaagaagggaagcaacttgtccagactcacaccgcgagttgggcgggtctgagctcccagccaagggtctctctcctgggactggactctgccgagctcacacatctgatgccctgtggctagaaagaggcagcakgtggtgagaagtgcaccagatgcccagttctccgctttctggcctccatttgcttatctaaaaagaatgaggtgaactgggctagagggagccccaagactcagtgactctgatggtaaagctgacacagcaggcaggcccctgctgcccaggccttcagccacgtgtccagggctgctctcaccgccccaggaaagctcagaagctgagggggtcctgggcctctgagctgatgctccccaggagaatcccactgtatgcagagaccccgagcacagccacgacacttgtcaccatgag

SEQ ID NO: 45145 - DNA, 601 bp, Human
tcagcccagctgctagttgtcccgagaatgggagtgggagagagaagggggacagaatgtgatccaaaaaaacacctgacttagagctggagggggctttagagcttctttagccaaatcctcatattgtacacacgaggaaaccaaagcccaaagaagggaagcaacttgtccagactcacaccgcgagttgggcgggtctgagctcccagccaagggtctctctcctgggactggactctgccgagctcacacatctgatgccctgtggctagaaagaggcagcatgtggtgagaagtrcaccagatgcccagttctccgctttctggcctccatttgcttatctaaaaagaatgaggtgaactgggctagagggagccccaagactcagtgactctgatggtaaagctgacacagcaggcaggcccctgctgcccaggccttcagccacgtgtccagggctgctctcaccgccccaggaaagctcagaagctgagggggtcctgggcctctgagctgatgctccccaggagaatcccactgtatgcagagaccccgagcacagccacgacacttgtcaccatgaggctgatttagggc

SEQ ID NO: 45146 - DNA, 601 bp, Human
tttccttaagtaagaatctctcagttcaagaggcagagaaaaggattgctgaaggcaatctgtctcttcatatctctttcattctgctcctggggccgaggaaatgggtgaggaggggtgcaggaggcccttggcctgagcaccaggcctggagccttcccttccagccgctgctctccagagcttggggtgcaccagcttcgaggctttagaagcttctccagcaagaaaggcccttctgagggaaaagtgtgtgcgactggctgtctccattcctttctccatatagtgttgaccttcrgaattagctttattcctgacgtgtaccagaattttcagttaatcatgtaaaccaaggctcaggtgacttggctgtgggcagttggggccggaccagcccctgagaaactactcccatcccagacttcgtgacgcttcacttggccagagcccactcccagaaagcagggaaatgtgcctttctgcgtagcccaggcctatggaaagaggcgagaggtcagggacagctgcactccctgggcaggctgcttgtggtccgggagcatcccgtagtctccccaagccccacggccgtggggac

SEQ ID NO: 45147 - DNA, 601 bp, Human
ccagagcccactcccagaaagcagggaaatgtgcctttctgcgtagcccaggcctatggaaagaggcgagaggtcagggacagctgcactccctgggcaggctgcttgtggtccgggagcatcccgtagtctccccaagccccacggccgtggggaccccgggtcagggcattattgtgcatatccctgtcctcaggcccctcatgctcaggccagaccctcacccaggtgcccttgccctcagactcctccccttccagccattgtctctgtctccatccctgtccctctctttctctaycttcctctctctctgattccctgggggctactttgcaacctctgctgagtcagaattcttcccactcgccctgacgtcccaggctcctccttggcaccctgtcttctctgtggcagggaaagacgcccaaccagagctcccacgtcctgccctgggaaccccactgctctgggaaacaaaaacaagaaaattccttcccagggtacttgttctgtgctgttcctctttgttcttggtcacagggtgattcccacgtccttcccacactaaccctgcctaggtgaggctgcagctttgtgt

SEQ ID NO: 45148 - DNA, 601 bp, Human
ctatcagccaacagtttccaaccttatttatgtacttgtttctttgattccagcgatgcaggagagatgatattcagacagccgacttctgctgtgggtgtgccccaggttataaatcatttccatcaggctagctggagtcccggcccttcctttccactgaagaaagcaaatcagagtaccagatagcgagagtgatattatcacaggatagccttgaaactgccataacaaaaaaaataaatcgttcacaaatgtcaatccttcaactactattagccccagagagactgtttgtctrccccagtgtgtcgctgtgcagaggctgagaacgtcccctctcctcttcccacacctaggagagggggagccactggtagattgggagcaggggagggtctggagtttcagaaagatttccctggctgcagtgtggaagggggatttgaggggaagacgggacaccagctggggaggctgctgtagtaacagaatgctgcccccaccacccctgggtacagtggtggctgggatgaagagcaagggcagttttgagagagctagaggagccaacctccaccggactgactcactggatgtg

SEQ ID NO: 45149 - DNA, 601 bp, Human
tggagaagttgagcaagaccaagagacccaagagaagagaaacacactccaagaaaagcttggccagtgctggtgttgaagcttccccgctgaggcctgcagaggttgcatccagctgtgtgacaccagccagctgtcccacctcttccagagtttctcagaagcttctacaggaaaccactaatggagacagagatgccaccacctcggtgagaaaaagccacaccaaccaaactctcgttttcacagagcaagaacaagctgtggttgtttggcggcaagtcgcatttgtttgttggarccattgtgctctggtggtgctggttttctctccttttaaaaataactggaggccttgcaccatgctgttagttcttagggctggaaataaaagactagatttagagttgccttggaaagatccagggctgttaccttgaattacctggtagaggaaaacgtcgttattttcctaaattcaaagccaactcttgaaaaataggacacagaggtgaagtggatggaggggtggctttatacatgcatgtggtgtcctgggcacgtggtttgataggcttgtgatcagccctgagtcttcaaa

SEQ ID NO: 45150 - DNA, 601 bp, Human
tgctgttagttcttagggctggaaataaaagactagatttagagttgccttggaaagatccagggctgttaccttgaattacctggtagaggaaaacgtcgttattttcctaaattcaaagccaactcttgaaaaataggacacagaggtgaagtggatggaggggtggctttatacatgcatgtggtgtcctgggcacgtggtttgataggcttgtgatcagccctgagtcttcaaagccatttattttacattttaagatgtttataagggaaattgtttttgagaaaagaacgaactwttttttttttttttttgccttaatgtgaattcacccactggcacaagcagtaatagccctgaagtcaccctaggccatttattcctcagctgcctttgaatttcaatgggattctttcacacgcctcaagcatttctgaaatgctcctaaactaaaggaactcataatacccttaagaaatgatgatttcaccccattttctccataaagctggaatcacatgccctagcatgctgaaggtacttgataattagaagttgattatattggggacctggacaaaggcagagctgggaatgg

SEQ ID NO: 45151 - DNA, 601 bp, Human
taagggaaattgtttttgagaaaagaacgaactattttttttttttttttgccttaatgtgaattcacccactggcacaagcagtaatagccctgaagtcaccctaggccatttattcctcagctgcctttgaatttcaatgggattctttcacacgcctcaagcatttctgaaatgctcctaaactaaaggaactcataatacccttaagaaatgatgatttcaccccattttctccataaagctggaatcacatgccctagcatgctgaaggtacttgataattagaagttgattataytggggacctggacaaaggcagagctgggaatgggaataaaacccaggactccatgaaagtctctttcctttcataatagcttctaattcaggcttctaatagcttcgaatgccagtcacatacagagcctcccggccatcacctactggcagtggctgagcgggtattttgccaagctagaatggttcctgcccaggcacacgggtgctgcctccacgccccaccctgtgcccagctcactacaattgccatctttagcagccgaaaaaatacaggtttcagtcccagtcttttcgctta

SEQ ID NO: 45152 - DNA, 601 bp, Human
tgaaggtacttgataattagaagttgattatattggggacctggacaaaggcagagctgggaatgggaataaaacccaggactccatgaaagtctctttcctttcataatagcttctaattcaggcttctaatagcttcgaatgccagtcacatacagagcctcccggccatcacctactggcagtggctgagcgggtattttgccaagctagaatggttcctgcccaggcacacgggtgctgcctccacgccccaccctgtgcccagctcactacaattgccatctttagcagccgaaaraatacaggtttcagtcccagtcttttcgcttagttgctgtgagaagttagttaggtcagttacgcactggagctttgcattgattcactgtaaaatcaggtaacagctcttatcctgctggtcttgtcccactggcttgtgagaaagacgaagtggagccattcattcattcattcattggacaagtatttattgagtactagggatacagcagtaaagaaaacagaaaaagtcctttcctccatgaaccttatattgtaataggggttgtcagtcaataaatacaaaaataggccacat

SEQ ID NO: 45153 - DNA, 601 bp, Human
catagacacacgagatgaaaatagcacttttttttagtgcacctatgtgcccggcactgctctaatcattttagacatatcagctcctttaaccctcacagtaactctctgtgaggtggtacaagtattatcctcttttacaggtgggaagactgaggataagttcatgcagacattaaggtgcaaagcccggattcaaacataggtgttctggccctggaacctgtaggttcagctataccccagccagctttgcggcctttctgcaagccagtgtgtgggcagtaggtggatggtgctratgccacgtgtgggagacacaggcaaagagctggggttggctgggtgggtcaggatgggatttgaagtgggtcctgaagggccagttagaaggcatcagggaggacagggcaggagtgacaggagcaagagagccatgtgtgcaaggcaagcttggagcacagcaaccctgaagcggtggtcagagcatgaagccaaggaggcacagtcgaaggcgggaggaaagcaggccagtgagccgctgcagatgccagaggagggcagtgttccgaggagagaggcaccggtggggtcagaggcc

SEQ ID NO: 45154 - DNA, 601 bp, Human
tgcagaggatctggctcaatgcctgcaaatttccaacaaacaaatcagacccaggacaaatggctagagccgtcatatcatgtagatccatgtgaaaagaatccttttttttttttttttacaaaactagttttaaaaagtattcaaattcttttggagaataaggaagaagaggcagtcatttcactttggcttattttctgtcaccctagtgctgtaacagatcacagctagtgtcatgaagctgagttcttattaatagtgagaactgactccaagctcaaggaatttggcagccacyttgacaaaggtttaatctgctgaagagaacagctgaaatcattttaacatgattcactgaattactgaagcaagcctcacttttgtagagggacaggaaaagcagcatgcaggccttagtcagtccacaagtattttagtgagcccctattatgtgctagaccctcagaaggtaccaaggaaaggctacagagaatactgtaatataacttcagggttagacaaatagaccaatggaacagaatagagaaccaagaaatagtaccacttccacatataatttatgagacagagggagcat

SEQ ID NO: 45155 - DNA, 601 bp, Human
gtgaaaaaaatgaagttgtatccctgcctcacaccatatgcaaaatcaattccaggcaaattgaagacttagaaaggcaacattttaaaatatgtaaaaatgttacaatctcagggagggaatgatttctgcaaaaaccaaataactgctaattataaattaaaggatgataaagtcacctacagtaaaatttaaaacttctattcatcaaaaatactgtagagaaaaaggcaaggcacacactggaagaagatatttgcaacacacaaactgacaaaattcttattatctagaatatatraataacttttagaatcaatgagaaaaaacaaaaacaagccaatagaaaagtggacaaaagtcatgaatgacacgccacagaagagaaagtatgaatgacaaagaaacatatgaaaggctacttaagcttttatcatggaaacgtaaagtcaagtcttgatgagatcccaattcacccactagtgtggcagagattaaagtcagacaatggcaagtgttaatgaggatatggagaaacaggaactcttatccacctctggtggaagcctaattggcactggcatcttagaaaacaacttga

SEQ ID NO: 45156 - DNA, 601 bp, Human
tgccatattcatatgatgaaatacaatacaggaataaaaatagactatagctacatatgtcaatataatatatatgttgaacagaaaagaagcaattcatagaagagttcactgtattagttatctgttgctacataacaacttgctccaaaatttagcagctaaaaacagcagacatttaccatctcagggttgctgtgggtcaggaattcaggtgcagcttaaatgggtacctctgcctcaagttctctcatgagattgtcaggctgtcagccagggctgtggtctcacctcaaggctkgacttaaagaacacctgcttctaagctactcatgtggtggttggcaggctgtgtcccttgccatgtggcactccacgggcttgcctcccgacatggcctgtggattctcccagggagagtgatccaaaagataactagtgagagatcacccaagacagaagccatgatcttaccataacctaacttcagaaatgaaagtctatcacttctgccatactctatgtgttagaaaccagttacttggtccagcccacactcaaaaggaaaggattgcaaaagtgtgtgaagacctcaagagga

SEQ ID NO: 45157 - DNA, 601 bp, Human
ttaaatgggtacctctgcctcaagttctctcatgagattgtcaggctgtcagccagggctgtggtctcacctcaaggcttgacttaaagaacacctgcttctaagctactcatgtggtggttggcaggctgtgtcccttgccatgtggcactccacgggcttgcctcccgacatggcctgtggattctcccagggagagtgatccaaaagataactagtgagagatcacccaagacagaagccatgatcttaccataacctaacttcagaaatgaaagtctatcacttctgccatactctrtgtgttagaaaccagttacttggtccagcccacactcaaaaggaaaggattgcaaaagtgtgtgaagacctcaagaggaggggggatatcgaggtcattttagaagcttcctaccatactcttgtggtatgatttcatccttatgaaggtcggaaataggaaaaatgaaattacatattgcttaggtaatcctgcctacatggaagcactatgaagaaaaacgaggaaatgataaacatgacattcagggtaatgatgatcctggggtggggggcactaagaatggagagaacatacaag

SEQ ID NO: 45158 - DNA, 601 bp, Human
gctaattaattttagtatttacctccatgtctgtaagtaatatgtgtgtattgctaccttttgatgctttggtttatttaggtattatctattcccttcccactctgggagatgaaaatttagctccctttcctctcctccaactcttcctctcccttcatcttccttttataattacatcataattttggttaaagcagtaatcagtgtttacattactcagtcaacactaatttgactctattcatagttgagccttgtagtaaaaaatatgataacttttcccttcctgcagaacttytcatttttcctggagttgttaatgatcgtgtttgtttgtttgcttagttttctatgtattcgtcattaatgcaagtgcaaactctggcagttgtctaaacctcttttcaggatgttcaggcacattaagtttcctatcaatttcatctccttggaagtgtctcccagagcctcttgacctgctccagcccggacgggttgtcctccgcacctggtgtgcacctgtcctatgagggcctccctgtagcatcaccctgagctcgttacctttattccttgtcttcctccttggtttacttct

SEQ ID NO: 45159 - DNA, 601 bp, Human
gtttatttaggtattatctattcccttcccactctgggagatgaaaatttagctccctttcctctcctccaactcttcctctcccttcatcttccttttataattacatcataattttggttaaagcagtaatcagtgtttacattactcagtcaacactaatttgactctattcatagttgagccttgtagtaaaaaatatgataacttttcccttcctgcagaacttttcatttttcctggagttgttaatgatcgtgtttgtttgtttgcttagttttctatgtattcgtcattaatkcaagtgcaaactctggcagttgtctaaacctcttttcaggatgttcaggcacattaagtttcctatcaatttcatctccttggaagtgtctcccagagcctcttgacctgctccagcccggacgggttgtcctccgcacctggtgtgcacctgtcctatgagggcctccctgtagcatcaccctgagctcgttacctttattccttgtcttcctccttggtttacttctttgttttggtgaagcatacctcctgtgtcttcctgagagagggtgcatgggaggcaaacccgtgacaacct

SEQ ID NO: 45160 - DNA, 601 bp, Human
actcagtcaacactaatttgactctattcatagttgagccttgtagtaaaaaatatgataacttttcccttcctgcagaacttttcatttttcctggagttgttaatgatcgtgtttgtttgtttgcttagttttctatgtattcgtcattaatgcaagtgcaaactctggcagttgtctaaacctcttttcaggatgttcaggcacattaagtttcctatcaatttcatctccttggaagtgtctcccagagcctcttgacctgctccagcccggacgggttgtcctccgcacctggtgwgcacctgtcctatgagggcctccctgtagcatcaccctgagctcgttacctttattccttgtcttcctccttggtttacttctttgttttggtgaagcatacctcctgtgtcttcctgagagagggtgcatgggaggcaaacccgtgacaaccttacgtatctgaaaatgtcttcgttccaccctcagactgaactaatactttggccaattcagatttctggtctctggtttggaattctgatttggaaataattttcctccagaattttgaaggctttattccatggccttctagctt

SEQ ID NO: 45161 - DNA, 601 bp, Human
gtctaaacctcttttcaggatgttcaggcacattaagtttcctatcaatttcatctccttggaagtgtctcccagagcctcttgacctgctccagcccggacgggttgtcctccgcacctggtgtgcacctgtcctatgagggcctccctgtagcatcaccctgagctcgttacctttattccttgtcttcctccttggtttacttctttgttttggtgaagcatacctcctgtgtcttcctgagagagggtgcatgggaggcaaacccgtgacaaccttacgtatctgaaaatgtcttcrttccaccctcagactgaactaatactttggccaattcagatttctggtctctggtttggaattctgatttggaaataattttcctccagaattttgaaggctttattccatggccttctagcttccagtgttgctgtcaaaaagtccgaagctgttgtaatttctggttctttgtatttggcctcttttataccctcccccaaaacccctaaagctctgtaggattgtctcctttcccctggtgttctgaaatttcacaataatgtgccttggtgtgcatctattttcatccactgtgct

SEQ ID NO: 45162 - DNA, 601 bp, Human
ctgtagcatcaccctgagctcgttacctttattccttgtcttcctccttggtttacttctttgttttggtgaagcatacctcctgtgtcttcctgagagagggtgcatgggaggcaaacccgtgacaaccttacgtatctgaaaatgtcttcgttccaccctcagactgaactaatactttggccaattcagatttctggtctctggtttggaattctgatttggaaataattttcctccagaattttgaaggctttattccatggccttctagcttccagtgttgctgtcaaaaagtccraagctgttgtaatttctggttctttgtatttggcctcttttataccctcccccaaaacccctaaagctctgtaggattgtctcctttcccctggtgttctgaaatttcacaataatgtgccttggtgtgcatctattttcatccactgtgctggggacagtgagcctttgatctagaaactcatgcccttaagttctggggatttttgtttttgaatgatttttaaaataattacttctctccttctttctccttcttttccccccagttgtttctttctgtaacttctactgtttgaat

SEQ ID NO: 45163 - DNA, 601 bp, Human
cagccagggagcacgagtttaatcctcagggtttgcagggaaaggaggactgtggagacccacgtgcacaagaaaatccatgatgtgcacagagggcaggctacaaattaatcctaacttcatggttcggtattcaaggctctccattgcttctccctggacacctgcaaagcttctagcagcactgcttatctggggcctgacccctttagtcagtctttcatgtagaagaatcattttcagatactaagtatctcatgtcttttctttgtccaagaacttacagttgatttcttttgtrtctgtatcaaatagttctccagcctaaacttcaagacatcttcatgaatgcctcaccactccactgcacgtgtaaatccatgcccctgtatttttctgtctattgtttctcagactgataacacctgcgccctctcagcaacaataatggctgacatttagtgagcacttaatttgggtcactgtgctggtattgcttgtgggttattttacttaatcctcccatcattggataaggaaattgattgacagagagggcacgtcacttgcccacagccatggagctacttaactctggagc

SEQ ID NO: 45164 - DNA, 601 bp, Human
gctgcccccactccccaccccactccgtcttgttggcttcctggggctgatattggtggaccagacagtcagacccaggcttggggcagtcagcctgctgagcaggaggggccaggctctctcctcctttctgactccagtccagggcaggtccctattagcaggcaggtcctacgacagcagctaatgacaaaaagcttagcgctggggttgtgataaatcacgggtaagtgcaaggctttagaacaaatacctcccatcggttagtaggagtctgtcttggcatagcaccaactgtcaygaggaaaccggggaaagacgcttcttaccagaaaggaatgaaatgccactgaaggccaaatctttccttcttagagtcactcctggggctttgtgcctcagaaccagctctcagccagggctggcacagagcagggttgccagtaggtggatgggccctgccgggagcctctgttattttaaaataccgaccttttcccctctcagcacatagctgtccccatccaagaagcagcaccccaaagacctggcttcctggttcctggactccgcatctcctggctctactctggcacagctg

SEQ ID NO: 45165 - DNA, 601 bp, Human
gctcttccccccagtctgaccccagggaagtcatagcagcagctgtttaccctttcccatcctgcttcctccctcctcacacaccccctctacccaccagccatttcaaagattccacagttagccaggccctcggtgatttgtctcttaaaactaacctgcatcactgccatgtgacacagcactgccaggctgccactgtggcctgtcagactattaactcacctaagtgaaagggcccagcatcccaaaggggacccaggggacaggcaatccttataccacttgaagatggacacarcagggtgggatcccttggcacttccttcatgtcctctaaagggccaaaatggaccattgacttctggctcaagccttaggctccttgttcttccttcctctctcaatcccatcagcccatcattttttcttattcttcagcctcctccttctctctttccccccttgacccttgctgtttaggatgcgacgcaacttgttccccatctcattttctgcccagctttacctctccctgcacccaccttctcttctcttctcttctcttttctcctcttctcttctcttttctcctctctcc

SEQ ID NO: 45166 - DNA, 601 bp, Human
atggaccattgacttctggctcaagccttaggctccttgttcttccttcctctctcaatcccatcagcccatcattttttcttattcttcagcctcctccttctctctttccccccttgacccttgctgtttaggatgcgacgcaacttgttccccatctcattttctgcccagctttacctctccctgcacccaccttctcttctcttctcttctcttttctcctcttctcttctcttttctcctctctcctcccctcccctcctgttctattgtcttctctcccttcttcattttccckccccgcaccccgcacagtctgcagaggctcagcagtctaggcttcaggattcctccaccactttctgaaggctgctgatgtctggccccatctttattaggttgcctcttaatggaaaagaccaggttaggtgtcattactggtgactgccctaattacatccagtcaatggaaaaatgaagctgagagcatccatttaagttggaattaagggttaagaatgcagcatcctctagaggaatactcacaagggagtcataacatctctatgttgaaagaaactgggaagtgtcatctagt

SEQ ID NO: 45167 - DNA, 601 bp, Human
ggtaatgtttctcacttgaaccattatggaagtggttatggaagatgaaaatctgaaaatatgcaggaatgggtagaccatttagctgctgaaagttggacaccccactgaattgtctgagatgaaaagacccatttagaatagacagatacaagccttccagaataacagcaggccaaatgggcaaggcaggagctgtttattcaaggacagcttttatggaaaattctttagaactacagcctgaaggaaggtcagtaagatgatttcctgcaagactgtcctctttctgagacgagasagaattaaaaccctgtgcccgtgtctcggcctccatagtctttttcatttaggactgaagtaggttaagggacccatgagcaaccaaattttgatttgggtttttgaaagctagagaaaatattcagtgattaatgttgcacagcagcaaaaatgtgttagaaatagagacaacggcaggaaggaagaacaaaaagagagagagagagaatgacagagggagctgcgagcgagctcttggggaaggcagtgggagagtgtgcagcggccaaggcctctccagtttctcagcagaattatt

SEQ ID NO: 45168 - DNA, 601 bp, Human
gacatcgtgttcttccagacgccaggcctaaagacttagccccatttctgactcctctggaccctggaccccacgagggtctgagcactttctgtgtctgatttcaccttgccgtggctgttcacgcatgcccgcctctccagggcctcggccccgccactcttgaagccgccatcttctgtctcgcactatcacagcagcctgctacctgctctcctcacttcggcgtcccttaccccagtcatcctgcactctgcttccccatggatctccttagactctcaggcttagctctgaacawattacttcctgctcaaaaacctttaagtagtttccccacctactatctcctgaatgacactgaagaaaacttttctttaattacaagcatatgccaaagtttgatcataatcttgctagaagaaaattttcttcagcaggctaattcaaagattactcttagtagtggtatttcgtaggaaaaacaatggtagtcattgttatgccagattatagaaggtttagctaaagactgctaatggacagctggttgggctcaacagtggatttccagaacaagtcttcaagtctttacaattga

SEQ ID NO: 45169 - DNA, 601 bp, Human
catattacttcctgctcaaaaacctttaagtagtttccccacctactatctcctgaatgacactgaagaaaacttttctttaattacaagcatatgccaaagtttgatcataatcttgctagaagaaaattttcttcagcaggctaattcaaagattactcttagtagtggtatttcgtaggaaaaacaatggtagtcattgttatgccagattatagaaggtttagctaaagactgctaatggacagctggttgggctcaacagtggatttccagaacaagtcttcaagtctttacaatkgatcagataatcaatagggcagttatcaggaatgctaattctccccagaagaggattataaattacatcacgcacaaggttctgtcccagacagattgggtgcaggttttctttagcaatagtcacagaaacaatgtgcgtttaagctggaaggacccttagggaagagccactccaacccacatgagaagacgaaggcccagaaaggggcgagggtgggcccccggcctatgcaagatccactttgctctcagaccatcaggcaggcagctttagggcggtcagttccttggaactcag

SEQ ID NO: 45170 - DNA, 601 bp, Human
tcttcaagtctttacaattgatcagataatcaatagggcagttatcaggaatgctaattctccccagaagaggattataaattacatcacgcacaaggttctgtcccagacagattgggtgcaggttttctttagcaatagtcacagaaacaatgtgcgtttaagctggaaggacccttagggaagagccactccaacccacatgagaagacgaaggcccagaaaggggcgagggtgggcccccggcctatgcaagatccactttgctctcagaccatcaggcaggcagctttagggcggwcagttccttggaactcagcatggggttagggtcccagacctgctgaaaagaaaagccagcttaactccaccctaactgagtatcacataaatagcattatagaattatccaccacccattaccatattgctacagggagaacctcaagctccaactctgaacaacggaaatacacctcctctctctctacccaatttcctgccagccagagaggtggagctcccagttctaagtggtcagtgagggcctctgggtgaggcaggcagagaagcctgtaaagggagtgtggaatagaacagg

SEQ ID NO: 45171 - DNA, 601 bp, Human
ggggttagggtcccagacctgctgaaaagaaaagccagcttaactccaccctaactgagtatcacataaatagcattatagaattatccaccacccattaccatattgctacagggagaacctcaagctccaactctgaacaacggaaatacacctcctctctctctacccaatttcctgccagccagagaggtggagctcccagttctaagtggtcagtgagggcctctgggtgaggcaggcagagaagcctgtaaagggagtgtggaatagaacagggggaggaaaaagaggaggtgcragcagggtgatgaaagagagggcagccggggaagccagagcaagtctgcagggtggtgatgaggggagagtgggcttggcaaatgggaaagaggaaccagcccccttctctagtcctgtgtgtaatggacaccttcagtcaagggctggcttgcaggttctccgatagtgatctgatcatcactcagcctaatttcaacctgtgtaactccttgaagttacagtcatgcactgcataacaagtttcagtcaatgatggtgcacatataccaaggtggtctcagaaggctataacagagct

SEQ ID NO: 45172 - DNA, 601 bp, Human
tcccagacctgctgaaaagaaaagccagcttaactccaccctaactgagtatcacataaatagcattatagaattatccaccacccattaccatattgctacagggagaacctcaagctccaactctgaacaacggaaatacacctcctctctctctacccaatttcctgccagccagagaggtggagctcccagttctaagtggtcagtgagggcctctgggtgaggcaggcagagaagcctgtaaagggagtgtggaatagaacagggggaggaaaaagaggaggtgcaagcagggtgmtgaaagagagggcagccggggaagccagagcaagtctgcagggtggtgatgaggggagagtgggcttggcaaatgggaaagaggaaccagcccccttctctagtcctgtgtgtaatggacaccttcagtcaagggctggcttgcaggttctccgatagtgatctgatcatcactcagcctaatttcaacctgtgtaactccttgaagttacagtcatgcactgcataacaagtttcagtcaatgatggtgcacatataccaaggtggtctcagaaggctataacagagctgaaaaattcc

SEQ ID NO: 45173 - DNA, 601 bp, Human
ttttcagacattgctctgaaattatttcttttttgtgccaattacatttacatgtacaattgcagtgcaaatgtttttggccatttgggaaaggagacaatgggctcgttggtacctatagttccaatcagtgggaaagacattttctcaaagaagtcttttaaaatctccagctgataggaaatctgtttactctctgaacccaagcaatgtaccgtatacacgaagtggcaatctcaggcaaagctcggaagtctgcatgtaagggcagcaatggtatatcgctagctattttccaagrggaccccgggactcaaggtctcgctcatgcagcctgtctaaatatagcatcagcaacagcagtcaagagatagtattgaaataatcaagaaggaagaaagaaagaaggaaggaaggaaggagaaagaaagagagaaagaaagaaaaagaaagaaagaaaggaagaaagaaagagaaagaaagaaagaaagaccctccaacttcaagctctggtctgcagtgtccaacacaagattaagaacagatgaattttaatcacctttttttttcctttttttttttttttttgagatggagtttc

SEQ ID NO: 45174 - DNA, 601 bp, Human
gtgagcaccagcgtgggggccacaacccaggggcctggactctgagtccagagctcatcagggtgcccctgcggtcaaatgaaatgggtgattttgcacattccgggaagaatgtttgcctcgaggaggttctgtcatgttgattaataaagggagtactttcacttctaaagtcaccctgtcctccaagggcatccacgacacggtgtcctgctctggcaacagcagagctcatgggagcggggccatctccatgccaccttgtgacctttccttatgctgccccagtgaatttcctcayggggcctgtagtctgctggggaggcctcactgcattttgtgcccctgctccccttcattcttctctggcttctcacatcttcttttactcttcttttttcctctcaccttacttgctgctgctttggtccctggggcataaatcatgtccatatcttcctagagtaacctgaaatttcacgtgaaataggatcggggtgtcactggcagatcatcagaaacccaaagagccacagtacctcagggatgaccaagcaaccaccggcctggccctctgcattgccgccccaggagcctcact

SEQ ID NO: 45175 - DNA, 601 bp, Human
tgtcatgttgattaataaagggagtactttcacttctaaagtcaccctgtcctccaagggcatccacgacacggtgtcctgctctggcaacagcagagctcatgggagcggggccatctccatgccaccttgtgacctttccttatgctgccccagtgaatttcctcatggggcctgtagtctgctggggaggcctcactgcattttgtgcccctgctccccttcattcttctctggcttctcacatcttcttttactcttcttttttcctctcaccttacttgctgctgctttggtcccyggggcataaatcatgtccatatcttcctagagtaacctgaaatttcacgtgaaataggatcggggtgtcactggcagatcatcagaaacccaaagagccacagtacctcagggatgaccaagcaaccaccggcctggccctctgcattgccgccccaggagcctcactccctgacacgtgggaggctgaagatgcttgtgaatcttgttcccaagtctgatgtacacagccaagatggcatttgctaatttgctgggagaaaaatatctgttgcatagactgggactctgcagaccaaca

SEQ ID NO: 45176 - DNA, 601 bp, Human
tgaacccgggaggcggagcttgcagtgagccgagattgcgccactgcactccagcctgggagacagagcgagactccatctcaaaaaataaataaataaataaataaataaataaataaaggccatgagtggtggtgcactcctgtagtcccagctacttgggaggctgaggcgggaggatccttagagtccgcaagttcctgtagtgagctattatgccaccgcactacagcctgggtgacagagcaagaccctgtctctaaattctaaaaattaaaaaaaaaaaaaaaaaaagaatgarggagtgggtgctaggtgcctcccttttttggccaggaggagcaagtgccaggcatggggggagtccacatactacccagtcttcagtcttctcaggactcccttccccacctcttgggagctgcctggggaagccagcacaggtgggaagggctggaaggggctgctccccacagtactgaatgctgcatgaaccaccccccataccacaaacacagcgaagcatgacttaggaaaagcctccagtgggtggtccaaggacgacctgtatcagttctgattagaaatgaagattcctggg

SEQ ID NO: 45177 - DNA, 601 bp, Human
atggcgtgaacccgggaggcggagcttgcagtgagccgagattgcgccactgcactccagcctgggagacagagcgagactccatctcaaaaaataaataaataaataaataaataaataaataaaggccatgagtggtggtgcactcctgtagtcccagctacttgggaggctgaggcgggaggatccttagagtccgcaagttcctgtagtgagctattatgccaccgcactacagcctgggtgacagagcaagaccctgtctctaaattctaaaaattaaaaaaaaaaaaaaaaaaaaaatgaaggagtgggtgctaggtgcctcccttttttggccaggaggagcaagtgccaggcatggggggagtccacatactacccagtcttcagtcttctcaggactcccttccccacctcttgggagctgcctggggaagccagcacaggtgggaagggctggaaggggctgctccccacagtactgaatgctgcatgaaccaccccccataccacaaacacagcgaagcatgacttaggaaaagcctccagtgggtggtccaaggacgacctgtatcagttctgattagaaatgaagatt

SEQ ID NO: 45178 - DNA, 601 bp, Human
ctgacaactcttgagagacaaagagagtgcaagaaatggatgagatgatcgattcacaggttccgagaggctaagacctgcagtgcccataaccacacagcttagatgtgagaaggagggtcaccacaccctgtcctacaggctggagctgccacacacctctctagctccagtgcccaacactcaatgtggtatagcaccaggcttgatcaatgtcaggtggatggatgctgtgaagaagctgggcagagaggcaggaggtacagttgcacacagtgcagctgcagacacagaggtggaracaggggttgggaaaggtctcctcaaacagatataaagtgaggaacactgtcctttagactgacttcaacccaagggtgaaaagaatgtcacggtaaaaaaagaatgagggaggccaggtgtggtggctcacatctgaatcccagcactttgggaggccgaggtgggaggatcgcttgaggccaggagttcaagaccagcctgggcaacatggtgagactgtctctaccataaataaataaataggctgggcgcggtggctcacgcttgtaatcccagcactttgggaggctgaggcggg

SEQ ID NO: 45179 - DNA, 601 bp, Human
ggagcacacgaatgttctgaatgtgtttgtgagcatacgctattagtataaggctttctcagcaaaaaagaaaataggacgagcatgccaagagcggccaatctaatcaggatttgcagaaatcacaagtcggaatttgcagatccaagaattcttgtttccagagtaaatactctactccaaaaacaaacccaggcgttaccaaacagtccttccctgcgccccttctcgccaaagttatctggcgaatttcacgtttatatattctgagaggcacaaatatgcctaacacatttaaaascctgatccagaattaacccgcaacaatcggccagggcgttcggaatagaagttcaagactccttttagaaattactcaagtatatgagagcgaacctgaaaaacaagacttttctctttgttacgctcccgctacgggtctggccgccgcgccccattctccgggattccggggccgcgggcgcgctccggggtccgggcgagtggacacaccccaccgctcgggccagccgcccgcccctcccgccggccggggaccgcgccctcacctgctcccgctcccgctcccgcatcctcgggg

SEQ ID NO: 45180 - DNA, 601 bp, Human
cccgggaccgcgcggagaggcaagatctattcccgaccctctcatctggcagacagaacccaggcttcaggaagagaagcggctttcgcagtttcacgctaggacgggctgagctgggaatcgatcccaaattccacagtcccagtcctctcctgggtcctgctctcctgactgcgtctcaggcccagaggtgatggggcacttagggttagggaatggcagacctggagaaaagggttccgctactaccctcggctttgccaaacttaacattttgaaattccattccacaaatgtgtaytgcgtctctgggaacaagacagcgtaatgagcatcgtgagaaatctaagacgaatccctaaaccgtcgctgtctttaaagagattacaaccatgctataattacatacagagctgtatctctaataaggacccaaccacggttttatctggctagtttttttgtttgttttgagctctggttatttcccatagccaggaaaatcaaaatattaaaaacaagggataggggaaggccagaagaaaaaaacaacgctgcaactacctaaagcactgtgttaattaaccgcatttgctgagtg

SEQ ID NO: 45181 - DNA, 601 bp, Human
tttcttcaagaatggaggagcaaagagggaaaagctacccccaccaacccagcgctggtgacgccaggagaaagcgatcctctccggatgggacgaacactgtccggcctccagctgctcacccagcagccgctgccgccattaaaaagcaacggagtctccaatggcccgaggaagggagcattgacgccagcgctggggaaagaggaacgccgttagttaagcaaacgtaacgctgggctttgcttatataaagaaaagccagtcaagctgtggccaaagaacaagccgtccctctccrctggaaaaaaggcactaacaggacccggaaggcagggtggaattttatctcagagttgtgctaggctcagggtcagactccacccttcactgtatcctacaaatagggatagcaaactgggccatcctcaggattaaatgagataatagccagcactactataatcccaaattttgtagttagtaattgtgatcctcttcctattttggataaggtgttgttttttcataggtaactctttcaggttgtaatactccaaatgtcagagttctttagtccttaagtgagaaaagtgccaaa

SEQ ID NO: 45182 - DNA, 601 bp, Human
ggcctgcagtgtctttaggtggcttacctcccgcagctccagcctctgggccacggcctcgaggctttcctggccagtgctctccacggacagggtgaactccacaaactcgttattaagcagttggatccgggcaaccaggcaactcttgctggacaccgtgtagcgccgggtgcgtttcagtttcaacccaaatggcagtggcatcttcttctttcttcaagaatggaggagcaaagagggaaaagctacccccaccaacccagcgctggtgacgccaggagaaagcgatcctctccgkatgggacgaacactgtccggcctccagctgctcacccagcagccgctgccgccattaaaaagcaacggagtctccaatggcccgaggaagggagcattgacgccagcgctggggaaagaggaacgccgttagttaagcaaacgtaacgctgggctttgcttatataaagaaaagccagtcaagctgtggccaaagaacaagccgtccctctccactggaaaaaaggcactaacaggacccggaaggcagggtggaattttatctcagagttgtgctaggctcagggtcagactccaccct

SEQ ID NO: 45183 - DNA, 601 bp, Human
atttactgaacacattccacacctggtataaaaataaataaaccacagttcctcaagaagctgactctctaggcgttatagacagacctggtgcacgaggaagaaaattacaggaagaagaaaccataataggaaaaaaaaaaaaaaagtcgaagcaaccaaagtaaataaataaataaataaatagaatataagccactaagccaggcaaggtggcacacgcctgtaatcccacctactcacaaagttgaggcaggaagataactagaggaaacaactcccagaccagcctgggcgacayagcaagactccatctcaaaaacacaagttaaaaaaaaaattagctgggtgtggtggagtgtacctgtagtcccagctcttggcaggctaaggcaaaaggatcacttgagcctaggtgtttgaggatgcattgagctatgacggtgccactgtactccagcctgggtgatggagtgagacctcatccctaaaaaagaataaatgcaagtaagcagggactggttactgaggcctgctgttctggttttctttcttcttcttcggcagtttcatctcagtttccttccaacactttcccctc

SEQ ID NO: 45184 - DNA, 601 bp, Human
ctcacgcctgtaatcccagcactttgggagaccgaggcagacggatcatgaggtcaggagatcgagaccatcctggctaacacggtgaaaccccatctctactaaaaatacaaaattagccgggcgtggtggcatgcgcctatagtcccagttacttgggaggctgagacagaagaatggcatgaacctgggagactgagacaggagaatggcatgaacctgggagacggaggttgcagtgagccgagatcgcgccactgcactccagcctgggcgatagagcgagactctgtctcaaataaaaaaaaaaaaaaaaaaaaagaagttactttctgtagttcaaatatggtgaatttaaaagaaagttagcaacctaagttaactacattggatacatgtatattaaccacgttgcttttaatttaatacaaaatatcttagacacttgtaaaaatatgacagctaaaaatacaaacaaaaaaaatacccatatacccagtgtaagaaacactactgatatagctgaaacccctgggtatagtgttatactattgtgcggcccttgtaactgtcattataggcccgggcacgttggctcact

SEQ ID NO: 45185 - DNA, 601 bp, Human
aaataacaaaactactctgccccatatataaatctcaacactatacaccttttaatgatcatatttgggtaatctactatagaaagtggtacaaacccttgataggaagttatttctactacatgctaccaatcctcatgaaggatttgtgacatacacagtttcttctagtaatgttagcatcttaggcaaaaacttaaattgcctctgtatgttctgtcaattcattaaaagataaaggaaatctaagtgacatttgtttatgaacaaattgctcagagaactgaataggaaaatattygctaaattggcatactgttaaaagaatgatgaatccttgttaatagaaaagaaaatgccatattcacataaagtgtgtatctgacaagaagaatgatacagagggctcaacaattggcctgggaacttgattaatgtataaaggaagaatgaatcatccattcaattcctgaagatgcatcacatacctgctgcctagcagggaagacagacatggatctaccatcagcaggacagtgggggaattcccactcatgacctcccctctgtcccccctgagaggggctttttccttaatagt

SEQ ID NO: 45186 - DNA, 601 bp, Human
tattgattgaatacctactacatgtcaatcactgttctgggaactaggaatacagcattgaacatgagaacaaaattcctgccctcacgtaacttaattccaatagggaaaaatagacaagcaaaatatatattatgccagatactgataagtgctatggagaaagatcttgaattataagattaagacaatatcaacatgtttttaaagagtaaactaggattaaaggggaaattttagtagtcacgtgtcccttaacgatgtgggaatgcatcattaggctatttcattgtgtgaacaktatggagtgtacttacacaaacctaaatggtatagcctcctacacatttagggcatgtgatatagcctactgctgctaggctacaaacctgtacagcacattactgtagtgaatattgtaggcaactgaaacacaatggtatttgtgtatctacacttatgtaaacataggaaaggtacagtaaaaatacagtattataattttatgggaccaccatcttataagcagtctgtcattgaccaaaaatgtgatatgcagcacatgactgtatatatataaccaacaagaatgacagggata

SEQ ID NO: 45187 - DNA, 601 bp, Human
tgtaatcccagctacttgggaggctgaagcacaaaaatggcttgaacccaggacgcagaggttgcagtaagccaagatcacgcaactgtaccccagcctgggcaacaaagtaagactgtctcaaaagaaaaaaaaaaaagtttaaaaagtaaaaaacaaaaaaatactttaaaatagaaaaaagcttatagggtaaggatatagatatttttgtatagctgtacaatgtgtctgtgttttaacctatgttattacaagagtcaaaagttttaaaaatttaaaagtttgtaaagcaaaaacrttatagtaagctgaggttaatttattatcgaaggccaggtgtggtggctcatgcctgtaatcccagcactttaggaggccgaggtgggaggatcacctgaggtcaggagttcaagacaagcctggccaacatgttgaaaccccatttctactaaaactacaaaaattagccaggtgtggtggtgcacgcctataattccagctacttgggaggctgaggctacttgggagaatgcttgagcctggaagtcgaggctgcagtgagccatgattgcgtcactgcactccaacctgggcaaca

SEQ ID NO: 45188 - DNA, 601 bp, Human
ggtggtcccctaagactgtaacagctgaaaaattcctatcacatagtgatgttgtagttgctaagttgcagtgcaatgcattactcacatgtctgtagtgatgctggtataaacaaacctatcgtgctaccaattgcacaaaagcacagcacatacaactatgtacagtacataacactggacgataataaatgactatgttactgatttatgcatttattatactttttatttagagtgtactcctatttataaaaaagttaactgtaggccaggtgcagtagctcccatctgtaatccyagtgctttgggagactgaggccagaggatcacttgagccaaggagttcaagaacagcctgggcaacatagtgagaccccatcacaacaaaaaatacaaaaatcagccaggtgtggtggtgtagacccaactaggaggctgaggcaggaggattgcttgagcccagaagttcgaggctgcagtgagctgtgattgagccactgcactacagcctgggtgacagaatgagaccctctttcaaataaaaaaaacagtgaactggaaatcagcctcaggaggtttccagaagaaggcattgtta

SEQ ID NO: 45189 - DNA, 601 bp, Human
tccaatccaaagcagattaaaagatgacaaattaaaggaaaagggcttatttaataatagcaagttggcagtagagggaagtgatgggcaatattctttttagcaaaggagaacacgtacataacaaacaaaaaccccttaaatagaatttacaaagaattacaaatatatgggagtctggagttacttactaaagaaacaaataactccaaacattaattagtcatgtattcaacaacaatcactgttcctaaaagcagaggtagtatcctttatttacgacagatagaaatttataaaytgtttccaaaacttagcactccaaatagtttggacaaaggagtcaaccttgtttatcaggcaaagttagttatgaagcgcttcatttcccaaagaaataacttatttccaagaaataacttattttccaaaaataacttattttatataaagctttacagtactctagccaatttaattggggtttcattacttcacttacaagtacaagcatattttccaaagccaaacatgaaagctgtttccatttctgttttggtacctgctgttatttgttttttgaaaggtttaactagtagca

SEQ ID NO: 45190 - DNA, 601 bp, Human
ggatgcccatgttcaccactgccatttgacattgtactgaaggttctaaccagagcaattaggcaagaaaaataaaagacatttaaagtggaaagaagtagtaaaactatctatgtacagatgacataatcctagacaaagaaaatcctccaaatccaccccccaaccgtgacacacacacacacacacacacacacacacacacacacacccctgccctactcgaggtaatacattcagtgaagtttgcagggtacaagatcaacatgcaaaaatcagctgctatataccagcaatgtayatgtcaaaaaaagaaaacaattccatttacagtaatatccaaaagaacaaaatatgtaggaataaatttgaccaagaaggtgaaaaggcatatactgaacacaactaaacagtgctaaaagaaattaaggaaaatctaaataaatagaaagatatcccatgttcatagactgaaatacttaatattgttaaggtgcagtactacccaaagtaatcttcaaattcaaatgcaatacctatcacaatcccaatatgctttttcatagagataaaaagccaatcctcaaattcacatgggcct

SEQ ID NO: 45191 - DNA, 601 bp, Human
caaaaaattagccagatgtggtagcgtgtgcctgtagtctcatctacttggcaggctgatcacttgaacccaggaggtagacagaggctgcagtcagctaagactgcaccactgcactccagcctgggtaacaaagtgagactctgccttaaaaaaaaaaaaaatccttgacaagctgcatgcaaataaaatttttgaaaatccaagcacattgtaatatatctgaaaggccaagtcccattgttaattatattctgaggttatgacattttaaaatgaattgcttattatctgtaagcayagaatatgtatcatacatttatagaaaacaagtactgttcttttctttttttaaactgcaacttatagaaaacaaaaatctggtttaatagaaagagcttgatgcttaagtccaaagttctgagtttgatttccaacagttatttactaggagtgaaatggtaaagtcaatcaatctaatttggttttctcaagtgtaaaataaagtaatatctccctcacaatcctgtcatgaggattggatacgggaaaactacctaagtacattttcctattagaaaaccattatattttatttttt

SEQ ID NO: 45192 - DNA, 601 bp, Human
aagttatataaaaccttatctttggctgggtgtggtggcacacacctggaatgccagcattttaggaagctgaagtgggaagatttcttgagcccaggagtttgagaccaatctgggcaacatggcgaaacactgtctgtgtaaaaaatacaaaaaattagccagatgtggtagcgtgtgcctgtagtctcatctacttggcaggctgatcacttgaacccaggaggtagacagaggctgcagtcagctaagactgcaccactgcactccagcctgggtaacaaagtgagactctgccttaaaaaaaaaaaaaatccttgacaagctgcatgcaaataaaatttttgaaaatccaagcacattgtaatatatctgaaaggccaagtcccattgttaattatattctgaggttatgacattttaaaatgaattgcttattatctgtaagcatagaatatgtatcatacatttatagaaaacaagtactgttcttttctttttttaaactgcaacttatagaaaacaaaaatctggtttaatagaaagagcttgatgcttaagtccaaagttctgagtttgatttccaacagttatttactag

SEQ ID NO: 45193 - DNA, 601 bp, Human
caactgcaaaagtttccttgcacccctcataatctttctctccaattcctaccccattcctaggaaaccactcatctgctttctgactatggatgtaatagacagaactctggatatcttggaccaagaggtaacctagtgcatgggaaggatgcgctgaggatgctggagcactaagagaaagtgcgagcatccttgaagactctgtggagctgtcagacaagctctgcaaggctgacttctgaactctcacagaagtcaatgatatttagggtttttgttatatatagctatacttaayccttaccgatacaacttctctatcaggtgctcctatacctaatcgatgagcaatcctattgattgactctaataggcccattctctctcaatccagctaatgcctttctgttcagttctatattgtaaacctatgcctagattatggcacaggtattcctaaactggtgtcctgcctatagtcttgccatctctgatctaccttctatgatgggtgatctttgtgaaatgtaaatttaatgattccattaaatttgaaaatctcttcctcattgtaccatgactttattgctaatgtcta

SEQ ID NO: 45194 - DNA, 601 bp, Human
ccaggctggagtgcagcggtgccatctcggctcgctgcaacctccgcctcccgagttcaagcaattgtcctgcctcagcctcccgagtagttgggattacaggcatgtgccaccacacctgacatattttgtatttttagtagagacggcgtttctccatgttgatcaggctgatctcgaactcccgaccttaggtgatctggccccctcagcctcccaaagtgctgggattacaggtgtgagccaccacgcctggccctccccctttgttttcttccaatatctttgagtgggtttttttagaacacaatttttgaggtataattggcatacgaataagctgttcaaatttcaagtgtacaatttagacacatatatatatccatgaaaccatcactataaaatgaggaacatactgaccaactgcaaaagtttccttgcacccctcataatctttctctccaattcctaccccattcctaggaaaccactcatctgctttctgactatggatgtaatagacagaactctggatatcttggaccaagaggtaacctagtgcatgggaaggatgcgctgaggatgctggagcactaagaga

SEQ ID NO: 45195 - DNA, 601 bp, Human
atatactagcagtgtgaccttgggcaaggtgttcaacccttctgtgtcttggtttcctcatctacaaaatagagataatagcacctacatcacaggatttgttatgagaattaaattaataaagtacttgggacagtgtctaacatacagtaaaaaacataagtggttgttattatatgttattgtattatccctcaaatactttaatggaagcaactaaggatggatgaatggatggatggatggatacacagacagatagatttttttttttttttgagacagggtcttgctctatagyccaggctggagtgcaatggcgtaatcagggctcactacagcctcaacctcctggactcaagtgatccttgagcctcagcctcctgagtagttgggaccacaggtgtacaccaccacagctggctaaattttttttaattttttgtagaaacagggtctctctatgttgcctgggctggtctcaaactcctgagctcaagcgatcctcccacttcggccatccaaagtgctgggattacaagcatgagctaccacacccagccataaatacgtttttcttaaagaagtatttactgtagga

SEQ ID NO: 45196 - DNA, 601 bp, Human
cctgcttgagtcccagttccagtatatactagcagtgtgaccttgggcaaggtgttcaacccttctgtgtcttggtttcctcatctacaaaatagagataatagcacctacatcacaggatttgttatgagaattaaattaataaagtacttgggacagtgtctaacatacagtaaaaaacataagtggttgttattatatgttattgtattatccctcaaatactttaatggaagcaactaaggatggatgaatggatggatggatggatacacagacagatagatttttttttttttttgagacagggtcttgctctatagcccaggctggagtgcaatggcgtaatcagggctcactacagcctcaacctcctggactcaagtgatccttgagcctcagcctcctgagtagttgggaccacaggtgtacaccaccacagctggctaaattttttttaattttttgtagaaacagggtctctctatgttgcctgggctggtctcaaactcctgagctcaagcgatcctcccacttcggccatccaaagtgctgggattacaagcatgagctaccacacccagccataaatacgtttttc

SEQ ID NO: 45197 - DNA, 601 bp, Human
ttacatgacagtccacaaaacacaatggtcgagagcaaggacccaggagccagcctgcttgagtcccagttccagtatatactagcagtgtgaccttgggcaaggtgttcaacccttctgtgtcttggtttcctcatctacaaaatagagataatagcacctacatcacaggatttgttatgagaattaaattaataaagtacttgggacagtgtctaacatacagtaaaaaacataagtggttgttattatatgttattgtattatccctcaaatactttaatggaagcaactaaggatrgatgaatggatggatggatggatacacagacagatagatttttttttttttttgagacagggtcttgctctatagcccaggctggagtgcaatggcgtaatcagggctcactacagcctcaacctcctggactcaagtgatccttgagcctcagcctcctgagtagttgggaccacaggtgtacaccaccacagctggctaaattttttttaattttttgtagaaacagggtctctctatgttgcctgggctggtctcaaactcctgagctcaagcgatcctcccacttcggccatccaa

SEQ ID NO: 45198 - DNA, 601 bp, Human
tagtatttttattcatttagtatgttacatgacagtccacaaaacacaatggtcgagagcaaggacccaggagccagcctgcttgagtcccagttccagtatatactagcagtgtgaccttgggcaaggtgttcaacccttctgtgtcttggtttcctcatctacaaaatagagataatagcacctacatcacaggatttgttatgagaattaaattaataaagtacttgggacagtgtctaacatacagtaaaaaacataagtggttgttattatatgttattgtattatccctcaaatmctttaatggaagcaactaaggatggatgaatggatggatggatggatacacagacagatagatttttttttttttttgagacagggtcttgctctatagcccaggctggagtgcaatggcgtaatcagggctcactacagcctcaacctcctggactcaagtgatccttgagcctcagcctcctgagtagttgggaccacaggtgtacaccaccacagctggctaaattttttttaattttttgtagaaacagggtctctctatgttgcctgggctggtctcaaactcctgagctcaagc

SEQ ID NO: 45199 - DNA, 601 bp, Human
tcaatgacccaaaggtcttgttcttaaccacgacaaatctacagttatagatatttctagtatttttattcatttagtatgttacatgacagtccacaaaacacaatggtcgagagcaaggacccaggagccagcctgcttgagtcccagttccagtatatactagcagtgtgaccttgggcaaggtgttcaacccttctgtgtcttggtttcctcatctacaaaatagagataatagcacctacatcacaggatttgttatgagaattaaattaataaagtacttgggacagtgtctaayatacagtaaaaaacataagtggttgttattatatgttattgtattatccctcaaatactttaatggaagcaactaaggatggatgaatggatggatggatggatacacagacagatagatttttttttttttttgagacagggtcttgctctatagcccaggctggagtgcaatggcgtaatcagggctcactacagcctcaacctcctggactcaagtgatccttgagcctcagcctcctgagtagttgggaccacaggtgtacaccaccacagctggctaaattttttttaatttttt

SEQ ID NO: 45200 - DNA, 601 bp, Human
gatgaagagctggagctcagagattaagcaacatgctcaaatgcacagagccagactgagctggagtttgaatccccaggtctcaatgacccaaaggtcttgttcttaaccacgacaaatctacagttatagatatttctagtatttttattcatttagtatgttacatgacagtccacaaaacacaatggtcgagagcaaggacccaggagccagcctgcttgagtcccagttccagtatatactagcagtgtgaccttgggcaaggtgttcaacccttctgtgtcttggtttcctcatmtacaaaatagagataatagcacctacatcacaggatttgttatgagaattaaattaataaagtacttgggacagtgtctaacatacagtaaaaaacataagtggttgttattatatgttattgtattatccctcaaatactttaatggaagcaactaaggatggatgaatggatggatggatggatacacagacagatagatttttttttttttttgagacagggtcttgctctatagcccaggctggagtgcaatggcgtaatcagggctcactacagcctcaacctcctggactcaag

SEQ ID NO: 45201 - DNA, 601 bp, Human
aacatgaaaaagcaacatacttggacccaattaatgtagccttccacaaaaatatttttgccttacattatactgttatgagaattgactcttccatatttgctctaacttattcatttctggttcaatgtcttatataaaaaatcacacctcaaagtttctgtttaaatgctataccaggaaaatgtatcatgcttgcaaacaggtatgcttctttgtgttacataatgaatgatggaactcgtatttcttcttttgctttggctgccattaagctcacagctaaaatccaggcataatygcactcattactatccctcttaattgctttctccactatttaataatagttacctttaagtgatgaagagctggagctcagagattaagcaacatgctcaaatgcacagagccagactgagctggagtttgaatccccaggtctcaatgacccaaaggtcttgttcttaaccacgacaaatctacagttatagatatttctagtatttttattcatttagtatgttacatgacagtccacaaaacacaatggtcgagagcaaggacccaggagccagcctgcttgagtcccagttccagt

SEQ ID NO: 45202 - DNA, 601 bp, Human
gagttggagaccggactggccaacatggtgaaaccccatctctactaaaaatacaaaaattagccaggcgtggtggcacatgcctgtagtcccagctacttgggaggctgaggcaggagaatcgcttgaacccaggaagcagaggttgcagtgagctaagatggtgccattgcactccagcctgggcatcacagagagagtctgtctcaaaacaaaaaacaaaaaacatgaaaaagcaacatacttggacccaattaatgtagccttccacaaaaatatttttgccttacattatactgtyatgagaattgactcttccatatttgctctaacttattcatttctggttcaatgtcttatataaaaaatcacacctcaaagtttctgtttaaatgctataccaggaaaatgtatcatgcttgcaaacaggtatgcttctttgtgttacataatgaatgatggaactcgtatttcttcttttgctttggctgccattaagctcacagctaaaatccaggcataatcgcactcattactatccctcttaattgctttctccactatttaataatagttacctttaagtgatgaagagctggag

SEQ ID NO: 45203 - DNA, 601 bp, Human
catgcctgtaatcccagcattttgggaagccaaggcgggcggatcacttgaggtcaggagttggagaccggactggccaacatggtgaaaccccatctctactaaaaatacaaaaattagccaggcgtggtggcacatgcctgtagtcccagctacttgggaggctgaggcaggagaatcgcttgaacccaggaagcagaggttgcagtgagctaagatggtgccattgcactccagcctgggcatcacagagagagtctgtctcaaaacaaaaaacaaaaaacatgaaaaagcaacatayttggacccaattaatgtagccttccacaaaaatatttttgccttacattatactgttatgagaattgactcttccatatttgctctaacttattcatttctggttcaatgtcttatataaaaaatcacacctcaaagtttctgtttaaatgctataccaggaaaatgtatcatgcttgcaaacaggtatgcttctttgtgttacataatgaatgatggaactcgtatttcttcttttgctttggctgccattaagctcacagctaaaatccaggcataatcgcactcattactatccctc

SEQ ID NO: 45204 - DNA, 601 bp, Human
tttccttaaatcaaaaacactagaaagggctgggtgcagcggctcatgcctgtaatcccagcattttgggaagccaaggcgggcggatcacttgaggtcaggagttggagaccggactggccaacatggtgaaaccccatctctactaaaaatacaaaaattagccaggcgtggtggcacatgcctgtagtcccagctacttgggaggctgaggcaggagaatcgcttgaacccaggaagcagaggttgcagtgagctaagatggtgccattgcactccagcctgggcatcacagagagastctgtctcaaaacaaaaaacaaaaaacatgaaaaagcaacatacttggacccaattaatgtagccttccacaaaaatatttttgccttacattatactgttatgagaattgactcttccatatttgctctaacttattcatttctggttcaatgtcttatataaaaaatcacacctcaaagtttctgtttaaatgctataccaggaaaatgtatcatgcttgcaaacaggtatgcttctttgtgttacataatgaatgatggaactcgtatttcttcttttgctttggctgccattaagc

SEQ ID NO: 45205 - DNA, 601 bp, Human
gctattcacatattccattctaaatattctaggacttttccttaaatcaaaaacactagaaagggctgggtgcagcggctcatgcctgtaatcccagcattttgggaagccaaggcgggcggatcacttgaggtcaggagttggagaccggactggccaacatggtgaaaccccatctctactaaaaatacaaaaattagccaggcgtggtggcacatgcctgtagtcccagctacttgggaggctgaggcaggagaatcgcttgaacccaggaagcagaggttgcagtgagctaagatgrtgccattgcactccagcctgggcatcacagagagagtctgtctcaaaacaaaaaacaaaaaacatgaaaaagcaacatacttggacccaattaatgtagccttccacaaaaatatttttgccttacattatactgttatgagaattgactcttccatatttgctctaacttattcatttctggttcaatgtcttatataaaaaatcacacctcaaagtttctgtttaaatgctataccaggaaaatgtatcatgcttgcaaacaggtatgcttctttgtgttacataatgaatgatggaa

SEQ ID NO: 45206 - DNA, 601 bp, Human
gaacatgctattcacatattccattctaaatattctaggacttttccttaaatcaaaaacactagaaagggctgggtgcagcggctcatgcctgtaatcccagcattttgggaagccaaggcgggcggatcacttgaggtcaggagttggagaccggactggccaacatggtgaaaccccatctctactaaaaatacaaaaattagccaggcgtggtggcacatgcctgtagtcccagctacttgggaggctgaggcaggagaatcgcttgaacccaggaagcagaggttgcagtgagctragatggtgccattgcactccagcctgggcatcacagagagagtctgtctcaaaacaaaaaacaaaaaacatgaaaaagcaacatacttggacccaattaatgtagccttccacaaaaatatttttgccttacattatactgttatgagaattgactcttccatatttgctctaacttattcatttctggttcaatgtcttatataaaaaatcacacctcaaagtttctgtttaaatgctataccaggaaaatgtatcatgcttgcaaacaggtatgcttctttgtgttacataatgaatg

SEQ ID NO: 45207 - DNA, 601 bp, Human
aacaggtaattactggggtctattatatgttaagcattattctagatgctggggataccgtactaaatggaaatcacagacactctgccagtgcagtctatggagccatctggaatccaaactgtcctccgtatctggtgcctgtgaagtgcaacccagttacagttcatgtttgaattcctctgacagcccacccctttaatcatttcatatgagtctttatcatcttatttcagccacagacatgtaaacctctgttctttattaccaaagaacctgaccaaaacaccatccattcaaktaagaagaatttggatccagcttttctccttccacctgctaacagccaaacccatggatttccctctatagctaatgggatgctggcagttctgggatccaccaaagagaaaaacttgagattttctatatggcagctcctttcagaagcttatctgagggagagcgtgtttagggaagtctgtctattgaacatgctattcacatattccattctaaatattctaggacttttccttaaatcaaaaacactagaaagggctgggtgcagcggctcatgcctgtaatcccagcattttgg

SEQ ID NO: 45208 - DNA, 601 bp, Human
accccttcacaggactgaacatactcaaataataatatatgtgaaggaccaagagcatagccggctaacagcagctcttatcaatcacgtacttgaagccactcacttctccattttgataaagctctagagtgaagatttactacttccttttatttattttctcaacaggtaattactggggtctattatatgttaagcattattctagatgctggggataccgtactaaatggaaatcacagacactctgccagtgcagtctatggagccatctggaatccaaactgtcctccgtatytggtgcctgtgaagtgcaacccagttacagttcatgtttgaattcctctgacagcccacccctttaatcatttcatatgagtctttatcatcttatttcagccacagacatgtaaacctctgttctttattaccaaagaacctgaccaaaacaccatccattcaagtaagaagaatttggatccagcttttctccttccacctgctaacagccaaacccatggatttccctctatagctaatgggatgctggcagttctgggatccaccaaagagaaaaacttgagattttctatatggc

SEQ ID NO: 45209 - DNA, 601 bp, Human
taatctttactttaaaaactctgactagtaacttagtaatataagagtttgcttaccttgtttggtagaagttccctagcactggaaagtaaagccagagaaaaatggtttctgatatttcagaccaggctgatattaaaatgtttctgatgaaatccctcaaaacagctgttaagatgctttcttaatatctggtaatgtgggtttacttctgtttaccaccctgtttgtactttcaatatatagggcatcagttaccagaacaaggtttagagtcaagtagacctgaactctccaaatyagtattctgcacgaacttgggcaagtcataatctggtgaatttaaattctatcaccagtaaaatgagggtaccatcaccccttcacaggactgaacatactcaaataataatatatgtgaaggaccaagagcatagccggctaacagcagctcttatcaatcacgtacttgaagccactcacttctccattttgataaagctctagagtgaagatttactacttccttttatttattttctcaacaggtaattactggggtctattatatgttaagcattattctagatgctggggatac

SEQ ID NO: 45210 - DNA, 601 bp, Human
gttgtaacacattttaatctgatagaaccatttcattatgaattgatcttatttaccttgaacagctaagcctgctagctgaattgcttgttctaaggtacaaggaatacttccttccaagatatctttcttcagttgcagataatactgatacctataaaaaatgtcagttgtataaggtcaatgtcaatattatctcattgagatacaatgcatttaaccataatttggtagagaagcataaaccagtgaaataaaaccttaatcccacatggttgtgtgtgtttttttttttttttttagatagggtctccctttgttgcccaggctcgagtgcagtggcatgattactgctcactgtagcgtcaaccttcctaagcttaggtgatcctcccacctcagcctcctgagtagctgggactacaggtgcataccactatgcctgacaaatttttctattttttacagagatgggagtttcaccatgttgcccaggctgttctctaactcctgggctcaggcaatcctagtgcttggattcaaaatgttgggactacggacatgaaccaccacacagagcccctagacagtttcaaacaag

SEQ ID NO: 45211 - DNA, 601 bp, Human
tgtactgaatactgtaggcaactgtaacacaatggtatttgtgtatctaaacacagaaaaggtacgctaaaaatagtgttataattttatgggaccactgtcctatatgaggtcttttgttgaacaaaatgtcattcggcatatgattgtacatatgtgtgtgtatacacacatatatacatacttctatttattgtactgtttgctctgttgacctataacatgattaacttccagaagtctcatatttcattgaggtattccaagttcattttttcccaaaaggaagccccttagataacagaatatttcactaatatataaacactactaaagatgtatatagatagataacttaaaaatcccttgctattttgttgtaacacattttaatctgatagaaccatttcattatgaattgatcttatttaccttgaacagctaagcctgctagctgaattgcttgttctaaggtacaaggaatacttccttccaagatatctttcttcagttgcagataatactgatacctataaaaaatgtcagttgtataaggtcaatgtcaatattatctcattgagatacaatgcatttaaccata

SEQ ID NO: 45212 - DNA, 601 bp, Human
actgtactgaatactgtaggcaactgtaacacaatggtatttgtgtatctaaacacagaaaaggtacgctaaaaatagtgttataattttatgggaccactgtcctatatgaggtcttttgttgaacaaaatgtcattcggcatatgattgtacatatgtgtgtgtatacacacatatatacatacttctatttattgtactgtttgctctgttgacctataacatgattaacttccagaagtctcatatttcattgaggtattccaagttcattttttcccaaaaggaagccccttagataacagaatatttcactaatatataaacactactaaagatgtatatagatagataacttaaaaatcccttgctattttgttgtaacacattttaatctgatagaaccatttcattatgaattgatcttatttaccttgaacagctaagcctgctagctgaattgcttgttctaaggtacaaggaatacttccttccaagatatctttcttcagttgcagataatactgatacctataaaaaatgtcagttgtataaggtcaatgtcaatattatctcattgagatacaatgcatttaacca

SEQ ID NO: 45213 - DNA, 601 bp, Human
ggaatgtgttgagaaaggcatcatcagattttgtcactgtgcaaacatcagagtatacttacacaaacctaggtggtgcagcctactccacacctaggctatattgtatagcctactacacacctaggctatattgtataacctattgctcatagaagcctatacagcatgttactgtactgaatactgtaggcaactgtaacacaatggtatttgtgtatctaaacacagaaaaggtacgctaaaaatagtgttataattttatgggaccactgtcctatatgaggtcttttgttgaacraaatgtcattcggcatatgattgtacatatgtgtgtgtatacacacatatatacatacttctatttattgtactgtttgctctgttgacctataacatgattaacttccagaagtctcatatttcattgaggtattccaagttcattttttcccaaaaggaagccccttagataacagaatatttcactaatatataaacactactaaagatgtatatagatagataacttaaaaatcccttgctattttgttgtaacacattttaatctgatagaaccatttcattatgaattgatctt

SEQ ID NO: 45214 - DNA, 601 bp, Human
ctccatctcaaaaaaaaaagtaactaaataaataagaagaacttattcatgtaagcaaacaccacctgttccccaaaaacctattgaaataaataaaaagaaaccaaacatatgaagtgtacttaaactgtaagcgaatataacctcatcaaactcactgactggcatatctttcttcttaaaatatgacctattagcagacaaagtctttgaactagatgaatacatagcatagtattaataaatgtatatgtatatagtcatgtgtcaaggatgggaatgtgttgagaaaggcatcatyagattttgtcactgtgcaaacatcagagtatacttacacaaacctaggtggtgcagcctactccacacctaggctatattgtatagcctactacacacctaggctatattgtataacctattgctcatagaagcctatacagcatgttactgtactgaatactgtaggcaactgtaacacaatggtatttgtgtatctaaacacagaaaaggtacgctaaaaatagtgttataattttatgggaccactgtcctatatgaggtcttttgttgaacaaaatgtcattcggcatatgattgt

SEQ ID NO: 45215 - DNA, 601 bp, Human
cgcttgaacccaggaggcggaggaggttgcagtgagccgagatcgtgccactgcactccagcctggtccatagagcgagactccatctcaaaaaaaaaagtaactaaataaataagaagaacttattcatgtaagcaaacaccacctgttccccaaaaacctattgaaataaataaaaagaaaccaaacatatgaagtgtacttaaactgtaagcgaatataacctcatcaaactcactgactggcatatctttcttcttaaaatatgacctattagcagacaaagtctttgaactagatraatacatagcatagtattaataaatgtatatgtatatagtcatgtgtcaaggatgggaatgtgttgagaaaggcatcatcagattttgtcactgtgcaaacatcagagtatacttacacaaacctaggtggtgcagcctactccacacctaggctatattgtatagcctactacacacctaggctatattgtataacctattgctcatagaagcctatacagcatgttactgtactgaatactgtaggcaactgtaacacaatggtatttgtgtatctaaacacagaaaaggtacgctaa

SEQ ID NO: 45216 - DNA, 601 bp, Human
tttactaaaaatacaaaaattagttgggtctgtgtggtggcaggtatctgtaatcccaggtactcgggaggctgaggcaggagaatcgcttgaacccaggaggcggaggaggttgcagtgagccgagatcgtgccactgcactccagcctggtccatagagcgagactccatctcaaaaaaaaaagtaactaaataaataagaagaacttattcatgtaagcaaacaccacctgttccccaaaaacctattgaaataaataaaaagaaaccaaacatatgaagtgtacttaaactgtaagygaatataacctcatcaaactcactgactggcatatctttcttcttaaaatatgacctattagcagacaaagtctttgaactagatgaatacatagcatagtattaataaatgtatatgtatatagtcatgtgtcaaggatgggaatgtgttgagaaaggcatcatcagattttgtcactgtgcaaacatcagagtatacttacacaaacctaggtggtgcagcctactccacacctaggctatattgtatagcctactacacacctaggctatattgtataacctattgctcatagaagc

SEQ ID NO: 45217 - DNA, 601 bp, Human
atagccagccacggtggctcacatctataatcccggcactttggaaggctgaggcaggtggatcacctgaggtcaggagtttgagaccagcctggccaacatggtgaaaccccatctttactaaaaatacaaaaattagttgggtctgtgtggtggcaggtatctgtaatcccaggtactcgggaggctgaggcaggagaatcgcttgaacccaggaggcggaggaggttgcagtgagccgagatcgtgccactgcactccagcctggtccatagagcgagactccatctcaaaaaaaaaagtaactaaataaataagaagaacttattcatgtaagcaaacaccacctgttccccaaaaacctattgaaataaataaaaagaaaccaaacatatgaagtgtacttaaactgtaagcgaatataacctcatcaaactcactgactggcatatctttcttcttaaaatatgacctattagcagacaaagtctttgaactagatgaatacatagcatagtattaataaatgtatatgtatatagtcatgtgtcaaggatgggaatgtgttgagaaaggcatcatcagattttgtcactgtgca

SEQ ID NO: 45218 - DNA, 601 bp, Human
cactaaagaacttattcatgtaaccatagccagccacggtggctcacatctataatcccggcactttggaaggctgaggcaggtggatcacctgaggtcaggagtttgagaccagcctggccaacatggtgaaaccccatctttactaaaaatacaaaaattagttgggtctgtgtggtggcaggtatctgtaatcccaggtactcgggaggctgaggcaggagaatcgcttgaacccaggaggcggaggaggttgcagtgagccgagatcgtgccactgcactccagcctggtccatagrgcgagactccatctcaaaaaaaaaagtaactaaataaataagaagaacttattcatgtaagcaaacaccacctgttccccaaaaacctattgaaataaataaaaagaaaccaaacatatgaagtgtacttaaactgtaagcgaatataacctcatcaaactcactgactggcatatctttcttcttaaaatatgacctattagcagacaaagtctttgaactagatgaatacatagcatagtattaataaatgtatatgtatatagtcatgtgtcaaggatgggaatgtgttgagaaagg

SEQ ID NO: 45219 - DNA, 601 bp, Human
gtaatcatatatgcttgcttatgtacaggaaaatgtcaaggagaaaccaaattgtcaacagtactgatgacctctggggaatagacttagaccacttgaatatattacagcaagatatatttgtgttgaaatttttaatattttttaaaaaattgacaattcagcaaaatgcttatgaaaaagtaattcttaaagccaaaagtgatacttaagaaaatctaaagtaccttgaaaaggaatgtggctccatgtgcatcaggcatttgtttaaaaatgatacatgtctccatgccttcttatrgctgaaggagttttattaataattattctgattaaatttcactcccaaggctaaatgccagttattgtttgaaataatgccccatcagaaatcttcccagccaggcacagtggctcacacctataatcccagcacttcagtaagccaaggaggggaggatagcttgagccaaagagtctgagaccagcctagcaacatagcaagaccctatctctataaaaaattttaaaaatcagccaggcatggtagcgcacacctgtagtcacagctacttgggaggctcaggtgggaggatcactt

SEQ ID NO: 45220 - DNA, 601 bp, Human
tgggttcacaaggaccaagatgactacaacagggaaagcagtcacacttgagatgtttataagagggaatttttttttataatcctattcctgacagtaagtctatcatacggatttcatttcagggattattaagggtataggaataaactgtttcttttaaaaggcccagtgtcaaaagaagtcttaccacaggaaacaaggcaaatttctgaagaaagtcctgggattcatactgatcaaagtcaccaaaatccgctatatagaatgacaaacattcacgttaattatatttaaattkcattgcaaaatatgcacaacaaaattcaatacgcagtatatctagatggtatgctaatatttcagaagtcaaatttgttatagctatataaagtatatttttaaagtatctttttaaaagtgttaattaggcagatatgagtcttggcttggaaaaatgcctatgaattaaataaaaaaacaagttgcaagctctatgtaatatgatctcattttacagttaaaatgcaaacaaaacctaccctgtaatcatatatgcttgcttatgtacaggaaaatgtcaaggagaaaccaaattgtc

SEQ ID NO: 45221 - DNA, 601 bp, Human
acttgtaatagtagtggcagtaatgttccaaatttagttgggcaaataaatattaatcatgtaaattaaatatttaattgaatatttcaaattcaagcagacattggttctatgctatttccatgtcttatttcttagagttacctgtatttctgatgtagtaaggccactttttgggttgcttcttccaatactttttcatcttgtaaccatccctgaagaaaacacacagtggtaagtatgtgacaattcaccccaatttcttagaaggaatcatggccattgactgttaatgactctygtcactatcaggcaaaattatgactattgttactatatgggagctttgtttacataggtaatcatctttctaaggaattaactggcttctcacaagagccaaaaaaaaaaaacttgccccaccttctcaattccagggaaagtttcagctgagttatgtcaagttggtgacagtagttagccagtcctgagcccagcaagataaaaacatcttgtgcgttctctggcactgtgtagacactcagaacagcataccacaccttccttagttgttgcaatgcagtttccatgtcccttccat

SEQ ID NO: 45222 - DNA, 601 bp, Human
attctagggagattaatcttttgtgagtcactgtgtggatttgagtggagagagactagaggcaaaagtttattttatttggaaggggataagcaataggttctaatgaaactgatctgctttcaatttccacctctaccacacgtagaggtaactaaatctttttcttttttttttttttgctctgtcaccaggctggagtgcagtggcacgatctcagctcactgcaacctccacctcccaggttcaagcgaatcccctgcctcagccttctgagtagctgagactaccggtgcatgcyaccacacctggctaattttttgtattttagtggagacagggtttcaacatgtttgccaggatggtctcgatctcctgacctcgtgatctgcccacctcagcctcccaagtgctgggattacaggtgtgagccactgctcccagccagagataacaaaatctttttgagcttggtttccccatctggtaagatggagataataatgtttatcttaatgagtagttataagaatttaatgatagagtacagacagtcctcaacttacgatgatggttcaactgaatgactttcaactttaca

SEQ ID NO: 45223 - DNA, 601 bp, Human
aggatttaaccaacttgtaggaggcctttaatcccagggtaatgaacttgggctagtagaaagcatgaaaatacccatgagcacgtggaaggagaaggagagaggtaagaggaaactgatattctagggagattaatcttttgtgagtcactgtgtggatttgagtggagagagactagaggcaaaagtttattttatttggaaggggataagcaataggttctaatgaaactgatctgctttcaatttccacctctaccacacgtagaggtaactaaatctttttcttttttttttttttgctctgtcaccaggctggagtgcagtggcacgatctcagctcactgcaacctccacctcccaggttcaagcgaatcccctgcctcagccttctgagtagctgagactaccggtgcatgccaccacacctggctaattttttgtattttagtggagacagggtttcaacatgtttgccaggatggtctcgatctcctgacctcgtgatctgcccacctcagcctcccaagtgctgggattacaggtgtgagccactgctcccagccagagataacaaaatctttttgagcttggtttcccc

SEQ ID NO: 45224 - DNA, 601 bp, Human
gcagaaggtaaagctgggaaggcaggatttaaccaacttgtaggaggcctttaatcccagggtaatgaacttgggctagtagaaagcatgaaaatacccatgagcacgtggaaggagaaggagagaggtaagaggaaactgatattctagggagattaatcttttgtgagtcactgtgtggatttgagtggagagagactagaggcaaaagtttattttatttggaaggggataagcaataggttctaatgaaactgatctgctttcaatttccacctctaccacacgtagaggtaactaratctttttcttttttttttttttgctctgtcaccaggctggagtgcagtggcacgatctcagctcactgcaacctccacctcccaggttcaagcgaatcccctgcctcagccttctgagtagctgagactaccggtgcatgccaccacacctggctaattttttgtattttagtggagacagggtttcaacatgtttgccaggatggtctcgatctcctgacctcgtgatctgcccacctcagcctcccaagtgctgggattacaggtgtgagccactgctcccagccagagataacaaa

SEQ ID NO: 45225 - DNA, 601 bp, Human
ctcctgcatgtacagcatttcagcatcaggagctgtgagccctctgcaacccaaaagaagcaagattgttcacaaagcaagcttaaaatggtttaaaataaagcttttcttaaaacctatatgtcaatttagcataagacattataaacatttcacgtttctaagcatctataattggctatatcaatcttgctatttactgaaaaccagtatgtgctgaatgctgagggtatcacatgagatcctgctctccatacttaaggcagatgagtgggaaggtgggggataaaacaactccctraaaaatcttagggtgaaatcttgaacttttcttaaaccaccaagtaattgcttattatcccaaatatcagggctgggcatggtgactcatgcctgtaaccgcagcaccttgggaagccaaggacaaaggaccacctgaggccagcagtttgagaccagcctgggcaacatagtgagaccctgtcactacaaaaaaaaaaatgttttaaattagccaggcatggtggtgcacatctatagtcccagcagcttggaaggctgaggtgggaagactgcttgagcccaggagttcaaggatgca

SEQ ID NO: 45226 - DNA, 601 bp, Human
tactaagaatacaaaaaaaattagctgggcatggtggtgggcacctgcaatcccagctacttgggaggctgaggcaggagaatcgcttgaacccaggaggcggaggttgcagtgagctgagacagcaccattgcactccagcgtgggcaacaaaaatgaaactctgtctaaaaaaaaaaaaaaaattacaaaaactaggccaggcgaggtggcaggcacctgtaatcccagctacttgggaggctgaggcagaagaattgtctgaacctgggaggcagaagttgcagtgaaccaagattgygccactgcatgccagtctgggcaacagaacgagactctgtctcaaaaaaaaccaaaacagaaaaaagaaaaaaaaaaacagtggttttaatcagctagcatgaatgttctaattgaagtaacagcagctagttcaaaaagtaaactcatgtataataaatgagggaaaagagaatttaaaagatgtaaaatgtatcattctcatgtgtcagatttgcttgatggaagatccctctcttagctgattgccaatgccccatttattcattcaacaaaataaaagacacctattataacaatg

SEQ ID NO: 45227 - DNA, 601 bp, Human
atagttcaaggaatagattccttcctgtaatcccaggtacttaggaggctgagatgtgaggatcacttgaggccaggggtttaagaccagcctgggcaacacagcaagaccccatctctaaaaaactaaaaaaaaaaattagccaggcatggtggcacacgcttataatcctggctacttcagaagctgagggctgaggccagtggatcccttaagcccgggagtctgaggttacagtgagctatgatcacaccaccacactccagcctggaagacagagcaagaccccgtctctttaaawaaataaataaataaaagtgttagatggtggaaatacctagcaaatgtttgtctcaatgacttacaccttttgagctcactatagtaagggtaaggaagaataaatgctctcctcccagcctacacttgggtagaccagggctgcatccaagctgcttacaggtcactgacttggctctgggatgcctgcttccactgttcacccccctaccaaaccccgccttaggtgtagcttcctggcattgtgggatgggagaggaacaaagccagcagagaccatctcaggtaactgggaaggaat

SEQ ID NO: 45228 - DNA, 601 bp, Human
ttgataaacaaaaagatgccattgaaagctcatgcactaatagatagttcaaggaatagattccttcctgtaatcccaggtacttaggaggctgagatgtgaggatcacttgaggccaggggtttaagaccagcctgggcaacacagcaagaccccatctctaaaaaactaaaaaaaaaaattagccaggcatggtggcacacgcttataatcctggctacttcagaagctgagggctgaggccagtggatcccttaagcccgggagtctgaggttacagtgagctatgatcacaccaccrcactccagcctggaagacagagcaagaccccgtctctttaaaaaaataaataaataaaagtgttagatggtggaaatacctagcaaatgtttgtctcaatgacttacaccttttgagctcactatagtaagggtaaggaagaataaatgctctcctcccagcctacacttgggtagaccagggctgcatccaagctgcttacaggtcactgacttggctctgggatgcctgcttccactgttcacccccctaccaaaccccgccttaggtgtagcttcctggcattgtgggatgggagag

SEQ ID NO: 45229 - DNA, 601 bp, Human
tgtccaacctgctccccaaccccaactaatctgtaagctccgtggaggcaagatgtggtatccctggtgcctttgctgagcaaatgagtgactaacaagtgaggactaaagtgatgcttattactaagcatttacagctgagcttgtatttctaagcctcgtctgaattttgctttgtaagtttcctttcttatacgatgtaagggagttaagattttgataaacaaaaagatgccattgaaagctcatgcactaatagatagttcaaggaatagattccttcctgtaatcccaggtactyaggaggctgagatgtgaggatcacttgaggccaggggtttaagaccagcctgggcaacacagcaagaccccatctctaaaaaactaaaaaaaaaaattagccaggcatggtggcacacgcttataatcctggctacttcagaagctgagggctgaggccagtggatcccttaagcccgggagtctgaggttacagtgagctatgatcacaccaccacactccagcctggaagacagagcaagaccccgtctctttaaaaaaataaataaataaaagtgttagatggtggaaatacctagc

SEQ ID NO: 45230 - DNA, 601 bp, Human
acagtgttctaaggactaattactagaaaatccatcatgacaaagtgaatattcaatccatttaagcaaatttaccataatatcaagcctcatgtctcataaattaatattactcttagcactctgaaaactagtatcttatattcaaaaaccctgaatattagcttatttttataagactcttgagataaaaagaaaactagtacatactagttttaacatcaggtgattacaactgcttttactagcttttataaataatttcatttctttgttactggaaagtattcaggctgttaakgaaaaataaatgtctcttttccaaaagatattccattcttccagtatttattttggtgacacaagtctgcatggcgtgtctgggttttaaaaaataaaaaataaaaaataaaaaatactccttaactgcacattaatatattccttaaaattagtgcccacaaattagccaggcgcggtggcaggcgcctgtaatcccagctactcaggacgctgaggcaggagaatcgcttgagccaagggggcggaggttgcagtgagccgagatcacgccactgcactccagcctgggcgacagagt

SEQ ID NO: 45231 - DNA, 601 bp, Human
gttcttcttcccagagagaaggtccgacaccggccttttcttcagagagtccctccgggctcggtagcggcctgacgtggtgaggtcggactccgacatggagggcatcagcagcccgtctctccagggccgctgggcctctgcggtcgtgcggacggggctgctgtccatcatcctcttctccgcgtctgggacgtgggccttgggctccaggatgtgcaggggcccggcgagcaggacgcgagggcagccaggtgggtcctgggccaggccgggccgaggctcgcgcgcacgtgcaggrggcgcccgggccccgctctcctcctcgaagtcctcgtcctcctcctcctcgctgctgtggattagcatggtggcgtccgacagggacttcttatggccgtacctcaagccctccgcctcctccggcccttctcgctgtgtcctctcggtgaaaacgctgggctgggagcccaccgagacggctcgcggcgccacctctgccgccgacgcggatagggtgcgctccttgagccgcaggccctccaggccgtggctgagcccggccacctcgatgctgttccgtttgtgcagctgcgcgtgg

SEQ ID NO: 45232 - DNA, 601 bp, Human
gattggtacctaactcaataagctaagtggattaatttttaattttataattaatatttgatcatgagctccccacataatgcagtctagactataaacagcagaggcctgggttcacatctggcctctaactgaccaacttctttcaggcaagtcacctttcctctgtaagcctcacctagacagaaagagacagatatatccagacacaggcatacagactaaacacttcctgcttaggctgaaatttaatgattctaacgtgcagaaaacagtgatgtgctggtaatatttaacaacwggctcttggaaggaagttttgatcggtgtttgcccatatccatggtgtaaatactcccatcacagccaatttcaaactgttaatgtcacatcaattggctcacaaggttcctgaacatttaagtcggctcttgctagtcaatatgaactagctctggcacttctctgcctgaaaatgactcaaaatatcccacactgggacacgctggataaagctgattggctgtgaggtcagttcaaaagccagtattggaagaatgttgtatgtagtcaaaactagccttgaatatgccttaattag

SEQ ID NO: 45233 - DNA, 601 bp, Human
tatgtaaagagaacagatggcaccttggtaagttgaaagcttttgtgaacaccatcaaaaagcccagacacttttgttacataaaaatgcatgtcagtatgtgatgaggaaaaactagcaattcagtggctcccagaatttatgagctaaaaagaggtcttcagatttagaaggacaaagttctaaagccaggcaacacaaggtcaaggctgtagggagccatgatcataccactgcactccacctgtctgggcgacagagcaagactctatctcaaaaaaggcaaaagaaaaaaaaaaaagccgggcaaataagtgcgccctgagtcctggtaacagtgttgggggcagagtggtttcgcacatggagagtagacatgactttggctctgtctgatagacgctttttatctagcactggtatgtggatttcccagcttgcagtacagtttgtcacaaatgtttaaaactagggtgtttatctaaaacaatacaataaaaataaattttaaaatatctgaattctaaacagacatgaatacaattcttaccattcttgtaacttaactgaaactgcatgtgctgttgattacttgaggcgt

SEQ ID NO: 45234 - DNA, 601 bp, Human
tctcaccataaacattaccccagtttaatggcattatactggttccaggaaaaaagcacttcttcaaagaaaaaaatgatacttaaaaattattataaagagtatgtaaagagaacagatggcaccttggtaagttgaaagcttttgtgaacaccatcaaaaagcccagacacttttgttacataaaaatgcatgtcagtatgtgatgaggaaaaactagcaattcagtggctcccagaatttatgagctaaaaagaggtcttcagatttagaaggacaaagttctaaagccaggcaacasaaggtcaaggctgtagggagccatgatcataccactgcactccacctgtctgggcgacagagcaagactctatctcaaaaaaggcaaaagaaaaaaaaaaaagccgggcaaataagtgcgccctgagtcctggtaacagtgttgggggcagagtggtttcgcacatggagagtagacatgactttggctctgtctgatagacgctttttatctagcactggtatgtggatttcccagcttgcagtacagtttgtcacaaatgtttaaaactagggtgtttatctaaaacaatacaataaa

SEQ ID NO: 45235 - DNA, 601 bp, Human
attaaaggtaactacattttattgtatgtttactatctgccagacaccgtacatgtattagatcattaacaatcctgtgagacaggtactgttattgtccccattttagaaatttgaaggaactgaggcacagaggagtatgaaatctgcgcagggtcatacaagtagtaagcagaggggctgggatcccacctagacagtctagcacctggactgagccagacaagacaggctttttttttttttccggacaagacagggtctcactctgtcactctctcatccagggtggagtgcagtrgtgtgatctcagctcactgcagcctcaaccttccaggctcaagcgatccttccacctcagcctcctgagtagctgggactacaggcacgtgccaacacactcagctaatttttgtattttttgtagagacagggtttccctatgttgcccaggctggtctcgaacgcctgggctcaagcaatccgcctgccacggcctcccaaagtgctgggattacaggcgtgagcaactgtgccccacctagcctccactcttaatcctatattatactgtctctccaaaacaatatatcgcaataca

SEQ ID NO: 45236 - DNA, 601 bp, Human; identical to SEQ ID NO: 17713

SEQ ID NO: 45237 - DNA, 601 bp, Human; identical to SEQ ID NO: 17714

SEQ ID NO: 45238 - DNA, 601 bp, Human; identical to SEQ ID NO: 17715

SEQ ID NO: 45239 - DNA, 601 bp, Human; identical to SEQ ID NO: 17716

SEQ ID NO: 45240 - DNA, 601 bp, Human; identical to SEQ ID NO: 17717

SEQ ID NO: 45241 - DNA, 601 bp, Human
gaaccagcccaaattggaaaaggggctagattacaccagccaaataaatacctacccatcaatcaaccacttcccaaaaaggtcaaggttgcaaaatgctatcaacagaaacctttatgacccctcaaaaacaccactcttggatcctgttaaggtatatgaacagtcaagtccatcagttacataccgactcatcctcctgcaccttgctcctggtatgcacaaatatatcacacgtgacaaaaaggataaatgtaaaagctgcccactctaccaacaattctggcagataagagagaarccgtgttggcaagtgactagagatccacatgcgcagagtaagagacccaaagtgcacgaggaaacttcccccaattttaaaattctacttttctagccacacgtggggatgagattggaggccagcaagtatgagcagccacaccctgctctaccattacctagtatgtcacaatcctgatgcaaatcctgtgcccaagagtccaacgataccgcgctgcagggcagcagacgcctgttacgtaagctctgcagggcctcctccagttcgccccgccctaccctcccaccccaattcttt

SEQ ID NO: 45242 - DNA, 601 bp, Human
ggaaatgaaaagatttccaaacatgtttctttactcttaaaataacttgataggcatatttccaatcgtttctgtgtgttgcacaataatgaagatcaagcgggatcagatctgccttatacaaagaccctgccactatggtacagcagggatgtgcttggcaaaatgacaggctctattctaggaccaatacctgaaaatgttctgggctagacctgcactgtccattacgacagtcatttagtcatgtgtgtctgttgagtaccagatatataactagatcaaattgagatgtgctgtagtataaaaacacatgccagatcttgaagacttagtaccaaaaaagttaaatgtccctttaatttaattaacacaatttggctcacattgtatttctattagataccactggtctagatcattagaaagcaccttgccaacacaaacccttcatttaaaatttaaaataggcggagcacagtgactcatgcctgtattcccagcactttgggaggccaaggtgggcggggtccaggagctcaaggccagcttgggcaaaagggcaaaacgctgtctctacaaaaaaaatatgaaaaagtag

SEQ ID NO: 45243 - DNA, 601 bp, Human
aattcaaaatcatctgcaaagagccagttttatcattgaatatttgaattctggttgtcagttcacagtaatctgtttggtgagttatctatggctgcttttgcacaacatcggcagaggtgagtagttccaacagagactatatgcagatggaagtgactgcacaacacagaaagcctaaaatattaactatctggccatttatagaaaaagtttgctgattgaatgggctgagctctaaagaccaacagcaccactgcctctaactttaatcgtatgactgcctttcagaaacttaagtttttttttttttgagacttagtttctttatgaaataagtcgatacctgtacctctatcttaaagagagatttaaaggaacatactttacacatcttaagaaaatgccttaaatccaaggtgacatcatcatgaccatcatattcactgaatactctttcacctcaaaggtgttcacatatttttcaaacatatttaaacaccacctgaacatgaaggagggcttctgggatgctggtaatattctattccttgacctgggtggtggttacacaagtgtgtttactttgagataacccatc

SEQ ID NO: 45244 - DNA, 601 bp, Human
ccagaatagtggaaagtactaaaaaatgccttcagcttcctttctagtcaatgggcaaattcaaaatcatctgcaaagagccagttttatcattgaatatttgaattctggttgtcagttcacagtaatctgtttggtgagttatctatggctgcttttgcacaacatcggcagaggtgagtagttccaacagagactatatgcagatggaagtgactgcacaacacagaaagcctaaaatattaactatctggccatttatagaaaaagtttgctgattgaatgggctgagctctaaagcccaacagcaccactgcctctaactttaatcgtatgactgcctttcagaaacttaagtttttttttttttgagacttagtttctttatgaaataagtcgatacctgtacctctatcttaaagagagatttaaaggaacatactttacacatcttaagaaaatgccttaaatccaaggtgacatcatcatgaccatcatattcactgaatactctttcacctcaaaggtgttcacatatttttcaaacatatttaaacaccacctgaacatgaaggagggcttctgggatgctggtaatatt

SEQ ID NO: 45245 - DNA, 601 bp, Human
gtattaaaagccattagatagtgaatgtcaagtcagtttactaaaaaagtcatagactacatagtcagctcatcatttcctaaataaaaagttttgcttcaatatgccctttgcctcctgccacttctaagccctagagttcatgcatcatgagttccagattaaaaggacaccaaattttaggtcagcatttgactcctaatactgcagcaagaccatgccaaaagcaggataaggcaagaccagcatctttggtgctaaaaaaagaaactgcttgaaagcaggcactcccaatgacctyaataaatgtgagaagccaaaggagactgagacactagactcagagcatcttgttctccgagatactaaagaccagaatagtggaaagtactaaaaaatgccttcagcttcctttctagtcaatgggcaaattcaaaatcatctgcaaagagccagttttatcattgaatatttgaattctggttgtcagttcacagtaatctgtttggtgagttatctatggctgcttttgcacaacatcggcagaggtgagtagttccaacagagactatatgcagatggaagtgactgcacaacacag

SEQ ID NO: 45246 - DNA, 601 bp, Human
caaagcgctgggattacaggcatgaggcaccgcacccagcctcactgtttttttaatccattttgaacttgggactgactcctgaaatttcaggtattaaaagccattagatagtgaatgtcaagtcagtttactaaaaaagtcatagactacatagtcagctcatcatttcctaaataaaaagttttgcttcaatatgccctttgcctcctgccacttctaagccctagagttcatgcatcatgagttccagattaaaaggacaccaaattttaggtcagcatttgactcctaatactgyagcaagaccatgccaaaagcaggataaggcaagaccagcatctttggtgctaaaaaaagaaactgcttgaaagcaggcactcccaatgaccttaataaatgtgagaagccaaaggagactgagacactagactcagagcatcttgttctccgagatactaaagaccagaatagtggaaagtactaaaaaatgccttcagcttcctttctagtcaatgggcaaattcaaaatcatctgcaaagagccagttttatcattgaatatttgaattctggttgtcagttcacagtaatctgtttg

SEQ ID NO: 45247 - DNA, 601 bp, Human
aacattcctgacagcagggcacaagctcacgcctgtaatctcaacactttgggagaccaaggcaggcagatcgcctgagccccagagttcgagaccagcctgggcaacacagtgagaccctgtctctacaaaaagattcaaaaattagccaggcatggtgatgcatgcctgtagtcccaggtactagggaggctgaggtgggaggatcgcttgagcctggaaggtcaaagctgcagtgagctgtgatcatgccactgcacttcagcctgggcagcagagtgagaccctgtatcagaaaaaraaaaatctatatatagatctagatctagatatatagatatgtctatatatctaaaatatctatatatgtacacacacacacacacatatatacacatatttatttcacttgtattcactttgtcaggaatatatacgtgtgtgtgtgtatatatatgtgtgtgtgtgtgtgtgtacattcctgacaaaacagagttaggacataaaagaaacaagattagcaaaactgtcaattaattgttgaaacagggtaatggatacctgggagtttactacactattctctcaacttccatacata

SEQ ID NO: 45248 - DNA, 601 bp, Human
atttggagcaccctaaaatcaactatattagtctttaatatacacttacatttctccctgcttgtaatcagtatacttaattttttcatatgagaaagttttcttatatagctttctagatagcaacataatccaaaacaacccaaaccatgaaagtacatgacactatctccagtacgcagtaagtacttaatacacattaaacagatgaagaaaaaacagataaaactaaaaatgggccgggcacagtggctcacgcctgtaatcccagcactttgggaggccgcagcaggtggatcaygaggtcaagagattgagatcatcctgaccaacatggtgaaaccccgtctctatgaaaaatacaaaaattagctgggcatggtggtgcacacctgtagtcccagctactggggagggttaggcaggagaatcacttgaacctgggaggcagaggttgcagtgagccgagatcatgccactgcactccagcctggtgacacagcgagactctgtctcaaaaaaaaaaaaaaaaacaacaacaacaaagttttgcaacacattactgcattactgaaggccagtaatccaatagcactgcttt

SEQ ID NO: 45249 - DNA, 601 bp, Human
gcaatcaaaatgatatttggagcaccctaaaatcaactatattagtctttaatatacacttacatttctccctgcttgtaatcagtatacttaattttttcatatgagaaagttttcttatatagctttctagatagcaacataatccaaaacaacccaaaccatgaaagtacatgacactatctccagtacgcagtaagtacttaatacacattaaacagatgaagaaaaaacagataaaactaaaaatgggccgggcacagtggctcacgcctgtaatcccagcactttgggaggccgmagcaggtggatcatgaggtcaagagattgagatcatcctgaccaacatggtgaaaccccgtctctatgaaaaatacaaaaattagctgggcatggtggtgcacacctgtagtcccagctactggggagggttaggcaggagaatcacttgaacctgggaggcagaggttgcagtgagccgagatcatgccactgcactccagcctggtgacacagcgagactctgtctcaaaaaaaaaaaaaaaaacaacaacaacaaagttttgcaacacattactgcattactgaaggccagtaatcc

SEQ ID NO: 45250 - DNA, 601 bp, Human
catgtaaaaacatgatacaattttatacagcaatcaaaatgatatttggagcaccctaaaatcaactatattagtctttaatatacacttacatttctccctgcttgtaatcagtatacttaattttttcatatgagaaagttttcttatatagctttctagatagcaacataatccaaaacaacccaaaccatgaaagtacatgacactatctccagtacgcagtaagtacttaatacacattaaacagatgaagaaaaaacagataaaactaaaaatgggccgggcacagtggctcacrcctgtaatcccagcactttgggaggccgcagcaggtggatcatgaggtcaagagattgagatcatcctgaccaacatggtgaaaccccgtctctatgaaaaatacaaaaattagctgggcatggtggtgcacacctgtagtcccagctactggggagggttaggcaggagaatcacttgaacctgggaggcagaggttgcagtgagccgagatcatgccactgcactccagcctggtgacacagcgagactctgtctcaaaaaaaaaaaaaaaaacaacaacaacaaagttttgcaacac

SEQ ID NO: 45251 - DNA, 601 bp, Human
aggggctgaggtgggaggatcacttgagcccaggagttcaaggctacacggagctaagattgtgccactgtattctggcccaggtgacagagcaacatcatgtctctcaaaaagacacaaaataaataaaaataaaaacaaaaataaacataacttaagtcataggacggatcaaattccacatggaccaaaagaattgtacaatgacaatgagcccacgtaagattatgcattttcctgccttgcccttatctcaaactatccccagccacctctctcatcaagctttaatcaaagcagragttcactttgccataatcaaagttcagcggtattgaaatctcatgatttggctgggcatggtggctcatggctgtaattccagcactttgggaggccaaggcaggttgatcacttgagatcaggagttcgagaccagcctggccaacatggtgaaaccccgcctctactaaaaatataagaattagccaggtgtggtggcaggcgcctgtagtcccaggtgctcaggaggctaaggcaggagaatcacctgaacccaggaggcggaggttgcagtgagctgagattgcaccactgcact

SEQ ID NO: 45252 - DNA, 601 bp, Human
agtatttttgtgccacaaatagcattactatttgtagtaatacaaaatagcattacagatagcattactatttgtaatggaccccaaactggaaacgacccaaatggatagctgggatcacagtagaatggaaattgtgtttactcacaaaagaatactagataacaatgaggatgaattaactacaacagtagttaattaacaataattaacagtagttaattctggaacagtatggataaatttctcaaacaatggtaaactaaagaggacagaatcgaaagggtatatacactgtacrcttccagtcacaaaagctcaaaatcaggcaaaactcatttatgatgtcagaattcagcatagtggttatatttggtgggaatgcagtggagagacagtacctagaaaagggaataatgggaggttataggatgcaggtaaatcttttgttacttgctgtttacacatgttcactgtgtgaaaattcgctgagctgtactcttaatgatttgtgtgctcctctctgtattgtatctaatttttaaaaaattcaaacagtaagaaaaaagcctttgctaacacaaatttcctgtcttgctgt

SEQ ID NO: 45253 - DNA, 601 bp, Human
tggacaagccagcaagagggactgcacccaagctcagctcccatgggatgacaggattcctcctcatgggaggtaggtacaacttctcatgggttcagggccttcaggtgctgggcagtttctcacacaactggcaacctgaatccaagtccagggtgcctggtactaagtagcctgcgtgtgaccctcctccccgcaacagtgtagctttcccatgctacctgataagaagggagaatcacagatggatggatccctccctgtgaacacagacaccaggtttgcccctccctgaattgayggcagatgagagaacatttccttctcctgctaaccttggccctccaagttctctctttccccaataaggtctattccttaacccaacctatctgacatcacacaatttgtcctgagctatgtcacacagcagactctaaagagaaccaccttgcaagacggatatttttcctgatgaatcaattttctaggagcaaaattcagctggtgaaaaaaatatgggttatatgtgtataatggaataggaagacaacattgagacagcctcagtctgagataagtttatcttcaacttttcgta

SEQ ID NO: 45254 - DNA, 601 bp, Human
aaaaaaaaaaaaaaaagaaatgtgacttagtgagtttaaaatcagtacctgtaaaaacgtgcgataatcttcactagtaactcctccttctgccattctcatcctctcctcctcatccagctgatgtgcaattgaggataattccacagggctaaaatattctccttgcaataagttattcaggcaatgttgagcacaaagtgagccttcttgctaatatttccaaaagaaaaaattaaaatgtgacttgttaaacagaattgtatagtatcttcccctaaataattttttttttttttttgagacggagtctcactctttcacccaggccggagtgcagtggcgctatcttggctcactgcaagctccgccacccgggttcatgccattctcctgcctcagcctcccgagtagctggtactacaggcacccgccaccacgcccggctaaatttttgtatttttagtagagacggggtttcatcctgtgttagccaggatggtcttgatctcctgacctcgtgatccgcccgccttggcctcccaaagtgctgggattacaggcatgagccactgcgcccggctcccctaaataatttaat

SEQ ID NO: 45255 - DNA, 601 bp, Human
aaagaaggatacaaactgtcattagcgtgcatatttaaaacaatatcttgtgcattcccatttccaaagttaacagcacagttataattcaccagtcagatccctataggaagaatggcccatccttttctaaatggtatccacatttttaaaagaaatgtaagccgggtgtggtggctcacacctataatcccagcactttgggaggccaagacaggtggatcataaggtcaggagtttgagaccaacctgaccaacatggtgaaaccccatctctaacaaagatacaaaaaattagccrggcatagtgccgtgtgcctgtaatcccagctacttgggaggctgaggcaggagaatcgcttgaacccgggaggcagaggttgcagtgagccgagatcgcgccattgcactccagcatgggcaacagggcgagactccgtctcaaaaaaaaaaaaaaaaaagaaatgtgacttagtgagtttaaaatcagtacctgtaaaaacgtgcgataatcttcactagtaactcctccttctgccattctcatcctctcctcctcatccagctgatgtgcaattgaggataattccacagggctaaa

SEQ ID NO: 45256 - DNA, 601 bp, Human
cattttctcaaatttacccaacagatggtaagtttgagacattgtgacttattagaattaaggatttctttttttctttgagatggagtctcgctctgtcaccaggctagagtgcagtggcgcgatcttggctcactgcaacctacgactccctggttcaagcgattctcctgcctcagcctcccgagtagctgggattacaggcacgtgtcaccacgtccagctaatttttgtatttttagtagagacggggtttcaccatgttagccaggatggtctcaatctcctgacctcgtgatcygcccacctcggcctcccaaagtgctgggattacaggtgtgagccaccgcgcccggccagaattaaggttattattagcatccagatgcaaattaatctttctcaagaaggaatttttaaatgccccactctaatatgaagattctacaatcctttcatgtttatctatataaaaatctagtactctagttggccaggtgcagtggctcacacctgtaatcccagcactttgggaggctgaggtcaggagttggagaccagactggccaacacggtgaaaccccactatctctactaaaaa

SEQ ID NO: 45257 - DNA, 601 bp, Human
accaccaaagaattcaaagagagctatacattaaaaaaaaaaaatcaaaagccacaaaccataataaggaaatccagtctggtaggctgatttaaaaggatggtagcaaggtattgcattttctcaaatttacccaacagatggtaagtttgagacattgtgacttattagaattaaggatttctttttttctttgagatggagtctcgctctgtcaccaggctagagtgcagtggcgcgatcttggctcactgcaacctacgactccctggttcaagcgattctcctgcctcagcctccygagtagctgggattacaggcacgtgtcaccacgtccagctaatttttgtatttttagtagagacggggtttcaccatgttagccaggatggtctcaatctcctgacctcgtgatccgcccacctcggcctcccaaagtgctgggattacaggtgtgagccaccgcgcccggccagaattaaggttattattagcatccagatgcaaattaatctttctcaagaaggaatttttaaatgccccactctaatatgaagattctacaatcctttcatgtttatctatataaaaatctagtact

SEQ ID NO: 45258 - DNA, 601 bp, Human
cgctcaggagaggttccgaaagtactctggatacaactcacagtgttagaaaaagaatgaaagacccacagataaaagaatcttgcgagtacatatatatataaccaccaaagaattcaaagagagctatacattaaaaaaaaaaaatcaaaagccacaaaccataataaggaaatccagtctggtaggctgatttaaaaggatggtagcaaggtattgcattttctcaaatttacccaacagatggtaagtttgagacattgtgacttattagaattaaggatttctttttttctttgaratggagtctcgctctgtcaccaggctagagtgcagtggcgcgatcttggctcactgcaacctacgactccctggttcaagcgattctcctgcctcagcctcccgagtagctgggattacaggcacgtgtcaccacgtccagctaatttttgtatttttagtagagacggggtttcaccatgttagccaggatggtctcaatctcctgacctcgtgatccgcccacctcggcctcccaaagtgctgggattacaggtgtgagccaccgcgcccggccagaattaaggttattattagcatc

SEQ ID NO: 45259 - DNA, 601 bp, Human
tgggcctactctggcctctgatttcagccctgcagtagccattacctgttagcagtggcacggtaaagcactagatggaaatgctggtggatgaggaagagtccaggagggcagtacaagggaaacataaacaaagatatctgcagagataggtcgctcaggagaggttccgaaagtactctggatacaactcacagtgttagaaaaagaatgaaagacccacagataaaagaatcttgcgagtacatatatatataaccaccaaagaattcaaagagagctatacattaaaaaaaaaaaatcaaaagccacaaaccataataaggaaatccagtctggtaggctgatttaaaaggatggtagcaaggtattgcattttctcaaatttacccaacagatggtaagtttgagacattgtgacttattagaattaaggatttctttttttctttgagatggagtctcgctctgtcaccaggctagagtgcagtggcgcgatcttggctcactgcaacctacgactccctggttcaagcgattctcctgcctcagcctcccgagtagctgggattacaggcacgtgtcaccacgtccagctaat

SEQ ID NO: 45260 - DNA, 601 bp, Human
ggcaccaagagcagcaaggcacaaataggaaacgccaagtgctgggcctactctggcctctgatttcagccctgcagtagccattacctgttagcagtggcacggtaaagcactagatggaaatgctggtggatgaggaagagtccaggagggcagtacaagggaaacataaacaaagatatctgcagagataggtcgctcaggagaggttccgaaagtactctggatacaactcacagtgttagaaaaagaatgaaagacccacagataaaagaatcttgcgagtacatatatatataamcaccaaagaattcaaagagagctatacattaaaaaaaaaaaatcaaaagccacaaaccataataaggaaatccagtctggtaggctgatttaaaaggatggtagcaaggtattgcattttctcaaatttacccaacagatggtaagtttgagacattgtgacttattagaattaaggatttctttttttctttgagatggagtctcgctctgtcaccaggctagagtgcagtggcgcgatcttggctcactgcaacctacgactccctggttcaagcgattctcctgcctcagcctcccg

SEQ ID NO: 45261 - DNA, 601 bp, Human
agtgggcacacatgaacaggcaccaagagcagcaaggcacaaataggaaacgccaagtgctgggcctactctggcctctgatttcagccctgcagtagccattacctgttagcagtggcacggtaaagcactagatggaaatgctggtggatgaggaagagtccaggagggcagtacaagggaaacataaacaaagatatctgcagagataggtcgctcaggagaggttccgaaagtactctggatacaactcacagtgttagaaaaagaatgaaagacccacagataaaagaatcttgcragtacatatatatataaccaccaaagaattcaaagagagctatacattaaaaaaaaaaaatcaaaagccacaaaccataataaggaaatccagtctggtaggctgatttaaaaggatggtagcaaggtattgcattttctcaaatttacccaacagatggtaagtttgagacattgtgacttattagaattaaggatttctttttttctttgagatggagtctcgctctgtcaccaggctagagtgcagtggcgcgatcttggctcactgcaacctacgactccctggttcaagcgattc

SEQ ID NO: 45262 - DNA, 601 bp, Human
tagtggcacgatctcggctcgctgcaacctccgcctcccaggttcaagcgattctcctcctgaggctcccgagtagctgggattacaagcacacgccaccacacccagctatttttgtatttttagtagagacagggtttcaccttgttggccaggctggtctcaatctcctgaccttgtgatccacccgcctgggcctcccaaagtactgggattacaggcatgagccaccacgcccagccggctataggttttaaaaagtgtgtgtgtatagatatatcactaaatccataaaaaaaaacacatatatattagaagagtgcttttcataccaggtctctgagatgttccagaaaaccacacaattcctaaataaaactgcctcaaaaatccagatgtatattctacccataagtgcttttcttaaaactagtctactatatacatctgataatttggctgctgtgggtgctactttagaaaaattatattcaacttgctacctgcaatgtcagaaatcatatctaccaaaataagttctccctgggcatttaaactgaaggttccatagatgtcagacttctagggtcatgggcttgcc

SEQ ID NO: 45263 - DNA, 601 bp, Human
tgtagctatgttagttgtgtacttcatatataaatttctctagaaggctataggtttttttttttttttttgtgacagagtcttgctctgtcgcccaggctggagtatagtggcacgatctcggctcgctgcaacctccgcctcccaggttcaagcgattctcctcctgaggctcccgagtagctgggattacaagcacacgccaccacacccagctatttttgtatttttagtagagacagggtttcaccttgttggccaggctggtctcaatctcctgaccttgtgatccacccgcctsggcctcccaaagtactgggattacaggcatgagccaccacgcccagccggctataggttttaaaaagtgtgtgtgtatagatatatcactaaatccataaaaaaaaacacatatatattagaagagtgcttttcataccaggtctctgagatgttccagaaaaccacacaattcctaaataaaactgcctcaaaaatccagatgtatattctacccataagtgcttttcttaaaactagtctactatatacatctgataatttggctgctgtgggtgctactttagaaaaattatattca

SEQ ID NO: 45264 - DNA, 601 bp, Human
ttaggaagtgtagctatgttagttgtgtacttcatatataaatttctctagaaggctataggtttttttttttttttttgtgacagagtcttgctctgtcgcccaggctggagtatagtggcacgatctcggctcgctgcaacctccgcctcccaggttcaagcgattctcctcctgaggctcccgagtagctgggattacaagcacacgccaccacacccagctatttttgtatttttagtagagacagggtttcaccttgttggccaggctggtctcaatctcctgaccttgtgatccrcccgcctgggcctcccaaagtactgggattacaggcatgagccaccacgcccagccggctataggttttaaaaagtgtgtgtgtatagatatatcactaaatccataaaaaaaaacacatatatattagaagagtgcttttcataccaggtctctgagatgttccagaaaaccacacaattcctaaataaaactgcctcaaaaatccagatgtatattctacccataagtgcttttcttaaaactagtctactatatacatctgataatttggctgctgtgggtgctactttagaaaaat

SEQ ID NO: 45265 - DNA, 601 bp, Human
tttctcttctttaagaaattacaactttaaaaatcaaatttgggaaaagaaatgtatgaaatgcaaaacagaatcttacataggatcgatcctgagcctctgatactctggactgttgaacaggattagttctaaaccccaaactttcaaggcattgcttataacctgttaagaaaaatagcaacttttcataagctaaaccactccattccaaatttaggaagtgtagctatgttagttgtgtacttcatatataaatttctctagaaggctataggtttttttttttttttttgtgacrgagtcttgctctgtcgcccaggctggagtatagtggcacgatctcggctcgctgcaacctccgcctcccaggttcaagcgattctcctcctgaggctcccgagtagctgggattacaagcacacgccaccacacccagctatttttgtatttttagtagagacagggtttcaccttgttggccaggctggtctcaatctcctgaccttgtgatccacccgcctgggcctcccaaagtactgggattacaggcatgagccaccacgcccagccggctataggttttaaaaagtgtgtgtgt

SEQ ID NO: 45266 - DNA, 601 bp, Human
atttatgttgtctactggcaaatattatataaaatttgtgataatttaagattatatttatagttaagtgtcactgatgtttttaaaagatcacacaaccatatgaacgtctctgcagcagcttagtgatgctgtgccacaagatggcctcatgcaccacttatggggtcagctctgtgctgccacagacactggggtgccaggaaggctacagggcagatgctcatggacatcacaaaggtgaaataggaaagtctgagtgaatgaaacagggaacatcaaaacaaaagtattcaaaatrtatttctcttctttaagaaattacaactttaaaaatcaaatttgggaaaagaaatgtatgaaatgcaaaacagaatcttacataggatcgatcctgagcctctgatactctggactgttgaacaggattagttctaaaccccaaactttcaaggcattgcttataacctgttaagaaaaatagcaacttttcataagctaaaccactccattccaaatttaggaagtgtagctatgttagttgtgtacttcatatataaatttctctagaaggctataggtttttttttttttttttgtg

SEQ ID NO: 45267 - DNA, 601 bp, Human
gttccttataattgcatataaatgatctttcatttctaaaaaagaaaacagacaatattaacttgaaatattgaattcatatttatgttgtctactggcaaatattatataaaatttgtgataatttaagattatatttatagttaagtgtcactgatgtttttaaaagatcacacaaccatatgaacgtctctgcagcagcttagtgatgctgtgccacaagatggcctcatgcaccacttatggggtcagctctgtgctgccacagacactggggtgccaggaaggctacagggcagaygctcatggacatcacaaaggtgaaataggaaagtctgagtgaatgaaacagggaacatcaaaacaaaagtattcaaaatgtatttctcttctttaagaaattacaactttaaaaatcaaatttgggaaaagaaatgtatgaaatgcaaaacagaatcttacataggatcgatcctgagcctctgatactctggactgttgaacaggattagttctaaaccccaaactttcaaggcattgcttataacctgttaagaaaaatagcaacttttcataagctaaaccactccattccaaattt

SEQ ID NO: 45268 - DNA, 601 bp, Human
agaaaaaaagacaaggaagggtaagaaatgttacctgttttcctaattttctaactgtaaaccagtgttccttataattgcatataaatgatctttcatttctaaaaaagaaaacagacaatattaacttgaaatattgaattcatatttatgttgtctactggcaaatattatataaaatttgtgataatttaagattatatttatagttaagtgtcactgatgtttttaaaagatcacacaaccatatgaacgtctctgcagcagcttagtgatgctgtgccacaagatggcctcatgyaccacttatggggtcagctctgtgctgccacagacactggggtgccaggaaggctacagggcagatgctcatggacatcacaaaggtgaaataggaaagtctgagtgaatgaaacagggaacatcaaaacaaaagtattcaaaatgtatttctcttctttaagaaattacaactttaaaaatcaaatttgggaaaagaaatgtatgaaatgcaaaacagaatcttacataggatcgatcctgagcctctgatactctggactgttgaacaggattagttctaaaccccaaactttcaagg

SEQ ID NO: 45269 - DNA, 601 bp, Human
tttttttttttatttatttttatttttatttttattttttttttaagagacaggacctccctttgttgcccaggctggtctcaaactcctggcttcaagtgatccccccacctcagcctcccaaactgttggcatgagccaccacacctggcccacattttagttttaaatggggtacaatataagaaaaaaagacaaggaagggtaagaaatgttacctgttttcctaattttctaactgtaaaccagtgttccttataattgcatataaatgatctttcatttctaaaaaagaaaacasacaatattaacttgaaatattgaattcatatttatgttgtctactggcaaatattatataaaatttgtgataatttaagattatatttatagttaagtgtcactgatgtttttaaaagatcacacaaccatatgaacgtctctgcagcagcttagtgatgctgtgccacaagatggcctcatgcaccacttatggggtcagctctgtgctgccacagacactggggtgccaggaaggctacagggcagatgctcatggacatcacaaaggtgaaataggaaagtctgagtgaatgaaaca

SEQ ID NO: 45270 - DNA, 601 bp, Human
ccatgctacacacacacacattactggtcagtttcctaattttaaagtcagcaatccttttttttttttaatttttaaatatattttttttatttttatgttttatagaacagtcttactctgtcacccaggctggggtacagtgacaaaatcatagttcactgcagcctcaaactcctgagctcaagtgatccttctgactcagccttccaagtaagctggaattacagatgtgagccaccatgcctggctctttgtttttttttttatttatttttatttttatttttattttttttttaagagacaggacctccctttgttgcccaggctggtctcaaactcctggcttcaagtgatccccccacctcagcctcccaaactgttggcatgagccaccacacctggcccacattttagttttaaatggggtacaatataagaaaaaaagacaaggaagggtaagaaatgttacctgttttcctaattttctaactgtaaaccagtgttccttataattgcatataaatgatctttcatttctaaaaaagaaaacagacaatattaacttgaaatattgaattcatatttatgttgtcta

SEQ ID NO: 45271 - DNA, 601 bp, Human
aaatgacaatttctatctatcaagaaggataaaccatgctacacacacacacattactggtcagtttcctaattttaaagtcagcaatccttttttttttttaatttttaaatatattttttttatttttatgttttatagaacagtcttactctgtcacccaggctggggtacagtgacaaaatcatagttcactgcagcctcaaactcctgagctcaagtgatccttctgactcagccttccaagtaagctggaattacagatgtgagccaccatgcctggctctttgtttttttttttatttatttttatttttatttttattttttttttaagagacaggacctccctttgttgcccaggctggtctcaaactcctggcttcaagtgatccccccacctcagcctcccaaactgttggcatgagccaccacacctggcccacattttagttttaaatggggtacaatataagaaaaaaagacaaggaagggtaagaaatgttacctgttttcctaattttctaactgtaaaccagtgttccttataattgcatataaatgatctttcatttctaaaaaagaaaacagacaatattaa

SEQ ID NO: 45272 - DNA, 601 bp, Human
agtttcacatgttaagaatagatacaacccatcaaagcttagtaagattgtttaaactctggaaatatttcaagttgagctcttttctttgactgaataatatgatcttaaaaactacaagagaatactgcagatttatcactattaaatacttttttttttttttgagaagagtctcactctgtaacccaggctggagtgcagtggcatgatctcggatcactgcaacctctgcctcccaggttcaagtgattctcctgcctcagcctcccaagtagctgggactacaggtctgcaccaycacacccagctaatttttgtatttttagttagagacagcacatttgccacattggccaggctggtctcaaactcctgacctcaaatgatccgcccgcctcagcctcccaaagttctgggattacaaacatgagccactgcacctggcctctgctaaatactctttttttttttttttttttttttttagacagagtattgctctgtcgcccaggctggagtgcagtggcgcgatctcggctcactgcaagctccgcctcccgggttcatgccatcctcctgcctcagcctcccgagtagc

SEQ ID NO: 45273 - DNA, 601 bp, Human
agtgagaactctaactgaacagcgtcacccaaatcacagcctatcaccacgtcaaaactaaagattgtttcactgccactgccagaaaaacagttttatcacactgtcatctaatgtgcctggttatttaactacttcgaaaggtaacattacaaaatgttcagccgttacttaccttcctgttgtaattgagccaagaaaagtgcaagatatgtatctgatattaattctggacccgtcaagagagaattcaagttaaaccactggaaaaaaattgtcaatatttaagttagtgtatatyataggtaataaggaagtttcacatgttaagaatagatacaacccatcaaagcttagtaagattgtttaaactctggaaatatttcaagttgagctcttttctttgactgaataatatgatcttaaaaactacaagagaatactgcagatttatcactattaaatacttttttttttttttgagaagagtctcactctgtaacccaggctggagtgcagtggcatgatctcggatcactgcaacctctgcctcccaggttcaagtgattctcctgcctcagcctcccaagtagctgggact

SEQ ID NO: 45274 - DNA, 601 bp, Human
agtggcgcgatctcagctcactgcaagctccgcctcctgggttcacgccattctcctgcctcagcctcccgagtagctcggactacaggcgtccgccaccacaccccggctaattttttgttatttttagtagagacaggatttcaccgtgttagccaggatggtctcgatctcctgacatcgtgatccgcctgcctcagcctcccaaagtgctgggattacaggcgtgagccaccgtgcccagccgttaggggcatgtatttcaaagaaactggagtttataaggaagaacagtggcctrgaagaggcaaagaagaaaaacatctatccctcctctcagccgtgtgatatgtgatgtataaaagaaaaagccattacttagaagggctgcaaagaaagcagcatcctcagaagaggaagggccaggtgtcagtgagaactctaactgaacagcgtcacccaaatcacagcctatcaccacgtcaaaactaaagattgtttcactgccactgccagaaaaacagttttatcacactgtcatctaatgtgcctggttatttaactacttcgaaaggtaacattacaaaatgttcagccgtta

SEQ ID NO: 45275 - DNA, 601 bp, Human
ttttttttttgagacggagtctcgctctgtcgcccaggctggagggcagtggcgcgatctcagctcactgcaagctccgcctcctgggttcacgccattctcctgcctcagcctcccgagtagctcggactacaggcgtccgccaccacaccccggctaattttttgttatttttagtagagacaggatttcaccgtgttagccaggatggtctcgatctcctgacatcgtgatccgcctgcctcagcctcccaaagtgctgggattacaggcgtgagccaccgtgcccagccgttagggrcatgtatttcaaagaaactggagtttataaggaagaacagtggcctagaagaggcaaagaagaaaaacatctatccctcctctcagccgtgtgatatgtgatgtataaaagaaaaagccattacttagaagggctgcaaagaaagcagcatcctcagaagaggaagggccaggtgtcagtgagaactctaactgaacagcgtcacccaaatcacagcctatcaccacgtcaaaactaaagattgtttcactgccactgccagaaaaacagttttatcacactgtcatctaatgtgcctgg

SEQ ID NO: 45276 - DNA, 601 bp, Human
gataggaggtggtagttaaagagtaatatgcttgcaattgagatttgacagtggttatgattactggtaatagctaagcaagagtaagtgattttgaaactaagaggcaggtactggattgattgacgatacagaaataattaagaatgataaaagtagttgaagtagagaaaaagacaacgagtcagatcctaaaatcactgatgaaaagagacttgtggatgagtgcaaaaggacaagggatagtttaatctaggggcatgtatttcttttttttttcttttctttttttttttgagayggagtctcgctctgtcgcccaggctggagggcagtggcgcgatctcagctcactgcaagctccgcctcctgggttcacgccattctcctgcctcagcctcccgagtagctcggactacaggcgtccgccaccacaccccggctaattttttgttatttttagtagagacaggatttcaccgtgttagccaggatggtctcgatctcctgacatcgtgatccgcctgcctcagcctcccaaagtgctgggattacaggcgtgagccaccgtgcccagccgttaggggcatgtatttcaaag

SEQ ID NO: 45277 - DNA, 601 bp, Human
ttataataaatttaaagtaaaaccttagctaggtgtggtagcacaagcctgtagtcccagctactcaacaggctaaggcaagagaatcacttgagcccaggagtttggagctgcaatgagctgtgattatgctgctgcactccagcctgggcttcagaaataggcctagtcactttgatagatggatgggtgaatggatggatagatcatttaagaaaaaagtaaaaccaatcatcatgttttatgttattttttagccacgtccagctactctggtacaggaatggacaaggccaagatktggtttaaccagggttgagatttttgtcattcaagtatgatggagggagagaggggaaacacgttgaagaatgcaatggagtgattatgatgacggattacagaaaataagcagtagaagaaaggaagaatgcgtataaaggaaatgcttgggccccacagtagggtttaaagaatggctggaataaaaaaacagacaaaacatggtttaaagataggaggtggtagttaaagagtaatatgcttgcaattgagatttgacagtggttatgattactggtaatagctaagcaagagtaag

SEQ ID NO: 45278 - DNA, 601 bp, Human
ttttataaacatcttggagagtggtacataattttttataaacaccttggagggtggtacatcactaagaaaacatagtagaaatatcagacagcactaaaggctcatctgaattttgtgattataataaatttaaagtaaaaccttagctaggtgtggtagcacaagcctgtagtcccagctactcaacaggctaaggcaagagaatcacttgagcccaggagtttggagctgcaatgagctgtgattatgctgctgcactccagcctgggcttcagaaataggcctagtcactttgatagatggatgggtgaatggatggatagatcatttaagaaaaaagtaaaaccaatcatcatgttttatgttattttttagccacgtccagctactctggtacaggaatggacaaggccaagatgtggtttaaccagggttgagatttttgtcattcaagtatgatggagggagagaggggaaacacgttgaagaatgcaatggagtgattatgatgacggattacagaaaataagcagtagaagaaaggaagaatgcgtataaaggaaatgcttgggccccacagtagggtttaaagaatggc

SEQ ID NO: 45279 - DNA, 601 bp, Human
aagccacaaggaaggtgtgtaagggagaggaaagtgcttaaaggtttaaagacataagctgtgaaattagtcaccttggagggtggcacattattttttataaacatcttggagagtggtacataattttttataaacaccttggagggtggtacatcactaagaaaacatagtagaaatatcagacagcactaaaggctcatctgaattttgtgattataataaatttaaagtaaaaccttagctaggtgtggtagcacaagcctgtagtcccagctactcaacaggctaaggcaagagratcacttgagcccaggagtttggagctgcaatgagctgtgattatgctgctgcactccagcctgggcttcagaaataggcctagtcactttgatagatggatgggtgaatggatggatagatcatttaagaaaaaagtaaaaccaatcatcatgttttatgttattttttagccacgtccagctactctggtacaggaatggacaaggccaagatgtggtttaaccagggttgagatttttgtcattcaagtatgatggagggagagaggggaaacacgttgaagaatgcaatggagtga

SEQ ID NO: 45280 - DNA, 601 bp, Human
ccaggcgcagtggctcatgcctgtaatcccagcactttagggggccgaggtgggcggctcacctgaggtcaggagttggagaccagcctaacaaacatggagaaaccccttccatctctactaaaatacaaaattagccaggcatggtggcacatgcctgtaaatccagctactcgggaggctgaggcaagaaaatcgcttgaacccaggaggcagaagttacggtgagccgagatcacgccattgcactccagccggagcaacaagagggaaactccatctcaaaaaaaaaaaaaaaaaattagccggtcatggtggtgcacgcctgtaatcccagctactcgggaggttgaggcaggagaatcgcttgaacccaggaggcagagttcaagaaaaggagaaggcacactagagacaatcctaaggaaaaaataaaaatggggaggcagctggagtttcatggaattaagagaggatttttatttttaatcaatggaaataaaaagcttattttactgcttataggaatattacaaaaaaagggggggggaactgattatataagagagtggagagatgaaagcaggaacatcttgagtag

SEQ ID NO: 45281 - DNA, 601 bp, Human
tctactaaaaatacaaaaaaaaaaaaaaaaaatttagccggggccaggcgcagtggctcatgcctgtaatcccagcactttagggggccgaggtgggcggctcacctgaggtcaggagttggagaccagcctaacaaacatggagaaaccccttccatctctactaaaatacaaaattagccaggcatggtggcacatgcctgtaaatccagctactcgggaggctgaggcaagaaaatcgcttgaacccaggaggcagaagttacggtgagccgagatcacgccattgcactccagccgragcaacaagagggaaactccatctcaaaaaaaaaaaaaaaaaattagccggtcatggtggtgcacgcctgtaatcccagctactcgggaggttgaggcaggagaatcgcttgaacccaggaggcagagttcaagaaaaggagaaggcacactagagacaatcctaaggaaaaaataaaaatggggaggcagctggagtttcatggaattaagagaggatttttatttttaatcaatggaaataaaaagcttattttactgcttataggaatattacaaaaaaagggggggggaactgatt

SEQ ID NO: 45282 - DNA, 601 bp, Human
tcgaggccaggaattcgagaccaacctggccaatatggtgaaaccctgtctctactaaaaatacaaaaaaaaaaaaaaaaaatttagccggggccaggcgcagtggctcatgcctgtaatcccagcactttagggggccgaggtgggcggctcacctgaggtcaggagttggagaccagcctaacaaacatggagaaaccccttccatctctactaaaatacaaaattagccaggcatggtggcacatgcctgtaaatccagctactcgggaggctgaggcaagaaaatcgcttgaacccrggaggcagaagttacggtgagccgagatcacgccattgcactccagccggagcaacaagagggaaactccatctcaaaaaaaaaaaaaaaaaattagccggtcatggtggtgcacgcctgtaatcccagctactcgggaggttgaggcaggagaatcgcttgaacccaggaggcagagttcaagaaaaggagaaggcacactagagacaatcctaaggaaaaaataaaaatggggaggcagctggagtttcatggaattaagagaggatttttatttttaatcaatggaaataaaaagct

SEQ ID NO: 45283 - DNA, 601 bp, Human
ggctaggcaaggtgactcacgcctgtaatcccagcactttgggaggctgaggcaggtggatcactcgaggccaggaattcgagaccaacctggccaatatggtgaaaccctgtctctactaaaaatacaaaaaaaaaaaaaaaaaatttagccggggccaggcgcagtggctcatgcctgtaatcccagcactttagggggccgaggtgggcggctcacctgaggtcaggagttggagaccagcctaacaaacatggagaaaccccttccatctctactaaaatacaaaattagccaggcrtggtggcacatgcctgtaaatccagctactcgggaggctgaggcaagaaaatcgcttgaacccaggaggcagaagttacggtgagccgagatcacgccattgcactccagccggagcaacaagagggaaactccatctcaaaaaaaaaaaaaaaaaattagccggtcatggtggtgcacgcctgtaatcccagctactcgggaggttgaggcaggagaatcgcttgaacccaggaggcagagttcaagaaaaggagaaggcacactagagacaatcctaaggaaaaaataaaaatgggga

SEQ ID NO: 45284 - DNA, 601 bp, Human
tattcctaaatgtgaattcacaataactacataacaaacccagcagcaataagcatgccagcactcaaattgtgatctccaaataccattactaaaagatggctaggcaaggtgactcacgcctgtaatcccagcactttgggaggctgaggcaggtggatcactcgaggccaggaattcgagaccaacctggccaatatggtgaaaccctgtctctactaaaaatacaaaaaaaaaaaaaaaaaatttagccggggccaggcgcagtggctcatgcctgtaatcccagcactttagggggccgaggtgggcggctcacctgaggtcaggagttggagaccagcctaacaaacatggagaaaccccttccatctctactaaaatacaaaattagccaggcatggtggcacatgcctgtaaatccagctactcgggaggctgaggcaagaaaatcgcttgaacccaggaggcagaagttacggtgagccgagatcacgccattgcactccagccggagcaacaagagggaaactccatctcaaaaaaaaaaaaaaaaaattagccggtcatggtggtgcacgcctgtaatcccagctactcg

SEQ ID NO: 45285 - DNA, 601 bp, Human
ttcttaaactttggtgtttgttattggatatcctttgttggattaacacataatgggacaaagattataagaactattaatggaaaacctcaaaatagtatgttgaacattttttatgaggacaactgtattcagagtttagacggtttaatgtgttttctgccagtaaaattgtttctgtattgtataataaatatgccagctcaccatggtattctatgaagagtgtctgaagaatggatactctgccctgttcaggggccatggtaaagatcttgggttttattcaagacttcacatwttttttttttttaatttttttttgagagtctcgttctgtcacccaggctggagtgcagtggtatgatcttggctcgctgtaacctctgcctcccgggttcaagtgattctcctatctcagcctcccgagtagctgggactacaggtgcacaacaccacacccagttaatttttgtattttttggtagagacagggtttcaccatgttggccaggctggtctcatcaactcctgacctcaagtgatctgccccctcatcctcccaaagtgctgggattgcaggcatgagccaccaagcccg

SEQ ID NO: 45286 - DNA, 601 bp, Human
ttctcctgcctcagcctcctgagtagctgggattacaggcacccaccaccacacccagttaatgtttgtatttttaggagaggcagggtttcaccatgttggctgggctggtctcgaactcctgacctcaggtgatctgcccacctcggcctcccaaagtgctgggattacaggtgtgagccaccgcgcctagcacatttttcttaaactttggtgtttgttattggatatcctttgttggattaacacataatgggacaaagattataagaactattaatggaaaacctcaaaatagtaygttgaacattttttatgaggacaactgtattcagagtttagacggtttaatgtgttttctgccagtaaaattgtttctgtattgtataataaatatgccagctcaccatggtattctatgaagagtgtctgaagaatggatactctgccctgttcaggggccatggtaaagatcttgggttttattcaagacttcacatattttttttttttaatttttttttgagagtctcgttctgtcacccaggctggagtgcagtggtatgatcttggctcgctgtaacctctgcctcccgggttc

SEQ ID NO: 45287 - DNA, 601 bp, Human
tagatgctacacacaaaaaccaaggatgggctatacctaaaacaatctaactgatttaagtttctctatcattaatttttttttttttttaatttgagatggagtctcactctgtcacccaggctggagtgcagtggtgcaatattagctcactgcaacctctgcctcccaggaggttcaagcgattctcctgcctcagcctcctgagtagctgggattacaggcacccaccaccacacccagttaatgtttgtatttttaggagaggcagggtttcaccatgttggctgggctggtctckaactcctgacctcaggtgatctgcccacctcggcctcccaaagtgctgggattacaggtgtgagccaccgcgcctagcacatttttcttaaactttggtgtttgttattggatatcctttgttggattaacacataatgggacaaagattataagaactattaatggaaaacctcaaaatagtatgttgaacattttttatgaggacaactgtattcagagtttagacggtttaatgtgttttctgccagtaaaattgtttctgtattgtataataaatatgccagctcaccatggtatt

SEQ ID NO: 45288 - DNA, 601 bp, Human
cattagtctagtgtgactgtgtctaaatatgattccagaaatccagggtttccccaagctagatgctacacacaaaaaccaaggatgggctatacctaaaacaatctaactgatttaagtttctctatcattaatttttttttttttttaatttgagatggagtctcactctgtcacccaggctggagtgcagtggtgcaatattagctcactgcaacctctgcctcccaggaggttcaagcgattctcctgcctcagcctcctgagtagctgggattacaggcacccaccaccacacccrgttaatgtttgtatttttaggagaggcagggtttcaccatgttggctgggctggtctcgaactcctgacctcaggtgatctgcccacctcggcctcccaaagtgctgggattacaggtgtgagccaccgcgcctagcacatttttcttaaactttggtgtttgttattggatatcctttgttggattaacacataatgggacaaagattataagaactattaatggaaaacctcaaaatagtatgttgaacattttttatgaggacaactgtattcagagtttagacggtttaatgtgtt

SEQ ID NO: 45289 - DNA, 601 bp, Human
attgtaagactggaagagccgtctcattgagtgactgtgagaaataaatatgtctgtaaagggccctactaatatagtacttgactgagcaggctactcacttactgttgtcagagtgggtaacagcaactgatttagaatcagactgcctgcatctgatcccagttctcccacttcctagctgcatttgtcttggtttctactgttaaacatatgatactagtaccttcctgtgatggttaatattatcaacttgattggattgaaggctacaaattattgtttctgggtgtgtctgcgrgggtgttgccaaaggagattaacatttaagccagtgaactgggagaggtagacccaccctcaaactgggtggtcaccatctaatcagctgccagctcagctagaataaagcaggcagaaataagagtgtggaagtactagacttgctgagccttcatctttctcccatgctggatgcttcctgccctcaaacatcagactccaagttcttcatcttttggactcttgaacttacaccagtggtttgccaggggctctcaggccttttgccacagactgaaggctgcactgtcagcttccc

SEQ ID NO: 45290 - DNA, 601 bp, Human
aataaaacaaaaaacccacttcaaacttttaattaagctactttgagctatgtcttaacatttttctttgcctagattgtctaggggatatgttttcgcttttctctattgatagtttatatcactaaaaaactgggcccaccaaagtgggcttacggtttaagttgcatagccaataaatgttgggtttttgtaaaatcagtttatattccctgtccaggcccttccatagtgtctaatggcacatatttatgtaacagctgatttggataagggtcaactgatacccacaaagattaamaccacaatttactattgtgttagtacagtgttgaaaccaaataaaataaccaggagtaaaaatataactactcctaataaaatataggttgtaaaaagtgatttccattataagaaatctaaagggaaagcccactatatagctattgcttctgcagtaattgtcaaaacacctctaagagtacattaacttccatgaaatctaagaataattggaatcaattcttcagcaatgaatacaacacacatcagaatgtctttaccttgcatacttagctgaatagccctgcggagatctgct

SEQ ID NO: 45291 - DNA, 601 bp, Human
gttacttgaaaagaatgtattttcatatggtggaattcctatttagcaagcacttacaaggctgggcacaaggtaaggttttaggagttgatccagatttatggtttgcatccattcccctgatgctaacaggcttacaggactgcctgaagcggccatgagcagctaaatgaactaccacgtctatttgggaatgcgctcccatacctccaaagctgtttttcgtactgattggtagaggaattttgcagggttaatcaggtaagcaagaagtacatccaaaggatcaattggcattctgcttgtcttgtcctaatttcatttttcttttaataaatgaaattttataaggtttccttcactcagtttaaaaaatttatccagtattggggcaaggtttttttgtttcatgttatttgccgtaaatttttatttttatttatatatatatacatatatttttggagacggagtctcactctgtcacccagtctggagggcagtggtgcgatctcggctcactgcaacctccacgtcccgggttcaagcaattctcctggctcagcctcccaagcagctgggactacaggcgcacgcttcc

SEQ ID NO: 45292 - DNA, 601 bp, Human
gccgggctcagtggctcatgcctgtaatcccagcactctgggaggccgaggcaggtggatcacttgaggtcaggagtttaaggccagcctggacgacatggtgaaatcccgtgtctactaaaaatacaagaattagccaggcatggtggtgtgtacctgtaatcccagctacttgggaggctgaagtgggagaatcgcttgaactcaggaggcagaggttgcagtgagcagaaattgtgccattgcactccagcctgggcaacagagcaagactccatctcaaaaaaaaaaaaaaaaaaaagcaagattggccgtgtgctagtatttgttgaatctgggtcataaacaggagtatgctagtttttctacttttgtataaatttggagtttattataataaaaaagttaattttgaaacttaaaagtaaaaagcactaataagcactactttgaaatttaacatataattagccattaatctatactgaataaagactagaaatatctcacattaagaggatgtcagctgatcagaattttccttcatctacttctgagttgtgacttaaaaacaaaacagaaaaaaaggtaaatattttct

SEQ ID NO: 45293 - DNA, 601 bp, Human
cacacccagctaatttttgtgtattttttagtagagacggggtttcactgtattagccaggatggtctccatctcctgacttcgtaatctgcctgcctcggcctcccaaagtgctgggattgcaggcatgaactaccgcgcccagccttttttttttctttttgagacagtatctcgctctgtcacccaggatagagtgcagtggcacaatctcggctcactgcaacctccacctctgggttcaaacgattctcctgcctcagcctccaaagtagctgtgattacaggtgtgcaccaccaygcccaactaatttttttgtatttttagtagagacaggctttcgccatgttggccaggttggtcttgaactcatggcctcaagtgatctgcctgcctcagcctcccaaagtgctgggattacagacatgagccactacgcctggccatgtatgctttaatttctatatttcttttctcttttttttttttttgaggcggagtttcactctgtcacccaggctggagtgcagtggggtgatctcagctcactgcaacctctacctcctgggttcaagcgattcttctgtctcagcctcctga

SEQ ID NO: 45294 - DNA, 601 bp, Human
ttttttttgagacagagcctcgctctgtcgcccagactggagtgcagtggtgtgatctctgctcactgcaagctccacctcccgggttcatgccattctcctgcctcagcctccagagtagctgggactacaggtgcctgccaccacacccagctaatttttgtgtattttttagtagagacggggtttcactgtattagccaggatggtctccatctcctgacttcgtaatctgcctgcctcggcctcccaaagtgctgggattgcaggcatgaactaccgcgcccagccttttttttttctttttgagacagtatctcgctctgtcacccaggatagagtgcagtggcacaatctcggctcactgcaacctccacctctgggttcaaacgattctcctgcctcagcctccaaagtagctgtgattacaggtgtgcaccaccatgcccaactaatttttttgtatttttagtagagacaggctttcgccatgttggccaggttggtcttgaactcatggcctcaagtgatctgcctgcctcagcctcccaaagtgctgggattacagacatgagccactacgcctggccatgtatgcttt

SEQ ID NO: 45295 - DNA, 601 bp, Human
ctgaaggaggtgagagtatgctttcttttttttttttgagacagagcctcgctctgtcgcccagactggagtgcagtggtgtgatctctgctcactgcaagctccacctcccgggttcatgccattctcctgcctcagcctccagagtagctgggactacaggtgcctgccaccacacccagctaatttttgtgtattttttagtagagacggggtttcactgtattagccaggatggtctccatctcctgacttcgtaatctgcctgcctcggcctcccaaagtgctgggattgcaggcrtgaactaccgcgcccagccttttttttttctttttgagacagtatctcgctctgtcacccaggatagagtgcagtggcacaatctcggctcactgcaacctccacctctgggttcaaacgattctcctgcctcagcctccaaagtagctgtgattacaggtgtgcaccaccatgcccaactaatttttttgtatttttagtagagacaggctttcgccatgttggccaggttggtcttgaactcatggcctcaagtgatctgcctgcctcagcctcccaaagtgctgggattacagacat

SEQ ID NO: 45296 - DNA, 601 bp, Human
caagccaagaggctgaagctggtaaccatcactgcacactttcctcctcaatcaatcctccaccaagtaggaaggaggtatatcgatattcgaacatttttaaaagggtacaaggttgcctgaccctgtttactaaaaagcactagttattgctgacattgtacttgttataacttacttagtcattattggacattactgaattatcgttactactataaaaagttcaggccgggtgcagtggctcatgcctgtaatcccagcatgttgggagacccaggctggcagattgcctgagatyaggagttcgagaccagtctggccaacatggtgaaaccccctctctactaaaaatacaaaaaaattagcccgacgtggtggcatgcgcctgtaatcccagctacttgggaggctgaggcaggggaattgcttgaaccagggaggtggaggttgcagtgagccgagatcgcgccactgcactccagactgggtgacaaaagcgagacctcgtctcaaaaaagaaaaaaaaaaaaaaaaaagctcaatttgttggaagtttcatatttttaatccagtttttaaaaaattttaagtaaaagag

SEQ ID NO: 45297 - DNA, 601 bp, Human
tcccaaagacagaacctagagagacaacgaactacctaggctaagtaatcaggaattttagtgaaaggcaaatattagcttcttagctcctactaatgagctctacaaggttttgaatgcaagccattgttaaaaatgaacatcaagaagttagttcttaactcttctcagcaacatgtgactatgtaagatattctcaagctctttccaaattctcaccagtatttgcaaagtcaagccaagaggctgaagctggtaaccatcactgcacactttcctcctcaatcaatcctccaccaaktaggaaggaggtatatcgatattcgaacatttttaaaagggtacaaggttgcctgaccctgtttactaaaaagcactagttattgctgacattgtacttgttataacttacttagtcattattggacattactgaattatcgttactactataaaaagttcaggccgggtgcagtggctcatgcctgtaatcccagcatgttgggagacccaggctggcagattgcctgagatcaggagttcgagaccagtctggccaacatggtgaaaccccctctctactaaaaatacaaaaaaatta

SEQ ID NO: 45298 - DNA, 601 bp, Human
agtggttacagctcttcctgcaagttggtttgtggtactgtggaggcctggctaagagctgcaccttcatcctttcttaagattatgtaaacccctaatttctatattaagtattttcctctttaaaacatccccagtagtttctgtttctcaacactgtttgataaattataccatatcactgaagtggtggctcaagtattaggcaatcaaacactcatagcaatccatgtccatgaagatatttgtgtctctccttgttatagaacatttgcaacttatgttttttgtaacagaaagmatctgcatccatttcaaagccacacctagagaagacattaataactgccaacatgtatgtatggaatactttacagtttataaaatagtttcacacacattgcttaatttcatgcttctgtgagttaaggcaggttttacagtgacacagctgatgtagtagagttttgcttggggttttatgatggtaaaacagatttagagactactgctggaaaaaatgtcatggcttgaaaatattatttaatgactcataaattatgaatctgtaatagggagtttttttttttttttttttttt

SEQ ID NO: 45299 - DNA, 601 bp, Human
gggggccagacttcatgttcccatctctaggcaattgtggtggcagctttctatgccaaggatcattgctatagcagtatgttcttaaatttaatatcctcattacccattgtcccaactggggcagtggttacagctcttcctgcaagttggtttgtggtactgtggaggcctggctaagagctgcaccttcatcctttcttaagattatgtaaacccctaatttctatattaagtattttcctctttaaaacatccccagtagtttctgtttctcaacactgtttgataaattataccrtatcactgaagtggtggctcaagtattaggcaatcaaacactcatagcaatccatgtccatgaagatatttgtgtctctccttgttatagaacatttgcaacttatgttttttgtaacagaaagcatctgcatccatttcaaagccacacctagagaagacattaataactgccaacatgtatgtatggaatactttacagtttataaaatagtttcacacacattgcttaatttcatgcttctgtgagttaaggcaggttttacagtgacacagctgatgtagtagagttttgcttggg

SEQ ID NO: 45300 - DNA, 601 bp, Human
gtggcaagcaaagccatttgggagatgccagtcccaaaattctgcttcactgctgttgcaatgggggccagacttcatgttcccatctctaggcaattgtggtggcagctttctatgccaaggatcattgctatagcagtatgttcttaaatttaatatcctcattacccattgtcccaactggggcagtggttacagctcttcctgcaagttggtttgtggtactgtggaggcctggctaagagctgcaccttcatcctttcttaagattatgtaaacccctaatttctatattaagtaytttcctctttaaaacatccccagtagtttctgtttctcaacactgtttgataaattataccatatcactgaagtggtggctcaagtattaggcaatcaaacactcatagcaatccatgtccatgaagatatttgtgtctctccttgttatagaacatttgcaacttatgttttttgtaacagaaagcatctgcatccatttcaaagccacacctagagaagacattaataactgccaacatgtatgtatggaatactttacagtttataaaatagtttcacacacattgcttaatttcat

SEQ ID NO: 45301 - DNA, 601 bp, Human
ctccgtctcaaaaaataaaataaaataggcagaaatgaggcctagccatctccctccactttggttgttctctggtggcaagcaaagccatttgggagatgccagtcccaaaattctgcttcactgctgttgcaatgggggccagacttcatgttcccatctctaggcaattgtggtggcagctttctatgccaaggatcattgctatagcagtatgttcttaaatttaatatcctcattacccattgtcccaactggggcagtggttacagctcttcctgcaagttggtttgtggtactstggaggcctggctaagagctgcaccttcatcctttcttaagattatgtaaacccctaatttctatattaagtattttcctctttaaaacatccccagtagtttctgtttctcaacactgtttgataaattataccatatcactgaagtggtggctcaagtattaggcaatcaaacactcatagcaatccatgtccatgaagatatttgtgtctctccttgttatagaacatttgcaacttatgttttttgtaacagaaagcatctgcatccatttcaaagccacacctagagaagacatt

SEQ ID NO: 45302 - DNA, 601 bp, Human
agttcaagaccagcctggccaacgtggcaaaaccccacctctactaaaaataagaaaattggctgggcacagtggcgggtgcctgtaatcccagctactcaggaggctgaggcaggagaattgtttgaagctgggaggcggaggctgcagtgagccgagatcacactactgcactccagcctgggcgacagacaagactccgtctcaaaaaataaaataaaataggcagaaatgaggcctagccatctccctccactttggttgttctctggtggcaagcaaagccatttgggagatgccmgtcccaaaattctgcttcactgctgttgcaatgggggccagacttcatgttcccatctctaggcaattgtggtggcagctttctatgccaaggatcattgctatagcagtatgttcttaaatttaatatcctcattacccattgtcccaactggggcagtggttacagctcttcctgcaagttggtttgtggtactgtggaggcctggctaagagctgcaccttcatcctttcttaagattatgtaaacccctaatttctatattaagtattttcctctttaaaacatccccagtagttt

SEQ ID NO: 45303 - DNA, 601 bp, Human
tgacaggtgagatagcaattttagaggaatagcctttattctacttttagtttatgaaaaatgagaagtaaatcaattgtccaccttgaaacaatgtagacaccttccagctgtgaagacactgaggtggaacatgttcaagtggtactcagcatccactcccactgtgccatcaatattatagaggttacaaagctaaaagctacatgtcttagattattttacaagtaggattctggttacaaattaagtgctcacatgagctttaaaaagcagaaacgggtcaggcacagtggcttgygcctgtaatcccagcactttgggaggccaaggcaggcggatcacctgaggtgaggagttcaagaccagcctggccaacatggcaaaactgtctctactaaaaatacaaaccttgtctgggcacggtggctcatgcctgtaatcccagcactttgggaggccgaggcgggcggatcacgaggtcaggagttcgagaccagcctggccaacatggtgaaaccccatctctattaaaaatacaaaaaaattagccaggtgtgttggcgcacacctgtaatcccagctactctggaggctgagg

SEQ ID NO: 45304 - DNA, 601 bp, Human
ttaccagcaacaattattaatagaatggcacattttttatagagttcctctcaattttgtgttttaaaactgtgaacaataaagaaagttcaactaatgagaactgcaatttctccctgttggtctctgagccagaatactgacctgtgtgtaggtgtaagaccttagtgtgcatggctaatgatgcacgtaagggcagtatcctcccattagcaaatcctgatgctgcaacatagcacaagagggacggactgagttatggagaattcctggcacatctgctatcactccatgccctctkcccctccactcaagaaggtatgtgagaatgcaagggagtgacaggtgagatagcaattttagaggaatagcctttattctacttttagtttatgaaaaatgagaagtaaatcaattgtccaccttgaaacaatgtagacaccttccagctgtgaagacactgaggtggaacatgttcaagtggtactcagcatccactcccactgtgccatcaatattatagaggttacaaagctaaaagctacatgtcttagattattttacaagtaggattctggttacaaattaagtgctcacatga

SEQ ID NO: 45305 - DNA, 601 bp, Human
aaaggaacaaggatttttaaattaccagcaacaattattaatagaatggcacattttttatagagttcctctcaattttgtgttttaaaactgtgaacaataaagaaagttcaactaatgagaactgcaatttctccctgttggtctctgagccagaatactgacctgtgtgtaggtgtaagaccttagtgtgcatggctaatgatgcacgtaagggcagtatcctcccattagcaaatcctgatgctgcaacatagcacaagagggacggactgagttatggagaattcctggcacatcygctatcactccatgccctctgcccctccactcaagaaggtatgtgagaatgcaagggagtgacaggtgagatagcaattttagaggaatagcctttattctacttttagtttatgaaaaatgagaagtaaatcaattgtccaccttgaaacaatgtagacaccttccagctgtgaagacactgaggtggaacatgttcaagtggtactcagcatccactcccactgtgccatcaatattatagaggttacaaagctaaaagctacatgtcttagattattttacaagtaggattctggtt

SEQ ID NO: 45306 - DNA, 601 bp, Human
aaaaaccaaaacttacaaacagctgacaatctcagtgagaagctataggttaaaaaaaaaaaaaaaaaaaagattgcttctcggtcttttggctaagatcaagtgtttaaaaaaaaaaggtatataagaatttgaaaaggaacaaggatttttaaattaccagcaacaattattaatagaatggcacattttttatagagttcctctcaattttgtgttttaaaactgtgaacaataaagaaagttcaactaatgagaactgcaatttctccctgttggtctctgagccagaatactgacytgtgtgtaggtgtaagaccttagtgtgcatggctaatgatgcacgtaagggcagtatcctcccattagcaaatcctgatgctgcaacatagcacaagagggacggactgagttatggagaattcctggcacatctgctatcactccatgccctctgcccctccactcaagaaggtatgtgagaatgcaagggagtgacaggtgagatagcaattttagaggaatagcctttattctacttttagtttatgaaaaatgagaagtaaatcaattgtccaccttgaaacaatgtagacacctt

SEQ ID NO: 45307 - DNA, 601 bp, Human
tatgtaaatacaaacacagaaaaccaaaaaccaaaacttacaaacagctgacaatctcagtgagaagctataggttaaaaaaaaaaaaaaaaaaaagattgcttctcggtcttttggctaagatcaagtgtttaaaaaaaaaaggtatataagaatttgaaaaggaacaaggatttttaaattaccagcaacaattattaatagaatggcacattttttatagagttcctctcaattttgtgttttaaaactgtgaacaataaagaaagttcaactaatgagaactgcaatttctccctgytggtctctgagccagaatactgacctgtgtgtaggtgtaagaccttagtgtgcatggctaatgatgcacgtaagggcagtatcctcccattagcaaatcctgatgctgcaacatagcacaagagggacggactgagttatggagaattcctggcacatctgctatcactccatgccctctgcccctccactcaagaaggtatgtgagaatgcaagggagtgacaggtgagatagcaattttagaggaatagcctttattctacttttagtttatgaaaaatgagaagtaaatcaattgtc

SEQ ID NO: 45308 - DNA, 601 bp, Human
gggaatctgggtgaaggatataaggagctctgtgtactatttctgcttttatgtaaatctgaaattacaggtcaagcatcctaaatccgagaatcagaaatccaaatgctccaaaatcagaaactttttgagcaccaacatgatactcaaaagaggtgctcagtggaacacttcagatttgaaattttggatttggaatgcttaactggtaagtatagtgcaaatattcacaaatcctaaaaaaccccaaatctaaaacacttccagtcttaagcattttggataagggatactcaatctrtatttcatatatgtaaatacaaacacagaaaaccaaaaaccaaaacttacaaacagctgacaatctcagtgagaagctataggttaaaaaaaaaaaaaaaaaaaagattgcttctcggtcttttggctaagatcaagtgtttaaaaaaaaaaggtatataagaatttgaaaaggaacaaggatttttaaattaccagcaacaattattaatagaatggcacattttttatagagttcctctcaattttgtgttttaaaactgtgaacaataaagaaagttcaactaatgagaactgcaat

SEQ ID NO: 45309 - DNA, 601 bp, Human
attttaattctcagcataaacttatcatcatctggtgttctctttatttccctctttatggcatgtaagctaatgaaagtgcaaatcttatcttactcatctatttccccagtgctgataactgtgctgttacatagtaagcattcactgaacacctgataaatgaaataaatgaaaactactatttaacacacattatcagattttaagtaatactgattgcattaagctcctctgtaattttttcaaaaagagaaacaatgtaatacaaatccccattttaaaatgtttaaacatgacrgttatcatgtaaatatgtaggaatatattcttgtacttagaaaatatacactgaacaactgagacataatggaaaatcatatctgcatattattcccaaatggttcagaaaggccaataattggggaatctgggtgaaggatataaggagctctgtgtactatttctgcttttatgtaaatctgaaattacaggtcaagcatcctaaatccgagaatcagaaatccaaatgctccaaaatcagaaactttttgagcaccaacatgatactcaaaagaggtgctcagtggaacacttcaga

SEQ ID NO: 45310 - DNA, 601 bp, Human
cattgtttcacgaatcaaagtagtcactggtattaaaagaatgcaagagcagttagtctgatacagattactttaaaatatggaagtgctgatcttaggaaatctagacataaaatttaaatttatcagacaaattaagaggtaggtattttcatcacaaaataacctatcatggccaggagtggtggctcacacctgtaatcccagcactttgggaggccgaggcgggtggatggcttgaggtcagaagtttgacacgagcctggacaacacggtgaaaccccatctctactaaaaatayaaaaattagccaggcgtggtggcaggcacctgtaatcccagctactttgggaggctgaggcaggagaatcacttgaaccggggaggtagaggttgcagtgagccaagatcgcgccactgcactccagcctgggcgacagagcgagactctgtctcaaaaaaacaacaaacaaaaaacctatcatacaaaaagattcactggtagttattcttatgcaaatgagtgttggtttatagacccttaatattgttgaaagtcaccaaaaataagtacctttgatcagataaagcatttcaaact

SEQ ID NO: 45311 - DNA, 601 bp, Human
agaataaatacaccatgagaaaaactattcataaggaaaatacattgtttcacgaatcaaagtagtcactggtattaaaagaatgcaagagcagttagtctgatacagattactttaaaatatggaagtgctgatcttaggaaatctagacataaaatttaaatttatcagacaaattaagaggtaggtattttcatcacaaaataacctatcatggccaggagtggtggctcacacctgtaatcccagcactttgggaggccgaggcgggtggatggcttgaggtcagaagtttgacacsagcctggacaacacggtgaaaccccatctctactaaaaatacaaaaattagccaggcgtggtggcaggcacctgtaatcccagctactttgggaggctgaggcaggagaatcacttgaaccggggaggtagaggttgcagtgagccaagatcgcgccactgcactccagcctgggcgacagagcgagactctgtctcaaaaaaacaacaaacaaaaaacctatcatacaaaaagattcactggtagttattcttatgcaaatgagtgttggtttatagacccttaatattgttgaaagtc

SEQ ID NO: 45312 - DNA, 601 bp, Human
caaaacttaaaagaataaatacaccatgagaaaaactattcataaggaaaatacattgtttcacgaatcaaagtagtcactggtattaaaagaatgcaagagcagttagtctgatacagattactttaaaatatggaagtgctgatcttaggaaatctagacataaaatttaaatttatcagacaaattaagaggtaggtattttcatcacaaaataacctatcatggccaggagtggtggctcacacctgtaatcccagcactttgggaggccgaggcgggtggatggcttgaggtcagragtttgacacgagcctggacaacacggtgaaaccccatctctactaaaaatacaaaaattagccaggcgtggtggcaggcacctgtaatcccagctactttgggaggctgaggcaggagaatcacttgaaccggggaggtagaggttgcagtgagccaagatcgcgccactgcactccagcctgggcgacagagcgagactctgtctcaaaaaaacaacaaacaaaaaacctatcatacaaaaagattcactggtagttattcttatgcaaatgagtgttggtttatagacccttaatat

SEQ ID NO: 45313 - DNA, 601 bp, Human
tgcttattatctaaaggtttttatcttgctaggttgcctcttttggctagagagagcaggcttttcatggggttttctcttggtctgaacccatagcttctccagcaccaagtccaggataaatgaggcaaaaagaaaatccagtccactccccaccacactgctcctctggttccaaggtccctagccagtctgtcttctctctgcctttgagattcagctgaatggttttttttttctttttgagacagagttttgctcttgttgcccaggctggagtgcaatggtgcaatctcagctyactgcaaccttcgcttcccgggatcaagcaattctcctgcctcagcctcccaagaagctgggattacaggcatgcgccaccatgcccgactaatcttgtatttttagttgagacagggtttctccatgttggtcagaccggtcttgaactcccaaccttaggtgatccacccgcctcagcctcccaaagtgctgggattacacgtgtgagccaccgcacccagcccagctcatgttttatacaaatgttgaggtgttttggctgtacttaaacaggaggaatagaaaaaagtaccagttc

SEQ ID NO: 45314 - DNA, 601 bp, Human
ccaggttggggtacatatcttggctcccacttggcctttgctgacaggggtgaatggggccagtttattctgttttgtttgactggagtcaagtgcttattatctaaaggtttttatcttgctaggttgcctcttttggctagagagagcaggcttttcatggggttttctcttggtctgaacccatagcttctccagcaccaagtccaggataaatgaggcaaaaagaaaatccagtccactccccaccacactgctcctctggttccaaggtccctagccagtctgtcttctctctgcytttgagattcagctgaatggttttttttttctttttgagacagagttttgctcttgttgcccaggctggagtgcaatggtgcaatctcagcttactgcaaccttcgcttcccgggatcaagcaattctcctgcctcagcctcccaagaagctgggattacaggcatgcgccaccatgcccgactaatcttgtatttttagttgagacagggtttctccatgttggtcagaccggtcttgaactcccaaccttaggtgatccacccgcctcagcctcccaaagtgctgggattacacgtgt

SEQ ID NO: 45315 - DNA, 601 bp, Human
gagccagagagatgcctatgtattactgggtggaagttcagcctccctgtgaccactgacaccatgtgaaaggagtgttatcacctcctggagggaatgagaatcccagctccccagtcagccttctctaacaccaccttggctgggaaaggggagaagtgtaccttatgacttccaggttggggtacatatcttggctcccacttggcctttgctgacaggggtgaatggggccagtttattctgttttgtttgactggagtcaagtgcttattatctaaaggtttttatcttgctaggytgcctcttttggctagagagagcaggcttttcatggggttttctcttggtctgaacccatagcttctccagcaccaagtccaggataaatgaggcaaaaagaaaatccagtccactccccaccacactgctcctctggttccaaggtccctagccagtctgtcttctctctgcctttgagattcagctgaatggttttttttttctttttgagacagagttttgctcttgttgcccaggctggagtgcaatggtgcaatctcagcttactgcaaccttcgcttcccgggatcaagcaatt

SEQ ID NO: 45316 - DNA, 601 bp, Human
ttttttttgagacaaggtctcgctctgtcacccaggctggagtacagtggcatgagcttggctcactgcaacctccacctcctgggttcaaccaattctcttgcctcagcctcccaagtagctgggactataggcgcccaccaccaagcctggataatttttttttttttgagatggagtctcgctcaactgcccaggctggagtgcagtggcgcgaccttggctcactgcaaccgtcgcctcccaggttcaagcgattcccctgcctcagcctcccaagtagctaggattataggtgcgygccaccacacctggctaatttttgtatttttagtagagacagggtttccccatgttggccaggctggtctcgaactcctgacttcaggtgatctgcctgcctcagcctccaaaagtgctgggattacaggtgtgtgccaccgtgcccagcctagagtttttgtctttcagcactagaaaaaatgttgtatgtaccccttccttctggcctttatgatctctgatgggaaatctgctgtcattcaaattgcttaggtaaggtcatttcttgctaatttcgagatcttcattttttgtctgc

SEQ ID NO: 45317 - DNA, 601 bp, Human
atcagtgctataattcttgcttcaaccatcatacaatttagaaaattcaaaaggaggggaaagtctattgtgtttacccatattttactctttttattgttctttcttccttcctgatgttccaaaattacttcttttatcatttcttttctgtttagagaaattcctttagccattcttttagggtaggtctcctgaagacaaatcgttaattttcccttcactcctgaaggatatttcactggatatgtaactctgggtttagagtttttttcttggttttttttttttttttttttttgagacaaggtctcgctctgtcacccaggctggagtacagtggcatgagcttggctcactgcaacctccacctcctgggttcaaccaattctcttgcctcagcctcccaagtagctgggactataggcgcccaccaccaagcctggataatttttttttttttgagatggagtctcgctcaactgcccaggctggagtgcagtggcgcgaccttggctcactgcaaccgtcgcctcccaggttcaagcgattcccctgcctcagcctcccaagtagctaggattataggtgcgtgccacca

SEQ ID NO: 45318 - DNA, 601 bp, Human
ccaaatcagtgctataattcttgcttcaaccatcatacaatttagaaaattcaaaaggaggggaaagtctattgtgtttacccatattttactctttttattgttctttcttccttcctgatgttccaaaattacttcttttatcatttcttttctgtttagagaaattcctttagccattcttttagggtaggtctcctgaagacaaatcgttaattttcccttcactcctgaaggatatttcactggatatgtaactctgggtttagagtttttttcttggtttttttttttttttttwttttgagacaaggtctcgctctgtcacccaggctggagtacagtggcatgagcttggctcactgcaacctccacctcctgggttcaaccaattctcttgcctcagcctcccaagtagctgggactataggcgcccaccaccaagcctggataatttttttttttttgagatggagtctcgctcaactgcccaggctggagtgcagtggcgcgaccttggctcactgcaaccgtcgcctcccaggttcaagcgattcccctgcctcagcctcccaagtagctaggattataggtgcgtgcc

SEQ ID NO: 45319 - DNA, 601 bp, Human
accaaatcagtgctataattcttgcttcaaccatcatacaatttagaaaattcaaaaggaggggaaagtctattgtgtttacccatattttactctttttattgttctttcttccttcctgatgttccaaaattacttcttttatcatttcttttctgtttagagaaattcctttagccattcttttagggtaggtctcctgaagacaaatcgttaattttcccttcactcctgaaggatatttcactggatatgtaactctgggtttagagtttttttcttggttttttttttttttttwtttttgagacaaggtctcgctctgtcacccaggctggagtacagtggcatgagcttggctcactgcaacctccacctcctgggttcaaccaattctcttgcctcagcctcccaagtagctgggactataggcgcccaccaccaagcctggataatttttttttttttgagatggagtctcgctcaactgcccaggctggagtgcagtggcgcgaccttggctcactgcaaccgtcgcctcccaggttcaagcgattcccctgcctcagcctcccaagtagctaggattataggtgcgtgc

SEQ ID NO: 45320 - DNA, 601 bp, Human
caatatatatactgaaaaccaaatcagtgctataattcttgcttcaaccatcatacaatttagaaaattcaaaaggaggggaaagtctattgtgtttacccatattttactctttttattgttctttcttccttcctgatgttccaaaattacttcttttatcatttcttttctgtttagagaaattcctttagccattcttttagggtaggtctcctgaagacaaatcgttaattttcccttcactcctgaaggatatttcactggatatgtaactctgggtttagagtttttttcttggttttttttttttttttttttttgagacaaggtctcgctctgtcacccaggctggagtacagtggcatgagcttggctcactgcaacctccacctcctgggttcaaccaattctcttgcctcagcctcccaagtagctgggactataggcgcccaccaccaagcctggataatttttttttttttgagatggagtctcgctcaactgcccaggctggagtgcagtggcgcgaccttggctcactgcaaccgtcgcctcccaggttcaagcgattcccctgcctcagcctcccaagtagcta

SEQ ID NO: 45321 - DNA, 601 bp, Human
tgttcagtttttaaacaaatagtgaaattattttccaaagtgcctgcatcagtacaaaagaaatatagaaaggttacctccctttatatcctttgaccctccttcatctgtaacataatgccttaaatatttccaatatatatactgaaaaccaaatcagtgctataattcttgcttcaaccatcatacaatttagaaaattcaaaaggaggggaaagtctattgtgtttacccatattttactctttttattgttctttcttccttcctgatgttccaaaattacttcttttatcatttcttttctgtttagagaaattcctttagccattcttttagggtaggtctcctgaagacaaatcgttaattttcccttcactcctgaaggatatttcactggatatgtaactctgggtttagagtttttttcttggttttttttttttttttttttttgagacaaggtctcgctctgtcacccaggctggagtacagtggcatgagcttggctcactgcaacctccacctcctgggttcaaccaattctcttgcctcagcctcccaagtagctgggactataggcgcccaccaccaagcctgg

SEQ ID NO: 45322 - DNA, 601 bp, Human; identical to SEQ ID NO: 45251

SEQ ID NO: 45323 - DNA, 601 bp, Human; identical to SEQ ID NO: 45252

SEQ ID NO: 45324 - DNA, 601 bp, Human; identical to SEQ ID NO: 45253

SEQ ID NO: 45325 - DNA, 601 bp, Human; identical to SEQ ID NO: 45254

SEQ ID NO: 45326 - DNA, 601 bp, Human; identical to SEQ ID NO: 45255

SEQ ID NO: 45327 - DNA, 601 bp, Human; identical to SEQ ID NO: 45256

SEQ ID NO: 45328 - DNA, 601 bp, Human; identical to SEQ ID NO: 45257

SEQ ID NO: 45329 - DNA, 601 bp, Human; identical to SEQ ID NO: 45258

SEQ ID NO: 45330 - DNA, 601 bp, Human; identical to SEQ ID NO: 45259

SEQ ID NO: 45331 - DNA, 601 bp, Human; identical to SEQ ID NO: 45260

SEQ ID NO: 45332 - DNA, 601 bp, Human; identical to SEQ ID NO: 45261

SEQ ID NO: 45333 - DNA, 601 bp, Human; identical to SEQ ID NO: 45262

SEQ ID NO: 45334 - DNA, 601 bp, Human; identical to SEQ ID NO: 45263

SEQ ID NO: 45335 - DNA, 601 bp, Human; identical to SEQ ID NO: 45264

SEQ ID NO: 45336 - DNA, 601 bp, Human; identical to SEQ ID NO: 45265

SEQ ID NO: 45337 - DNA, 601 bp, Human; identical to SEQ ID NO: 45266

SEQ ID NO: 45338 - DNA, 601 bp, Human; identical to SEQ ID NO: 45267

SEQ ID NO: 45339 - DNA, 601 bp, Human; identical to SEQ ID NO: 45268

SEQ ID NO: 45340 - DNA, 601 bp, Human; identical to SEQ ID NO: 45269

SEQ ID NO: 45341 - DNA, 601 bp, Human; identical to SEQ ID NO: 45270

SEQ ID NO: 45342 - DNA, 601 bp, Human; identical to SEQ ID NO: 45271

SEQ ID NO: 45343 - DNA, 601 bp, Human; identical to SEQ ID NO: 45272

SEQ ID NO: 45344 - DNA, 601 bp, Human; identical to SEQ ID NO: 45273

SEQ ID NO: 45345 - DNA, 601 bp, Human; identical to SEQ ID NO: 45274

SEQ ID NO: 45346 - DNA, 601 bp, Human; identical to SEQ ID NO: 45275

SEQ ID NO: 45347 - DNA, 601 bp, Human; identical to SEQ ID NO: 45276

SEQ ID NO: 45348 - DNA, 601 bp, Human; identical to SEQ ID NO: 45277

SEQ ID NO: 45349 - DNA, 601 bp, Human; identical to SEQ ID NO: 45278

SEQ ID NO: 45350 - DNA, 601 bp, Human; identical to SEQ ID NO: 45279

SEQ ID NO: 45351 - DNA, 601 bp, Human; identical to SEQ ID NO: 45280

SEQ ID NO: 45352 - DNA, 601 bp, Human; identical to SEQ ID NO: 45281

SEQ ID NO: 45353 - DNA, 601 bp, Human; identical to SEQ ID NO: 45282

SEQ ID NO: 45354 - DNA, 601 bp, Human; identical to SEQ ID NO: 45283

SEQ ID NO: 45355 - DNA, 601 bp, Human; identical to SEQ ID NO: 45284

SEQ ID NO: 45356 - DNA, 601 bp, Human; identical to SEQ ID NO: 45285

SEQ ID NO: 45357 - DNA, 601 bp, Human; identical to SEQ ID NO: 45286

SEQ ID NO: 45358 - DNA, 601 bp, Human; identical to SEQ ID NO: 45287

SEQ ID NO: 45359 - DNA, 601 bp, Human; identical to SEQ ID NO: 45288

SEQ ID NO: 45360 - DNA, 601 bp, Human; identical to SEQ ID NO: 45289

SEQ ID NO: 45361 - DNA, 601 bp, Human; identical to SEQ ID NO: 45290

SEQ ID NO: 45362 - DNA, 601 bp, Human; identical to SEQ ID NO: 45291

SEQ ID NO: 45363 - DNA, 601 bp, Human; identical to SEQ ID NO: 45292

SEQ ID NO: 45364 - DNA, 601 bp, Human; identical to SEQ ID NO: 45293

SEQ ID NO: 45365 - DNA, 601 bp, Human; identical to SEQ ID NO: 45294

SEQ ID NO: 45366 - DNA, 601 bp, Human; identical to SEQ ID NO: 45295

SEQ ID NO: 45367 - DNA, 601 bp, Human; identical to SEQ ID NO: 45296

SEQ ID NO: 45368 - DNA, 601 bp, Human; identical to SEQ ID NO: 45297

SEQ ID NO: 45369 - DNA, 601 bp, Human; identical to SEQ ID NO: 45298

SEQ ID NO: 45370 - DNA, 601 bp, Human; identical to SEQ ID NO: 45299

SEQ ID NO: 45371 - DNA, 601 bp, Human; identical to SEQ ID NO: 45300

SEQ ID NO: 45372 - DNA, 601 bp, Human; identical to SEQ ID NO: 45301

SEQ ID NO: 45373 - DNA, 601 bp, Human; identical to SEQ ID NO: 45302

SEQ ID NO: 45374 - DNA, 601 bp, Human; identical to SEQ ID NO: 45303

SEQ ID NO: 45375 - DNA, 601 bp, Human; identical to SEQ ID NO: 45304

SEQ ID NO: 45376 - DNA, 601 bp, Human; identical to SEQ ID NO: 45305

SEQ ID NO: 45377 - DNA, 601 bp, Human; identical to SEQ ID NO: 45306

SEQ ID NO: 45378 - DNA, 601 bp, Human; identical to SEQ ID NO: 45307

SEQ ID NO: 45379 - DNA, 601 bp, Human; identical to SEQ ID NO: 45308

SEQ ID NO: 45380 - DNA, 601 bp, Human; identical to SEQ ID NO: 45309

SEQ ID NO: 45381 - DNA, 601 bp, Human; identical to SEQ ID NO: 45310

SEQ ID NO: 45382 - DNA, 601 bp, Human; identical to SEQ ID NO: 45311

SEQ ID NO: 45383 - DNA, 601 bp, Human; identical to SEQ ID NO: 45312

SEQ ID NO: 45384 - DNA, 601 bp, Human; identical to SEQ ID NO: 45313

SEQ ID NO: 45385 - DNA, 601 bp, Human; identical to SEQ ID NO: 45314

SEQ ID NO: 45386 - DNA, 601 bp, Human; identical to SEQ ID NO: 45315

SEQ ID NO: 45387 - DNA, 601 bp, Human; identical to SEQ ID NO: 45316

SEQ ID NO: 45388 - DNA, 601 bp, Human; identical to SEQ ID NO: 45317

SEQ ID NO: 45389 - DNA, 601 bp, Human; identical to SEQ ID NO: 45318

SEQ ID NO: 45390 - DNA, 601 bp, Human; identical to SEQ ID NO: 45319

SEQ ID NO: 45391 - DNA, 601 bp, Human; identical to SEQ ID NO: 45320

SEQ ID NO: 45392 - DNA, 601 bp, Human; identical to SEQ ID NO: 45321

SEQ ID NO: 45393 - DNA, 601 bp, Human
aaaagccacaaaggccaggaatgcctgtaatcccagcactctgggagggcaaggcaggcggatcacctgaggtcaggagttcgagaccagcctggacaacatggtaaaactccatctccactaaaaatacaaaaattagccaggcgtggtggtgcgcacctgtaatcccagctactcaggaggctgaggcaggagaatagcttgaacctgggaggcggaggttgcagtgagccgagattgcgccactgcactccaggctgggcgacaaagcgagactccacctcaaaaaaaaaaaaaaaaagccacaaagagggggtggtgtgggagacctacaaggttgctcccaggctagggaaggcaggtgggaggggtacaagagaacacaaccagagccgtgtccccagagaaaggggaagaaacaggatggcaacaggaacaaacagtaccactgacaaacaagtggattcaaaggcccatctgctggctagcagagccccatcctatcagagtgcacatctgaaaaggctggcgcctgtccctacctacggcaggtggggcacttcatggcccatgaagtggctctaaccacccactgttgcca

SEQ ID NO: 45394 - DNA, 601 bp, Human
aattaaattaatatcacccagtatttccaactaacagctttaatttcttcactccccctctgaagccccttctgagcatctagaaaaagccacaaaggccaggaatgcctgtaatcccagcactctgggagggcaaggcaggcggatcacctgaggtcaggagttcgagaccagcctggacaacatggtaaaactccatctccactaaaaatacaaaaattagccaggcgtggtggtgcgcacctgtaatcccagctactcaggaggctgaggcaggagaatagcttgaacctgggaggcrgaggttgcagtgagccgagattgcgccactgcactccaggctgggcgacaaagcgagactccacctcaaaaaaaaaaaaaaaaagccacaaagagggggtggtgtgggagacctacaaggttgctcccaggctagggaaggcaggtgggaggggtacaagagaacacaaccagagccgtgtccccagagaaaggggaagaaacaggatggcaacaggaacaaacagtaccactgacaaacaagtggattcaaaggcccatctgctggctagcagagccccatcctatcagagtgcacatc

SEQ ID NO: 45395 - DNA, 601 bp, Human
tcaggcctgaaactgaggcagtcccttcaatagatccatgtgcacacggacgcttcctcctatgtgaagttctgtttgctccccaggaggctggtagaaagtgttcatttgcaaggctgggttatgaatactccctgtgcactgctgcaaagaaaacctaagtcagcacctcttcccacctctgcacccccgaaatggtggcaaatccagacattaaaacaaataaaaaaatacccacccacagaccagcatcacttaatcctggaaaagatcctccttcctccctgcagagaatctcccraaagaattccagaccagaatgctaagccatccctgtagaaaaggaccttggagatggccctattttaaaggaacaaatgtagggcccaaggggaagggacaggcccggtggcatgctacactctcactggcacgcctcccaagccagtttactgttgacaccaaactcccagacccatgagagcagatgcaggcctgggctacctaccaagggtggtcataaacgtgaacattaatgaactcctcagtcccttctaaggtattgggacaaaagggtccctggtgggataccaaggtctga

SEQ ID NO: 45396 - DNA, 601 bp, Human
tgaatagagaggcatccatgggcagagacccactcactcactccacagggacgacgacagcagcggccgccgccactgacagaattccaggcactatcctggaccctttagcaaattccctcatttgatgctcgcaaccctaagctaaattattaccctcacagatgaggaaagtgaggcacagaggggtagggaatgtgtcgagggtcatggggcacataggcagtcagtcgtggagtcaggcctgaaactgaggcagtcccttcaatagatccatgtgcacacggacgcttcctcctaygtgaagttctgtttgctccccaggaggctggtagaaagtgttcatttgcaaggctgggttatgaatactccctgtgcactgctgcaaagaaaacctaagtcagcacctcttcccacctctgcacccccgaaatggtggcaaatccagacattaaaacaaataaaaaaatacccacccacagaccagcatcacttaatcctggaaaagatcctccttcctccctgcagagaatctcccgaaagaattccagaccagaatgctaagccatccctgtagaaaaggaccttggagatggcccta

SEQ ID NO: 45397 - DNA, 601 bp, Human
atacacacaaaaagtatgaaaaagtaaaatgcctgtgccctctgacccagccctcctcatctagcaatgtacacccaggcaaggggacggggtattgtcatgctgcccataccagcagaaaccaacaccagcggaagaaacatgttccatccttttaagaactggaccacacagctgtttaaaaaaaaagaggtaatgatacaaaactttctccaaatgaagcagcgatgtggagtttctccaagacacacagtcccatgcaatgtgcaagagcacaacagtaatacatatggagagaccyacacgtgcacgcgcccctgagtgtgcataaacacctatagagacagactgccccagggaactggaactcagcaatgagaagcgaacagggctgacgtttcattgtatactttgagtcctctgaattttttttaatatgtgcatgtcttaaatattcaaaaagatacagaaaacaataaatgttagctagtaatagtaacaagattaccagtggagacttggcattttcaggaaatccagaacaaactcttctcaatctccaaacttaaaaaaatacaagtagcatcttaacataaatttc

SEQ ID NO: 45398 - DNA, 601 bp, Human
ggctttggccagtggtgagtggggagcactcggcttggagcgaggcaagttcccctcccacatttccactgtgtgaccatgggccagttctcgggagtcccacaccctctccagagcaaggccacacacacccgggccggctccccaagggccaccagagtgggagaggctgggctgggcccaattcatgcaggatggggaaggtgtttaagacagtgactttgcgagggaaagaaggaggtgcacagctcttgaatgctttgcttcctaaaatgaatgctactttttaaaagggaagtgycatagtattctctcaaatgtagctttccagctgaattcaaaatgagtgggaactgaaaccctatttacatccagctgttcaggaactgtgctcatggggcacttgactttaagtatttactgaatgtcccaaacctgctaaaccatgtgggagaaataaccggtaaaggcaggatggcccagtggttagaaacattgatgcccatcctgccatgcaggtgcacccagctcttccaggtgcctgcagtcagcccccagcaacctaaactcctcaatctcactatctcactaggtgaaatat

SEQ ID NO: 45399 - DNA, 601 bp, Human
cagcatttccagtgcatctgagagctggtttgccttcacctcctgcaggtgtacatgccggcaaggaccagcacccagcacaggcctggccagggcagatgctcaggacttgcccacaagcccctccggaacctgggacttaccacctaactctctccccatctcccccacccctggggtttccttcctggcccagagcattccagagtcacaagtggctttggctgagccatagggacatgaaaaaggcttccaaaaaccaccaggcagttattgatccactaacatactttttttttttgagacagagtccagctctgtcacccaggctggagtgcaatggtgcaatcttggctcactgcaatctccacctcccgagctcaagcaattctcctgcctcagcgtcccaagtagctgggataacaagcacctgccaccatgccctgctaatttttgtatttttagtagagataggtattcaccatgttgcccaggctggtcttgaactcctgacctcaagcaatctgcccgcctcagcctcccaaagtgctgggattacaggtgtaagccatcacacccagccactaacagattctttttt

SEQ ID NO: 45400 - DNA, 601 bp, Human
ccagaacacaaaggctggactgaaccagacccacggggagcattttgtcttcctatccctggccccgagggcataactgcagcctccctcggatgggaggaaggtcacactgtcaggaaacaaggctctagaaggacaccccgacacctccttgaaccaccctgtctaaggtggaaaccggcctcagttctgcccagagctgcctgccctccaatccacatggaacccagggcttatggcagaggcttataaggcttatggtagaggccagggtgtgtggcctctacaaagtggacaccgyccaccctgtgggtcctttagctcctggagagagctctaggcccctcttgctgaatgtcgcctccttagagaggccttctctgaccacagagtgctaaagtggctgcagccactgcgccatagttctctcctgtttgcaggtttcctggctctagtcacaccttgcagcatttccagtgcatctgagagctggtttgccttcacctcctgcaggtgtacatgccggcaaggaccagcacccagcacaggcctggccagggcagatgctcaggacttgcccacaagcccctccggaacctgg

SEQ ID NO: 45401 - DNA, 601 bp, Human
gaacctgcactaggacaagtaccccagggtggagaccggatgtttcctcacctccgcagcccagcccttgactgttggatggaaacagggtgtgaggcagaaatgaaagtgaaactgccacaggagggttctctctgcacccatctaccatgccccgccctgcccaggaagcagcaagctgaccactggaggatcccccagaaaaagatgggtggcagctcccagcagagatgtgtcagaggccccaggccctgccttgggcgggtaggagggcaggtgaggtggcctcttgggtggaggrggaatcctatcatttggccctagggcgggtgcactgcacccaccttacagttgggagggcagaggctcaggacaagtctcatgctccaacttcactgccatctccaccatgcactatcctcctgggcccaacaactgcacacaaaggatgctcagaaaagaaccccttgaggcagggcgcggtcgctcacacttgtaatcccagcattttgtgaggccaagttgagcagatcacctgaggtcaggagtttgagactagcctggccaacatggtgaaaccccatcttctccactaaaaata

SEQ ID NO: 45402 - DNA, 601 bp, Human
aaaaagaaaaatagggccgggcatggtggcttacgcctgtaatcccagcactttgggaggctgagacgggcagatcacgagttcaagaccagcctgaccaacacagtgaaaccccatctctactaaaaatacaaaaattagccgggcgtggtggcgcgtgcttgtaatcccagctactcaggaggctgaggcaggagaatcgcttgaacccgggaggcagaggttgcagtgagattgcaccactgcactccagcctgggcaatagagcaagactccgtctccatctcaaaaaaaaaataakaagaagaagaaactcacgagcccaggaccctgagaggtacgtgacccagcacactgtgggcaagagctcccagtggtgagacaactgccctgaagctctccctaagactgaccctggggctccaggagactgtggtgctcactgctgtatcaatccccagaacccaggagtgcccagcatacagcaggcactcagtaagtatgtggcatgtaagtgcataaaggaatgaatggggtgttttttaaaaagaagatgccacggcccaccccagattcattccaggggagggggaggcctggg

SEQ ID NO: 45403 - DNA, 601 bp, Human
gcttgcagtgagccaagatcgcgccactgcactccagcctgggcgacaaagcaagactccatctcaaaaaaaaaaaaaaaaaaagaaagaaagaaagaaaaaaagaaaaatagggccgggcatggtggcttacgcctgtaatcccagcactttgggaggctgagacgggcagatcacgagttcaagaccagcctgaccaacacagtgaaaccccatctctactaaaaatacaaaaattagccgggcgtggtggcgcgtgcttgtaatcccagctactcaggaggctgaggcaggagaatcrcttgaacccgggaggcagaggttgcagtgagattgcaccactgcactccagcctgggcaatagagcaagactccgtctccatctcaaaaaaaaaataagaagaagaagaaactcacgagcccaggaccctgagaggtacgtgacccagcacactgtgggcaagagctcccagtggtgagacaactgccctgaagctctccctaagactgaccctggggctccaggagactgtggtgctcactgctgtatcaatccccagaacccaggagtgcccagcatacagcaggcactcagtaagta

SEQ ID NO: 45404 - DNA, 601 bp, Human
tcaggagatcgagaccatcctggctaacacggtgaaaccctgtctctactaaaaatacaaaaaattagccgggcatggtggcaggcgcctgtagtcccagctactcgggaggctgaggcagaagaatggcatgaacctgggaggcggagcttgcagtgagccaagatcgcgccactgcactccagcctgggcgacaaagcaagactccatctcaaaaaaaaaaaaaaaaaaagaaagaaagaaagaaaaaaagaaaaatagggccgggcatggtggcttacgcctgtaatcccagcacttkgggaggctgagacgggcagatcacgagttcaagaccagcctgaccaacacagtgaaaccccatctctactaaaaatacaaaaattagccgggcgtggtggcgcgtgcttgtaatcccagctactcaggaggctgaggcaggagaatcgcttgaacccgggaggcagaggttgcagtgagattgcaccactgcactccagcctgggcaatagagcaagactccgtctccatctcaaaaaaaaaataagaagaagaagaaactcacgagcccaggaccctgagaggtacgtgacccagcaca

SEQ ID NO: 45405 - DNA, 601 bp, Human
caacggcaaaaaagacagaaacaagtctgggagtggtggctcacgcctgtcatcccagcactttgggaggccgaggtgggcggatcacaaggtcaggagatcgagaccatcctggctaacacggtgaaaccctgtctctactaaaaatacaaaaaattagccgggcatggtggcaggcgcctgtagtcccagctactcgggaggctgaggcagaagaatggcatgaacctgggaggcggagcttgcagtgagccaagatcgcgccactgcactccagcctgggcgacaaagcaagactccrtctcaaaaaaaaaaaaaaaaaaagaaagaaagaaagaaaaaaagaaaaatagggccgggcatggtggcttacgcctgtaatcccagcactttgggaggctgagacgggcagatcacgagttcaagaccagcctgaccaacacagtgaaaccccatctctactaaaaatacaaaaattagccgggcgtggtggcgcgtgcttgtaatcccagctactcaggaggctgaggcaggagaatcgcttgaacccgggaggcagaggttgcagtgagattgcaccactgcactccagcctgggcaa

SEQ ID NO: 45406 - DNA, 601 bp, Human
ctgtctctacaacaacggcaaaaaagacagaaacaagtctgggagtggtggctcacgcctgtcatcccagcactttgggaggccgaggtgggcggatcacaaggtcaggagatcgagaccatcctggctaacacggtgaaaccctgtctctactaaaaatacaaaaaattagccgggcatggtggcaggcgcctgtagtcccagctactcgggaggctgaggcagaagaatggcatgaacctgggaggcggagcttgcagtgagccaagatcgcgccactgcactccagcctgggcgacaragcaagactccatctcaaaaaaaaaaaaaaaaaaagaaagaaagaaagaaaaaaagaaaaatagggccgggcatggtggcttacgcctgtaatcccagcactttgggaggctgagacgggcagatcacgagttcaagaccagcctgaccaacacagtgaaaccccatctctactaaaaatacaaaaattagccgggcgtggtggcgcgtgcttgtaatcccagctactcaggaggctgaggcaggagaatcgcttgaacccgggaggcagaggttgcagtgagattgcaccactgcactc

SEQ ID NO: 45407 - DNA, 601 bp, Human
gaggtggaggttgcagtgagccaagatcacaccactgcactccaacctggatgacagagcaagactaacaaaaaagaaaaagaaaataggctggctaggcacagtggctcaagcctataatcccaacacttcgggaggctgagacgggcgatcgatcaagctcaggagttacagccaaacctggccaacacagtgaaaccctgtctctacaacaacggcaaaaaagacagaaacaagtctgggagtggtggctcacgcctgtcatcccagcactttgggaggccgaggtgggcggatcacraggtcaggagatcgagaccatcctggctaacacggtgaaaccctgtctctactaaaaatacaaaaaattagccgggcatggtggcaggcgcctgtagtcccagctactcgggaggctgaggcagaagaatggcatgaacctgggaggcggagcttgcagtgagccaagatcgcgccactgcactccagcctgggcgacaaagcaagactccatctcaaaaaaaaaaaaaaaaaaagaaagaaagaaagaaaaaaagaaaaatagggccgggcatggtggcttacgcctgtaatcccagca

SEQ ID NO: 45408 - DNA, 601 bp, Human
tgaggtggaaggatcacctgaggtccgagaatcacttaaacctgggaggtggaggttgcagtgagccaagatcacaccactgcactccaacctggatgacagagcaagactaacaaaaaagaaaaagaaaataggctggctaggcacagtggctcaagcctataatcccaacacttcgggaggctgagacgggcgatcgatcaagctcaggagttacagccaaacctggccaacacagtgaaaccctgtctctacaacaacggcaaaaaagacagaaacaagtctgggagtggtggctcaygcctgtcatcccagcactttgggaggccgaggtgggcggatcacaaggtcaggagatcgagaccatcctggctaacacggtgaaaccctgtctctactaaaaatacaaaaaattagccgggcatggtggcaggcgcctgtagtcccagctactcgggaggctgaggcagaagaatggcatgaacctgggaggcggagcttgcagtgagccaagatcgcgccactgcactccagcctgggcgacaaagcaagactccatctcaaaaaaaaaaaaaaaaaaagaaagaaagaaagaaaaaaa

SEQ ID NO: 45409 - DNA, 601 bp, Human
cctttctccaacacgatcccaatgccgcgggacacaccttcctgcagggaggcggcaaaggcctctagtggcaaggccataattccttttcttttcaaggatcccatgacgaatgttaggactttaaaatcttaaagaaaataggctgggctgggcgtggtggctcacacctgtaatcccaactctttgggaggctgaggtggaaggatcacctgaggtccgagaatcacttaaacctgggaggtggaggttgcagtgagccaagatcacaccactgcactccaacctggatgacagagcragactaacaaaaaagaaaaagaaaataggctggctaggcacagtggctcaagcctataatcccaacacttcgggaggctgagacgggcgatcgatcaagctcaggagttacagccaaacctggccaacacagtgaaaccctgtctctacaacaacggcaaaaaagacagaaacaagtctgggagtggtggctcacgcctgtcatcccagcactttgggaggccgaggtgggcggatcacaaggtcaggagatcgagaccatcctggctaacacggtgaaaccctgtctctactaaaaata

SEQ ID NO: 45410 - DNA, 601 bp, Human
ctggcctctccacagctacaggcttccccagagcagcgagaggatggggcacccaaatctccgcaagcacaggccacggcttggctgcgcccaggtcaaggtgataaaaagggtgcttgggagctgactgtgcaggaagcaaaacctttctccaacacgatcccaatgccgcgggacacaccttcctgcagggaggcggcaaaggcctctagtggcaaggccataattccttttcttttcaaggatcccatgacgaatgttaggactttaaaatcttaaagaaaataggctgggctgggcrtggtggctcacacctgtaatcccaactctttgggaggctgaggtggaaggatcacctgaggtccgagaatcacttaaacctgggaggtggaggttgcagtgagccaagatcacaccactgcactccaacctggatgacagagcaagactaacaaaaaagaaaaagaaaataggctggctaggcacagtggctcaagcctataatcccaacacttcgggaggctgagacgggcgatcgatcaagctcaggagttacagccaaacctggccaacacagtgaaaccctgtctctacaacaacg

SEQ ID NO: 45411 - DNA, 601 bp, Human
aattaaggcccagagaggagctgaaacacacccacagtcatccacctagtaagaagccgaggccgggcacggtggttcacgcctgtaatgccagcactttgggaagccaagccaagtggatcatttgaggtcaggagttcgagaccagcctggccaatgtggcaaaaccccatctctactaaaaatacaaaaaattagctgggcgtggaggcgtgcgcttgtgactccagctactcggaaggctgaggcaggagaatcgcttgaatccaggaggtggaggttgcagtgacctgagatcgcrgcactgtgcaaactgatgtttgaaccccacccccagggtgatcggctatgaaaccccgggaaagtcacttaccctctctgagcctcagtctccacatacggactgacagcttcaaagagccacatgttagcgctcagcaccatgtcaggcatgaagctagagctccagagacaggagccactgctgtttctggagctaactgtccttataccacttaacaatgcagggcagggtgactctgcaagcttaagtgcatttctggagggactcccctgcccctaaccctccacactacaggca

SEQ ID NO: 45412 - DNA, 601 bp, Human
cctgcaaggccagccactctgagctgcaaacccttacacgcaaaggcctcttctggctcaaaggttttcaaaagttactcctctaagatcgtgaatctctgtacctctggactctgtggaggtttactctgataccacctgacacaggtgagtaaggggccactttcccccttcttccttccagagatggcctctgccctgcacagaagggaagtttgcatgtgctgaccccctcctatgcatgagcacaaggtcacctcttactgacaaggaaattaaggcccagagaggagctgaaacmcacccacagtcatccacctagtaagaagccgaggccgggcacggtggttcacgcctgtaatgccagcactttgggaagccaagccaagtggatcatttgaggtcaggagttcgagaccagcctggccaatgtggcaaaaccccatctctactaaaaatacaaaaaattagctgggcgtggaggcgtgcgcttgtgactccagctactcggaaggctgaggcaggagaatcgcttgaatccaggaggtggaggttgcagtgacctgagatcgcggcactgtgcaaactgatgtttgaaccc

SEQ ID NO: 45413 - DNA, 601 bp, Human
tacatgtgtgaccctgcaaggccagccactctgagctgcaaacccttacacgcaaaggcctcttctggctcaaaggttttcaaaagttactcctctaagatcgtgaatctctgtacctctggactctgtggaggtttactctgataccacctgacacaggtgagtaaggggccactttcccccttcttccttccagagatggcctctgccctgcacagaagggaagtttgcatgtgctgaccccctcctatgcatgagcacaaggtcacctcttactgacaaggaaattaaggcccagagwggagctgaaacacacccacagtcatccacctagtaagaagccgaggccgggcacggtggttcacgcctgtaatgccagcactttgggaagccaagccaagtggatcatttgaggtcaggagttcgagaccagcctggccaatgtggcaaaaccccatctctactaaaaatacaaaaaattagctgggcgtggaggcgtgcgcttgtgactccagctactcggaaggctgaggcaggagaatcgcttgaatccaggaggtggaggttgcagtgacctgagatcgcggcactgtgcaaactg

SEQ ID NO: 45414 - DNA, 601 bp, Human
tggaggccacaggtgtacttctgggctgcgaagctgtcagcccaaagctctacatgtgtgaccctgcaaggccagccactctgagctgcaaacccttacacgcaaaggcctcttctggctcaaaggttttcaaaagttactcctctaagatcgtgaatctctgtacctctggactctgtggaggtttactctgataccacctgacacaggtgagtaaggggccactttcccccttcttccttccagagatggcctctgccctgcacagaagggaagtttgcatgtgctgaccccctcctaygcatgagcacaaggtcacctcttactgacaaggaaattaaggcccagagaggagctgaaacacacccacagtcatccacctagtaagaagccgaggccgggcacggtggttcacgcctgtaatgccagcactttgggaagccaagccaagtggatcatttgaggtcaggagttcgagaccagcctggccaatgtggcaaaaccccatctctactaaaaatacaaaaaattagctgggcgtggaggcgtgcgcttgtgactccagctactcggaaggctgaggcaggagaatcgcttgaat

SEQ ID NO: 45415 - DNA, 601 bp, Human
ggggcacccactcactcccccatccttcccaggagagcatcccaaatccaaagaattggttcctgtcacattcccagcaaggttaggagagaccacagggcccatcaacaaaaataactcatcctggccgggatggggtccaccaatcatggcccagaacagaacacaccctcgcctcttcacactcctagaggttccctggaggccacaggtgtacttctgggctgcgaagctgtcagcccaaagctctacatgtgtgaccctgcaaggccagccactctgagctgcaaacccttacacrcaaaggcctcttctggctcaaaggttttcaaaagttactcctctaagatcgtgaatctctgtacctctggactctgtggaggtttactctgataccacctgacacaggtgagtaaggggccactttcccccttcttccttccagagatggcctctgccctgcacagaagggaagtttgcatgtgctgaccccctcctatgcatgagcacaaggtcacctcttactgacaaggaaattaaggcccagagaggagctgaaacacacccacagtcatccacctagtaagaagccgaggccggg

SEQ ID NO: 45416 - DNA, 601 bp, Human
cctaccagctgtgtgaccccaggcaagttacttagcccttctatgagaaacaggaatgctaaaaccaccaccctcccagggctgttaatgcggatcaaatgagatcacacacctaaggaacgccacagtgcctggctgagaataaggattgagggtgaggactcaccttgcaccacatgggcctgagaatgaagccaatgtaaaagagaccagggaagcagggagggggccggggggagagaggagggagagagagagagagagagacagagagagagagagacagacagacagacagaccaggccctattggactgtcgcctgagtctacctacacctgaagccagaatgccccaaggatctgactcaggaaccaatacatcccctttattaccgaacccgctcagcactgaggctcctgtcagaacccatccacccctgtggctctaggaatcagccatacaatcgacttactgctcagatcattagctgacgagaccccaatgactcatcacatctgttggttaattgagagtgagaggactggagcacacagcaatggaaacagatttgcagccatgtggcccactccataggtctc

SEQ ID NO: 45417 - DNA, 601 bp, Human
tggttcagagacaggtatgtggcccaggatgacaaatcagaggccaacagaaggaatccctgtccctgtggacctggagcatgagggatgggggaccctggagccaacccaaccagctctgaatcccagctctgcccctaccagctgtgtgaccccaggcaagttacttagcccttctatgagaaacaggaatgctaaaaccaccaccctcccagggctgttaatgcggatcaaatgagatcacacacctaaggaacgccacagtgcctggctgagaataaggattgagggtgaggactcrccttgcaccacatgggcctgagaatgaagccaatgtaaaagagaccagggaagcagggagggggccggggggagagaggagggagagagagagagagagagacagagagagagagagacagacagacagacagaccaggccctattggactgtcgcctgagtctacctacacctgaagccagaatgccccaaggatctgactcaggaaccaatacatcccctttattaccgaacccgctcagcactgaggctcctgtcagaacccatccacccctgtggctctaggaatcagccatacaa

SEQ ID NO: 45418 - DNA, 601 bp, Human
ggaaaaaccccagcccacaaataggacatcagccctccagtatgtccacccacccagctggctgctgggcgcagccaggactctcagaatctgcctgtgtcgggctggccgtgggaataagccagattcaggtttaactgaggcacaaggtggggtccaggaagccgcttcggggctgcccatgcagccacagccacagggaggccccgagcagcctcccttccggagcttcccaccagcactcccacccagctgcctccgagaattctggaaccccaagcagaggtgcccagcacagggwaggccagcctggggctcagacttgtgggggtaggtactctccactcccttcttgggaacaacgtcctagccctggactctgtgtgcgaaccctcaggcccccgtccaagtctttgcaagctgggtccagagctggaagctgagggagagcagcccccagcctcactctggccagccactgaagcccagaaacagggagcacgtccactcccacctcagctgccaaacatccctcccctgcctctgggaaacagtgcccctgcagcatccttttggggatccaccctgcccacactcaggc

SEQ ID NO: 45419 - DNA, 601 bp, Human
ccagggtctggcttagtatatcggagcggagtgtcctggacaggagtggccctccccagaccaacactcccctccagctccgacaacccccagccactagttcacagctgctccaggctctcagaattcccaggatccagcaaaaagacaccttctcaaccctccccaagcaggacagggtcaaacagcaacaggctaattgtgtttacataacacgagattgtttagctccagaacacatcagtgtcaaaacaccaaggttctgcacagcgacagcgacagtggggcaggaaagatgtcrtccttctccaggaactcaggcagcatttcccaaggcccggaaaaaccccagcccacaaataggacatcagccctccagtatgtccacccacccagctggctgctgggcgcagccaggactctcagaatctgcctgtgtcgggctggccgtgggaataagccagattcaggtttaactgaggcacaaggtggggtccaggaagccgcttcggggctgcccatgcagccacagccacagggaggccccgagcagcctcccttccggagcttcccaccagcactcccacccagctgcctccga

SEQ ID NO: 45420 - DNA, 601 bp, Human
cccaccagctaaaccagaagcaatgggtcccaaactcatttcccagagcctttgagctgagggccctcaaatagagaccatggtgcagggccgcacagctcagcggcaaagcaggggtctgagcgctggtcccagcttctgccaccttgtgcagcaccgaaaggcccatgaagctacttcagggctgtccacacggccgcaaccaaggcagggcagaacggcttcccttcccgagcttccctccagcactcccatgcagccgcctctgaaaattctggaacaccaagcagaggcacccacrgcagttaagcaggcccggggcaaggggctctgagcaggccttgccctcacctgccccactcgtttcagaaaggaaccataagggacccatactctaaccagggcctgtcaccctgcacttctcccaacctccagcccagcccctttgcccggggccctcggaactggggccctgatatatggaacatcctgggtttgtggccaccagccactcaccgttcatttcctctccccttccgggtggaaatagtccagcatgtcctccccgcagttccaccaggcctgctcagctgtggggggc

SEQ ID NO: 45421 - DNA, 601 bp, Human
ctccatctcaaaaaaaagaaaattagccaagtgtgggctgggccaggtggctcatgcatataatcccaccactttgggaggccaaggcaggcagatcacttgaggtcaggagtttgagaccagcctgaccaacatggtgaaaccctgtctctactaaaaatgcaaaaattaatggccgggtgcggtggttcatgcctgtaatcccagcactttgggaggccaagacaggcagatcacgaggtcaggagatcgagaccatcctggctaacacagtgaaaccccgtctctactaaaactacaraaaaagtagccgggcatggtggcgggcacctgtagtcccagctactcggaaggttgaggcaggagaatggcgtgaacccgggaggcggagcttgtagtgagccgagatcacgctgccgcactccaacctgggcgacagagcgagattccgtctcaaaaaaaaaaaacacacaaaaattagccgggcgtggtggtgggcgcctgtaaccccagctacttgggaggctaaggcacaagaattgcttgtccaacctgacaggtccaccagccccaccagctaaaccagaagcaatgggtccca

SEQ ID NO: 45422 - DNA, 601 bp, Human
acagcaagaaaatgggaaaaatcggccaggcacagtgattcatgcctgtaatcccagcattttggaaggccaaggtgggcggatcactttgggtcagaggttagagaacagcctggccaacatggtgaaaccctgtctctactacaagtacaaaaattagccaggcatggtggcaggtgcctgtaatcccaactactcaggaggctgaggcaggagaatcacttgaacctgggaggcagaggttgcagtgagccaagattgccgccaatgcactccagcctgggcgacaagagcaaaactycatctcaaaaaaaagaaaattagccaagtgtgggctgggccaggtggctcatgcatataatcccaccactttgggaggccaaggcaggcagatcacttgaggtcaggagtttgagaccagcctgaccaacatggtgaaaccctgtctctactaaaaatgcaaaaattaatggccgggtgcggtggttcatgcctgtaatcccagcactttgggaggccaagacaggcagatcacgaggtcaggagatcgagaccatcctggctaacacagtgaaaccccgtctctactaaaactacaaaa

SEQ ID NO: 45423 - DNA, 601 bp, Human
cgtaacggaatcagaaagggaaggaagacatttatattcacaaagatgcccaatgcagctgtacctacaacagcaagaaaatgggaaaaatcggccaggcacagtgattcatgcctgtaatcccagcattttggaaggccaaggtgggcggatcactttgggtcagaggttagagaacagcctggccaacatggtgaaaccctgtctctactacaagtacaaaaattagccaggcatggtggcaggtgcctgtaatcccaactactcaggaggctgaggcaggagaatcacttgaacctgrgaggcagaggttgcagtgagccaagattgccgccaatgcactccagcctgggcgacaagagcaaaactccatctcaaaaaaaagaaaattagccaagtgtgggctgggccaggtggctcatgcatataatcccaccactttgggaggccaaggcaggcagatcacttgaggtcaggagtttgagaccagcctgaccaacatggtgaaaccctgtctctactaaaaatgcaaaaattaatggccgggtgcggtggttcatgcctgtaatcccagcactttgggaggccaagacaggcagat

SEQ ID NO: 45424 - DNA, 601 bp, Human
aaaacttttacctacacgtaacggaatcagaaagggaaggaagacatttatattcacaaagatgcccaatgcagctgtacctacaacagcaagaaaatgggaaaaatcggccaggcacagtgattcatgcctgtaatcccagcattttggaaggccaaggtgggcggatcactttgggtcagaggttagagaacagcctggccaacatggtgaaaccctgtctctactacaagtacaaaaattagccaggcatggtggcaggtgcctgtaatcccaactactcaggaggctgaggcaggaraatcacttgaacctgggaggcagaggttgcagtgagccaagattgccgccaatgcactccagcctgggcgacaagagcaaaactccatctcaaaaaaaagaaaattagccaagtgtgggctgggccaggtggctcatgcatataatcccaccactttgggaggccaaggcaggcagatcacttgaggtcaggagtttgagaccagcctgaccaacatggtgaaaccctgtctctactaaaaatgcaaaaattaatggccgggtgcggtggttcatgcctgtaatcccagcactttgggag

SEQ ID NO: 45425 - DNA, 601 bp, Human
aagccccagggcagagaccccttaccagactgcaagctgaccacacacacgcaagggattcctagcaagaccagagctacgcagcaaagcccacagaactgtgggatgaaaaaatgcttattgcttaaagccagtagtttttaggatgggttgttatgcatcaataactgataaaaacttttacctacacgtaacggaatcagaaagggaaggaagacatttatattcacaaagatgcccaatgcagctgtacctacaacagcaagaaaatgggaaaaatcggccaggcacagtgattcaygcctgtaatcccagcattttggaaggccaaggtgggcggatcactttgggtcagaggttagagaacagcctggccaacatggtgaaaccctgtctctactacaagtacaaaaattagccaggcatggtggcaggtgcctgtaatcccaactactcaggaggctgaggcaggagaatcacttgaacctgggaggcagaggttgcagtgagccaagattgccgccaatgcactccagcctgggcgacaagagcaaaactccatctcaaaaaaaagaaaattagccaagtgtgggctgggcca

SEQ ID NO: 45426 - DNA, 601 bp, Human
cagcctgaggaaagccaagaaggaggccaggtcatgcccagcgccttcggttagccaaaggtcaagccccagggcagagaccccttaccagactgcaagctgaccacacacacgcaagggattcctagcaagaccagagctacgcagcaaagcccacagaactgtgggatgaaaaaatgcttattgcttaaagccagtagtttttaggatgggttgttatgcatcaataactgataaaaacttttacctacacgtaacggaatcagaaagggaaggaagacatttatattcacaaagatgyccaatgcagctgtacctacaacagcaagaaaatgggaaaaatcggccaggcacagtgattcatgcctgtaatcccagcattttggaaggccaaggtgggcggatcactttgggtcagaggttagagaacagcctggccaacatggtgaaaccctgtctctactacaagtacaaaaattagccaggcatggtggcaggtgcctgtaatcccaactactcaggaggctgaggcaggagaatcacttgaacctgggaggcagaggttgcagtgagccaagattgccgccaatgcactccagcc

SEQ ID NO: 45427 - DNA, 601 bp, Human
cccagggcttgaccctccctgtatccaggccctttgcaatgactttgacacctccgccaaggggtaaagtttattttcttaccccttgaatgttagctggccttgggtcttgttttggccaacaaactgtagagacacaaacgggcctccagaggccttggaaacatccactgttagtgtcaggaacaagcccagcagcctgaggaaagccaagaaggaggccaggtcatgcccagcgccttcggttagccaaaggtcaagccccagggcagagaccccttaccagactgcaagctgaccrcacacacgcaagggattcctagcaagaccagagctacgcagcaaagcccacagaactgtgggatgaaaaaatgcttattgcttaaagccagtagtttttaggatgggttgttatgcatcaataactgataaaaacttttacctacacgtaacggaatcagaaagggaaggaagacatttatattcacaaagatgcccaatgcagctgtacctacaacagcaagaaaatgggaaaaatcggccaggcacagtgattcatgcctgtaatcccagcattttggaaggccaaggtgggcggatc

SEQ ID NO: 45428 - DNA, 601 bp, Human
ccaacgcgcagacccggatcacacactctgtgtgcagacatgttcccagggcttgaccctccctgtatccaggccctttgcaatgactttgacacctccgccaaggggtaaagtttattttcttaccccttgaatgttagctggccttgggtcttgttttggccaacaaactgtagagacacaaacgggcctccagaggccttggaaacatccactgttagtgtcaggaacaagcccagcagcctgaggaaagccaagaaggaggccaggtcatgcccagcgccttcggttagccaaaggycaagccccagggcagagaccccttaccagactgcaagctgaccacacacacgcaagggattcctagcaagaccagagctacgcagcaaagcccacagaactgtgggatgaaaaaatgcttattgcttaaagccagtagtttttaggatgggttgttatgcatcaataactgataaaaacttttacctacacgtaacggaatcagaaagggaaggaagacatttatattcacaaagatgcccaatgcagctgtacctacaacagcaagaaaatgggaaaaatcggccaggcacagtgattc

SEQ ID NO: 45429 - DNA, 601 bp, Human
agccttccctctgtaagcaaaagccaagttcctgaagaaccaggactgacaatacctgggtcggtagagctgggcacacagcggacacttcgaaaagctttctgaatgatgacagttgttccttatgaacccgacttctccgcccctccccatacccagcccagcaccagctgggcacctgccaggtactaatttgggaaaggtctatgggctgccggccaacgcgcagacccggatcacacactctgtgtgcagacatgttcccagggcttgaccctccctgtatccaggccctttgcaatgactttgacacctccgccaaggggtaaagtttattttcttaccccttgaatgttagctggccttgggtcttgttttggccaacaaactgtagagacacaaacgggcctccagaggccttggaaacatccactgttagtgtcaggaacaagcccagcagcctgaggaaagccaagaaggaggccaggtcatgcccagcgccttcggttagccaaaggtcaagccccagggcagagaccccttaccagactgcaagctgaccacacacacgcaagggattcctagcaagaccagagctacg

SEQ ID NO: 45430 - DNA, 601 bp, Human
cagagccttccctctgtaagcaaaagccaagttcctgaagaaccaggactgacaatacctgggtcggtagagctgggcacacagcggacacttcgaaaagctttctgaatgatgacagttgttccttatgaacccgacttctccgcccctccccatacccagcccagcaccagctgggcacctgccaggtactaatttgggaaaggtctatgggctgccggccaacgcgcagacccggatcacacactctgtgtgcagacatgttcccagggcttgaccctccctgtatccaggccctttgcaatgactttgacacctccgccaaggggtaaagtttattttcttaccccttgaatgttagctggccttgggtcttgttttggccaacaaactgtagagacacaaacgggcctccagaggccttggaaacatccactgttagtgtcaggaacaagcccagcagcctgaggaaagccaagaaggaggccaggtcatgcccagcgccttcggttagccaaaggtcaagccccagggcagagaccccttaccagactgcaagctgaccacacacacgcaagggattcctagcaagaccagagct

SEQ ID NO: 45431 - DNA, 601 bp, Human
cgcagccccagctttctgcgactgactcctttctgacctgtcagcagcagccacagctctctccttgggaaaggtcttctctgactatgtgaggacagtccccagaccccttcatatcactgtcatcacttcattttccgatcccagataaaatcatccctgtaactcactggttgacatgtctgtaccctccctatagccctcacagactaaagctccaaatgacaagaccttgtccatcttggccatcacttggccacatgcaccacgaggcctggcacggagggaggccaatagatgyctgtaaacagctctgcagaggatgcaggagttgttctaatgaagaaacacacacgaagaacaacaacaggaaatcctgggtctggatgcaatctggaaacaacacaggcacccagcagcacaaggagaaggagagagcgcaggagctagtcctggctgcagattcaccgctggtttccccactgaaaatcccaagggctctcccagttggaatgttcaagaatgtaggggctcgaatgttctagaatgtaggggctccaatgttctaacctcctcttccagctgagaaaaatgaacttca

SEQ ID NO: 45432 - DNA, 601 bp, Human
cagatagagaaacttgctctgttcctcgagcagagttcatctaacacttcacctcctgtctctgtctccgcaccaactgggctcccggggtgcaggaggaactcggtgctccagcaccccgcatggtgtctgaaacccagaccacagcaccacctacataccaccaccaccaccacagtaataccatctaccgctgattggggcctacgatgagttatttgtagtaattgtaaataaatctagcaggcagtgaactatggaactttataccattaataattatttcaactgacacaccaaycacagaagttaagaagtgctttttttatcctacagacaaagaaacaggctcagagaagctcgctaacttgctagacaggagcagaagcaagtttgacccagtccctccaattccaaagccagcttctgggccctgtggcaggcagctggagggatgggaagtaatgaagccgctccaggacacagtcacacttatcagcaccacccaaagcttttaaaagggtcacctagagtcacggactaggttttttttttttttttttaataaattcaacttttatcttagattcaggggtacatg

SEQ ID NO: 45433 - DNA, 601 bp, Human
tcccccagaccagcaagcagtgccagctgcacaccacccatacagctaagtcaccaaggagctgtcagctggacgtggcccctgggagccgggtgaagccatcattttatcagtgcatgccctgtgctgggtgctagacacagactcctcatctcccctcacaccagccctacgatcatctccctggcggaagcttagggacactcaatgacctcccagggccaccaagcttcccagtgaggcagccaggccccaagccggtgagcccaccggctccacgttcttcaccacttgacgagcrtgtgtccacacctggcagtcacagcgtggggacgggacccactgcaggcacagggagaggcaggggtgttcctcccacagccagcccactgcttcctagaggctctcagcccaggcttccaggggctccccacagccacccatctgcaccggccctacatgcccagagtccgtgttgaaggactcctggctccacagcgtcacgccttggcacaggcttgcccgctttctccactaccttccatccatacctgtccgtgagcgagctccctgcgccctcaaacatacctctcaagggtca

SEQ ID NO: 45434 - DNA, 601 bp, Human
ccctcagccctgcgctgaggtcaacaggttccctaaaccagtgtttgcaaacatgaatgtgccgtgtgtactggcacctcttgggggtcttgttaaaacacagattctgagtccgtggatacagagggcgtggcgatgctgaggaaccaggagtgctgaggccaccggccccatacagacaacatcctgagtagtcgaggaatagccgaggttgctaatgagtcctcagacctggatggactctgaagagttgatatccaccaccactgcacgatctagaccaccactgcctggacaatcrcagcagcctccccctccaatcccacaagcccctggcttccacccagcagccaacctcacacaactgctatggctcccccagccttcagggcaaagcccaagcgtgtacaatgatggcttataggatcctgtgcaacccggcctcaaagggatcctcaccccgattgccaagctccaggtggactaaacttctctcagctcctggggcgctccagccaggcccccaccgcctcggctccaccgctcccgggagaagggagggtctgggggcatcccagctcttacacctgggtggtctagc

SEQ ID NO: 45435 - DNA, 601 bp, Human
cgtttcggccctttgtgttataactgcactagtcctcaagccgcccctggcgtggggtgatgtagccctcctcccagtcagaagtctgagtgctccgacatcatctcctcttcccccgctccccaacctccccttcctcatgaagtcaggccttgacctcagtcctttcttcccccctcagccctgcgctgaggtcaacaggttccctaaaccagtgtttgcaaacatgaatgtgccgtgtgtactggcacctcttgggggtcttgttaaaacacagattctgagtccgtggatacagagkgcgtggcgatgctgaggaaccaggagtgctgaggccaccggccccatacagacaacatcctgagtagtcgaggaatagccgaggttgctaatgagtcctcagacctggatggactctgaagagttgatatccaccaccactgcacgatctagaccaccactgcctggacaatcgcagcagcctccccctccaatcccacaagcccctggcttccacccagcagccaacctcacacaactgctatggctcccccagccttcagggcaaagcccaagcgtgtacaatgatggcttataggat

SEQ ID NO: 45436 - DNA, 601 bp, Human
gaagacgagagtagtactggcatccagtaggtggaggccagggatgccgttgggcacagctgtggggaacccagccaaagctgggcctaatgtggtcctggctgatgtccactgggtcagccaagcttccaccccacgacagccagggcaccctctgcccagccccactgcattcgactcagcctccaggcaccaggagactccagcacggcagggcccaggccagggggctgggctgaagagcgcactcccctgcctcagccgaacccaccagccacagactcacccaccctccagccasggcgcgtgcctccagggtgccccagaccataatagtctttccctagaggaacctctgtcccagatccgactgctgcttcacttggtcttcacaatgacgcccccagctctccatacactcattaccacatgacccctcatgaccaggatggctactcaacaagcaggatgccgttctgtgaccaagtccaggcctgcatgggctcaacacccatctgctgacagcacaacggcaaatacccaacctgtggggcagacacgacccacacctacatggacacggcagaaaggacaaaggaca

SEQ ID NO: 45437 - DNA, 601 bp, Human
tgtcagcacatggccacacgggccttgacatgggtgagggaggacagcatgccagcccccaaagcaggcctgacccactgcctggaaacagagctcgccaggtggcagtgcagccaggctgggaccagaagggaatgatgaagaaccctcagccagcactggccctcaacggagcaattttaccccccacccagaggacatctggaagtacctgcagacattcttggaagacgagagtagtactggcatccagtaggtggaggccagggatgccgttgggcacagctgtggggaacccagscaaagctgggcctaatgtggtcctggctgatgtccactgggtcagccaagcttccaccccacgacagccagggcaccctctgcccagccccactgcattcgactcagcctccaggcaccaggagactccagcacggcagggcccaggccagggggctgggctgaagagcgcactcccctgcctcagccgaacccaccagccacagactcacccaccctccagccacggcgcgtgcctccagggtgccccagaccataatagtctttccctagaggaacctctgtcccagatccgactgct

SEQ ID NO: 45438 - DNA, 601 bp, Human
agagaagtcaaggggagattaacacactgtcaccaggcacccacgctaagcccagcatggggagggtgggcacactggcattcgcagcctccaccagcacccatggaaaggctaccacagccccacgccaaagatgcaaaatcgaggctcagggtcccctacaaggaccagagtgccaggattttccatccaggcctcctgacccccagacctgaggtccttacggcaccacggaagcctggagcaggaagccaggcgctctgactcccaggtcacatcaagcacatgtcagcacatggcyacacgggccttgacatgggtgagggaggacagcatgccagcccccaaagcaggcctgacccactgcctggaaacagagctcgccaggtggcagtgcagccaggctgggaccagaagggaatgatgaagaaccctcagccagcactggccctcaacggagcaattttaccccccacccagaggacatctggaagtacctgcagacattcttggaagacgagagtagtactggcatccagtaggtggaggccagggatgccgttgggcacagctgtggggaacccagccaaagctgggccta

SEQ ID NO: 45439 - DNA, 601 bp, Human
ctagctctgccaggtccagactccatgctcttgtcacactgggtccttgctgggcgtgagggatgacgggaggtgccactcctgggcagcactggcaggccgggtgcactcggacctcagctgctgctcggccctcttcaggaccctgggtttgagccttgattttaaagcaccacaggctctggcacggtgtccaaccccatgactcccctgtcccccaggctctccacctcattccccactttttacacagaagagagcccaagaacccttttataagcaaggcccagaactgagaggkacttatctgaggtcacagagaagtcaaggggagattaacacactgtcaccaggcacccacgctaagcccagcatggggagggtgggcacactggcattcgcagcctccaccagcacccatggaaaggctaccacagccccacgccaaagatgcaaaatcgaggctcagggtcccctacaaggaccagagtgccaggattttccatccaggcctcctgacccccagacctgaggtccttacggcaccacggaagcctggagcaggaagccaggcgctctgactcccaggtcacatcaagca

SEQ ID NO: 45440 - DNA, 601 bp, Human
gctctacacctcggttttccggcctggaaaatagcacggtggctgggcatgtaactcaggacactgccagagggtggaatgaatgaggctggcacatagtggcatccagtcagtgtcaccagctcctccccgcctcccatttaacctcagtcttcaggtgtggcacctgaagctcagacaggctccaggagccatgcagctagtcatagaagagcaaggaggcaaacctagctctgccaggtccagactccatgctcttgtcacactgggtccttgctgggcgtgagggatgacgggaggygccactcctgggcagcactggcaggccgggtgcactcggacctcagctgctgctcggccctcttcaggaccctgggtttgagccttgattttaaagcaccacaggctctggcacggtgtccaaccccatgactcccctgtcccccaggctctccacctcattccccactttttacacagaagagagcccaagaacccttttataagcaaggcccagaactgagagggacttatctgaggtcacagagaagtcaaggggagattaacacactgtcaccaggcacccacgctaagcccagca

SEQ ID NO: 45441 - DNA, 601 bp, Human
acccatccaaataccagtaattcccaggctcccttactccccacccaggcccgctctccccaaatctgtcaggaaaccctcctcatcccacagcactgtgtgacttcctggggagaaaggggacctgtgtgatggtggggggcccaccgggtctgttggggatgaggctctgggatttctggaacagggttgttctggacagagctgcctctccacccaaccacctgctgccctaatcctccctcagaaccttgaccccaggaggccaaaaggatggatgccattgccccaggggccccargacctgaggagcagcccctgagcaggcctgcagtgaagggcccggaaggcacttcctaaggtccagcctctggcatgtcaggatgctgtggggtagacacgccctgggtcaatccagcccagaagccgggggagccagcaccctgttcctcccctctccacacggttgacagtcctgtccaatatcaaaccttccaggcagaaggaacccttcctatgaagtagatttcagctcaaccataggaagaggttgctggcttccataggaaggcagtcaagaggtgatgagcaccccgtgaca

SEQ ID NO: 45442 - DNA, 601 bp, Human
gcaggtaagaagcagaaccacaatctaaacccatccaaataccagtaattcccaggctcccttactccccacccaggcccgctctccccaaatctgtcaggaaaccctcctcatcccacagcactgtgtgacttcctggggagaaaggggacctgtgtgatggtggggggcccaccgggtctgttggggatgaggctctgggatttctggaacagggttgttctggacagagctgcctctccacccaaccacctgctgccctaatcctccctcagaaccttgaccccaggaggccaaaagratggatgccattgccccaggggccccaagacctgaggagcagcccctgagcaggcctgcagtgaagggcccggaaggcacttcctaaggtccagcctctggcatgtcaggatgctgtggggtagacacgccctgggtcaatccagcccagaagccgggggagccagcaccctgttcctcccctctccacacggttgacagtcctgtccaatatcaaaccttccaggcagaaggaacccttcctatgaagtagatttcagctcaaccataggaagaggttgctggcttccataggaaggca

SEQ ID NO: 45443 - DNA, 601 bp, Human
cttcaacagtcaatgaggagttgatggggaggagcacagcacagctttgcacggtacccgcagattcccaaggggcactgggtacagcccagcatggccgcaggggtccctgatgggaatggcgggaaagaagcccagggaagggatgtgggggaactgggtgctggagaccaaaggctccaggcctggaagccttggctgcaaaccggggagctgggtgataattactgacacttgggctcatcctgaggtccatcagaggtgcccaggcacctgaccctaaaacaggcagcgcttcatyggctacccgagagactctccagtttcagagaggattccaggggcctgagcacgacccaaataaatgagaggctaacaccagtaatccccgagctctctcgttccccacccaggcctgctctccctgtcccaggcagaaacagggacagacgaggcagtggcggggcaggatttgtgagtgccaggcacttcgtccccctcacactggatctcagcaaccactgggtgggtacaatggttgcatcttttcttttttggttttgttttgttttttttttttttttgagacagggtctccctc

SEQ ID NO: 45444 - DNA, 601 bp, Human
cacaggctctgaggattagaacctgctgtctttggtggggagtggcaggggccttactttgcccaccacaaccccaaggctcccacagctctgccatcccaggattctcagacatcgcctggaagcattcatgtgtcaggcaggaatgaatgaggacctgtcaggagtttgtaggggccttcaacagtcaatgaggagttgatggggaggagcacagcacagctttgcacggtacccgcagattcccaaggggcactgggtacagcccagcatggccgcaggggtccctgatgggaatggygggaaagaagcccagggaagggatgtgggggaactgggtgctggagaccaaaggctccaggcctggaagccttggctgcaaaccggggagctgggtgataattactgacacttgggctcatcctgaggtccatcagaggtgcccaggcacctgaccctaaaacaggcagcgcttcatcggctacccgagagactctccagtttcagagaggattccaggggcctgagcacgacccaaataaatgagaggctaacaccagtaatccccgagctctctcgttccccacccaggcctgctctc

SEQ ID NO: 45445 - DNA, 601 bp, Human
tttaccatgtaaggcagcacactcacaggctctgaggattagaacctgctgtctttggtggggagtggcaggggccttactttgcccaccacaaccccaaggctcccacagctctgccatcccaggattctcagacatcgcctggaagcattcatgtgtcaggcaggaatgaatgaggacctgtcaggagtttgtaggggccttcaacagtcaatgaggagttgatggggaggagcacagcacagctttgcacggtacccgcagattcccaaggggcactgggtacagcccagcatggccrcaggggtccctgatgggaatggcgggaaagaagcccagggaagggatgtgggggaactgggtgctggagaccaaaggctccaggcctggaagccttggctgcaaaccggggagctgggtgataattactgacacttgggctcatcctgaggtccatcagaggtgcccaggcacctgaccctaaaacaggcagcgcttcatcggctacccgagagactctccagtttcagagaggattccaggggcctgagcacgacccaaataaatgagaggctaacaccagtaatccccgagctctctc

SEQ ID NO: 45446 - DNA, 601 bp, Human
tgctgtaacaaatcacaacagtagtggctaaaaacaacacaaatgtattattctcttagggttctgaggtcagaggcaggcttccttttggaggctccagggagaaatcgattcctccgctttctctagttctaaaggctgtccacattccttggcttgtggccacaacaccccaacctctgcttccactgtcacatctcctctggccctcctgcctccttgtaattacaccaggcccacccaggtaatgcaggaacattttctatttcaagatgcctcactccttcacatctgtaagccragagcagtggcacatgcctataatcccagctacttgggaggctaaggcgagaggatcacttgaggccgtgagtttgatgctgcagtgcgttatgatcagacctgtgaatagccactgcactccagcctgggtgacacagtgagacccccatctctgaaaaataaaaatttaaaaatcccatctgtagtcatgtcatacccttttaccatgtaaggcagcacactcacaggctctgaggattagaacctgctgtctttggtggggagtggcaggggccttactttgcccaccacaacccca

SEQ ID NO: 45447 - DNA, 601 bp, Human
tcccctaattagggatgggacctaaattgtgggaagcaggggagttggctgctgggagagggaggtagtggggggtgctggcaggcttggttctagcacctcctcccctccccgctacccccactccccctcctccgtcagccagccagcctcagggctaatgattcagttggttctcttcacagcagcttcttaatcccaagaatgcaaagtcatttagtatcagcctaatgagcaaggtaggctactgcaggaagggaggcagaaattcccgtgacatttccctcccttggactcactsggggagggagaagcctgctcaggaaagcctgaattgttctagcacctatcctcaaggtaccccacactcctaaaatagcagcataagtgtgtgtgtccccagcctgtgtcctggatgctgacactctttgaaaggctgtgttccagaggagaccgaaagacttcacccaaattctgctgccaacactccttacctggcctgagggctgggggcagctcctggtccctggatcccaagcccttaaagtttagttgtctttgccctgctgctgcacctccaaccacaggcagcgagagtttc

SEQ ID NO: 45448 - DNA, 601 bp, Human
gatatgacctttcccacccaagaggccctccccagggcagggtggggacctgagcgctgcagcaagtgaagtacatgaaatggtgaagaagcaagggaggaaggttctacggagaacaactcggggaagtgggaagccaggcacatcctcatccaagcaacgtgtggcacagttcagtaactactgatttcaggcaccccaaataacaagaccctttggcacctccaggtaccaggcactggggaaaaagccccaagttatggtcccctttccctgcctgcagagggcagggcccacaccrtaccccacagaagcccaggatgtctccccaggacttggggctcctaaacagatgactaagccccgtcacccatgtgtgttgatggccacactgttcccttcctcaaatgccatccccacatcaccacctgaccccccaggtcagctcctctggagaaacctgccttggctcccaccctcctcaggccccactgccccaagctgcccacacccagcactgggcagagagaaaggctgctggactccattgcactgaccccaccaggctaatgctcggtggtgaacatcaatggtggccatc

SEQ ID NO: 45449 - DNA, 601 bp, Human
ccagtggaagcaggatctgatttgctaggggaggacatagcaggggtggggtggggggcagcccttgcaggtcttgggaaaagggtaaaggaaacctaagaaccagaaatagttgtgacgctcacagtctggaaggagcagactgaggccctgcgccaggcccaggagacgagagaacactgcaagaaggcagcagcagtccacttttcaaccgtggtggtgccaggaagtggttagaagcccaggactgagcttcgcagcattcagaggcttagatgaacacaattcgggggcgtaggcrggagcggaagaggtgggtgagcccctgagagcagaacatggaaccagacccccctgtaccttgtgcctctgttttcttatctgtaaaatgggagaatcctagaactcatcccacacgggctttaagggaaacagagtccaggcctggcacagtacctggctcatgccagggatgggggtcttgtgacctgcactctgccctgccaccctgccttcctacccttccagaactgcctcctccagtccacatgactgggggcggcacgcccactccaggggtgggcacatgacctgtcacctc

SEQ ID NO: 45450 - DNA, 601 bp, Human
aaaaaattaaataagtaaaatttaataaataaatcttattaaaaatacatctatacaatgaatgggaattttttgaaaaattatttcatgaattctcagatgaatattgcctgttgctagaataagacagggtttatcaatttcatctccattttttaatttttacagatgtgagaacagaaaccacttattcaaatttaaaaaatagaatggaaagagatttaccacagcaaattctttggattcctttataattatttgccaagaattacagtaatctagtcatctcttatcaaatatyattctttttttttttttttttgagacagtgtcttactttgtcacccaggctgaagtgcagtggcacgatctcagttcactgcagcctcgacctcctgggttcaagtgatcctcccacctcagccccaagcggtcatacaccaccacacccaactaattttttgtatttgtggttgggggggaaccctcagacgaggttttgccatgttgcccaggcagatctcaaactcatgagctcaagcaatccacccacctcagccacccaaaacaaaggtcattcttaatgtgctatcagctgacg

SEQ ID NO: 45451 - DNA, 601 bp, Human
gaaaccgctcctcctgagccttccccacagattggatcggagtggaaggtgcccccaggtgacagcacctagcaaggctgatgcaggccttctgcctggcccacaggagagccccagccccactccccagatcacagacgaccaaggctcctgtgtacgggggaagtaatcatagtgccgtgcttggcacttggtcattttagcaactaggtgttttagaaggaagcacaaggacctaggaactgggttgagctctgtcaggccttgcctctcagttaggatctgttgggtagatgggctyattgccactaaccagactcgtcttccagggagccttcctgatttaccaggctgcgtgagggccctcctctgtgcctgtctggtgtccctgcctaccttggccactgtctgcagacatcacagagagttgaaggggcctggcttgggcctgtgtgagcccccagcacctggggcctatccatagcaagtgtcggggaaactgctgcatgttactgcgtcccatctgcacggcctggctatgaggggccctcagctcagcactcagtgagaccaactcaacactgaaatggtggagtcaggg

SEQ ID NO: 45452 - DNA, 601 bp, Human
ggaaaggcagcccagagaacaggccagggcagaggtcaggctgcaaaacatgcttccctaaggacgtccaggctggagggggcccggcagcaggtgggtctttctttcagggtcttcctccaccaaattcaggactattccagaaagaggcagtgagtccctggatggggaaaccgctcctcctgagccttccccacagattggatcggagtggaaggtgcccccaggtgacagcacctagcaaggctgatgcaggccttctgcctggcccacaggagagccccagccccactccccagaycacagacgaccaaggctcctgtgtacgggggaagtaatcatagtgccgtgcttggcacttggtcattttagcaactaggtgttttagaaggaagcacaaggacctaggaactgggttgagctctgtcaggccttgcctctcagttaggatctgttgggtagatgggctcattgccactaaccagactcgtcttccagggagccttcctgatttaccaggctgcgtgagggccctcctctgtgcctgtctggtgtccctgcctaccttggccactgtctgcagacatcacagagagttgaa

SEQ ID NO: 45453 - DNA, 601 bp, Human
gagcagacctcatttatataacccttcccagcacctcatgtatcatcattattaaaaaacactatggggatcatgctttcacataactttgtcttatttgttatctacatagcctaagcaaatagtaaatgatggagaatgaaaataattgtcaatgtttagggggaaaaaaatacctgcatttcaaattttttaaaaaaaccataaaatctatcttttaaaaaaggaaggagtaagctggaatccacaattgttagaaacccaaaagtgatacagaggggaggcaaaaaaaaaaaaaaaatactatattctccacactgaaacaatgtatctttctcaacagcccagtttcatctgtagctgtattttccccactgaaatgccaccattaatcataacaacagatgagtaaaaatcaattaatattccttcagcatctcttaggtgtcttcaatcctgtgcgctgtcatccctttaaagaggaaggaaaagatccacagccaggaaacagactcagaaactcaaacccaggtctctggaccccacagggaagtgaggcacagccaagagcaatctgtgtccattactggcctcaaatgac

SEQ ID NO: 45454 - DNA, 601 bp, Human
ggcaatgcatctccattcctggctttgactacgatggttctgcgcccagctggacaaggagcacagtccagggccctcaggtcaagatgcctcctcctcagagtctcagccctgcaccaggccaaacgggaaccgactgctgaggaatccagtgtttgcatccgagtttctccatctgcacccagattccctaggatcacactctgagtagcaatgctatggataccttcaccccagaatgccaggacagtcagctactttaagagcagaatcttgcttctggccctttctaaaacccccrttccatcccttcctatttcccctgtgtacttcattccatctcttttctttgcttttacgtaaaatgcttacctggcacgctccactgaggccacggaattcttgacatttgacagccaagcaagggtggcaggtaccagggagatccagtcccaaccctgcgtggtgtggtgaggagggcctggggttctggaagcctgcctgcaagaaggcacccaggcaccctggagcacagggagccccacctgccctggcagagctctgttgtcttgacatgggatgtgggaactttttttttttt

SEQ ID NO: 45455 - DNA, 601 bp, Human
ccagagacacccagggcaggactgttagtaacagcaaaccagaaataacctagaacttgagactctggagcagagaaatggttctagatgctgggacatagggatggtgggaagctggtgcagccactctaacagcaatttccaaggtgtttaaatggcacaggcaaatgctcaactgttcccccaaatgcaagtggcaaaactagggacacagaaaagcctaacctgaatgcacatcatatagaaaaaggagcatattttatgtaaaaattgcttcaataattatctctgggttttcatytgtgagcctatcttgacttcccaagatttccacaagtacatattacttaatgagcaaaagaataatctagagttatttttagcaagcacagaccctcgaggcctggccacatcctgtgtagcacaatacctcagtccttaattcactcacccagtagacacagcgcacatcagggccagaccacgtgctcctcagagaccagcaagtcccagcctcaggaggacacaccaacaggcagctcagcttggtgtgcgtgcgtgtgtgcgcgtgcatgtgtgtgtgtgtatgtgtgtgtgtgtg

SEQ ID NO: 45456 - DNA, 601 bp, Human
tacaaaaattagccaggcatggtggcgcgtgcctgtaatctcagttactctggggtctgagacaggaaaatcgcttgaacctgggaggcggaggttgcagcgagccaagatcgagccattgcactccagcctgggcgacagagcgagattccatctcaaaaaaaaaactgcatcaaagatgttggtgcacaccatggtcccagctactaagaaggctgaggtgggaggattgcttgagcccaggagttcaaagctgcagcaagctatgatcgcaccactacactccagcctgagtgacagrgcaaaaccccatctctaaaaaaagtttaattaaaaaaaaaagtttttttaatgcatcagtgtgtgtgccatttttatgctcaaaggacatgaataaagtcacactttattcacattttagtgtgctggttatccttcggctagggagtaacacattttgttcccacaagctacacaggaggctctccagaccttcctgaaaggcactttcaaacctgcttctggagggtcagaacatcatgcaggacagaggtcaggcactagcaggaggccctggtcccacggcaggtctgtgctattt

SEQ ID NO: 45457 - DNA, 601 bp, Human
ttacaactatgtcaaggctggtggctcgcgcctgtaatcccaacacttttagaagccgaggcgggcagatcacttgaggtcaggagttcaagaccaccctggccaacacggtgaaaccccatcactactaaaaatacaaaaattagccaggcatggtggcgcgtgcctgtaatctcagttactctggggtctgagacaggaaaatcgcttgaacctgggaggcggaggttgcagcgagccaagatcgagccattgcactccagcctgggcgacagagcgagattccatctcaaaaaaaaaactgcatcaaagatgttggtgcacaccatggtcccagctactaagaaggctgaggtgggaggattgcttgagcccaggagttcaaagctgcagcaagctatgatcgcaccactacactccagcctgagtgacagagcaaaaccccatctctaaaaaaagtttaattaaaaaaaaaagtttttttaatgcatcagtgtgtgtgccatttttatgctcaaaggacatgaataaagtcacactttattcacattttagtgtgctggttatccttcggctagggagtaacacattttgttcccac

SEQ ID NO: 45458 - DNA, 601 bp, Human
actacaaaaacaatatatacaacttacttatgtaacccaaagaaataatcatcacaggcttgcccaaacagtatcaaaagtggatgtttatcacaatactatttataaaggtgacagaccagaaccatggtcagcatcaaccaagggaatcaaagaacttcagttacaatcagataatattatgcagtcatttaaaaagcaagcctaagtagacatttaacaaagggggaagctctaagagaatgctaagtgtgtttgtgggaacagattacaacagaaccacaactttgtttacaactaygtcaaggctggtggctcgcgcctgtaatcccaacacttttagaagccgaggcgggcagatcacttgaggtcaggagttcaagaccaccctggccaacacggtgaaaccccatcactactaaaaatacaaaaattagccaggcatggtggcgcgtgcctgtaatctcagttactctggggtctgagacaggaaaatcgcttgaacctgggaggcggaggttgcagcgagccaagatcgagccattgcactccagcctgggcgacagagcgagattccatctcaaaaaaaaaactgcatcaa

SEQ ID NO: 45459 - DNA, 601 bp, Human
cctcatgggcagagagagtgggtctggggcaggagtgagaaaggaggggagggagggcacatgagagagaaatgagttgctgtatgcgtgcctggtgcacaggtgataacacagcattcaaatctagaagcacaaactcccacaagaccttccctttctgtaattccccaaaatgcaggggtttgtttatttcaccaagaagtacatattcctcctacagactacaaaaacaatatatacaacttacttatgtaacccaaagaaataatcatcacaggcttgcccaaacagtatcaaaagyggatgtttatcacaatactatttataaaggtgacagaccagaaccatggtcagcatcaaccaagggaatcaaagaacttcagttacaatcagataatattatgcagtcatttaaaaagcaagcctaagtagacatttaacaaagggggaagctctaagagaatgctaagtgtgtttgtgggaacagattacaacagaaccacaactttgtttacaactatgtcaaggctggtggctcgcgcctgtaatcccaacacttttagaagccgaggcgggcagatcacttgaggtcaggagttca

SEQ ID NO: 45460 - DNA, 601 bp, Human
tgactcctaaccctccaccactagctgcagattcctcaacacagatctggggccaggctgtgtgataagtactttgacactgtatctcaattacccttcttaaccttagaggttggtgttacgacaacccctttttccaggcaaggaggctgaagcaccctcggtgctgggaagaagcaagaccagaggccacccggggaccacccacctcctccagagcccaccactccttcctcctctccctggggtgaggaacaattgcaaggggagaaaagtccatgggcacagctgcggctaggcyacagcccccagcctcatgggcagagagagtgggtctggggcaggagtgagaaaggaggggagggagggcacatgagagagaaatgagttgctgtatgcgtgcctggtgcacaggtgataacacagcattcaaatctagaagcacaaactcccacaagaccttccctttctgtaattccccaaaatgcaggggtttgtttatttcaccaagaagtacatattcctcctacagactacaaaaacaatatatacaacttacttatgtaacccaaagaaataatcatcacaggcttgcccaaac

SEQ ID NO: 45461 - DNA, 601 bp, Human
aagagcctgcttcaagcagatcgacaaattctcccacatgcacactcactcacacattcactcactcacacacacttgctcactcctactcacttgctgcccagggggcgagaggcctcagatccctggattctgcagtatgaacagggcaacctcaccaagctgacttcaagatgaaaggctaagaaaggaaacagacgtgcgagtacacctgggagattttctagccccgttttctgaagaatcagggatttacagaaggtgagagtgaaacgggacccatgagatcctatcagctgtmagacagagaaagaagcagagcccggccgaggccatgcagggaggagaggcagaaccagcagggaccccagtctcctgcggccccagcctgcagcacaggcagccgtggcttcatgctctcccatgggggccacacgactcagggctcacccaccaggcaccctcctggtcattctcaccatgcttggtggcgctaggcaccttgatggagagaaaaaggatcatgacccacgattctggcatcaccacatgctgtctctcaaggggctacctactgacaggtgggagaaacccatcagct

SEQ ID NO: 45462 - DNA, 601 bp, Human
atgtgtgcatttgctatacacagaaacactgcacccaggcgaggtccaacgtggagagctagctgtgttctctcgaaatctgtcctgctgaaacagcacccaaagagcctgcttcaagcagatcgacaaattctcccacatgcacactcactcacacattcactcactcacacacacttgctcactcctactcacttgctgcccagggggcgagaggcctcagatccctggattctgcagtatgaacagggcaacctcaccaagctgacttcaagatgaaaggctaagaaaggaaacagaygtgcgagtacacctgggagattttctagccccgttttctgaagaatcagggatttacagaaggtgagagtgaaacgggacccatgagatcctatcagctgtcagacagagaaagaagcagagcccggccgaggccatgcagggaggagaggcagaaccagcagggaccccagtctcctgcggccccagcctgcagcacaggcagccgtggcttcatgctctcccatgggggccacacgactcagggctcacccaccaggcaccctcctggtcattctcaccatgcttggtggcgctaggc

SEQ ID NO: 45463 - DNA, 601 bp, Human
ggctaaaaacaggccctgctgggaatgcttcctgagcctccaaaactgggtgctgctgggagagcacatcacataactgctcacatcacagggcacttttacagcttagaaagcgcctggctcaccctctgggtgctcccaaatgccacccgggagaccataggccgaggatgagtaatgctgtcaggattatgagcctcacaggcgacttgcccagagcacagtgactccccagggtcacaaggctggtcaaggtcagaggcagcgtgcaaacccatcacccagactccaaatccaccaygcatacacaggcagccatgtgtgcatttgctatacacagaaacactgcacccaggcgaggtccaacgtggagagctagctgtgttctctcgaaatctgtcctgctgaaacagcacccaaagagcctgcttcaagcagatcgacaaattctcccacatgcacactcactcacacattcactcactcacacacacttgctcactcctactcacttgctgcccagggggcgagaggcctcagatccctggattctgcagtatgaacagggcaacctcaccaagctgacttcaagatgaaaggc

SEQ ID NO: 45464 - DNA, 601 bp, Human
cctccctttattctctccacccagaaaggtgacaaatccaagccctggatgtgaggggggtccacaagagtaattctggagagatggggtcaggtgaggaatggttagagacccagggagccaagtcacgggacctcagtgaccccatggctgacctaccgagacctccagtcgccagcatcgggtaggcccacacgtgtgggggaggaagtgagtgtcactggcccatcagcaagcagagctggcagaggtacctgtgcaggcgagtccaatgcccagctctttaataaacacgccttgyggtgctggaagagactcaaagtccatccaagacagattctgtcttcccactaaactggaagctccttaaggaccgggatgtggcagttttgctctcagctatgtgcccagtgctcagcacagggcccggcctgcctgggcactcagaaggacacctgacggacaaggaaccaatcaaacggtgatggccacactccacccccaggacctgacagccaacagtcatcacgcacctggcaggcccacagctctctgcacatacacatgcctcaatttcccaggcatgggggagctgaatatc

SEQ ID NO: 45465 - DNA, 601 bp, Human
ggatgtggagggacagaggcaccgggctggcagctggggtgggagatggggggagaccttcatgaccatctaagaaaacacagcacaagcagatttggaagggacagagggagtcaagttacaaacacggtccctccaggcagaggcacttggcaaaggttctaggcctgccatgggggtgggcgccgacaatccctgctgctgggaagtgcaactcctgctcagcttccctttcgaggaatggccttcccggggcaaaacaaaggccagggggcagcaggccgtaggaaatactctcacygccttaaatagaagcaaaccatctggccagttggagaaagtttacacaaggaggactgggttgcactcggtgcattttaaagaaagcccggcggacacacgggttctcctgctggtgctgccagcctggaaaatgacagctgagactcaagcaggcaggatcggctgcctcatctccaattcccgtgtgtggggtgagaggaggtacttccactcccctacctggctgcaagcccccgaatatgtcctgtctagggaggccctgctgccacacagcaaaaaataagtgattcactcttga

SEQ ID NO: 45466 - DNA, 601 bp, Human
gggtggggggtgggtaaggaaatatccagagggaaaaatcaacagaacctggaaacagaaaagatgtggatgtggagggacagaggcaccgggctggcagctggggtgggagatggggggagaccttcatgaccatctaagaaaacacagcacaagcagatttggaagggacagagggagtcaagttacaaacacggtccctccaggcagaggcacttggcaaaggttctaggcctgccatgggggtgggcgccgacaatccctgctgctgggaagtgcaactcctgctcagcttcccttkcgaggaatggccttcccggggcaaaacaaaggccagggggcagcaggccgtaggaaatactctcactgccttaaatagaagcaaaccatctggccagttggagaaagtttacacaaggaggactgggttgcactcggtgcattttaaagaaagcccggcggacacacgggttctcctgctggtgctgccagcctggaaaatgacagctgagactcaagcaggcaggatcggctgcctcatctccaattcccgtgtgtggggtgagaggaggtacttccactcccctacctggctgcaagc

SEQ ID NO: 45467 - DNA, 601 bp, Human
agctcagaatcatgagtgaagatgtgtctggttttaagtggtgactaaaaatggctttaatcataaggacggaacgttaggagggagtggagtctccagggtgtttcaacaggttgacatcagcaagaacccatactcctttcaagtttctattctgccatgctcgccatggtagacctttgtccgcgtgcctgtcgcctcacgctcacaagacagctgccaaagctcctgatactcccacaaaatatctggaagcggggaagaaggggccagggcgaaatagccaaccctttgaaagagragaaacactctttcccagctgggcgcggtggctcacgcctgtaatcccagcactttgggaggccaaggtgggtggattgcttaagctcaggagttcgagaccagcctggccaacaccatgaaaccccatctctactaaaaatacaaaagttacccagatatggtggcacacacctgtaatcccagctactcaggagactgaggcacaagaactgcttgaacccaggagccagaggttgcagtgagccgaggtcacaccactgcactccagcctggacgacagggcaagactctgtctcaa

SEQ ID NO: 45468 - DNA, 601 bp, Human
ggcatccttctctttggcaagcgccttcggccttcaaagctttgtttcaatgatggccagtctttacgtcaagggtgcatttggttttcgtataacaaaaaacaattccaacaagctcagaatcatgagtgaagatgtgtctggttttaagtggtgactaaaaatggctttaatcataaggacggaacgttaggagggagtggagtctccagggtgtttcaacaggttgacatcagcaagaacccatactcctttcaagtttctattctgccatgctcgccatggtagacctttgtccgcrtgcctgtcgcctcacgctcacaagacagctgccaaagctcctgatactcccacaaaatatctggaagcggggaagaaggggccagggcgaaatagccaaccctttgaaagagaagaaacactctttcccagctgggcgcggtggctcacgcctgtaatcccagcactttgggaggccaaggtgggtggattgcttaagctcaggagttcgagaccagcctggccaacaccatgaaaccccatctctactaaaaatacaaaagttacccagatatggtggcacacacctgtaatcccagct

SEQ ID NO: 45469 - DNA, 601 bp, Human
ctggcatccttctctttggcaagcgccttcggccttcaaagctttgtttcaatgatggccagtctttacgtcaagggtgcatttggttttcgtataacaaaaaacaattccaacaagctcagaatcatgagtgaagatgtgtctggttttaagtggtgactaaaaatggctttaatcataaggacggaacgttaggagggagtggagtctccagggtgtttcaacaggttgacatcagcaagaacccatactcctttcaagtttctattctgccatgctcgccatggtagacctttgtccrcgtgcctgtcgcctcacgctcacaagacagctgccaaagctcctgatactcccacaaaatatctggaagcggggaagaaggggccagggcgaaatagccaaccctttgaaagagaagaaacactctttcccagctgggcgcggtggctcacgcctgtaatcccagcactttgggaggccaaggtgggtggattgcttaagctcaggagttcgagaccagcctggccaacaccatgaaaccccatctctactaaaaatacaaaagttacccagatatggtggcacacacctgtaatcccag

SEQ ID NO: 45470 - DNA, 601 bp, Human
aaaccttcaatcgctccccagtgcccccaaatgaggacccacgttgcctccgacttcctttccacactcacagctcactgcctcccaagcggtcactgctctggcgggacgggtccaccagtggtctgtgagccgggcctcaagccctcaccaggcacacacagagtcctttttgaccccatccccaccccacgctcttttcttctgcaaacctcccagtgtggtctggggcagtcaagccgcacccctccctcctgactctcagggcatcttgacctcatcgcccaggctgaccacaagytccaaacaggactttcttgtggccattgctcaggtcccaggcatgcacaaacccactcacagacacttggctgagagaaatctcaaccattagtgctactcccattttctattctgaggaggtagaaactgaggctcagagaaacagcgctagcccggggccccacggtggggacagcagggtctgcacagggttggcctggctcaagcttcctttcccacatggccccatgtgctccagataaaggcaactatgaaccatgttcctgtcataaaggagataagacatacacacaggata

SEQ ID NO: 45471 - DNA, 601 bp, Human
gcaggcacagggcatcaagatcaaaccaaacctccaagcctcacctctcacaaataagcagaggccagttacccctctgggcaagacctcaggcccctgtccctgccagtcagcagctctgcctcccgcagcgcttgagggctggtccatgcagccggccaggaaaccacagaggccaggtcagagtggccttttaattcaactcccctggtgaccctgaagagcactgccgcagactgagaggctggaagtaggctatgctgcccctgccccataacaaagactctacagcaaatcaccwggatgggggaagattagcgcaaagtgggtggagagtctccctgaaacgtactgacagcacttaaaaaccaattagatggcacgtgcctgtagtcccagctactcaggaggaggaggtgagaggaggatcactggagcccaggagttcaaggctgaagtgcgctatgattgcatctgtgaaatagccactgtactccagcctgggcaacacagcgaaaccctatctaagaaaatccaattagagaccttggcttacatgcaatcagagaactaattaacaaggaccagtaattaaaattaa

SEQ ID NO: 45472 - DNA, 601 bp, Human
ggggcatttaaggtctccctcctgtaagatctaccttaaagaaccagatccctgactttgcagcccagtgccatgctgcttttgagcctgaaatggaagtctgtgccttagttccaagtcaccaggcactggttccttgcccttgcaggcacagggcatcaagatcaaaccaaacctccaagcctcacctctcacaaataagcagaggccagttacccctctgggcaagacctcaggcccctgtccctgccagtcagcagctctgcctcccgcagcgcttgagggctggtccatgcagccrgccaggaaaccacagaggccaggtcagagtggccttttaattcaactcccctggtgaccctgaagagcactgccgcagactgagaggctggaagtaggctatgctgcccctgccccataacaaagactctacagcaaatcaccaggatgggggaagattagcgcaaagtgggtggagagtctccctgaaacgtactgacagcacttaaaaaccaattagatggcacgtgcctgtagtcccagctactcaggaggaggaggtgagaggaggatcactggagcccaggagttcaaggctgaa

SEQ ID NO: 45473 - DNA, 601 bp, Human
ccggcttgtggatggctaggctctagcctccctcctcttctgtcccatcaccctgggaagacagagccagagggtactgaggaattcaggtgggaggggttgggggggaggtgaggagggggtcctaggagcaaatggagggtcacaaactgaagcgcccatggggcaaatgtaaaccatgaggctggtggtgtgggacaacagagaatggtggggcctaaggggcaaccagcttaaacactggcaacaaattcaaaggaaagaatgtaaaattcctgtgtgggccaaacagattgcatgsaggcccaggtatatctgagtcacccacgtgtaatctggtccaaccccctccgcagagataggaaagctgaaatccagacacaaggaagggaccatgaataagtttgtgctggcgattactgagaaagtctagcataaaaattaaaccgaagcctaggccgaacactggcatccctctgcttggctgtgaagctggtgaggatgctgcactcggcctggcagcagatggaaactctggaactcgagggccacggatgagccacagggccccccaggtaaaggactgacagccagccatgca

SEQ ID NO: 45474 - DNA, 601 bp, Human
ccaagcgcacgtcatgcccaggccaccgttctccttcccctcattggtggcaggctggcatcctgcaggaggcccttcccagaccacagccccacccttcctctcctgccgcccacctgaaggccccaatacacatcttcctacagttctggcttcaactctgttcctgagacctttactgccccaagtccactaccctgagttctgggcaaatgaaaaatcttttccccttcaccagatttctcaaatccaaccattctggaacccggcttgtggatggctaggctctagcctccctccycttctgtcccatcaccctgggaagacagagccagagggtactgaggaattcaggtgggaggggttgggggggaggtgaggagggggtcctaggagcaaatggagggtcacaaactgaagcgcccatggggcaaatgtaaaccatgaggctggtggtgtgggacaacagagaatggtggggcctaaggggcaaccagcttaaacactggcaacaaattcaaaggaaagaatgtaaaattcctgtgtgggccaaacagattgcatgcaggcccaggtatatctgagtcacccacgtgtaatc

SEQ ID NO: 45475 - DNA, 601 bp, Human
atacttggagttcccccaaatgctaagctggctcgtgccttgaggcttcctgcacgcagtccctcctcttcctcaggacctggtgagctcccagccttctctgaagggcccattcaatgcccccctctcccccccgcaggaggctgcccagcactccctgagcaggaagtagctctgtgccccctctgggtcactgccattctctttctctggtgactgcctccctctgggtggggccgtatgcagctgtaggaaacagccaagcttgggaggcaggagaactagaagcaaggtcctggcyccatcacctggatggaaggccctgggaactacttcacctcaccaaggccccgtcttctcccctgtaaaaaaggaaggatcctgcctacatctcgaggtgtcgtgcacattcaacaagataggatgtctatgcactgagctcagagcagaagtgtaactctaccactccccatcaatacagagtgtggggggagatggttggtctcgtatatacgacagccatgaacctaatcccctgtcaggagggggctattttgatcagtgattagccaggcgctgtcctcaaccatttactcctcac

SEQ ID NO: 45476 - DNA, 601 bp, Human
tagtggaggagaggcggtcttggtccactttgccactccccacctgcagaggccctcaccaccaacagaatgaggtcaaggcccctggccagagcacacatggtcccctgccacaccgcttggcccaacacccctgcccaggcaccctgcagacactgtatacaccaaatacttggagttcccccaaatgctaagctggctcgtgccttgaggcttcctgcacgcagtccctcctcttcctcaggacctggtgagctcccagccttctctgaagggcccattcaatgcccccctctccccsccgcaggaggctgcccagcactccctgagcaggaagtagctctgtgccccctctgggtcactgccattctctttctctggtgactgcctccctctgggtggggccgtatgcagctgtaggaaacagccaagcttgggaggcaggagaactagaagcaaggtcctggctccatcacctggatggaaggccctgggaactacttcacctcaccaaggccccgtcttctcccctgtaaaaaaggaaggatcctgcctacatctcgaggtgtcgtgcacattcaacaagataggatgtctatgc
